United States Patent 9,487,797 (GENOMIC PLANT SEQUENCES AND USES THEREOF) - sequence listing, part 78

SEQ ID NO: 76759 - DNA, 8131 bp, Oryza sativa
cccccccccccccccccgtcgccgtcgccgtcgccctgcgggccaccgccgcctgcctccaccgcccctcgcccgcccgttgcagccaccgcccatccgcgccccccgcctgcctcctccctgcccatccgcaccccccgcccgccgccgtccctcgcccgccccgaacgctcaccgctgccgccccttgctcgcccaccggccaccgccgcgcatccgcgtctgttggccgccccatctgccttgcaaacaaaagagtagaagagtagggagagtaaagaagagtagataagcgtagagagaaaagaggtgagaaaataaggaaaactggcagttgaacacatcaaaatgagaaaaaaaatactcactcaatacaaatatatcaattaaaaattaccaactaaaattatatccattaaaatttacttattttgaaagattatcacgatgaataacatcatagtcatccataatatagtccttaaaaatacaaatataaggttagttggagaatataggagggtatgatatagatgatgtagtatgaatgatctgttggagtgagaagagatatgaaggaggaatcttttttagatggccatccatatgggtatatagaagatcaaatttggatgagatgttggggatgctctaaacccaactccacctctctagttcattttgtgagatagctgggttcgctctcattttaggtagagctaaaactttttggctgagctccagctccaagagaggtggacctgcagctgcgctaaaaaggcccatattttttcgcaaagagcaagagatgagaggaccataatggtaggaagtgggtgcctcgaggaggtaggcgggatatatctttatcttaattgcttaaaaaatttgtatctttccaatcatcagacgcgattttggtatgtgttccgattcgcacgcgattggacgaagcagctgccatccgaacgcccggctacatccgttcctcttcttcttcctcgattcagtctgagtaggaagagcgggcgaacggcttcggcgtccgataacataatgtcgatgacagaggcacctcgatgcgctcccgaactcggcatgatggacgaaggcggcagccggagtggggagcgagggaagaattgggaactctggcggcaagaactcagtccggtaggagagagaaaactccagggtgtcttgatgtaagtgggagataagggggaaacggggaaaaaaaatggactcaccggagttgggagatacgctctaggggaggagatcatcgctccagcgaggcggcagcggaggtggcgtgcacacatgccacgcgcgtgtagaacggaggtagttgctggatctcagcttggttgggccgggccatggcatggctgcgccgtgtgagccggaagggcccagaaagtgcagtcagctcagcagggagaaagttggtggaggggatatatataggaggattggagggatttcggcccaaaagaaatagaagatttttctaaatttttagagggatgattttaatctctatttttatctatactaggaaaacaaaattttttgaaatgatccccttattcccgtgtcttccgaataaatggcgagctttagaccaagtgctatcccttaatatccgtgcgcttgcatcggtcaggttaaaacaattttaattgtgcatatgctttgacagataaatagtcaaaccatgacgattccttgaccacaacagtggagccaaatgagaaattaagaaaaaaatatgtatacgctccggctgataaatagtcaaacttgacaattcctcagccacaacggtggaggaagccaaaggagaaattaagaaatcgtgagaccaaattgattgagatttctgggccattttggtttgatgccaaaatgtgctctatcaaattgttggtattttgaatatagtagtttagctagtgtttggtttgctactaaaatgtgctaataaaacatataagttgtcaaaacatttggcactaccaaaatttgcctacgatttgacattgccaatattttagcgtggtagtaaaccaaacaagccctccgacaccaaatcgacgcttcaacagctacataagacagacgctcggatgtgatctatttgcttcttttgttgcaacaaatttccttatatatagatcctaaaaggaaaaaaaagtttctagtgtattaagtcaacaggctcagaacaaataacagaaaaatgccattgtttaaatctttgtatccactctgaacactggtggagaagtggcttttactaccagttcataaccagtggcggaggacggaaaaaaaatgaggtatggctcatggacacatacctaatcgcactatactgtacggcacaacattgtatcaatatttagcatggcaataatctttggaatcaggcaataatatgcataaaatctgaaaaaaaaaggagagcaaggattgattagggatgattgaatcgggaggaaggccacttgcttcagcttaccttgctgctgctgcttgccttccgcctgccacatcgctcctgctgcctgctggctcgccgcctgtcacgcgcgtgtccctgccgcgtagccgcgccgccgcataccagcattggcgcccagtcgccacttgttgatctcactagatggcactccgcgctttgctgcggaaactgcatcggctacatcaagagatattagtttagcatttattaacgtatttcaataaaaatcatcataaaaataggaaataacatgtgtcctaagaaacattttgttttttatatactccctccggtacgttttggacaatgacataatcgtcataatatatcttttttataatatatataattaataaatgtatttttatttttattaagtactttgtaagataaatatatatatgttattctaatgcctctaaactaaatacttttaaagttattgatagttggagttataaagaattgactttaaccatgttcaaaatatcaagaattatagacgatagttttatgatagactactcaaatacttcctctatttcagaatgtatgacgtcattgacttttcgcataacgtttgaccattagtcttattattatttttatatatgttatttattttgttgtgacatgttttatcatcaaataaaatataatacattcttaacttataattttacatatttatagtaaacttttgaatagaacgaatggtcaaatattatgtaaaaagttaacagtgtcatgcattttgaaaatgaggtagcataatgttattctttcaataaaaaaataatgctaattggtttttgcaacgttgagaaaatcgtagttcaaataaaaatgcttaggaataagcaggatcaaattttggtaaaagtaaaaaaaagaatcatattacaactatgaccatggtaaaataaaaccattaaaaatattatgatgatatgatcccagatgaaaaaaaaaattgtgccaatgtgggtcttaatttgttcgctctattataaaaaaaatacataactcataagaaaaaatatatagatatatagtttaagaaagatatacaacgctttcaaaaatggtaataaaaaagagaaagatttgtgtagctaatatgacactgcaatttgggctggccgcctgaggctttgtgttgagagttggcttggacaggatggtgggatactacataccgacgaacgtgatgctccaagagtaatccaacggctgtggttgtaaactgttgtttctacagtgatctgagagagaagatgggataacgtggcaggctgttgcacttgatgccgtacttcaccgagaataaagactttataggatgcggggagctggatgcggatgcctcccgcagttccaagcggccgcgccgtcgtcgcctcatcgtccgccgcggcggcggagatggggaatttctgagctagggttaagtctagtgaatcacccacatatgcccacattaacacaaaacgagcccaatgggcctacgattcagtggagagtgccccagcagcgagtgccctgtcttcgcccatcgcctgacgccgcacttcgcctctgcgcctgactgccgtcagcggcctgccggagttggaggtggagggtgttggtacgagcgggcggcgccatacctcgccctaccgagtcctctgcaactgttcataaccctttgtagtcccagtttttcaaccgggactacgaatccgggactaaagatcgttatctttagtcccgggtgaaataaccgggagtaaaaatccatttttagtcccaattggtgttatcaatcgagactaaagatagagcatttttagtcccggttggaaatagagttaggctagctagatacggttgctccattattctgttcttttcttcattgtttttaatatattgatttcactccatccccatcccaaaatcccaaatcaatcatccccaaatcctcaaatcgatcatatccaaatacatcacaaaatcttaaaaaaaattacattacaacttctacaaaattcatcacaaatacatcacatattcacatcacacacaaatcaaatacatctcagatccgaatcacaaattctcaaaaaaaaacaaagaaacgcccgctgccgcccgccttgaggccgcccggccctccgcccgccggagcgcggaccaccgccgcaccgctgcgaggccgaccggccctctgcccgccggccgcccggccctccgcgctgcagatcaagaagtggggaggatggggggagggaatggaggagaggcaccgccgggcctctgctctgcatatcaagaagtggggaggattggggagggaaaagaggagaggaagagataaggtgtaaggagctagttagaggatacgaggagccgggagttaaagggagagaaaggaggagaggaagagataaggtgtaaggagttagatgataggaggaaccgggagtttaaggagagaggagcgggagggaggaggagacctcgatccgatccgcgtgcacacctctccgtgtatgtcgatctcttttcccggttggactaaagattaaaaagtacctctgagattttaaaccgagactaaagatgtttttagtcccggtttttaatataactgggactattgtgaaatcgagccaaccgaccaaagatggtttctccaccagtggaacttataaatatcggttactcgaaataccaacaaaatcagtaaacagtaggtcaaaggtaagtaccactggtcatatcgtaccaatatttgggccaagttaagtttcaaactttttcttcaaacttctaacttttctatcacataaaactttcctacacacataaactttcaatttttttttcaaacttccagttttggcatggaactaaaacagccttagattcaaaatcttgattgaaaaactaatttatagaaaactggcttacaaaccataggcaacttattctaatctaattaaaatgttttgattatgcatgtgattacttgtagtatgaaaatttctcaacagttaattcggtcggcaggcaccctgggataattgaatgaccttatgaccaaatcaggtagaagcaaagtgcctctagccggacgtggcttgcttgctccctgcaaatacttctgtctgtgctctcttcgacatggcataaactcatttgtttgcagtacatgcccacaagttcttttttttagataatacatgcccacaagttctgttgtcaacaaagtaaaatattggacgagagctttggttaatagatcaccacctcacacacacacgatcatgttcctaaacatcacggcacgaattaactgttgtgaaagtacatgtagcctagtggttgcagcgaactgagtagcaccttaagatccgagttcaaatctccatagtagcgaatttcagattggttatttgagtactaagttcctaatttaaaaaaggttgcatatattcggttggacatagaatttcagattgggttatctgagggaaaatacccttctaaaaaaacatcacggcgccagagtataccgtccatgtccctctcactagggttccccttaccgtttttggcgcggttaccgcacccccgcggtaaagctttcactgcgaaaaccgcgtggtaaccacaagacataccgtagtttcaaaaattgaaaaaaaggttaccgcgcagttttgtaagccctagctctcattacgtgtgacaagaccttcgccggtgattttttttctctgcccttctcgatcaggtaataacatcaagcggctccaatatcagccgaacagcccagcccaccaggcccacattgccaaaaccctaaccgcacggacgcgccaacgcggcaacactgcaccccatccccaccccacacgggctcggcagaaccgcactcgatcggttgccgtttctcttcccgcagcactgcgccaaaccgacagccgccgcctcctcttcgcaccatatgccactgtcgcgccaacagcacagcagtctcctcctcctcatcctcatgccgcgccgccatcactgccgatggtccttgcgccgagccatcgactgcaccctctccacctcgccgttgtgccaccgtgctggtcaaagcttggcggtgtacgatgagggggtgagccgtgggcgctgggccacgcccgagccaccaatggtcgccctcctcctctccgttgtcccaccgtgccggctattgcccaatggcatgagatgcgggcgtagactatgagcagtataccaccaccgccaatgtttaccgtgcccacagtctcctgatctccttattccttctgccgattgcaatttgtgttcgatttatgtgagttttttcttctttttttttttgatttgtgcgatcttcttttctctctttttcgtttggtttctatctctcttttctgtgttgattccttactagatagcgtccctgttttttatcgagaatgctaatctgcgaccagtcgcgtcacgcgcggagaggggggcggtggacggcgcgtgatttttttgggggaacgttttttttttctttctatttttctttctgtacgagtttgttttctttccgtagtttacggtttccttttttttcgtttttctttctgtatcttacgatttccttttttttgcttttctgtttttttcttttcgtattatttttaggttttttttctaatatgtatatgcaaactttatatatgtacaaatacaaattttgtatacacgaatacaaactttgcatacacgtatgcaaagtttgtatacatgtatgcaaagtttgtatacgtatatgcaaattttatatatgtacaaatataaactttgtatacacgaatacaaactttatatacaaagggaacacccaattgaaagggagctaggggttgatgtggatcagcatctagcccgacagagtctcacaagggttgaggagatggggaaaactgagatgggtaagacaaaggtggcactcagatcttgaaggagggatctgaatgtactttacaggacttgatggaaaaggatatcagacagctagaagctattgcaaggaatggtgagcccaatgctgctgaagatggattcactcagtcagccaagaagagaaggaaaaagaagaaatcgtctgatccagcggttgcaacaagacaaagcatgagaattataagagatggtgtaccggtggctatgaaggcccagaagaggacatctgaaaagaacgacatatcaggtaccaataaatttgcagttttcaactcgttaagtaatgatcatcttgcatctattgctcttgattctggtattgatttaggagataaccaggatactatctttaataatattcaaactttaaaagcaaaggagctagcacagtcgctaatttgtatggcacaggataggttagataagaaggtaggggaggaaagattgcctgaacatattgaaattgaaggttgtgtgtcatcccaagatgctaggggcagagagccgtgtgcacatgggggtgacagcaacaataacacaaatcttgaatgatgaatatccttttctggaatg

SEQ ID NO: 76760 - DNA, 10551 bp, Oryza sativa
  unsure (1)..(10551): unsure at all n locations
atcctccccccctaacacgctcctctcccccttcctcctccccttcttctttttctactacaccataaatttaaaaaaaataaataaattaagttagaaaaatttatgtatataaatactatatataaaaatatatttgaattcaaattcaaatttgagtcgggtatataagcttttgacttataaactttaggtctataaattttagatgtatagaaaatactatatataaaaaatatttcaattcaaattcaaatttgaatcggatatataaactcttgacttataaactttgtgtctctaaactttaggtgtatagaaatactatatataaaaaatatttgaattcaaattcaaattagaatcgagtatataaacttttgacttataaacattgggtctataaactttagatgtatagaaataactatatataaaaaatatttgaattcaaattcaaatttgaatcggatatataaacttttgacttataaactttgggtctctaaactttaggtgtataaactttagatgtgtaaacttgaggtgtacaaattttaggtacataaatttatttaaaaaaataaaagtaatgtggtgaaaaaaaaaccacgtggagaaggaggggtcatcgctgggggcgatcgatcgcccgttagacttttcgtccaccttgtccatcatcagctcaatgatgcactatcgttggacctcgtgattatacatcacctccactttatccaatggagaattcccgttcatgtttatcctattgaagatatgtaagagtatgatgctgggtattctgttctcctcaatgctctagtgcaaacttgatctgagcgtccatgtatatcaggaaagctcatggtgcttcctagggtcccaggcctagctaccatgggcaagcgacaactgacaagtctagctggagctactaacacttccatgtgatgttgtgaactaactcgtcatggatgactctctcttacagctcaaagctactcctcttttataacccaaatgacgtttgcatgtggagagctaggtagcatgtgcgtgtacactgatcagttaaccaacatatttcaacaggttgacagaatctcacgcaacagtcttctaattggctacactattggtgcacgatacattgcgtaatggtgctacacatatagaaatggtagccaaagatattatattctagtttagatgatgtagtacgttcataatttcgttgatctattaattagcgggagttaatgggtttgtcccatcatcttattcgtttattcttattttttacttctaaaactttttggttgtgtcattgtgtgcccattggtagaggctaaaacataaaccatttccactatctaaaaagccacaaccaaatataaaagttgactttgatttttttttccagagtatagtttattttttatcaacagcctgtaagtagttaaaaatatatttttttacaacaatattttttatcgctcatatatataattagatattgagaaaagggaaatcatattagttggtgaactatcaaggaaacatatgcagttgtcggagaacacagatggaagcaagatcggagacacaagtccacaatggagctagttggcggtactgccaatcacataatgcaacaggtgcatggagattgccggacactcgccctagaccggtatctagttcgtgagatgcagcaagagtgagctcccagatagacgatgtctgcagctccagccggatttggcacgcgcggtagctaatcgtgatgcctcgctaggttccctgcgcttatattgagtactgaccgaaatttgtaatgctttactagaaaatagatctagtgacaagagaactcttgatgtttcccaaccctacatagccacataaccatgtaaacgcattttcggtctggcggtatatatccaaattattctcaactcgtcgcggtatatgagcctgtctttcagcctctcacgtctttgatgtgccaaaagagattgtatatatgatatatatcactactaaaaaaccctcgtaggaaccttataggtgccggtttatttaaaaccgacacctattaaccttttcccacctcccatggtttaaaaaataaagaaccagcaactttaaacaactatagatgtcggttctaagaaaaaaacaaaaccaatactattagtaccggttttttaaaaagaaccgacacctataatatatatatattataggtaccggttttctttaaaaaccgacactgttgacggtacttaaatcataatatttgaccatcaatacatgtatataatgaaataaaatatagtatccaagttagtggtagggtttattactaatcattccactagtgttggtgaaatatgtgtttacgggtattttgaggagaaaacacatccatcatgcgataaaatgcacctccgcgcattcaagacgtgtttacacggattggagggcccatatgtcaaccaaaactacttagaattgggccaaaacgttgtgcaaaatgttgggggcccattaagcaacctaccggccaaaggagaggccaggaggacggtttttggattcggccgaaccaatcctggctcttcccgctatctggcttcatgtggacggcttggatttctcccctatggcgattgcagggtgttttggtcatttcccatgcccctaaacgtcatttggagcctatataaggaagagtccactctcatttcaacacacaactttgagctgaattaccagaggctctattgtatctcttgtacattagaaataggtagagagtgaggagaagctctggaggagtgcccggaagtttggcactctctccgacttcttactcgacgagtgtagcttactaggaggagctttggaggagtaccggagctgtcggtacactctgctccgggttcggagaacttcttctataaagtaagcattcatgatcttttcttatgttatttaattactttgtctaagtaagatagatttccacctttgcgggttcattgtttagtattcatattaagtgctccagtataaggactccggataaagaaggaagttcgcgctcaagtattagagtagtaattaataacttaggcgtggtgtctaggttagagattacctttgtttgttgtgtatcccacggatttgtcagaggtagggggcaggtggtgacagccttgaatcccgtcctagtaatcctccacattcggatacatcatagagctatagccggaaccacgctagcagaccagcaggggtcagtgcccgaagcaacagataggaaattgcatttacttagattagataattaaaacacatagaaagtcctctctagcctacctagcctacatatagttgttgtccttggatcgtcttagccttaggtagattacacacgttccctgagttcgatatccttttggggtcacccgaaggtgaagtgctaaagcggtattccgtgcgcttgtggatttatctgtggtcgtaagaaataccaacagacacctaataatcgagccgagctagcaacaaaacgaaccggtggatctggcggggcccacgcgaggacataagaccacgcgagaagataaggatcgatctctatccagccaggcgcctcctctctccctgtctagtcgccgccccctccccctctcccagcctccgcttccctcccccggtcctccgtgcccctctcccagtcgaccggccatttccctccccctccgccccatctcccagccggccggccgtttccctctagcgagcagcaacgcaggcgaccggcggcctccccacgggtgacggggaggcacagatccagcgcccctcttcctctccctctccgtcggcctcaccggaggcggacaaatctggggagggggtagtttgggtggtgggttgtcggcggcaacggtggccaagggaggcggcgggcgatctccccacgggcgacctctttctctccctctccgtcgggctcccaccggtgccttgcagatccggtcggggtgggttggcggcggtggccaagagaggggacggcggccgatcggcggttggctaagggaccatggcggcagtagcggtagtggaagagacgacatgtgcgttaactacgtacgtgattgcaatccatccatcccctttctattttttcaccttgttctgactctgcaagtgatcaaccgttggtttttacttaagaacaacaaaaaatgtgtgtgtgatgcagtatgatatgatggatgaatgtgtgtgaactatgaatgcagtatgaactatgaatgtgtgtgatctgatggattgcatcaatgcagaaagtggttgccaaaaaatctattagatcaatgcaatgacggacctcaataacttcccaataaggtagccgccaaaatataacggacctcaataacttcccaataaggtagccgccaaaatatagatctttttcttccacatacccttcttgtactcattgctacgatttcttttcttcacaaactcattagtaatgtccttcaccatattgtgtacctgatatccagacaaattctcaggagcagacccaagttctctcttaccattgaaaattttcttctttcttctaaaggtgtggcatagagggagccatctcctatgacacatgtaaactagctttcttgattccttcagccacctactgcgtgtatgttccatagagtcagagcaagcattttttcctttcatggtttatccagaaagattacccagtgcaggataatcattaatggtgcagaacaaaagaacttgtagcttgaagttctcctgaccatatacatcccaagtttccacaccttctttctagagaatctcaagatcatcgataacaggctccaagaacacatcgatatcattgtcgggttgtttctgaccttggattaacaagcacaacataatatatttccttttgaagcataatcatggcgggaggttatagttcgcaataagaactagccaagtgatgtgagaactgctcatgtctccgaaaggattcatgctatccgtacacaaacatatcctcatgtttcttgggtcggcagcaaagtctttgtgcttccgatcgatattcatccattgaatcgaatccgcaggatgtcttagcaaaccgccattccttctctctgtggcataccaacgtactaactttgctttcttggggttggcaaatattctcttgaaataatcaatgattggtagataccacacaaccttcgccggaccacccccgcagtaaaatcaaagtatgtttgattcttattctgtaatgaacaattggcatatgagattattggttttgatatgtagagattatttgacaggaatcgtcatagacatgcctcggccgaggatctgtcctagtgagtagagccgatccggcgacgaccagctgcttcctccttggtggacgccgctgccgtcggagcccttgcataatggaggcgagctcggcgtcgacatcgtcctccccctaggccgccacaccgtcgtccttctccactccgccatccttccgccgccaccgctgctggaaccacggcctctggcggcgggaggcgagctccgtgtcaacgtcgtcctccctccaagtcgctgcactgtcgttcttgtacgctccgtcatccttccgccgccgccgccgcctctaccagcgccgccaccgctggaaccacggcctctggcggtgggaggcgatctcggcgttgacgttgtcctccccctaagccgccgcaccgtcgtcattctccgctctggcatcagctaggctacgcacggtagcccgtccttccgcttccgccgccgccgcctccactcaaggacggaactagaacgaaatggaggagggtgcctcttgcttaatttactctactttagatcaagtttaagtttatacgtgtggctatgtttgtattgagggaggtgcacatatggtgaaaatcggcaagttataactaaaaaattttgttgaccgggttcctgggcagtcccctcccatactctacctccgcccctgcctccactggaggcggcgctggaaccaaggcctctggcggtggcgttgaagcacgggggcgcggcggtggagcatgggggcgtggtgccggcgacgagcgacgacgaggaggtgctgcccgggctgctctatttcatgctcctggcctccatgcggcggcggtctctacaggcggcgtcgacgacctccgcttctttcttccgcaagctaatgagctggtggtcgccaccgtcgcccgctggtggtcgttgccgccgctcctttttgcaatgctctctctccaaaaccgtgctccaacaacgacgggcaatgtttggatacaaattaatcgtcaaagctatcgcattcacaggaattcagttgcttcctcgaaattttgcaagtctattgtgatattttaattcaacttgtgtctgtttgccagctagtttggatagacacatatagaatattcatagtcataccatcagtcaaatgcgtgtgaaggtgtgcactccaccgggagagcacctgcccaaatgaagataattatcccttaattatggagtacttcttaacaagctagatgcaacaatacgtttagcaaccttggtcaactggctgcctgctcctctaaatgttttttttaaaaggatgaactagcatggtgatccgcgcagattacacggctagcatcattatattttctttcatataatagtataaatgttttctcattgtattattaaaatatattaaaatgataacgtaattttaaattttgtactaactttacgaaactactaatgtgtaatattcatattatattttatatgcattttatatgcatgttagttattaattattttaatatcaaattttagttatatctaaattatattcctatatggactatagactcgcctttcaatatttcttttttttattccgaattttcgttatgtgtacattgtatttctatatagactctaggctcttctttcaatattatctatttttaattctaaatttttattatttctaattatatttctatctggactctaaactcatctttcaatattctttaatttttaatttcgaatctcagttacttctaaattctattcctatattaactttagactcttctttctatgtttttttttaatttcgaattttagttatttgtaaattgtaatataaactctaagctctacttttaattttattatgtttattccgaattttaattagttttaaattcctatataaactctgtactctacttctaatattctttatttttaattccgaatttctattatttcttaattgtattatatatggactctatactctacttctattgtactaactttacgaaactactaatgtgtaatatttatattgtattttatatacgtgttagttattaattattttaatatcaaattttagttatttctaaattatattcctatatggacctagactcgtctttcaatactttttttttaattccaaatttttagtattttttattccgaattttcgttatgtgtacattgtatatctatataaactctaggctcttcttctaattttatttatttttaattttgaatttttattatttctaattatatttctatgtggactctaaactcatctttcaatattctttaatttttaatttcgaatttcagttagttctaaattctatttctatattaactttagattcttctttctatgttttttttaatttcgaattttaattatttgtaaattgtattatttttatatgaactctaagctctacttttaatttttttatgtttattccaaattttaaatagttttaaattcctatatagacactgtactctacttctaatgttccttattttttttccgagtttctattatttattaattgtatttctatttggactctatactctacttctaatattcgttatttttaactctgaatttctattatttcttagttgtatttctatatggactgtagtctcctcttccaatattccttattttttaattccgaatttcaactatttccaatttgtatttctatatatatggactctgtttttcttcttctccgattaatatgagaatttctagaccgtgagagcgagcgtggaggctcttttttctattcttttaataagttaatagatgattgaatagctgaattttttgtgataagtattcaatggtacaaagaatgaattcaaaattcaatgcaacaatatgcttcaaacaaccttggtcaactggctgcccgctcctacatccacatgcatgcttcacactgccacctagattaattacttcctcacgaagcaccaagtcttagtcgatcaccaaatcatttgcacgaatatgccttctcccattccttttctagtaaattcacatcaattttaataatcaataatcatccaaacattagtgaaagtagtactatatatatatatgtgtacaaacattacttctgcccaaccacggttagccacatagtagtaattaatcagctagtcagcttacacttgtctacacgcggcgagcggccatggacgcacctcgccggcggagcaacggcgcgtgggagatcaacctggtgcggcggagcccggccacggcgcggaccgaccgctgctcgaggctgctgctgctgtggagcgggttcgtcggcgtcgtcgtcgtgctctacctgttcgtcggccacgtctgggcgtccgtcgccacggcggtgctcctcgccgccgcgggctggttcacctggtactacttcggcgcggcgccggcgccgccggtgctccccgatcatcatcagccggcggcgccggtggaggcccgcgggctcagccaggaggacatcgaggccatcccggcgttcgagtacaggaggggatcatcgggcagcggggtggcgcagtgcgcggtgtgcatcgccgccgtgaaggacggggacacggtgcggcggctgccggcgtgcggccacgcgttccacgcgccgtgcgtggacgggtggctgcgcgaccacgcgacgtgccccatgtgccgcgccgacgtcgtcaaggtcgccggagagacgacgccggcgacggaggaggagccgcccgtgtagccgagcccgcgcaagttgaggcatacgacaagtcaacaaaacatgcgccggaatggaaacgtgtgcttccatccctgcttgtttcttttttttccacttcgtttgactttctgttttaagtgtcagcttggtatagtatggatctgatatagtgtttactagcaaggtgtatatgcgatacaattaacaaaaaagttgtgaaaagtgagtgtcaatggcaaaattacttgagtgtgatatctacttcattttgccaacttctgttatctctttttgaatcgaactattaaagtgtactccgtttctaaatattcgacaccattaattttttagcacatgtttgaccattcgtcttattaaaaacttttgtgaaatatgtaaaactatatgtatacatataagtatatttaacaatgaataattaataattacttaaattttttaaataagatgaacggtcaaacatatttaaaaaaaatcaacggtgtcaatatttagaaacggagggagtacttttttacaacatatttatatagaaaagttgttttaaaaattatattaatcatttttttcaatttgttagtcactacctaattaatcatacgctaatttatcgtgtaaggatttggaaccctaaggttcgaatgaagaagacaagccaatcaaccttagggaaataatttatgcacgtcaggagaattagaaaatgctggtcacgaagtcaggctttcatgtactgtaactatcattgttgaatgggaaatgtatagaaatcttggatacgtatggcctgtttggtagagctctaacttctaaatttagctccaggagttgggactggagtagacttgtggagctgcctaagagcatccctagcagatacgctagccgggactccatccgaaatttggtgcatacgagcgtgaaactagcttccaacagatacgccatcgctcctccaaaaatagcgcatacgccaaaacggcaaagagagaaagggcaaatatagcgtgtctctctcctcacgccataccacatcggatcgagctcccgtcctaatccagagttccgcgacctccccccatcatcgtcgtcgctggagggtggagagagagggtatagcccaggatggagaggaagagccataccggatctggaaggagaacgccgctagcggcagccgcctacgcccgccgccgtccccctgcgcgcgtccgccacctgcgtcctccgcccctcgcccaactgccgccgcctccgcccatccgcggcacctcccctgcctcctccccacccatncacgccc

SEQ ID NO: 76761 - DNA, 927 bp, Oryza sativa
aaaaataaagactattgaaagaaaagaccatctaaaacacatgacgagattaattaagtaataagcatataaatgagtatagtggtggcggttgatgggacatgtaaaaattattaataaaacaccaaatataatcttaatgacgattaaaatgaatgatgatggataggtcgtaaagcaaccggttaaggcggttggcgggacttatagaaagtcgaaaaataaaccccaatgataattatatttaatttttaaaatctcaatgacaataaaaatgataggcaacgggcgggtcgtacagtagtacaatggcagagccggcaatagttgatgggacttctagaaagtaaaaaaatgaattccaacgatagttatgttcgattttacgaatcccaacaacaataaaaaataagcggcggatgggtatagtggcaacgtttaacgatatttctaaaaattataaaaaataaaatccaacgagtcaataaaccctaaaaactataaggtccaattttaaaaggttcgggcttctaaaaagttttaaaaaataaactccaatgataattatgtttgattttaaaatctcaatgacaataaagaagggaggcagcgggcgagccgtagaggagtacagcgacaaatccacgaacattttggcggaacttctataaagtagaaagaacctaaacgataattatattcgattttgaaaataccgaagatgcagcagactggccgtagaggagtataatgacaacgtttgacagaacttataaaaaaaatctaaatacgaaacccaacgagacaataaactctaaaaactataagatccaatttttaaaggttacaaggagaatgaataggaacagtggaagaccgagcaagcaaataaaaaaggatatgacagaagtaagggatagtaagtgg

SEQ ID NO: 76762 - DNA, 5243 bp, Oryza sativa
acggcggttaacacagcgaacagctcctcgccatcgcgatgatcctcatcggtgcggaagaacctggcaatgcagaacttgccggagcccaggttcacgaggtccgagctgacaagattgagggcgtctggcggtgtgaactccataggaaagctgcgaagcagcggcagctcgccgccatcaaggtccagagcggagagcaccaagctcctcttcctcctgtctctggtgctgtgtgagaggccaaaccaaaggccgtgctcatggcaatactcggcgagaccaacaaatggcagcgtccatcttgtggccactgtgctccacgcatggcgcaccgtgtcgaagcagtagatgccgccattgtcgtgcgtggataaccagatgtccgtgccaccgatcacagcgtaggagtcgacttcgaagtcggacagcggcggcggcgggagcgcgcagcagcgccaatcctcgttcaatccatcctcatagatgagcccatggaagcttccaccgtcgtcgacatcgaggatgtagaggtcgtcgccgacggtgacagaggtggcaggcaatgtcacctggtaggggagggcgggcatggtgcggacggcgtgctcgccggggtcgtagaggacggtgcggcagctctggtcggcggcgaccaccatgttgtggttgcctccaaggaggaagaactccatgttctggttcccggacaagctggaggagggagggtagaaggtcatggccgggcatggcaggctgccgtactccaccgcgtcggcggcggcggcggcggatggcaccggagatggacgtgggaggaagaagcggtccatgtctatgttccgcagcgtgtagttgctgcggcgtggggcgaactcctccagcaccagatgaacaaaccgacgaacactcatcgtcgatcgatcggatgaatcgatgatcgtccccaaaatgaagtaatcttactaaagattgattggattgattggattggattgctctggatcttcttctcccccaccacgaataactagggttttcacgaagccaaacgatctttctcgttgcaaagcgacttatccgattcggttacgcggagtggagatcatgcgggcgccctgatcatacgatctatctctatataaaccgagctgccgccttcacgcaacacacgcgaaatcaatctagggtttgcctcctactctgtgctgcacctgatcaagcgatctatctctatataaaccgagccgccgccttcacgcaacacacgcaaaatcaatctagggtttgcctcctactctgtgctgcgccatcgctcgtagactactccatcccactcgccggtgtgcaccggcgatcgggagagtagatctccggaacaatctacggtttgcctcctactctgtgctgcgccatcgctcatagactactccatcccgctcgccggtgtgcaccggcgatcgggagagcagatctccggaacctctgccttcgacgtcatgcaccgggagaaggcggaaataaggtttttgggaagcgcttcgcgcgactgctccctgttcgtccgcgatggctcgccttcctcttcgctcgcgtgctgcgcaccttcgtcgacgcctgcaaccgcgagtagtccctgccgagcaaccggtctttccgccacctcggtacgtgttcgacatgttgcgcatatttgatctgttcatattttactgtttagtttacatatgtagacctaatgatgcgttcatgctagtttatatctgcaatgtcatgatttatttatggaataaattaaatcattatgtgcttataatttcaacataagcgaatcggatagtcaccggcggcggacagatgatgggaagggaatggcggaggaagatggagtggagagaggggaggaggagttggccaccgacgaggtccactctggtggcggcggagaagaggggtgagtgcgggggcgtccgggggacgcggcgggtgggaagggaggaaggcgagggcgtgtgatctggacgtgaataatatttaaagctatgtgtgaactgtagataattataactagaggactgctacaccacggactcccgtcctaacgggataacttaatgaggattattgtttgaccaatcaaccacttctgtcaatctatccacttcacgtaattccatacaagggtcaaagcgtcagtgtatgttcacataatcacgtgagagtctacaggcttatggttgtctttcagtctttcactagagacacaacacactaggtactcgatacttaggtggtaccaggtaccggataccccatatatcataatatctagtactgggtatggtacctttaggtatcaggctggtctaggtaccaggtatatgatacctaggtacccaacgtactcagatggtaccaggtaccgaataccccatgtaccatgatatcttagtactaggtatggtacctttagatatcaggctggtctaggtaccaggtatctgataccccaggtactcgatgccctataccagatctggtacctatgggattcatgccgatctaggtaccaggtaccttgctaccccaggtatcaggctggtctagataccagatatctgataccctaggtacccaatgcccagtaccaaatatggcacctatgggattcatgccgatctaggtaccaggtaccttgctaccccaggtatcaggctggtttaggtaccaggtatatgataccccaggtacccgatgcccagtaccagatctggtacctatgggattcatgccgatctaggtaccaggtaccttgctaccctaggtatcaggcctgatacctatgatatcagtcgaaacaatctgggtaccagttacatgatacctatgtattagaaactcgatacctaagcattaggtatcttgtgggtatcaagcatgtttcatggatattaggccctcatgccgatgggagctatgagaaaaagggaaaagagacgaggcaagcacaaaaataagatggctatcttccttggaggtggaagaacactattccttcttgttgccatccttgattcggatcgccgctgctacatcctcgacacgcatgtgaccatgatggttatggacatcgcctgtgacagtaggacggacacctcaatctctcctcctagctcgaactcattgaagctcttcctaagcacctagtacacgagagttcccatgaccaccatcaacgatgtgatgttccgcacaacgagagctaacaccgctctggtcttgtcgcagggcttgcagtgagtacttgcccagccacattaattaggaatgaagagaggagttagagagggagagaggcgtagaggaggagaggcgaaggaggaggacgaccaagcaaagctccgggagagagaggtagaaagggaacagataagattggatatcgtttcacttctcccgttcctacggcattccgttggctagtttttctgttataactatttttagacgacatacggtgctcagtgaaaatatacggtgcttctctaaacttgctttccgatgattaataatcagctgtaatcaaagctgttagcacccaatggagtacaatatattgctgatgagcttatacatcagagacctgtgcatcgccgtcgtcgcagagctccacctcgacggcggtgaacaccacgaacagctccgggccatcacggtgttcgtcgtcggtctccaagaacctggcgatgcaggaacctgccgacgaggtctgagccgacgggattgagcgcgccgggcagcgtgtaatcccgaggaagaaggctgcgaccacaccggcggcttgccggcgtcaaggtccgtggcagagagaggaccatgccactgccatcactagccggtgagaggccgtgctccgggacgtactcggcgaggccgccgatcgaacggcagcgtccagtcgtcggcggcgcgccgtgtcgaagcggtaggtgccgtctccgccgccgaccaggagtcgggttggaagggaggcggcgggagagcacggtagcgctagtcctcgccgccgtggtcatcgtaggcgtagatgagcccatggaagcaaccaccggcgaccggcgaatccgaggcgttgaggcaggtcgggaaggcagaatccgaatccgaatgaggacggtgtgctcgccggtgtcgacggcgcggcgagtctggtcgactcatcgccgatcgattgaccatttgacctccaagattgtttatctggcatcctggccccgcctgccatagactcatcggtctctggccccacctgtcatagactcatccgcttctctctgctcgttagttgccttcgtcctcctgccgcctcgggtgttcttccttcctccatcgccatggcggcggcggcggcttcccaccgcgtgttcgtctacgggacgctaatggcggaggaggtggtgcgcgtcctcatcggccgctcgccgtcctcctccccggccgtcctcccaaaccagtccgtccacgagacatctgtttcttcttcttcttcttgccaagaatcccctcctctctgctgcgaaattctgatcggccaccgtctcctgcagccagaggttcagcatcaaggggcgcgtttacccggcgattcttcccgtcgacggcaaggaggtctcagggaaggtaagcccctcttgcttcctctctcggttaggcaatcaaagattcaagaaagctgaagagtcaagtgaagagaaaaatcacaagtgcttgttgctaaatcagcatgtggagaaaattaaggccagttaatctgtactcttcttttatgtatgttgtgcaggttttcaagggcatcactgacagggagctcaatgtgctggatatatttgaagatgaggagtatgtcaagagaaccgttgagatatcactaactgtaagcctatctctactatgtacttagcaaattccgattgtttagattgcctgaaattgctgcttcagcagtctgtcatgctgtactgaaattctgaatgttcagcaagattggaccctgtgtcttgaaggagaaatgttttgattagcttcttcttttcatcatatggcttcagtaagatgggatggtttggattttcaggacacatcggagaaattgcttgcttatgcatacatttggggcaatcaggatgatcctgacctctatggtgaatgggactttgaggtgaggatgtttcctttttttaaaa

SEQ ID NO: 76763 - DNA, 644 bp, Oryza sativa
agtattacaagtcttcctcaataaattactccaacaaaatcctcacctaggtcaaagcagcttttcctatggttattttcttcagagtttcttgtacttgcatttgtatagtataatgccttcaattcctctgcttttcaattgaaatgtttatattgctgtgatcctctttggtgattactaactggactgtgtgaatgtatcatttttacaggacaaagatgaaacgaaacccagccttcataagggattgcctgttgtttcattttcgctaggtgacactgcagaattcttgtatggtgacgtgaacgatgtggataaagcttcaaaggttgatctggaatctggtgatgttctcatatttggtggtaaatcaaggctcatattccatggggtttccagaatcaaaccaaaaacagcaccaaattggctgaccgatgaagcaaaacttctacctgggcgtctgaacctcacattcaggcagcattagcttgccccgtattacatgtagagggaaccttgttctgttctgttgtagtagctcagtacccaccctattagcatgagttagctggtagtacattcgatctaactactggaaaactcgagaacgagtcagatcacactatcgaacatatatatat

SEQ ID NO: 76764 - DNA, 701 bp, Oryza sativa
tcgggagattgtggtcagagatgtaagccgctttcaccattttaaagatggcagatgctcttgtcgtgattattggtgattgggaacaaagcatggtaggaatttcttttgcatcttctgaggggaacaacatcaacataccttacctggtttttgaactatctgaagcaatcagctgcagttgatgcccagcagtcataactaaggctcaacgggtgccacactctttactgccagctggcggtggtacaactaacaactcagatcggctagtatgcacacttgaatgaaccctaagatgcgaatgctcaatggtgtttggtttgtacttgtctaatggcccatgtacatacatgatggcttggttcccatgtaatgcaatgctatgggagaattcatctgttttcaccagatatctgccttattaacttctagaccagcgatgggagattgggtcttcaccaggtaccaaagaaccatgttccgatgttatatttcaaacaacagtatcaatactttgcattcttgctgataccaatctattaaatgaacagagataccacaaactaatctggaaagagcgcaactcgagaatctttgaacacaaagattgcactgcagcgcaagtttacagagcccttagagatgaagtgctgatttggagggaagctggagtgtttaagcatagagagtagtgtgtg

SEQ ID NO: 76765 - DNA, 1527 bp, Oryza sativa
gtgggaatctatacccagtccaattagacaatttcctgccatggctaacaaagctcctttcaaccatatagaaacctgtaaaggcattggtatttggtaagagtgttaacttgcaaggggtgattggttgggagaggtttagaagcatagcataaaagccactatccatgtctcttagcttctttcaataggtaggcttgaacttctcaaaaagttgtatggagatatttggctggacactattgaattgtcactctgaattgcattgatttgattgtatcattattttgaattggttctttcatatcctatttcagggttccctacaacatatggcaattctgaggcaacatatccagcacctgcagcatatggtaactctgagacaacatatgcaccaacgtatggtaatactgaggcagcatatgcatcaacatatggaagttctgaggcagcatatgcagcagcatatggaaattctgatgcttatagcactaatcaggttggttacattcccttatcattgttctcttgtttcatttctggtgtcaagtatatctttttgctttcattgttatgcatgtcaaaggatacgcactcaaggactgaaatccattattacttgaacagatgtattttagttagtagtttgaatatttgctcctctttttatttcactgttggtcttgaaatgattcgttgtgccatgtattgtttctgaagttttccacccctccataaggaattcaacgaaatatgtctttttagtgaaggaaaacatggatggtagcccattgtattctataacctataggtgtaactcttttacatcttcccctgtcaacgtcaacagcattaggtatttacaagctacattttgtggtctatgctataggttaattagtatgggtaccacttgctctaaactgtaaagtgtaaacatatgctctgttctattagggactaatagttcctggtgagggaaaaccattaaagcttctctcccttaattgttggatcatgggtgtattttgaatttggtttctgttccaggcttgaaaataccaaattatgctccaacttcctagtgcctctatatattattagtgattgctgtgtcttctttatcacaggctcatacccgcaccgatggcaatcctcattacatggctccacctgttcattatgcgcagtatgacagccagcacaccaatgtgcaaagatgaatgatgagtcagggtagctttgaccttgggtgtaatcctggcatttgtcaatgtagttgctgggttcaccaaatttaaggttatctgcaggaattcattccatggaagtgatggatacactgtttttcccctatcttttcattaaccagttccggaatgctcgagccagttgcctgaagtcaaaatctttctgcaaattgtcgatgtatcaccctgatgaaccatggattagtgagaccgcagctcagtctttttagtcagggattgtgattattcgcaaatgtagtgctgcagcattttc

SEQ ID NO: 76766 - DNA, 868 bp, Oryza sativa
tccatgcataattaactcagttccatctagcaacatgccagtacaaaatgcaggtgtttgttgatcctgccattcatagaccaagtctgatgattgtttatgcatagatcaatcatactatatagtaggctcgttagatcaatcttatacggttagcaactttatagcagcaaaatcaaaccaagttttgtttaaaacaggttctgttgcttctgggttcaaaataagttatgagctggcctaatctttttcagtcactgtgtacctcgtgcccccagtgtcggtgcttaccagtgttgggcacttggcttttttgagaaaagccacatgttcttttttttctcttttatgttcttttttttctcttttatgaaaatacgatgacatggacgatgacatgtacaaggcattttcgtcttttcgacaaggaagaaagagaaaaaaaaagaagggagaaaaaaataaaaagattccatgtcatcatccacatagcgtgttacgtaggtaagaccatggtcaaacgcggctttggaccgggatgatacaataaaccaagtttaagaaccttgatgtatgctttgcaagtttgtggatctaagtgaaacctcctgacaagtttaaggactgccggtgcattttactcaaaaaagaatgtgcagcaaaatcaacagcatgtgattagcttccattaactcggaaaggccacataatattctccatgcgactgcaagaatattgtcgcctcgatattcatgtccaacaaaatcaacagccatgtgattagtacagtatgagcatgtggcttttcaacgagctcagcattttccatgatatttccatctagtgctccttgtatatttatgattca

SEQ ID NO: 76767 - DNA, 3060 bp, Oryza sativa
atttctggggttcatagttgttgtccacccgcctcacggagcgcattcagtaccatcccataggcttcctgtgtttccatgtgtgcaatatccttactggtatcgttcaaaagaaccggaaggggaagtaatgtgttcagaattaacattagtatctgatcaactccagcttaaataagtaatcttgtggtctagacaatctacaacttctgcatttcatgaattcaataatcatgcacctctgaatttaaataaatcaattagcaatgcaatgctggtctggaaaaaagcaatgcaatgttcaacaaaatatgatcttctctgctgaaaatttccacatcctctcaaattttatctatccaaagacagtgcatttgaagtgtaggagaacaagaaatatgagaaatgttctgaaacataccacatataatgatataaatggaaggataaatgaatattaatgtgctcttcaaatataatgtaagctttagccttcatgtgagtaataacttgtaacaatagaagatacttacagaattttcatcttttgtccagtcatccaccaaaggtagctgttgaataccaagatgtcagctcccttccaaaacctggcatgcttttcaagggctgtcccccttacaattctatccgcaatacggtgaacaacagcatcatcagaatttgattcagctagaaagggagcccagtagaactcaatggtggcattatagttctagcaaaaagagaaaaaccaaaagcatattcagtgtgaatgagactattcagcaagctattaggatggaaaactcattatataattaaaaaatagatgtaaaatatttctaaatttggatcctgttgctctctttgtgtctgctctagcaatgttttgagaaacatttttaaatttcgcagtaggttcagtaatcatgaacacattttaagttacaatctgtcctgtaagcttccattagaaaaagaaaaccataaaacaaaacaaacaagggatacctttgctctgaaaaccgtaagcgagtcaaaagtttccatggactttgagctctcagggatggaccggtgtaggaggcacaccaatgacacatactgtccacggttcagagaatctccaacaaacatcatgcgcttcccccgcagcatctccaacataagagttgcattaaagctgcaatgcatgccattattaggcattagaatgggataagcagaaccaactgaagagcttgatcaacaatttagcatttcggttgtggttcaactgccgctttcatgtacagcactaaactgctaccatgttgagattcgtttaactatttaagagcacctgatattctttcataaatattttttttcaacattatttaagagctgtctagcgagttcagtgccacatagtatctgtccaggcccagatggtgacccaagacctgggccagctgccagcccattgcattttgtgctgggccatgtcaattacatggtggaaaaaaagcacattaaagtgggctttgaatcccaggccttgggccatggcccgtagtatgacccacatatgagccaaaattttttgaggagctgtgcacaaggaaaaaattacaaacaagttggtaagttcaggcaggcagttgggggaaagaatccatctacatgcatatctggatgctcatgcaccatggcatatatttaaagcgcactacaatttgtgcttagaacttagaagaatagggcatttgttttgtttaaatttgaaaacttgtagcaacctcaaggtacattaaatggacaaaatggtgcatgaacatccagtcctccatatgtgtacagactatagatgcgccaaaactgcatgaattatcaaatgcacatttaaattgaaccaaatgatagtctaaggcaaagattaggatgaggccagacagcaacagtacaccaaacggccccccctcatcatcagaactatcgctgaatcaagaccagatccgcagaaagagaagtataataaaggaacccccccaaaccttgcaagatggagatgggtccatgcctccatgccattgcattaacattaagccaatgcagagcacacgcaaaggagttcccttgccatggccggccggccctcatcctcctctccctcaaacccccatgctctcccatgtgacacctgctccctcaatgtcacacagctgcgacaaactggagccctcatgtgattatgcaaatgcagcgagatgcccacgagagtttggcactttcacttgtttcaccgtgacccagtgagtatggttgaaccagtcagcagccacggctggctgccggcggcgaacggctgcacggtgcactgtgctccgtcggccgggccggccatggctgtacccggttcaacgaggctggcctgttctacagtagacgccatgttaggcaaggcccgccattgcagccaagaagagcagcaagaatcatcaatgcgcattgctacgcggctacaccaggttgctgccgcgcgtcgagccgtggcgccctcgccgcacgaacacgtctcgctgtctcgcaccaagcccaccgcccaccgcccaccgccagccatgccgtaccgctcacctcacctcacctacacccacccacccgcctgagccgacacccgacagcccgagacacgcgccgcgctactcggccgctcgcccacgcaacgcgcggtcaggtctcccggcaaaatctcgccggagtttctaccgtttcgcggcgattccgcctgaacggctgaacctgaaaccatggccaggcaggagacccacgtgacacgtcgatttttattcagggataatattgagtagtaactaatctactcaacatcaaatcttttttttggaacatgcgtgctctcttcgctcgatctagttggtgcgcgttcaacaactcgatttctttaccaaatgttcttcttcttcttcttctttttacagttctttaatgcaaaagatcgaactaaatcaggagggaatttactgccattgttcgcgacgccgacgccgacgagaaggt

SEQ ID NO: 76768 - DNA, 1986 bp, Oryza sativa
gccgccgccaccgcccccacggcgaacggcggcaccacatcgccgccaccggactgggcaaagaacccgagttatcagcaggcattggcagatagaggattgatacactgatacagagggagctagctagcgaagcttacgctgctgccgccgccatggtggtggctcggggcgcgggggcgggcgatctggcggcggtggggaggagggcgggtgaggaagggttggtggagcgtggaggagaagtccttgaagtagaggacggagacgaaggtgatgaaggcgagcgtgagcgcgtacgacgtcaggaaggggctcctcgtccttcctcctccatgccccgccatgccgccgtgctgcggcttcatcatctcctccccgccgccgccgccccgcgcatcgagctacctcctcttgctctgatctgatgatctcggtgaggatctgatgggatctggagcaatgggagaaggagaagatggatgtgttcttggctctgcagtctgcaatgagaggagaggagtggcttttggtgatggggcctccccctttcttgcactttggtggagtaggcttgaaaatggttgaatggcgtggccgactactggttactggtagtgggtagagaagtgcagaggtgggtggctccagctgaaaacctcaaagtagtagtagatgagagaattggaacaattaacaaatactcctcctctacttttttttttcggttagaggaaacaaattggatatttattaattgtattataatgatttgataatgaactggagtaattggatggtcatttattgtattgtaatcatctgataataacagctgtcactatgaagagaaaaccaccaagttaaaataaccctctaccttttcagttaacaaattggttgttcattaattgtattataattatctgataataacagctctctctgtcaagagaaaatcaccaagctaaaataacactctacctttttggttaacaacttaacaaattggatgtcattaattgtattgtagttacctcctaacaacagttgtatctgtgaagagaaaatcaccaagatgaaatactcctataccttttttcagttaacaaactggatggtcattaatagtattataattatctgataagaacactcctacctcttaagttaggaaattggaatctctctaattgtattataatcatctgatagtaacagctgactccttgaattgaaaaccaccaagttaaggtaactgctagcaagaggtaatcttgatatcatttgctacttgcaactagtagtacaaaaatactcaagattcattttttttgtacggaagtggttttgtctgaacaatggtcgttttcagaggttgctaaacacctgtttaatagtactagtacttctacttgtgtagccaagcaacatcatcctgccctccttggcacggagagcttcccttccacgtgttctgggtagctagggccacatcagacgaaaaacaatatcctgaatttgctggtccattgctctggaccatttggttggtcctttcagtttatgagaacgattctttgcaaagttgcaagaagattgatggtgattaatgaagtatagcactagtgattggaacaatattaatttcagaaacattgctgcttttatgtccccaacgccccaactactatcggttgcagtatcttcatattccaaaatagttgtggtggggtagtgagcaataacatttttcataattcagatcagaaagcctagcgttttatcaaaatagctgtgtttcttgaacacaagttcgtcagttctcacaatctcacttgcatgtgaaaattcagacaatcttttcctttctgcttgtgcagaatgcatggaggctaatttcatttgactactgacgacctaaatttgatggatatgtctgaacttttttggctgatgaatcatttgctgagttctaatcattca

SEQ ID NO: 76769 - DNA, 6404 bp, Oryza sativa
  unsure (1)..(6404): unsure at all n locations
catcatgatctggaagctgaacaaatccggcatttacactccaaggtccctctgtagggctattttgtttggggggggtaatagacacaaacatgcaggatctttggaagatagcgcacccctaaaagcaaaaatttttctttggctaatgcttaaaggtagaattcaagccgctgcccagttaaagaagatgaactggaacggggatcctaactgcaaactctgtggggaaaaagaagatgtggaccatctgatcttcagatgtgcgccagctagatttctatggtgttgtattagagatgtgtttaactaggatgtggtcccttcgtctagggacgatattgttgccctgatgcatggcccaaagaagaaatctttgctcgttttcgttgctgctgcatcatgggcaatttggctaaccagaaacgacttggtgtttaataacaaactgatgaaagatgttctgcagctacctcataaaatgctctattttttaattctaaaattgttaaattctataaattaaaactaaacaatcatacgtatctatagtcattatattgatataggttacatatctctatctattataatataaaaattgaagatgtttttctcgagattttggtacatatgtgtttaagttagtttttagttgcataacgcgggcggttcgtttatatcgctaaatattaattaaccgtttgtatcgaataccaatacggtgtggtgttgtggacgtagctaatttgcttatgccgatgaggtcacatctaagtctaatctaatcaaaactaattaaataataataactttctagtcgtcagcaaaaattgcgtctgtgtcaagcggatccgttaacttatatgaatatgtgattggagtccgtttcaatttgtgaaattcgtggcaagcgcataattagcattctccagcgcatgctcctccgatccgctgcggcgtccttacgggcggcaagccaactccgtgagccacgtctgagagaccacgtcagccatctcgagatcgtncagcccgccctacctcgcctcnttttatttctctctttctgcaggatttcctcgaccacactgcctactagaggtgaggtgtaagtgagtcagccgcgaactcatttataggccaaaataagcggntttgtagtttattttagtctatactaaaaaaatgctcgtgcgttgcaacgggtgaagtctattttaatcttattattggtatatggtttagataagataaaattcactgtgcgagttctcttggatatatatatttttagaaaatcatgagctgcagttaggagttcaatcatctcaagttaacatacgagtttttttaaataaatttcttatatgattccttttgtattaccaaaagtgaacaatcttaaaaaccgactcaaatacggatatgtatttctaaaagcaaacgaacttaaaaaccgactcatacacggatgacataccaaaatactgacaaaaacattttcaatttttataatagtagagatagagaagatatatagattaaaaccaaaatataaaaattaaaaccgactaaaacacgcatgacggaccgcgtaaacatctttaatttttataatagttttagaagatcatgagctgcagttaggagtccggtcatcttaagttagcatgcgagttttttaaatagatttcttatatgattccttttagattaccaaaagtgaacgatcttaaaaaccgactcaaatatggatatgtatttccaaaagcaaacgaacttaaaaaccgactcatacacagatgacgtactaaaataccagcaaaaatatctttaatttttataacagtagagatagagaaatgggtttcgtgggttagccgcttacaccccgaccgcctaccatggcgcgaaggcacaattttcgatgccacgcgacggcacgccaataagctgatggagagctgcagcttcgtcgtcatcgttgcttgttgcttctacgaagaaggcgccatgcatgtggaggctaggaggagtgcagcgcgacgtgacggatcgatgaccggccgcgtgatctccagactccgcatgcaccgacctcgccgtgcactaggccagtgctgcacgcttgctggttgtgtaggagacaggagagatatagcagggaacgcttgacatgtattcctacatgaaggtggagaagccgcacgtatatggcacgtaacgtggttaaattatcggtgccgagaagatccataccactgttccattatcagctctcgcggcgcacgtatatgagacgtaacgtttttgtcctcgtttcatataaaagacccttataagttggccccacttatactcaactagtgaggttgtgctaatattagtcctaacttatttttaatggtacgggtttagaaaagtaggaaaagtggttggatgaaaaaattcatactttacgctagattcacatcttagtcctagcctatatatttttagtgctgaggttagttgcaatgcatggccatactactagtagagcagaaattatgttaagttttctcgtgtaaaacagttacttattgctggagttaattttgctgaaatatgaaatatctagctatattttcaggaaaaagtgatacttttgataagatttttttcgttttatcgatcattgtctaaaaagttgttgttttatcaatttgccacataatatctgttggaggcatgccatgaagcccttcggccgaacctgccgaaaccatagtaccagtaaggattcaagccaaagacgtcaagaccattcaggcgaagccctatggtgaaagccataagcgaagatggcgaaggctggaaagccgcgtcggtactccgaaagtaaaggcatcttgggcgaaggcatctcggacaaactacaaagacttcgctatgacgagttcggcatcaaggaggcccaacaggcctcccccagcctttaaggcccgttagccatagaccaggcccagcctatcagcccattaaaggcccatatgtgcaaatgacactgcatacccatgtaaatgtccctttcataagggcaaccatgtaaaatcccctgtaaccctaaaccctagaaggtgcaagcttgtcctaaggctataaataaacctctagggccatgtaatgggggatccccaaaaaattttacgaatcaatacaattgcttttacattccaactactgttgagagaaccacgcctttcgatgtggatagttgtccattcgacaacagctggcgccgaccatggggaacccagaccgaaagggcgaaatgggaccccttttgccacacccacacccttcgccacagtacctgcgaggtacagcgacaagggctaggggcgaaagtgagttaagtccaagctggggggctacgaagccgcccaagcctctagacacctttcgccacacgccacgcccttcgccatagtaccaatgaggtacagcatcaagggttgcggggaacaggtttcgcccactcacgccctttgccatagtacaaatgaggtacggcgtcaagggttgcgggcgaagaggtttcgtccacccatgcccttcgccatagtgccaatatggcacggcgtcaagggctgcgggcaaagaggtttcgccacacgccatacccttcgccatagtaccaatgaggtacggcgtcaagggttgcggacgaagggatttcgtccacccacgcccttcgccatagtgccaataaggcacggcgtcaagggctgcgggcgaacaggtttcgccaacccacgcccttcgccatagtgccaatatggcacggcgtcaagggctgcgggcgaagaagtttcgccacacgccatacccttcgccatagtaccaatgaggtacggcgtcaagggttacgggcgaacaggtttcgcccacccacgcccttcgccatagtaccaatgaggtacagcgtcaagggttgtgggcgaagaggttttgtccacccacgcccttcgccatagtgccaataaggcacggcgtcaagggctgcgggcgaacaagtttcgccaacgcatgcccttcgccatagtgccaatatggcacggcgtcaagggctacggacgaagaggtttcgccacacgccacacccttcgccatagtaccaataaggtatggcatcaagggctgggggcgaaaataagttgcttccaagctagggggctacgaggccaccctagcctctggagcctttcgccacacccatgcccttcgccacagtacccgcaaggtacggcgacaagagctggggacggaaatgagttgcttccaagctcaggggctatgaggccaccctagcctctggagcctttcgccatacccatacccttcaccacaataccaataaggtatggcgtcaagggctgcgggcgaacagcttttgccacacgccatgcccttcaccatagtgccaataaggtacggcgccaagggctacgggcgaacaggtttcgccacacccacgcctttcgccacagtaccagcgaggtacagcgacaagggctaggggcgaaaatgagttaaggagttgctcccaagagcagccgaaagagatttatcatttttcaagatgctccgaggggccggcaaactcaattggacacatgagtgtcaagccgccttcgatgggctaaggcagtaccttcagcattagtgtaaaaatccgttcagaaaagcattttctgcagattcggtgtgccgaaagagttcattaccggcaataacaagcggtttgactccgagaagtccaaggaaatgtgcgaacggctaaaacttgaaatcgagttcgcatcggttacacacccgcagacaaacggggcagccgaaagggacgaatgacaaaaccctagcagcactaaagaaatgaccgaaagccggtaacagttaaaaaggtcgaaatgctaaaaagaccgaaagccggcaacgtcaaaacgatcaaagtacctaaaaatacctttgccaaaggcaaaaaggggaaagtacgagccgaacagccgtaacacacaccacaacccttttatttgccaaaaagcacaagttacagataaattccattgcccgccaaaaggcattcggactttacatccgattcattaacaaaagcagtcctcaaatggcgaaggactacccacttgagcatcttcttcatcgctagttgttagatcaacacaaaaaatttagcggtgaagaaggaaaaacagggattatgctgcgtcgacgctaggcaatggaaaactgacgctcagtcatataaaattcataggtgtgttcgccttttttgtgtatgatatttcgtggaaaaaccccaaggcaaacgtttgatcgacgaaaacgccaggggggcgatacgaatcggccgaagcacagctcgccgaacgttgaaaccgcgacaactcattttcggaaaacataccgatcgtcgctacactcgacttatgcaaatacttaagcgtttctagacgcacatgccaaaagtcgagagcgaatgatgagggctggaaagtcaatgtgaattcctttcgctaacatgcaagggggccgacacgcctcgcccttccgaacgtacaagttccaaaatgtgatgatagcgaaaagaaacataaaaacacgcacaagctccatcgggcaaaagcacatacgtgttatacaaaggagcaaaaaattacataatccgtttcagaacatttttgcctcgcccctactaagtcccgcgaacacggttcgtcatctatactgtacacgactctaaggggggaaggaagcgaaatacacaccgacgtcaagcgatacaacttgacgattagtcatttcgaagtctaaccaaagtgtggcaatgtcatcgcggcgctggatgtggcaccggtcgtaatcctctaaggttcgaccaggatgtcttcgcctccaattcgccattttgacaacaacatagctacataaaaggcgaacgcttgatcgacgaaaacgctaggggggcgaaacaaatcggccgaagcatcgctcgccgaacgtttaaaccgcgacagcttgtttcggaataaagataccgaacgccgttacattcaacttacgcaaaacacaagcgtttttcccagcgcaaaatgctacgagtcgaaaacggaagtcgaaagctgaaaagtcaacaaatcttttcgccaatccccaaaagggggccgaacgcatgactttcggcgaaatccccgctaaaacaatagggaaaaggggaaagaaaaaaatacaagtcaagaatcgcgcaaagcagacaaacttggcaaaatataatcacctagtgtcataatacatcttcgccattctcaaaaggcgaacgccagtgttcatattttttctgc

SEQ ID NO: 76770 - DNA, 1109 bp, Oryza sativa
agcaaacgtggtgcctcctttcaaaactgtatggcacagtaatataataaaatggttttagagggaaccatttgaatatgtgtccgatcttttgagttgtgtcattgttgttatttgtaatcgttttgtgatcagatatggcggtaaattttattttgtttcagtcaatttttttatcgttagagttatcctgggattcatgctatttgggggttctcaaaggagaggacagctctcagagcggagtgcttgatgtagttaattgcatgtgttaccagtcatgatgcatggatacgtgatattggtacggtgatacgggaattttgaaaaacatcaacatgacgatacggtgagtatataaaaaatatttttaaaaaactaaaatatagagaaggtaaaacaataagattaccttaacaaaacaaaattctatgcattgttgcctcttacaaacaagtaacaagcttaacaccttgtaaccttaaataataaatatggtcagtactaaacttataaaatatattagtagtgtagcattggggttttaatgggctattgaacaagtggttatagggctaggtatcagagaagtatccaataagtatggtacgagtatcgttaattattttttattttttcactgtttagtgtccgtgtccgatactccttcgataccgtatcgatggagtatccgatacacgtacggcaagaaaataaagtatcggtgtttcacactcagtggtgagtatgggtgttcttttagtatttggtgaggcttccatgtcttctcccactcgttgtagccttctgccagcagtgagtgatgatgagtctgcatcttcttgctctttgaccagtgtggtcacgctgtgtgcgcttttgggttggtttgccctctacggttatggggtagggatgtagggtgttgattttgaagtcatgctgggagagagtgacggaggaaggtggtttcagggcttagtgaaatgaaaatttttgggtgtcacatcagacgtttaaccggatgtcagaaggggttttcggacacgaataagaaaactaatttcataactcgcctagaaatcgcgagacgaatcttttgagcctaa

SEQ ID NO: 76771 - DNA, 9232 bp, Oryza sativa
  unsure (1)..(9232): unsure at all n locations
tccccccacgtcgccaccaccgctgccggcggaggaacgcagcgagccgcctcgggtgggctcgccggaggaagtcagcggcacaactattattgcaaggactaaacaagcatgaaactagcttaaagatgggcctcatgctaatagggccagttaatcccttcatcctaaaatataagtcacaactatttttttatatattttataatacaagacgtgctcccactctcctttattttttttctttaaatcctcaatctcaaaatctctaattccattgagtgtatgtattgtatttactaggtgatactccgcgctttgctgtgggattcatggacgagtatatgctaaatattgtcaaaatgatgaaagttgaaatgttaagaaaataatatgaggaagatgatttgacacatacttgtcgatttctataacattatattgtagatgattatgctagaatagtaattgctagtgagtgaagatgtggcatgcttgcatgggattttaaataggctaaaatagtaattgctagtgtgtgatgatgtggcatacttgcatgttgagctttagcttataataattattattgggtactactatatagaaagtatagatttcttggttttgtgctaatagtagttgtgccttatatttttgtatggagagaggtattaaacaaatgatgcttgtcctcgttcctcatgcatagaaaattgtagcaagagatttgagtgggttttctttcttcccatggttttcagtggtgaaggaagcattccttcaatcttcctatgatcattttgagtggtccgaatggtaggaaaggaaacacttcattcaccctaatttctgggtgcacgaaatcaaggagagatggtgacacagttgtttatactggttcaagccctcaatgcgaggtaataccctagtccagttgtttgtggattgaatctgtgtcggctgtgaatggtagaatgcataacccctgcgtgtatgctgggttctggagatgatacccgatctcgggacccctaccccctcttatataggataagggggagggttacgaggaaagtatccagttgactacaactagatctccctattctatctatataagatatgcatgatccccgagatttatattttatcccgagaatatctcttacttaatttataacatatccttgtgggcctagggctcttggcccactccatgtcatacggcccaaaggcctctccttgggtacccgagtgccgtgtacaccacactctgctctggccggcgtttcccgtcatgccgcgctagctcttctgtccctaaccccctatctccttccataggttgcacccgcctctgtctgccgctccctgctcgcaagccatagccgggacctcgcctctgccgcgacccgtgtctatgctgccaaaaccccactgccacccttgccgttcgcgccaccagtgagctcccagctccctcctacgcctccaccgcttccttctactgcttccccgcgccgccgcttgtcgctggtgccaccgccagtggctcatggcccgtgcactgcctccttatatattttctattagggatatataaactaatatcattaatatgtcacaataattactactccctccgttttatcttattataagtcggttttaactttttttcaagtttgaccaagtttatataaaaattattaacatctacaacactaaattagtttcattaaaattaacatttaacattttttacaatatgtttgtttcgggttaaaaaataattatttatttggttaaaaacattagtttaaataatatataataaaaaaaaggaaaactcaattagaaatggtagaaaaagatataaatatctcatatttcgaggtgaagtatccctgcataattgtgccaaagaaggaagagaaatcatcatgatgggtgtctcgaggatatttccccgtccactctgtgttgactccgactctttgtgtggtgtagatcatctagagttgttgctaaaaaccacctagtatggttgcaaaaatttctagcatctctttgtttctactagctgtgattaatttatcctaattaactctcttaacaaatattgatgtagtgagaaaatatttttcttttcaccaatgagataagcaacacaaatatgtatatccccatgagttcagtttatcctcattctacatattgaaagaaattttatctctcagaacgctacttgaaattgatctaataaaaaaaagagaagaaaacatatatgttttctagatgagaaaattacattgccggtacatgaacttgtcaggggagtgcaatcctatgcatgaacttgtaaaatacttgttttggtgcatgaacttgtctgatgcgtgcggatgaaggtgaaaagaactctacatgactaatcttattgatttaggggctgattaggatatatatccttcatcatatatatatatatatatatatatatatatatatatatatatatatatatagaatgggatataatgatagtagaaaaaagataaagagaaagctgagaaacgatataagggttagcaatatatatgatgaaggataaagtagagaccaaatttatacatattgtcttatgcatactcagtacacatatgcatgtcgcatcctaatcaacatccgcttcgtaaagtgtacattgccaagttaatttggtccttaatcgcacgaactagacaagttcgtgtactgaaataagcactttacaagtttatatattaaattgcacccaccgaacaagtttgtgtactaccaatgcaatttaccgtttctagattgtattgtgcctgcattttattttgggaaaagagtgtgttatttttttaagtgttggctggagagtaatcgctataatgaaagagttcatcccctttaatttgacactaataaaattaattaggtgtgattgaggtgtcttaattgatcttatcggtagaaacataagaatggctacgagtttgccaaatctttctataggttgtcaaatgggctgggactttccttgtctgacctagcacgcatgtgcaggtcacagcccaggaacaacacggtttgtttggctataggttgtgctggcacgacccatctagccaacacgacatggcccaggaatagcacacagcttggcccgttgttgacagaaaacacaaggcctgggagatctgcttaactccagtgcaggtccaaagctcgccttcggatatatgagcatgccagttgatttgatcctgcaatcaacaagaaatagaacaaaggaaccgcaattaatcctataaatgatagccgatcggctaggtgccgatgacatatcatttatttcaagccgatgtcatgcgtgcatcgatcggcaaatatcaataagcaaatcagaactaaatctactcgatcggctgtaaatattaatgatatataatccttatatcgatatatacttaaatcaagtgattgggatagatcggtcgccttaccgagacagtataaatcacttaaatcgaaatatatattaatagtgggattatacgcatttatagcatagccgatcaaatggatctagcgtgtattggctaatactccgatactactctatattaagatgttaaagcaagtaaaatataccaaacagaagtctaatatacttagatgcgacaagatcttaacataaagggcaaatttaacatatagattaagcatatgaaataaaagtagttaaatcagataagatcggctaaaactccaatactaccctaatcggcaactagaaagcaggctagagattgcaattctaagcacgacttaatagatcaaactcaactgatgtagcattaagtatgaaaagaagaacaatatctggacaatcaagccgctggaagtttcatagagtggtagatatatcacaaaatctaagttaacgtcattgtctaacctaatcggctgccttccattaacagatgttagtcgattacatgttagataaagatattatcgaagattatgtaagatatatgataactcgacgaattatatagataagattagagtatcataaagatggaagcactaatcctgagaacataagtcgtcatgacaagttttacctcttgttgaagatcggaaccgatgcagctcaacccgagagcatgaactcatcgaaagtaaagcaaaaagggtggcgatgcgccgagattgtattagatgtctttttttttgttttttacatagggctcgggtctatttatacccgagaattacaagatacatccataacagacacgactattatctctaacaaactctaagataccataagtctttacggcagacttctgcccaaacatatctctaaggaaattacacagaatatcctaattaatagatacaattgcctccccaggactctatccatgcgtggcaatcatcttgaagcacatcaacttgaacccgatgacgtacaccgagtcatattatcggaatcggctgtatcggctagccccgtccgactcgaactctgccgacctgaccttagccgatttggactgcagccgattcttactctgtttccgcaacgatcttcatcttggattccacttcgatctgatcttcacctccgatgccaatattgatagaatttaccaaaggagaatggaagaatcgagaaagccaggggctgagggcagaggaagcgatggtggacactcatcgacgtaggactagacggtagcattgtggtgtggccaaccccattctcgagcacgataactaagcatgtcggtcattgggggctcaccggctcggggagaagtgaataggaagtgaagggtcacgatggtgcttgaagaggaggaagataaatgtgctattagtgagcggaggaccttgctagagtttcgccgaagtttgtgcgactagatgacacggactttgttcgcattttttcttggtatatatatgaaatttgggctaaccgatctccacacaacccacgtaacctatcgtgccatgccaatacgacatgacccaacatctcattaggctccgtgcttgggatgaaaacggagcggatacagacggataatactcataccatttttatttccatattctttgtcagatacgaaaacgaatacaaatagctcatatacggacgcaaatacgaattatatcgaatacaaataagaatcgaatatgaccggacacgaatactgagacattttttctgtcggaacacgaaaaccacctcatcttcatatataattagttcattttatataaaatatagtatacgtttcaaaaatatttaaaaatttaaataatattaataatatggactagtgttaagagatggcatgctattaaaatctagaagggtagatcgaaggttgtagcgttataaagaaatgaaatatgtctcatgatatcagtggatatccgaatagagaccatgtgcgtattattatctgtatccgtcgaaaaccctaataccatgtgcgtattcgtatccgggagaaaatatcctattcatatccgtatgcaaactatgcgagaattatccgctccgaaaagtatccgtattttttctcttgagtggacggaaattatccgctcgttttcatggccgacaaagtacggctcgttccgtgagccctgccgaattgggcagtgctcaaacgtaactattatttatctactatattaaaaaagttaaataaaaattcaccatctcagagggcaggtccggctccattcgaaaaatgggattaggaccgatggacatacataatttctatttttctgatttccaacgatgtgatgtgcaagcaatccgtggtaggcgaaattactaaattaccctcgcgaagcctcctcgtcagtttgcctttgccgaccgcctccgcctccgcctccgcctccgccgatccccatccatcccgcgagcgagcgagcgagcgagcagggcgccgtcgatcgtcctgctgcttccgccgcatccatcctggtgagcacatcctccgccaccgccgcctgcactgatccccatccatcgcgcgagcgaagcgagcaggggtcgccgtcgctcgtcctgctgcttccgccgcatccgttgcgcacgtcctctttcccatctctctctctatacccacgcgctttttctcgaatttgtgttaaccctagcttctgttctagaaattttggcttaaccttaatactaataacagtttgatggttcccaaaaaggtttggggccatgccccatgttagatccaacacatgtcacaccagttctaataattaggggatccgttgatgaattttaggctattaactatatagcaaacttgctgagtttttcttctttccgagatatatgcattgtagtccattaggtacagtattgttctacacaggtttacatcaaatttatatgtattttcctgtaccacacatgccaactttcaggcttcatacttgtttctgaacctagacaatatggtatcttaaaaatgtgatagaaactggaaaaatgaaatattactaatataggtgaatctgcctgagttgcatcatgttcaagtcctcataaaattgccaatttgagaacagaaaattgtgcatctttattgaaaggtgtgcattttatttacctaaaatgtaagattttcgacctcttctattaagctgtgaaattaccagtcctatctgatatttgtataccaccaagtagctgggtaacattcacttgactaataataattatctaacctatattttcatgcactccaactgatctggatccattttaagaatatgtcttgaatttccaatgtacgcgattacctcatcgtgtactcacctatttgtaaaatgtcaagccccccccccttctttttttactctcttcccaagttcatgtgtgtactggttgttgaaaagatggattaagaattagcacttgtttttgatataattttatttattgtaataattttttttttgagaaaagaagaacattccttctaaccttcttgaaacctgaatcagggacattcaatgtatgctgtgcaccctgttcttgtacggactgtaaccgttcttcagtcctgatggagtcagaagcaggcagtgcacctaatggttgtacatctacagtaaaggggtcagaagagaggcacagtttggaacgtcgtcatgatgatggctcatgtatctcagagattaaacttatttctaatatggttgtaaagaaaaagagggggagaagagcacctccatcttctagaagattaagtggtaataaggttattagtggtgaagatgctgttcaaaatcgcaaccatgctaaagaagaagaccaggctggtaaaactcagtctaatttatttacacattaataagaaaagcattattgccttattggtagaactggtggatttaacttaccaaaaacttgtctctcaggtaattcttctgatgtggcgttgtcgccatctagcaggaagacagaaggtcaagatcagtcgacaaaccccaaagatttgtttgagaaagcttgccatcaagctacagagatggttactgaaagcacaactggttgcaagaaatccttttgggaagaaaagggaagtgataataggagaggcaggcaagctacactttgtgtgaaacaggatgggcttgatattgaaacaacaggcaaggatgtctctgcaagtgaagcttatgaaaaatccagcacactggaagatacttctgttgggcatgcagcagcaaagagtgttaatcctgaggataattctctagatcctatggataatgtaagtttcagttttccttttttatctgcaactactagtacatattttatccatcaacagatgtccagtattttctttcttttttgtggttaagtcatgcttctgtcataatctagcaattgatgtttggcaatttggcatgttgatccaaacataatgtgtgtatacagtttgatttatattcctttgaatttgtgttcaaaattaaattccttggacatggtttcaatatccattaggtgtctgatacacatgtgaatgccacatcttctgaggacaaaagttctgaagaagttgaggacgtgagttcaaaacctttatttttgtgcattaaaattatgacaaatctttttgtgtagctaaatattttgtttcacttgacaacaataggtgaaagtgtgtgacatttgtggagatgttggtgaggaggagaggcttgctgtttgcactacatgcaatgatggtgctgagcatatgtaaggcttatttgttccgttgctttttatgtataattactcatctttgattgcttgatgacatgccatgatggttaagattgttgcacttgtagtttgcaaacaagccacaattaggatgcctgccctgtgtctcaggacaggaataaactactactgttattatgcagacaagccagttaggagtattattttcagaatatttttccacattgagaatatgggtattgttaatctacttaaattttgtctcatttctttgctccagttattgtatgcgggtaatcatccaagaggttccagagggtgaatggttgtgtaaaaagtgcgaaaatgaattggaatatgaaaagaagaagcaactagaaaaatctcagctgaaggttggtgcctcaaaaagccagttctttgaaaggaaaaccaatanaattgccaatgcatcaaaaagcaattcttatgaagatgaaccctcaaaagcccttgaagggaaaattagtaaacctgacactgctttgaagaacagaagttcttttgaaaatgaagtggagaatgaaaatggagataagaaagagttgaattcaacaaaccaatgcaataatagcaattcgaagaggaaggaagaaggtgcagggatcatttcctcgattaaacaaagtattactgaacgctgtggtttctccatgggagctgagtccagaaaaaggttgccattgtcatgtgagagctcatttcggttggatgtagagaagggaaagcaagccgctaccaaagtaccaacttcattggcatttgacgctgccaagaatctgggaccaccacttcgtggtaaatttttttccattattactttcaattcagacactttacctatgtaaa

SEQ ID NO: 76772 - DNA, 781 bp, Oryza sativa
tcttagtcgacggcaatcgcagaaacaagatgttgcgtcacctgtaatgggcctatgggcttgtaacttcgtctgggaccccggcccaagtggggcccatgtggggtgcgccccaacctggtggagaacgaccctacggcaccgttggtcgtcctcccacatccttaaatagctaggtaccccttcagggtttctcgggttttgatgatagagatagctacttgctaccggctcgcagcgcgcgtgttggctaaaccgctcgtcttcctgtaatcagaacccccaccatattgtgttttgatagtgaaattttcatctttatctagcaatttcagtgcttgttctacttgttcttgcttgttcttcgattgcttgcaggacgagtgccctcgtggccgggttgacgcgcaccacaagttcgcggcgaccattggagacagtgtatcggttgctaaggcgcagcgtctttggacggttgtagtcgggccgtgaacgtcgtctttatccaatcgagttatcccctacctctcatcgaaagatcgggccacaaaccctagcgggttcgcatcaggtggtatcagagctttcgttgctcggtgagtttttatctacccataaccagaaaatagcccgacaaaaagaaactgcatcatttacctagccatattgtgccattgcatagttcttttcagtttttgctttgccgaattttgtgttgcatcgtcacgtcatcttgctggtcttaacgtctagttagtttagagtatcgagttctggtcac

SEQ ID NO: 76773 - DNA, 741 bp, Oryza sativa
tacctctcatcgaaagatcgggccacaaaccctagcgggttcgcattagtataagagtatgctaacattcaaaatttatcctaaacaaacttgcccacttattttctcatctcaatcaaattacaaccatcactcacttaattccacatctctccttaatttcataaaaaaagaacttttaaaacacataggagtagtagaccttttataaacatctacgctaataaaactaagatgaagtaagatcacttcataagcaattccgtttactattttgtgaattactccctccatcccaaaataaacataaccatgagttttcgtaccaaactttgatcatccgtcttatttaaattttttaatgattagtatttttagtgttattagattataaaacataaatagtactttatgcgtgatttatgttttttagctttttcaaaaaaaaattaaataagacgaacgattaaagttgggtacgaaagcttatagctgtgtttattttgggacggagggtgtatatcctataataacctcatagttacagttaatacataattacagcatcgtgaatctttgctgatggtggtggttgctgatggtggtgcggcccgtgacgagagagagatggaatttagagctgaccaggtgatgttaggtcgtacaaagctgtcttgggcgtgatccatgtaagaggagaccagagaataagctttgcctcactgccaggagacaaggcaa

SEQ ID NO: 76774 - DNA, 1315 bp, Oryza sativa
tatacatgcaatatttaagtaggaataccaaaaaataatgtgttgaactgttgagggagcgtcagatctccatcgatctgcctcgaatgataaggggtttagtatataaatttgatctagaattaaaatcggttggcctttccttgggactttggccgacccagtttgctaaaaaatcatttgtccagtatttcctctgttgtataatataagacacaactactttttttttatgtttcatgatataaggcatacatacaattaattaggacatcttctccattaaattattacttttttaaatcatccaccttaagatctctaatttcattggatgcatgcattatatttattagggtgatccaaactaggagatgataataattatttcttgtttttttaggttaagggtggttgtgccttatattttagaacggagtattactcaagcttatcagaaagaagaagctccccgaaaaacaaaaaggaaagaagaagctcccctacgtaattgcagcaggagaagatcacacccctgttctttgtccagctggtaactaaccagtatgagagtagtaagcatgtttctcaagctggtaactaaccttgtaatttttagaaaactttatacacataaatctattaaaatattatcttaaatctatttttcaatctcgtaacagttaattaattcatttgcttgtaatatcgaattattcatctatttagaagtccattttattccattattcagctcagaacaacacatccggagttagcgagcaagcgagctacctatactttattattatcatctttgctaattaattaattgcagctagatcgctcgtttccgtcgtttggttgagtgtatatatatggatgaatatatagtgtgtatgtacatatatagatactgtcatatatacataatgtggcggctaagagtcgcggaggaggccggcgccggcggcgaggggtggctgagctccaccaacgcgcacgtcggccggcaggtctgggagttcgacgccgccgctgctgatgacgatgacgccgccgccgcggcggaggaggtcgaggcggcgcgccgcgagttcacccgccggcgacaccagatcaagcacagcgccgaccttctcctgctcctgcaggttgtatacatatacaccttggcatttcaaaataactcaatttagaatgtgacagaatctggacgtagacatatccagattcgttggctaaagatatgggtcatatttcatcgtaagtttagttattttgatacggaaagagtgtacatgtaatggattgc

SEQ ID NO: 76775 - DNA, 2411 bp, Oryza sativa
aaaaatattcagacactcccgggctctggcggagggacgaccaatgtcaacgcgctgcgctaatcacgcgcggtcagacgttgactaccatgaaaatgccacgccagctgacacgtcacccacaggcaagtaggcccactggactttatcagtgggccgagatatgggccttcgtcgaccgacagagatagtgggccaagaaaaagtaagtagccagagttatgggcttaatggaattatgggccgtgtaggcgatgaggcccactagagcccacaaaaagcccaagaggaaggccccgtgtccccgtctcgtcttccccttccttcctctcgttccccttcgctttgccctcgtgcgacccaaccaatcaggcggcgctaatcctcgccgccgccgccgccgcctgccatggccgcccgccgcggcccgcacgtaatcaagctgcacgactccgccccggcgctgctcggccgcgcgccgatgccgccgccgcctggcccccgagacgagctcccgccgccgtcggccgtgctggtccaccacccacgaggggggctcgcgccccaccccgccgtcgcggcgctcgaggaccggctcgccgtccgcgaccgcgacatccaggagctcctcgtcgacaaccagcggttcgcggccacccacgtcgcgctccagcagcagctcatcgcggcccagcacgagctccgggtggtgtccatcgccgccacgagggcgcgtgccgagcgcgaggatgaggtccgcgcccttgcggagcaggccgcgcgcatagaggccgaggctcgggccgccgtcgccgcgcgcgcggaggtcgaccaggtccacgcggacgttcaggtgctcgccggcgcgcgcactgaactcgtggaccggttgcaggacctccgcgggcagctcgcgcgcttccaggccgaggcgggtaagactgagtccgtccgtgcccaggttgaaaccatgcgccgggagatccagaagggcaggtattctgttggtttatctcaacccccagttttaatgctaccatttcaacactaaatgtctgcttggattattcgtgatttcgtgtttacattttgtgaatgcacatgagtgttccatctcatgcattgcaaggaagaaattgtgcacttcatagcttaactttaggcctgatgaggataatgtttcacagagttggcgtgagcccgtgacttgagcacattgcttaagcgagttgtgttctttgttagtcaatcgagctgcttagagcttctacattttagcaagtcagtttgtgtttagttagagtaggttgatgatgcctcagaatttcacttagacatgtagcctgtttagatgctagtatatttgatcaatctggttttccagaacctttcgatttctgcttgcttatgtttgtatgagtccaaacctgtggcctatacatgatcacagtactgtgtttctttgtccagcaaattgctagctctatatggcactgttgtcattttaagcataattgaagtgtattagataggatgtccagggtgagttgttgaacatgctttgctcatgatttagctggagactagaaatcacttctatttcacatgttatcagcagtagttattttcacaaaaaatattcacatatacctgactaagtccagatagtctaggcctaggaataggattcttgctaagggtgttaattctgataagcctagtttccatggatatgccactgcatcggcgcttccacgcacaattcttaactcttagtcacaacactttcaagttcgaaattactaaaatgagctttgctcatcataaggcataaattataatattgtatgctggcagatgattctttgatgattggagtggtaatgtactgcccttgaaagatgaaggtggtgagaactacctattgctttcaagcactcccagctagtgttctaaaaagtggtcgtgcagccgcttaaatatggatggccatatcccatccatgcatgaccatgaaccaaacacaccctaagtgtacaaggttgccaaacctttctgagtattgtaatcgcttcgttttcaaggcttatgatgttaagtgggcagcacatgcggatatgcaacccatttaccgcatacaaggccgattaaggatgtatttggttggagggattagagtgtataggatgcgatagtacatgatacaactcagttatttgcttagaggtatggaaacgtacaacagtttgtctggttacttgtatgatatgggatggtatcgtacgggaattcgtttggtaggatgaatgaatttgatttggtaatacaaattaaccccatacagtaatgagctccatcttttgcctttcagcttattagccgttgccaaaatttgaattttaaaacttaat

SEQ ID NO: 76776 - DNA, 556 bp, Oryza sativa
cgtgttggatcccacaggagttttaatgctgcctgccattatggctcgtcgcgcccggtgccctgaaaaatgaaaaaaagttgaagtggagggcaatggaattgtctggtgcacgccagtgtgcatgcaatgcacatatggttcgttgctgattggccactggtgtaacgtagcctaactaatcttacccggtgcacttttccgcgttgttgttgctgttgttgattcctgattgtggctgtcaaatccaacgtgcacggtctggaccgtgctccctctcccggctgcgcgcttggctggtggcctcaaatggctaaactatccaacaagagggtacggttgttcccttttttacgataaagaaaacctgttctgcgatgaagatatttataagtttatttggttttagctactagtacaataagatatgaatggccatgtgtcccatacactatacactgtctgttttaggaatacatcttataatacttattatactagtaaattatatggtgttaaatattgctatgtatattataaaaaggtttcattattg

SEQ ID NO: 76777 - DNA, 583 bp, Oryza sativa
gtcccatccatctgtctctatttccttttctcccgctgctccccacctctctatgtcctcctcctcttgttcttcatccaaccccccatggggaccaccacctggtgctgtggttgctgctgctcctgcctcgccaccgctcgaagccggtgagtgagtcgtggtcagtccaggcgccaacgatcgagctgagctatagccagggtgaaccagaaggcgaggagagttggtggtgagttgaactggatcgaagtccgaagagggaaagagggtggaagtgtttggttggcttgccggtgtggtgaggattggacatgttgttggatctcaatgtggagtgcccggaacgggtcgggcacgtcgagctcctcggtgctaaactccgggaacccgggaggcggcggtggcggtggcggtggcggaggattattccggttcgacctcctcgcgagcagccccgacgacgaccagtgctccggggagcagcatcagttgccggccgccccggggatcgtgacccgtcagctcctcccgcctccgcctcccgcggcgccgtcgccggcgccggcgtggcagccgccgc

SEQ ID NO: 76778 - DNA, 2089 bp, Oryza sativa
atatagtgtccatgagctataagatgcctcttgtggctggagctgatttagttgctgttcgaaattatgaattaccctccaggtctccctagtcattagcaatctatacatttttacgttttgctacggcagtgtacactatatgctgaaatatggatcataatctcatgggtgtagtaactctttctgatgaaatgctctcaattcactggcttaagcaatcagcatagcattcacccctaattcaatatttccatggctagactccactggagtgtaaatatagcaggcttgttaacattttctgtctgctggattgtgctctactgatttaagtagtagtcaccacaaccatatctagttgcatacatctgtttgctatgctattgccttgtaggagtattgcatagtggatgcatattagacgcatagtgtttcccttgggaaatgttttccaattggaggcgactataagaggtggtgggacatttgcgtttgcccttagcctgatcgaacttaaattgcactgtcgaatctcttttgctgctttccctttagcaaattggttgttcatgagtgatgcttgcagtaaactggttgttgagtcctcaaaattcgtctcatacttttgggtagttgaatcttcttcaatggagtgatctgtcagacagagttgtacctatgtacttttagaacaaaagcaattacactcatcttaatataccactgtgctaatatttctagttcctttgatgctcatgttgaaactgtttgacgtatagctttagaactttattgatgcacttggtgtttacatatatttcttggatgcaattgcagtaagacacgtggtatgggagctgggcgcaagctcaagacccacaggagaaaccagaggtgggccgacaaagcatacaagaagagccatcttggcaatgaatggaagaaaccctttgctggttcatctcatgcaaagggcattgtccttgaaaagatgtaagtgcaataaacgtagagcaattatttgctctgaagaacattcaataaccaacatgcattactttatctgcagtggcattgaagctaagcagccaaactctgctatccgtaagtgtgctcgtgttcagttggtgaagaatgggaagaagatagctgcctttgtgccgaacgatggttgcttgaacttcatcgaggaaaatgtatgttcaactgctgccatacagagctttcttgttgcttatcatgttcttaccattttccgttcgggatatgcaggacgaggtgctcatcgctgggtttggtcgtaagggacatgctgtgggagacattcccggtgtccgtttcaaggtggtgaaggtctccggcgtctctctcctcgccctcttcaaggagaagaaggagaagccaagatcttaaatcctattcccctccattgcaagcagctggagcggcatggcggctataagaagtacaattagctacattcagctaatgaattctggggccttccttttctgcttctggcagctaatctctctctgaaattcagactcgatgttgtggtgaacatgtcaatcgtatttttaccccccctaatcacctgaattcaaattccatatagaagtagcagcggatttggtttccttcagcgcgattttaaaattcaaacctggaatgtcgtggagtgaagtagtgtcatcatatgcttgtgaatctctgcaagttgcaagcagcctattttgttgttttcttgtggcgcggtttgaatcttgaatgaagtcatcattttgaaatctctccctctatgctgaaacggaacggatctgatctgatccacgtgcgggttcatctgagcccttggcggcgagatcggaccgaccaaaaaaggcctcgggggccaaacgaaccggataaacccggtcctcccttcccattggacccggttgaaaacccccgggccatcccgatctgtgccaggtcagcaacctatccgggcccacacgcataggacatagctccccctacccatcaactcacaccaatacttttacccaaccccacccacttccacgtgggtcccatgactcgc

SEQ ID NO: 76779 - DNA, 4118 bp, Oryza sativa
ccaacgggagctgggaggtggcgctgccggcggaggaggtgccgccggagctgcccgagccggcgctcggcatcaacttcgcccgcgacgggatgaaccgccgggactggctctccctcgtcgccgtccactccgactcgtggctcgtctccgtcgccttcttcttcgccgcgcggctcaacggaaacgaacggtactactcgctcgcatccgcaattccgcataccttccccgaattcaatttcttggctggaaaaaaaagaaagtcagtaaaattttcagtgtctctttcctgacagaaagatttgtgcagttcaaagctgcctttcggtacagtagtttgcttgattgttaggtgaaggaggattcgcgtgatcgatttcatggtctaatttttgtttcagttggcgcatgtgtctgcatgtgcacatgtatcccgtgctcttctttttgtttcctttctttgctttgagtgaattggagtcatgcgttctggatgtgctggctgtagtgtactggccgttctatgtgagttttacatccttacccttctttcatgatagaattatcaattcatactctagggttcatattgattcatggtagctgctcgtaagaatttagtgcctatcctatcccattttagtttttgaattgaaaaacttttccagaacttgatttaatgagtcgcagagtctagcaaatgcaggctttaaagattgaagtagcacctacaagactcttatattaaatgaagggccattcatttctgcatttttctggcatgtcaactgcgccacaacttactccatttcattgtggttggagaaggtgtacatttactagtactagttgatataggagtaatgtgtatacggagcaaatatgacaatacgtgtatatgcctacatagtactattcccgtcttaaaataagttcacttttatacataaatctagacacttattttgggacagaggtagcaagccattacttgattccttggtcaagtgctatgcaagtaggtctctattattctccttttagagcttttggcattttagctggcatgatatatcatatatgaccaaattattctaagattttcgtagcatttgttaccagaaattttagattagtagtggagtttagcacacaatgcatgccagaaaaatatgctttccatctacttatgtacttcatgatgtatctgtgctgaagttaaattttctttactaaggtgaataaatcaatgaggtcatgacaaaaggagtacttgatgctcgcatcgatgttaagcatcaaaatgccccttatttcagctttcttgttcatcccatcgttgttcatttgtctagagacagttgtagctaattgcgggtatgggatgttatatctagaacttaggagcacataatgacattttctgctacacataatcctaccacttttattccaatatagtctactgctggtatgtcgacaatgcaatcaaagggattaggcaacatatttaggctttacttattgttcaactctgcgcatatagtttgtggcagaggtgttctgttgataaaagcgataacttgtttcttcttagtttaagaagtctgcgtatgctatgtcctggtatgctattagggtcgtaatccagaatctcgtgttttccacatcaatgtatttctctgtactagtttagttttatgttattcatttttttcttcttatttttcaggattagatgtgtattttaactgaagaaatgatgtatagtatttctgtttatgctactgagctactctattatactacatgttagtcacttagtctcgtctttggcatgctatccatgatggtgtgttactattctcatgtacatgtatctgccccatcaccttaaaattcaatgtttgccaaaaaaaaaaaagttccgcaatgcttacgagtagtttctttgctgctgactgtatgttgactttaggctgttactgaatactctcccgggctaataatattagtcattttgaacaagggtaaagtcaaactttaaaatctttgactatctaaaatatttatcttaaaaatatggaaacatatgtgtagattagtcttaaaaaatacttcaataaaattatatatttgttgatatttctatatatattataatagaaaatagttgctaaagttactttttggagaccatgcgcttggagggagttacaatattgctccttttgtttctcaggaagcggctcttcaacatgatcaatgatctacctactgtatatgaagcattggttgacaggaagcacgtcagggataggtctggtgtcgatagcagcggaaaatccaaacattcaacaaaggttagtatttccctcccccaaaattcagaaacttcaaatgcagttacttcagattttgtaacctaagctacaatacacagagaacaggcgaaaggcaagtaaagcgctccaagggtgttgcaaaggagtacgaggacgacgacgaagaacaccacgagacatttttcgggacttgcggtggcctttacaacgcgaacgagttctggatcgggtgcgacatctgtgagcggtggttccccggccaatgggtcaggataaccccgggtaaggcggagcacatcaagcactacaagtgccctgactgcagcagcagctcctccaagaaaaccaggctatagggtaaattgtggtgtgtgcaatctcctctgaccaatctgatcaaacgacaatctgtcctgccactaggaaaaaaaagatggtgaagctgttcttcggtccaatgtcgtagcttagctagatgtgaagtcatctagacattgtgctgtgtggtagatgaggcaaaaaagagtgaactgaaaagacgggaaaaacgtattcgatctttagctttgttttataaatgttttcttcattgtcaccgatgtgctttgggttttttcagacttcagagcatgggtatcgttgttgaattgtagctgcatgcattgcatgatatatttgtcaagtgctcaacaactggagcattcccaatcatagcgtctctgcacatttccattattcataaacacagagtgcttgctgaaaatggcataataacacattaacacacgagtaatctactcaggcagaaggattaatgcatagaaggatcaagagatgaagcctctgctcttgaggctttccactgaatccctgatgatcttctccatgggactgaactgcaaacccagcgcgatcagcttcttcgacgcagcctctgctctcaccagcccaggctgcgtttccttgggtaatctgccacacaaaaaccaaaaataatttatcagttagtgatatttgcaattgcagctgcatcattcacagtttgatatagtcatggaagcatttggagatttatgtggtacgtctaaggtttttgccgggaaggccgaaggaggccatccgaatgtattaagaaggtacgtctaaggtttggcgtggcaacctttggctgcgaaccaaacaggccctacagtccactaaactcactttggcactttgtactcggggtagagctcggcgactttggaagcgaaatcgctccagtgagcaatggactgcacgcagaggtgcctcccggatgcagatgggttctcgtacagcagaatatgggcaagagcaacgtcttccacatggactggccccatgtaaaaatccgcatactcctctgtgcaacctgcattgtcacaatggtgagcatgtttaggtgtttccttgcagtagcaatcacagctggaagaggcaaccattcaatcaagaatttctaggcacacaaaattgccattctatccctcacactgaatcaaacaagagaagtttttgagtagcacatgcatggtcatttaggaatcaacggttctcttttatgccaactgaactgaagaagcctatttttcatgtcattacatcaagtgttgagggatagcaaaacatgcggtttcactctctggtgatactaatcactgtgacatattcagtgcagcactatcagcttcctagtattctcagtatttgtggtaattttttttttggaacaagtatttgtggtaattt

SEQ ID NO: 76780 - DNA, 644 bp, Oryza sativa
gaactgaagcttcggctctgtcttggtacatgatcgagtataaatgtgaacctagcatctcgctcttactgatgctcatttgttttgggttacaagatctgtaattaatatacatgcgtattttcgttccggtctgatcagcgtagccctgcatgcacacaaaggcctcatcattcactttccgattcccatacgcacaaaaagccctcattattcacacgctagctggtccctatgtatatgcacataaaggcctcatttagcttatacaagaggcagcaagagagctctgagctgagaagagaagagatgagtgttagttcacaacttcacgttgaagtgatactagctccagtgccttactcttgtcagctgtcgcttgcccatggtagcagacttaaggaggcgcccgggggagctttccttctatatgtggactctgagatagtggatcaagttacctacagagcatagagggctacagaagaccagcatgccactcttgcatatcttcagtaaaataaacatgcacgggaatgctctatagtataatcataagaaccaaggattagacgtagttgagctgacgatggataaggtgatatgctcagtaatgatggacatgactatgttgatgatctgaa

SEQ ID NO: 76781 - DNA, 3008 bp, Oryza sativa
cacaagtcacaactatgctacttttgttttgaggagtacgacgataggctcagactatctataaaacatgcaactgtgacactactgtatatgctaaataccggaatttcaaacttcaaatttcagaccaagaacacaagaaaaccaagaaaaacaacaccaagaactgcagctcaatccttccactccaccaatacattgcagcctctacctccttatcatttccgctcactacctcgtccgtttggggctcgccatgggccgccgctgccacccgcgactggggatttaattgcatcaagaagccttaacccttaggcaatgggcacaggagagaggatgaagatttcttacgagtgagaaggtggccaccgaaggtgatagccgcctcgcaggggagagcattgtgtcgccgtcacctccagcaccatgccatgctacacagccactgctgcatcgcctcctgttttcccgagagctcatttccatcacagggttttttttccacacgtcatgagtaaatgatattttttcctggtccggatgaggggaaattacgtcatgagtaaatgatatttttttgctgacctttcccagcctaaccgaacagggccttagggataaaattggggattttactattacaatcgacttacctcaaagagtatatagatctgcacaagatgagggaaaaactccacaatgcaataccttaatacttataactatcccaacctctcaccaggcgaaatcaagggacctttgtaccgtcaaagttctctttgtataaatcacctagactaagaggtaagatgtacagcagggatagtccgtttcttctgttttgaaatatatccaggtttaacaaactctggaattaggaattgagaactaaatatccacgttggcattagcattcttgtactcataacaaatgaaccgtttattctcgcccatatacaagagagcgcctaattaagcttcagatcatcaacatgagtcatgtccatcattactgagcatatcaccttatccatcatcagctcaactacgtctaatccttggttctcatgattatatatactacagagaattcccgtgcatgtttattctactgaagatatgcaagagtggcatgctggtcttctgtacccctcaatgctccgtaggtaacttgatccaccatctcagagtccacatatagaaggaaagctcccggcgcctcctaagcctgctaccattattcaacgtgaagttgtgaactaacgctcatctcttctcttctcagctcagagctctcttgctgcctcttttataagctaaatgaggcctttatgtgcatatatatatagggaccagcgactgaataatgaggactttttgtgcgtatgggagtcagaaagtgaatgatgatgcctttgtgcgcatgcactgctacgtcgatcagactggaacgaaatttggcatgtattagaaatcttgtacccaaaacatactggatcgaccgaaaaccacaatagtcctgttccaaaaataaccggggactaaaaatcatctttagccccggttaagaagcccacaaccattttatgatatttagtctcggttggtaacaccaattaggactaaaaatcatctttagcctctattgggaagcccataaccattttatgatctttagtctcagttggtttttagtcccgttaagaaagtgtccaccccctactctttttattcccggttggtaatgccaaccaggactaaaaatcggcgcatagtatatagtccctagtacttatcctctagcaaccacctcttcgcttatccttctctctttttttatcctctccctttcatctctctattctatctacgtctatcctctcaggcggcagaggcgagcgagccttctatctctcacgcagcaaagggcgagcgagcggacgcagagaggcgcggcggcgctcggaggggcgcggcggctgacgcggaggggcggcggcgctcggggaggcgcggtggcctgcacggaggggcgcggcggccgatgttttcttttttccctttttttccctctttaactggtggatgattttttgtggactatatatattgtttggacgatttgagattgtggatgatgattttgttgttgtgaatgatttgggatagtggataatgttttttttgtatgatttgggattgtagatgatttaggatgttaggagatgaatcgtggatgagttcggctaaaaacaagtgcaaacagctaaaaacaatgatctagaagcaaataaaaaaaatatatctctactccaggttgataacaccaatcgggactaaagatagcactatctttagttctggttggtgttaccaaccagaaatagagatatttctttattcccgggtatttaaatcgggactacaaatgacgatctttagtctcagattactcctctcggtttgttacccgggattaaatggggttgcaaatcgggagagaagaggtattctccagtaatgattttatactcgtgcagtaccaagagagagccgaagcttcagttcatcaatacgagtcatgtccatattactccatcatcagctcaatgatgcactatcgttggacctcgtgattatacatcacctcactttatccaatggagaattcccgtacatgtttatcttattgaagatatgtaagagtatgatgctggtattctgttcccctcaatgctctagtgcaaacttgatctgctgtctcagcgtccatgtatatcaggaaagctcggtggcctagctaccatgggcaagcgacaactgacaagcctgatctgaacctgttttgtatgaatcacctaagagtaagacgtaaaatatacaacagggatcgatagtccgtttcttcagttttgaaatacatccaggttcaacaaactctggaattagcaattgaaaactagatatccacgttggcattagcattcttgtgctcacaacaaatg

SEQ ID NO: 76782 - DNA, 15329 bp, Oryza sativa
ggaggtgcaccacatggacgtcaagtcagcgttcctcaacagtgagctccaggagatggtatttgtttagcaaccacccggcttcatcaacgccaacgatcaaggcaaagtgtacaagctccataaggtgttgtacggtctccggcaagctccttgagcgtggaacgccaagctagatagctccttgttgtcgctgggtttctgttgcagcagctcagaacatggagtctacacacgtgccaccgccggcaagcgactgatcgtcggtgtgtacgtggacgacctcatcatcactggtgatcacactgaagacatcgctggtttcaaagaggagatgaagaatctcttcaagatgagtgatctcggaacactcaaatactacctcggcatctaagtgactcaacgcagtggctgcatcacgcttggccaatctgcgtacgccaccaagatattggagaaagctgggctccaagactgcaatccaagtcagactccgatggaggtatgtctcaaattgagtaagaactccgattctcctttgatggattcgactttctactgcatcctcgtcgggagtcttcgttacctcgtcaacacccgccccgacctggcatatgcaatcgggtatgtcagcagattcatggagactcctagagaagagcatctctctgctgtacggcgtatacagcgctatgtggccgggacgaggaactggggactcacttacctcggtgggaaggaagaaaagcctagtctgctgggttatagtgacagtgacctagcaggcgacactgacgatcgccggagcacctctggacaaatcttcttcaccggtggaagcccagtcacctggcaatcctccaagcaacgagtggtggtggctctgtcttcttgcgaagcagagtacattgctgctgcggtagcagcatgccagggagtgttgttggcgcgactcctgactgatgtgctggaggctgatgcgcctgctccaaaactgatggtggacaatcagtccacaatttctcttgtcaagaatcctgtgcatcacgaccggacgaagcatgttgacatcaaatttcattatctccgggagtgcgcagaacaaaagctaatcgaggttgcgttcgttggcaccgctgatcagcttggggatatcttcaccaagtcactcggcagaaccaggttccacgagctgtgttccaagattggtgtttctgatcttcgtcaaaggagtagcaagaattagggggtgatttgttgaataaatctagctgctttgtttgttttagtttcccctgttttcggtttttcctagtcaagcacgatctggctttgttttcaggtcatgtgtagtaaggcttgacgcgcgctgagttcgcgcggagctggtgtcgtgtgcgtcgtgtcctggatcgtgggatggcacgatgtggcaacggatacgtgtgcacacatttaggagtccacttcctttcagttgtaactttccttatttatagttcaatgcaacaatcagaaaagctgcagcttcacagcaccaaaaacctcacagagttcgtttctttcttctttgcaaaagttcgagaatcttgagtgtttctgtcactcgacttatgaattatgactaggttggcctctgcctcaggatgctcgtttagattgccatggggcagtggatggaacgctcaatcctggccatggaacggggtaggaagggcctttttggttggtgtcttgagcatcatgcctgagaggaataggagaagttgatgaaaattgcctagctaggcagcctggcattttgcttgtttggttgtgcatcgttgcctgaggggaaaaaacatggttagagtttagatagtactgctaagagcatccacagtgtgtaatcgattttaggattataaggtcgttgacgtggaatttaatcgagagctgcagtgttgcatcagatcgttgtcctcaagggaacaataaaaaaaattataagctgcttcttggctggacagatgaagccatgcttggcctgacacccgtatctatctattcttgcgcctggatttttttaatcagcaatgcgtggtttggttcggctcgtctttggagttcgatttttcctctgacacgcaccagtcgaccgccccagtgtactctattcgatttttccgtctcacggttcgatttgtccatacactggagtttctcaaactcaaatgctaattgaaagacaaatctcgattcgcctagctttgttcacttttagttgttcgctcttccgaacaaatcaatttattgccttagcttttgatgaacgaaccatttgcatacatcaagaagaattaaagaatgaagaacataggaaaaaaaaaatcccaaatccacgcatctagcagaacgccaacctagaatgatttctgcgggctttctttccaaggaccaatcaatcatcacgtacatgaagaaggagaaaaagggaacagaatgcaatgacagaaattcccaaaccatcaacgatttcttcaagattcaactgcatgcaaagcgtttcaatcgtttcggcagatcggcgactgctgttgcttcgtgcggaagatgggtcgcagacgtcgatgtcgcgccttgaccagctcccacgggtgttggatccattcgccggaggggactgcgaggcgggggtggcagtcagtggcggatggtgtgtgcggaggagggggctgcgaggaggcggcgacgcggtggagaggcagggggcagcggttagtggcgcaaatcctggtgagtgagagatagaagatgggagatccgcgaggagggtggggcggcgtgaattccttgaagagcggagtgcgtgcgatgagagtggatgggagcgggaggaaacgtcggatgatttgaggcgttggattagaaaattctgtatcattggatttgacgaatgaagtacgaaggatgcaagatctagttggtgaactcataaggtgtaatataataatatgtaatataaggtgtaatagtaatataatactgtcactatttatcataccataaatctatctattatcttctattattattattattatatactaaaagtccattaaaaatcctaaaaacacactcaagtcgccatgtgtcactctataaacactcctataccaccatgtggcactatctaatctcaccatcgattttcatttaattggtggatccattattttagaacattagattagatctgatttttattaaattggtggacccattacttacactgatcattagtatataatatcttccctttataaaagtgaaaatacgtacgtcagcaaaaaaaaaaaatcaagtatctccggtacatatgattcgggaataaaagcgttcacattccgttcgtcggaagaaaaaaaaattgcccggccatgttataaaagagacagagaaaaaaaaaagagaatactataaacactcctataccgtcacgtggcactatctaatctcaccgtcgatttttatttaattggcggacccgttattttagactaatcattagtgtatatataatatctttcctgtataaaagtgaaagtacgtacggtcggcgaaacaaaaaatcaagtatctccagtaggtatgattcgggaaaaaaaaaacgctcatgttccgttcgcggaagaaaaaaaatgccaggccgtattaaaaaagagataaagcaaaaaaaaaagaatataattttctaccgtataagatacagcgaaaaaaccatatatccgtagtaccatctatatctatctactatctatctattatataataaataaaatccattaaactttctacaaacactcccaaaccatcacatggcaccctataaataatctcaagtcacaacataaataaaatagaaatctaaccatcgatattcatttaaatcgatggacccattattctatatcattagatctattgtagaaaaccaaaacctcccacgttcccatatccgtgcaccacacacgtacagatcaaattgcaggctacctgttcctttctccttttttatccctatcacaatttaaattaaaattatcattatgaaaaacaatatcataaataggtgttaaagtccattaaacattctataagtatttctaaatcattgtatgacattagagaaacttctatccattggtttccacttaaatctggacacattaatttacatcattattggatctatttttttaataaaaaaacaccccaaaccatcttccctttctctccatccctatgggcgttttgccaagctgctacttgtctcacttaaattagattctaataaatctgagaaaaaaatataatatccaaccatcgattttggcttaaacttcaacacattattttatgtcgtcagatcaatcattttttttctaaaaaaagaaacatcccaaacctccctccatccccgttaccatgcggtgtgtggtgttacttttctatgttttttccggctctatgataattaaaataaaattatttttatggacaaagaaaagaccacaaatgaatctccatctattaggtctagctggctattatttttttaagtgaaaacaataacttaataacgatattgcctatatttaagtgctgaaaaatttactttatgaacccacatccatattgaagcctctacttaataaatataaaatttgctacaggacataaaagaagtgtagttagttgagagacactggaagaacatatatatgctatgggacacagaaaaaaaatggtaattagctgttggatacccgtggcattatttttttatatccaaaggaaagggagagagaaacaatcgcgaaagtatgattttgccccttccttccatgtgtggctcgcatatagctctgacgccattgtagtcatgacatggcagcgtgtcgtggcgcagctgcgagaccgacaacaatagcctgcgctctgcggcgccctgctcgatataaatcaggaggtgctccatgttgtgctcacccccaagcgcggtgtgtggtggagcatcgacaccggcatggccctcgcgctgtagcgacacgagtgcgggaacgacatggagctacgggccctccttgaaaccccctccccctctagatagccacctcaccggcggcgggtgcggttgccgcgttggaggtgtatgcgagccggacttggtagccaaggggcaaaattgtacttttattattgtttctctctccatttccgttggacattataaaataatgttgcgggtgtccagcaactaaataccagttttttcggtgtcctacagctgatacacattcttacggtgtccctagctaattacctttttttaatgtcctgtagcaaattttaccctaaataaaataaaatactaaagttgctcactaaaaatcaaagtatcctagcttaatttttttataaaactggtagacccattatttatatcccgttagacatctaacaactttctatcaactttattaattttgttctcagcatgtatacatgagctatttacccatacattttgatattgatgcttttatgaataaatgattattttaggagataaataaataatcttaagatgatcatatcatctaaattatatatatgatctatgaagttacgtggccagttgaacaacatactgatcatactaagcacgttggttgcaccaaggaatcttaagagtgaaacaaccatgatgtgccctcaacaatatataagccaattccagataggaattaaaagaccgtatccatttacttttcgggtaaaacttgctacagtacattgtgaatttgtgacatagcatagaacaatctagaaacgtgtaattattacatgacactccggtttagtggtaatttgctaagaaaatactatggcctctattttaaattttcttacttgattggagcgagataatttagaatggatgcctttaccccatgccaagttgtaggatcaacccacttatattttaatcccaaattacatacatcaaagcatttcaagaagcttcatagagtggatttgtccaaaaaaaatgaagataaaaagaaatgaaaattaaacaaagtttatctaattttaaatttcttttcgttgggtttataacccattctaaatagaaatatccaaacattttaccaagactaatcaaatgaatatatttaaaatttcaaacagaatttaacaaaaaaaagggcattcatatgaaacacatcaattgtttcgatacaaaaattttctcatgaattaaaagaacacggttttgaagtatttttagttcacaatttatatgttgcaagtaacgaacgttcaaagaaccaggggcggatccacagtatatggagtggggtcccactcaaatttaatatttagtgtattactaatgtgtaattaagtaaaaaaatttaagcacactatcaattctaataagatgcccccactcgatttttgggctaggtccgcccctgcaaagaacgttaaataagttaaattttagtttatgataaagtaaaaaaatatttttgatataaaaccatccacacatggacattcgtaataaaattttacgcacatgcccgcgcatatgcgcgggctaccttcctagttttgaactaaaaatttaacctgtacaaaacaaaagagaaaatagaaaaaaaagtcaatagcagtaaattgaaccactcgtagaaaatcttataatcttacaaccaatttggttcttaaattgagataatcattgcatcatttttaagtgattaaatataaatagcgttccctctacccctatacaaagcattctccatatattattgcatatataagccacacaaagatagcaatatatagttagtttaaaaattatatttcttactattaaatatttttaatatgcatgtttactaggtatattttaacaaaacacactatagatcatgcatacaatgtctacaatacatatatatctactctgtctttattaattttatgttggtatgtataacaaattatggtaatgtgatccaactgaaaagagggttagtttgatagtactattagcaaatatttgtttttcgagatttgttaaaaaaagatcccaaaacagtccattaaaaaaacacctcacttccaatttacacttaatttattagacacattttctaaataaactaaatctatctaatttattaggcacgttttctaaataaactaaatatatctttttttcgaatgataaagaagactataaataattccgcataaggataagttaaatatcatctttaaaaaatctattatatactaaaagtccattaaactttatagaaacgctctcatgccaccatgtggcactctacaaatactcctatgccaccacgtggctctctaataaatttagagaaattaaaaaaatctaaccgtcagttttcatttaatctggtggacccattatttttaaccattggatctataataaaaataaccaattaaatttatccttaaaaggcccacatacatgccccacatacgtgcatgaacgtacgtacttcgtgcaccgggccccacgttcctcttttctttttttctctctttttcacgcacctgagataaaaaccgaattaattattctataatatattatgtgttttattcatatattattagatatttaatatcaaatatattattttgacaccgtgtcattgtcatttatctcccagtaaagacttcgtttgatcaagctcattgtgtgagcttatccagggtacgcagaatggtgcaagtcattagcacatgattaattgagtattaaatataaaaatagaaataaatttgttttatttttaaaaaaacttttatataaagcatatttgtaatacacgcaccgcgtaatataccatttagtagttcgggaaacatgcttgatataaataagggagtagccaatccgataagcactttagaacatagccttaaatgtattatttaggtagtaaaacattaatatataatatacaatatatttgtatacttggtcaatcatagcctaaaatatcaaacttatgtcctcactgatccttatgtatgtaagttctatatataagccactattcactgattgctaaataatattatttacgcagtatctatgcacaatgcacctaaaaattagctgatatccaataagcacgtgtgtcatctaacaccgaagataaatggtgacactaagtgcacaaccatcaacaaactatagagtaagtagacgatgcaaacaatagttaactacaagtagattacaactatgagtaataccattcctacacttctataaacgctcctaagatgtcatgtgatactctaataaatgatgaaccctgagttccactcgacactcaaggctgttgtttgcccgatctttcggtgagttgtagataactatgatttgagagaaacgttgacgacccgactacaatcgtacgagatgttgtgttgcgccttagcgatcgatacacctctccgagggttgttgatcttgccggtgcagatcaaccttattcctgcaagcaaatcaaagaaacaagcaaaaacaaaataaaatcaatctgaattgcaaataggaattgagtacacacgataagttggggtttcgaatacaagcagacggacggtctagccgacacgcgcgctgcaaggaagtagcaatggctaaactttcatctaaacaaaacccgagagttcttggcggcaactagaggtataagaagaggggaagaatgaccacagggtcgtgctccaaccctaggacgtgcccctaatgggcccaacttgatacatagcccattgggccaaaagaggtgacgcagcaccatggacataaaatagtcaggagtaaaatgacaattgcggccgcttcagaacatatatggacatgtggcttgatccatttgaaagtagacttgataagctttccatgaagtacttgcacgccaagctttccatgaagtacttgcacgcccaaatcagagttcgcatgaagtcgtggcggccgtcagaagttggcgctaccctgcaatccgaatccaccccgcgcgaatcctctcccctttggatcctctccatcattcctgagtaaaatgcgagtgcacgcgtctccggggtataaagaagaggaacatgaactcaagaaagaactcacctgatagtttagttgacgtgcacgagcgcgggtaataggaccatcatgctgtacttgggggacgtggatgtatcgatggtgttgatgtcctcatcaataaattagaaagaatatatgaaaagttatataaaaaagtaaacatacatccatcaatttacacttaaatagatgatccattattttcaaccattaaattaatttagatatatgaaagtaatccctctgtcctaaaaaccatataatatgtccctacatacatacacaactcctatataatttcgtacacgatatatatatatatatatatatatatatatatatatatatatatatatatatatatatatatatatatatatatatatataaatataaaagaagagtgggtatgtgattcatcttatctggtagttttctctttctttccagctctaagattttctcaaattgaggatatataaacatagcaaccactcctagcgaggtggtaaaacaagccatgtcgcagcgttgcctcacgccacccattgcttcactctcctccagtcaatttttttgaaagtatctttttactaacaatgtgaaagtcaatcatatgagctcatatatatatatgtgcacatgcacactatgaatacacatgcatgcaccatatccctatgttagaaaaatattcattcagaaaaaatgaaaaacaaacgtatgcatgagagactactattcggtagaaaaaaacatacatataacaacattatatctatttttacgtcaccctcatccaaatagttttaacaaattagctcaaattccaacgcatattaaccccagcgtacatgcataggtgaattagatgtataatacaagaaaaaaaaaatcaaaacttgtattaacttgtaagttagcaaaggataactgtgtgagcaaatattttttacatggtcgttatcactgtagctattagacagtcgaatgatcaaccctgctatttttttaacaaaaatatctatactactaaaaattttagtattgattaacaccttaaacaaattttgtctactctaaacaacaaatcaactcaagataaaaaaaaacttttttttatcaatatgccaagtatggatctcaactggctacattgtagtaattatacaggagtatgcattattcagttaagttggtccgagtaagatgttacggttgacaataaagcttaactggccttctacttaccgataaaattatgttaccgttgaggagcacgactatatcaatgcaacacccatgaattaaggcattagagaaaaatccttagcggctatagtctgcttcactcgatcgtcagaggagcatttatatataagtttaattgttttatcctattaattggtagaagcggtatttttaaatatttatatatagatttggacctatgagacatgggcacttgggtataatgtggagattaactttttatggtattaatgatgtattggggttttttttatacagctacaattccatcgattaaaaagacacacatacttcaaaacaatgataataagttatggtgaatggtgaatttacatataattgggataaagtgatttttgtttggataagccattttgatcatttactacatatcaaaatcaatggtctatttcttatagtgaatatggtaagatatggtattctttttataggcaataaataaattgcccgcgcatctgcgcgggctttcttcctagttattataaagaatgattaagccgctacttagtttcgataataattatttattggatcaaatccatgaaaaatatcttgacgagggattagaaggaacgttgacgaggcctcgacaaccagtcccatctttcaacatgtcatagtttttctcaacatgtcatagttttagtagaccatattgttgtagttcgttagaagcatatatatggtggactagcgcttctatcttattagcgaggtcatcggaggggatgttgatcttattactctactgtactagctagtcccacctttccacggttgctactgctaccacacaaccatctagaaccatggaaaaaaaaatagaagaagacgaagacgaagttgacgagaacggtaggagaacgactaagtccacaactcggcattgagagtggccgattggaataacaagttaggttttttgtttttgcaaggaattactgattgcttgcttaaactcgattaggaccgggacctattggcatcctattcagcgtctaattcaaccagtttggcactatactgtttgagctttggctcgcacgcacgcagtggcattcctaggttatattacacggggctatgggaccccgaagagaatttcaatctgtagtaatatattttagtctatttattagtttaaaattaaagtattatatatgctagtatgatatatgtacagaaccctcgataattttttgttaagggttcaccactgctcgcacgtatgttttgcagtgaatttataaagatccagatagattgcaatcatctggagacttaactaatgagtacttaatattggtcgacgaccagattgattttattgacaattaaacttagactgttatcaaattatgtgacagacatacataccctttgaaaaagaacatttttagctaggaacgtcttttcggaccgagggtgtgtatacatataaaaggggataaagaacattaaaactaaagctatttacatatacagtttaatcatgcaaatcaaatgtaacttgcacggaacaattaatcatgcgatgctcatctcatagaagcatatagtatcgtctgaagatcgaaacgaatcttccaattcgctggggctacgttgactgactgcatggtactctatgttgactgagcacaccatgtagtactggctagtggctacgttgactgacttcagtatcaaacaataatccgagagcgctttcgtccgaacgatcgattccacatttccacgagaaaacttgaacacccatgtcaccctctcccttcttcactatatctctcctttctaattgtacaggccactttgcatacagcgtattataccactataccatggattgtatcttagcttgccacgtaggaaccaagccccgtttcgggccaggaccatcgcactgccaggaatcacacacgcctcctgcagggtccacacacctccgctcgctcactagtagaaaaatgatttttttaccaacgttggttttttatttttccagacataaaaaaaccctcttataactatttgcgaaaatagctaaagagcctctagatttaaccccgcctgtgaaaatcaatttttccaggtggacgccttcctttattttcgcatatggacgtccaactagaaaaatttgatttcacaggtggaaccttacgtggttcgcctacaaaaatcatgcctgcagaaaaaatattaagtcgcatccttatcttctcctctaccatccttatcctttccaccactcatttccctccccctcccccctctctctctcttctaactgatgcgcgtcggcgactctgaggaggtccactaccagctgcgacggcaacgacgacgactgctacgatgatgatggtgccgacgcctgggtctcgctgtcggctgcgatgacgaagacgacgccgcgtggatccgccgccggccgatcttggggaggtgagggcaggcggcggcaacgacgaggtgaggcggcggcaccttggttcctccctctcccagcctggcaacgacagcgacgatgagggctagcagcggcttggcgacgaggaggggaggcagcggcggcgctccaatcctccctcccttcctcctagatctatccatcggtggcagaggcagggcggaggaggagctgatggtggtggccatcgcagacaacgtcggcccctcccctcctagatctggacggaagaggggagccgggcagcggcggcggcgaacagaggaggagagccgtcggccacaaggagaggggctgtagaggggaggccgacggcggcgctcacgggtatgggtgcggcagcatgtttttttttgttcgctgaaaatattttcgcaagcaggtggatctaccactacgaagatggagatgttgcctgcgaaaatgattttcacaggcctttgtgtacaagtggtcatttcccccgcctggaaaaactatttatggctgcctgggaaaacgattttcctagtagtggccctagcttaggaactgcgaaggtgaggtcatctccatgtggtagatccccatccatctcgtccttctccttcttctccttctttgctcttcgccagaaagagcacttgtgtcgctgggagtttgctgctcgattcatcatcctagtcgccagcctcgccgccagagccattttgatctacacaccgaccagcgccacctcagcccccgcactaggaagcatggtggtggccagcgaaggatgataagagaagggggtatggcagtggtcacctccatagcgggaagacactgcgagaagctccgctggccaatgacgcccctatctatgctgccgatgtctattccgccgccccgaccatcacttcaagctgatccgcccgaccaccgctgttggcagatccactttcgcggccctgatacatgccgtgcctccttggtcttcttggtggtgctgccaaggagagtgggggaagaggtggctccaccaagaagtggagaggtcatgccaggaaggggagaggtgctaccaggaaggggaaaggcaatactgcctggaggggaaggggagaggtggtgatgccgctcgatggagaggaggacaattagaagttagggagagtaggagaggtagaggggtgggttatcatatatgtttatgattcttagagtccatatcataaaatattggatttatttgtcattgaaaaaaaatgaggatttaaatacaaaagtatccgactgatcaaggctgaaatacaaaaataaatacatggctatggcgtgcattggatgaagaatatcacatgtgtggtttcatcctaagtggcacctcctttttttctttggctatggcttccattggtcatgccctaagtgtccgtgcatgtacatgcatgaaaacataaggaaaaagtacgaattacacctctgaactatcgaggtcgaccgaattacacccccgaactcaaaaaccagacattctacaccctcaactattgaaaccggacaaattacccccctgagcactgttttaggtggttttgggatagacttgctgatgtggcagtcctacgtggccgcacacgtggcactggccccacatgtcaacctccacctcatccaccctctcttaaaataattagtgggacccactgtcagatccccacccctccctatctctctctctcttctccctcccctccccttctctctctcaggcgtgcgtcaacgggtagtgggcggcggcagcggcatgcggacgggcggcgagcgcggcggcgggcgtggcggggagtggtgggaacggggcaggcggcgggcgtggcggggcgggcgtgatggcgccgtgcccccctgtcgcggcggagggcggcgaagtggcgagggcgacgaagtgcccccctctcacccctctctcttgggccgtcgggaggtcggcgcgcacgcccgagctcgccgttgtcatcttcaatgtcctcggcgcccgccgcccgtctcgccctccccaccgcgcccgccggtgcttgaggcggcgggaggaggggatagcggaggggaggctgtcgagacaggctgggatgccggcaagcgcccgcggaggggatgcggcgagcgcgccgagagggaggaggcgggcggcgcttctctccgccgccgcgccaaatctgagccgagcaggtgtcggggaaggggtagcggggcacggcggtcgtcgtcgggccaaaggtggtcatcgcagcaacgagtatggctgggctcatcgtactccggcgggagcggctcgaacgacgacgacggcggcgtctgggggat

SEQ ID NO: 76783 - DNA, 7074 bp, Oryza sativa
  unsure (1)..(7074): unsure at all n locations
accaaaactctgctttgttttaatatactgacgtactttttttttgcgtgttcacgaaaaaatatgcagtaacagattgtgtgtgtcgtttcccatttgacaataacatcttgattctcatcggagcagggtgagagagatccagcgccgttgcaccgagcagctaggattcttatcaacctacaattagaggatggggagttccctcagcaagtaagtcataactgctcttctcttatagcaaagtagtgagttttttgcttttggaccatttctcgatttgtgcgtgaaaaatgtacacagaaattcaggtgcagagtgttggccaatggctgggagggttttttttttgtttttaccctttcgaatgatagcttttcttatgcttaataatgttaagtgctgtccctgtctccggtagcttctgaatctgaatgaatttttgtgtgacttgaaaaaaacaacaggagatcatcggagcattcagcaaaaactgcgccatcagctactctcagtacaggaacatattccctatttgggctctcggagagtaccgctgccgagtcttgttaggcaggcaggatgcatcggtgaccggcaacactgctagctgatgatactgatgaagttattttctttttaaaaacaaaaaaaaaagaagtcaagagtgcaggtgttgcgtggctttctgtacctgaaacttactattaccataatagcagcattatggtttatttacagctgaaagtgcactgtgatatcgaaaacaatatgtgctgatcatcgtgaaataatgtcgtatttaagggatgtatgtgtaaaagttcacctcgcgttgcgaattgtgatcgttccaggggtatcttagaaaactgacgttctaatggggtcctttgtgaaaaatgccacctcttgaatcttgactctgagcagcatagatccgatcggacggttcacgtggaccccagtcataggatcggcaatgcttttaacggatgatgattaaattttgggtaattttagggtctcttttgaacaaatgcttgtgcaaactcaccacccaaaataggttcgctaccatttggtgccagcaatcactgccacagtgcagggcttggttgcgtagagatattgatcagtgttccatgatcatagatgcccacaagaaatcaagaatctgaaaccatgatcacttgctgaagcaattctgatacaaagtatcaccagaatgaaattattcaagcacacgattagtgacagcgactaaaggaaagcaaaagttaagtttatgtttcatggcagcgctacaaccagagtacaacacaaccagatcaattcaagttcaagtttctcgcacacctttattcttcagaacaccaagaatgcagttccagatttcagaaatttcagataagagcagaagccatgtcgattgcgcgacatctgaaacatcgtcagttcatctgatcatagtgggagttgtcataggaaggctttgggagctggagatgatcttcgtcgtcgtcgttgccaaggcggtcgaaagcctgaaactgcgcctgctgatcaagggacaagcctccttgccagattgctggagatggcatcatgacagggttggaggtgccggcaatggcggtgacaccagggtgaatctgagaacctggctgaaggtttgcagcacccactgaatcgattgacagaagagagagagcatgctcaaagtctgggcctctagcggagccggaagcgacagcagaagcttccatgcctgaaaaattagtgagtagaactgtaagttttatgcggataaataaccgaaaaaagatcgtannnnnnnnnnnnnnnnnnnnnnnngtcatatatatcatggtaactatgaacagattgcaacaaaaatctcagtgaagataattcctctcttctagtagtatatatgagcccaggttttccatgtagaggatcttggtcctactagaagtaatgatgattagattatccaacagattgcgactccctccattttggtcaaaagcttaaagctttcctgcatgcacattattacactcaactaagctgttgaagcagaatcatgcttgatcaggacattctggtgctagtcattgtacaagagttgggccaaatgaagaaacaccaaaggtgggtggttaccggccacaaatgaagctccaataacatgcgaaaacgcaaaggttttcagtgattgcagtctacttcacagaacataacagagcttcaaaccaatctatgatatcgatatataccactcaccttacacacgtcactacaagctgtcctagattgcaaggagtggggtccggaaatttgtttcacatgttgtagctttgtgcctacattattgtgagctgactcaatgttaaggtgtcagcaactggaggatggtgacagctctgctaaaaaggatgagtttcatgggaaagattgtggtatgtggacacttgctgcggcacaatgcaatagtacttttaaaatcaagcaagaagctaatgtagttttctttcagtcttagtctgtaatgtctgtaagacttttctccggcttttatataaagctggatcaatctttggtaagaaaaagaagctgatgtagacaaaggatgagtttaatcagaagtcagtagcaaagaaaagaacatggagaagaacgtagcccaacaatcaggttctcgtgttgtaaaaataaataaccagacatgtagtcatgggaaaaacttatctaatgaaatgatacgaccatacgtcctaagtgcatagagttccataccatctaataacttcacagaaacaccaatgatcagctagaatcaagaagaagcatcccaagaggcaccatcatataaaatagcttctaggactacataggcgcatccgtctatgctctttttcctcataaggagttgtgagaacaatttttatgcgggtgaaagacccaacattattattattttctcatcttttgctttcagaatgttaacctctcacctttttcttttggaaagttcatctataaatagctagagaaacaaaataccttggttaaggaccttcgcgttggtttctttgaacgccatgagaccatcaaaactatgatgtgctccatgtggcagtacattgcccgatgcctgctgattagatacatgcgtcccatcaacaccggcagctattgttggccttgaccaaggagcttttgttgctgtaaatttgaagcctcctggtactgggttatcccaagaacttgcacagcttcccatctgaccataaggagcttgaccaaatagaaaacttgcctgttgccttgcatctgcttaggacggtcacaagtcacaacaatttcagcgctaagctaaacagatgtaacgactaacgagaagaaataggttgcttattactattgtactattgcctattatggaagttaaagccacttttgtacaacttacgggtacactaaattcaatgtgcacttcttgaaattttagttaatgcttactcagatactcaacaacttctgtgctccaattcgttaatttttcagagtgatttttctttctgaagtattatgtgcagaaataacaatacaaagagatggcacagttgaaacttcccatgttttagtaccgatcagttcggtgacaatatttatggtattgggggggggggggtgagatttaaactgggtagatgacaaaataagcttcaatttcacagaactataatgcaaatagaatcttaataccaccatagagtaatgtagagagcctcgacgaacttaaggaaattgcttctggttgtggcttccgtctgcgggcattgtgatcatggaggcgcctgcgacagcttcgttttttctggtcgaactcagctaaaccgtgaaacctacaaaaacagcagaagttcaaagaaaagaatgaaacaagaacaattttactttaccttaatcaagggtgctaagatcggattcaagataacaagcagacaacatatttagtacccaagaagaaaatctcaccgactacactgttggcaaaagcgtcgctcaagacccgcaacgatgactttaagagtcttgctgtgaggttcacagactcggtgctttcgatggtaaggtttagcagaagagagatcaacattgcagccttcaacttgacagtgtgggttctgagtgttctgctgagccaccttcaccttcttggccagaccaggagatggggtagccacactcacaccagatggagaactcttgacattctgccctccacagacatcttcaaaataggttctcttgccaagcttcaggccaatcaagggctctacacgattggctgctaccaccggtgatcgagaagttccggtgtcatcaactttactcttacccttgtccatgttcttatcatgctcttccgcagatgcaaaattgagctctatggtgttccccactttggacggagaatcgatcgacgcggatatggaactcttggatgaaccatacccaatctctgagctagaagagaaagtaccaccagaagaatggcctgattcatggcctatgtcaaccccaacacctgcaagttttgattcagccagcatcacattcttgggattctcgttcgcgctatttcctatcggcggcatattctcccaatcccacaacaccgagctcttctgattccagtccatcccaaaagaacccatgccagttacagatcccagctgctgctgctccaacctttaaatcaacaaaatgaaatatgagaaggacagatactcaaaaagaaaatataactcaattagaagttgcagaaatcaggacagatttatggcatagctgacacttgactcaactgtgcatcattgaagtttgagagagaagtacaaccaccacaagatgtgctaccaagagtatcaatgaatgcccatatatgcagactctagcttagctttatcaggggaatcatcaatcatggcaagaacagcaacatcatcatttcagatgcaagaaaggcaaagcacaactacctcaacagtggggggagggggtagtgaagtacctgctctttgcttctctcccagagaaaaggagcacagcagattcctgatgaattcctcctgaaaaaaaaaaactgtttctctctctctctctctctctctctctctctctctctcaatcagcatcaccctggagaagcatgggagctccactgatcgcggcgagccgatctggcgatggcggcgccgtccatcagacttggcagccagagaagcagcctcactggagcattcaagcttggccacaccactgccttctcctcactctcatctctggctttctcagatcttatatcctactacacctctcctcttcaggctttctctatccctaacctttgaagccaacaacatcaaccagtccagtgctggaccctactatacatcatgacaagagaaccacccccaaaatttcacaatctcaaatcttatcacagtttcacactttcacttctcaccaccatgaaagattttacaagctcagatctttcacagttccacaccaccaagaactactactacctgacctcaaggctgctgcattatttcttccatgttagcagcactgcaatggtggcagcagcatatgcaaatcaaatcagaggggcaggaaaagaacctataccaagtcaagtcaagtagcttctttctttcttttctgtggggcacctatacaaagaaacctatagcaattagcaaaggaagctttttttcacctacctagggctaggggacaaagaaccactctactcctcttgtatctgaaatcaagaatctcacctcttttccctcaagaatctgtgtcttcctccagaattactttccctggcaagcgctggtggaaaatgaggaccttaaaccaaaagacaatgaagaaaagcaactatagataagaaagacaagactcacaataatccaacacacacaagatggcctctctctctctctctctctctctctctctctttctcactgtgccccacctgagcctcaaatgaacaggaggaatcaaagagggatgccaagtgggtggcctgcctccttgcactgtcacacacacagcaactagccacatgtgcttcactggcacaaaccaacagtgctcaatgtatcaagctatactcaccagtttactgttactgctgcaccaacagctctgcttactgttggtatgctgcctcttccagcccaatatggccactacacttcaagtactcacacaaaagaagcaaatcccctgtaagaaaggcacaaccttttgtatgatgaattcagaattcagatcaccttctcagggaaagagtaggacattcctgtagcctgcagtctgcacacctcaacaagttagtgccaagtataagtgatgatacacatttgcccatgcctaccttggaattgcatttcataattggtgcatgcaaatgaatgcttatctctttctcgtcttgctctggtgtgagtgtgacactcagcttctgttcttctaggccatctttacataggaccaaaagttgcagtagctgccttttgtcggttgtgcttaggtggtgctcctctttgcttagcacttttgatgtgacactgatggctgcaactgcaaaatataattactccataggaacaataggcagttgtgtaatgagatgcaagccttttgcgtattcccgaaaataagaaacgggcggttgttaaatcagctaaggcatgtgttaaaatcagctactatatcaagtggatcttgatcatgttggctacttgcaattgaagaaggcgacgtagatttggttccccaatggttcctgcttaaaaacaaagatcaatcagcacagataccacttgaaagtagcaaaaaatgattagtttaattaacaaccattgggactgtaaaaattggtttgcgtgatcccctcccccatcagcggtagggaagtagggagtcgtggatgcaatctacaccacgtctttctacaaaataaaatgggcctgg

SEQ ID NO: 76784 - DNA, 2629 bp, Oryza sativa
ttttttcttatctctcactcgattttctcactcaaatttacaatgcattttcttgtaagtacagtgtaatttatgaaacttacactataacttttgtaagttacactataatttttgaatcttcgcatgtaaattttaaattttgtattggatttggtctttttcttgaggatatggtaatttagtgtccattatggtgtttcttaattgctttttgctttttattatatctatcggattttaatccaaagattaaaaatctgtgtgatacgatcataaaaatctttcgaaagatgtataggtactccctagatcaaaaccgtaattaattaagatggaacaataatcttcatgaggagccagcaatttcctactccaagttatctagatcgttgggtttggatatactccgccatgagatctagtccaggtgcgtggatctagaggtagacaaggcgtagcgcgccactgtcgagccccgattccggcgatggcgagcgagaggatcccgctccccgccgtcaaaggcaggaggcagaggcactcgccgagaataccatggagatcgctgcctcgagcgacggcgagcgcccgccgcaacgaggcgggatctcgccgccggcgggagcggcggcgatctcggagggaggagagggaagagcaccgcgatcagccgatcaggggctaatctgcataatgcattccaaaacaggggctcatttgcaaagtttacgactcttggagtggtattgatcataaccataaggtccttttcgaaaaaaatgatgatagatactcctatctaaacggtatatttgaaaaaaaaaatgtgaacaaaacttttatatatgtgttcttagctatcgaaaagaaagcgctgaagaataaattttgatgaaaatccccaaaatcaactccaaatttaaggttgcaaattcaaattttagctgacgaaaaataacttatgaatagaacttttatatatgcgttcttagagcatgttcagtaaagctcctaaacacagaccttaaacaactttgagaggttgagactaaaaaataaagtccaacaggcccctacttaaggccccaaagtaggaagcctcccaaattccctcctacagcccctaggcctgggggctctatccccagcccctatccaattttctttggcgcgggggaatgcttccacgacgcgtgctccttcccgcgcgattgcttgcacgccgccggccgtcttgttgcgggtgattctgctctaatccggccatcgccctgctatagtattggtcacctgcatggatgcacgtatgcatggatttttctgcatatcgatgagacgtggtttggttcctgttaagtgtgaacagccatctgccgccagtggccaactgagatttgatgctgatctagaaggagctactactatatctccttgcatatattcatgcagtttcgtgtatgcactggatataatatatcttaatattgaccagctcatatatgattatatgcatccatatatgcatgtatatcattggatattgagtgtaggatggatgaactgctactgctactagccgcaacagatggactgattgagcattctagtgagtcatccatgcactcacactagtgtacgtatatgcacatatcagtgtgatattataaaaaaaaatcaaatttcaatttaattgtgttgtttgaaattattaatttaaatttgattaaattctatgcgttggaaatattaatatttacattattgtgatattaaactaaacataaaagatggattataagataaaatagaggagaaaaagaaataggggctaagaaatagatgttgttgctggagttagaaccattcttagagtcctgaggaaattggggcagcccccatttaacctttagggactctaaaatagtagctattgttggagatgctcttagctatcgaaaagaaaacaccgaagaataaacttcgatgaaaatccccaaaatcaactctaaatttaaagagaaaatcccttatatacccctgaaatttttcctaatcccttctatacccctgaattttgcttacttccttatatacccccaaaatttgattttgatcccttgcatacccctcccgtcagttgaccattagttgaccgtgtattttctataaaaatgaccattttacccttggatgaacaaagaaattcatgaattacattattaaaaatataaaagcttctcgcatgagactattatagttatgagtttgttgtgcgatgcattatttatcccaaaaaaatatttttagataatgaaataaaaaaaatacgtatttattttttaaaaaaaaggtcataaaaatgaggagcattcatataaagataggtataccaatgttcataatattttttttatgaatgctcctgataaaaaaaatccattgtcctattaaaatttcaaataaaaattttattttttttacatttattttattttcaaaatttatgtcaaaattttctgcactaattatttagtctcattagttttataaaatgcacacgatgtgcacttcaaacaaaatttcaattattttgaagcttatattaaacctaaagcataagggcaaa

SEQ ID NO: 76785 - DNA, 5093 bp, Oryza sativa
  unsure (1)..(5093): unsure at all n locations
cacagggaattcactcaaatttaaagctgcaaatttaaaatttagctgatatgagtataagtgtaagcggaaagatgaggttgttcagttggcagtgatccaaagaagggggcttatttgaaaaaaataatatcattggacttgtgttaagtgttaaccgttggatgggaatctaagatcgagttacatttacataaaaatccctctcattttcatgtttgtaattaggctccttctcggtttctcgctctccgatcccccgacgaggcggcggagctccggcgaacctgggaggggatcggagcagggttcgtcaggccgcgacggagggtgagatttcgcgcggatcgcatgccggagacggaggctccaaccgcttggccgttgtcggggattggagatgcagttctgagaggccgcaggctgcggcgagctttctctgaacttttctcatcctgatatcagctaaaatcaatcgaggtaatcaagaacctctcgaattgtttgcttcagatcagtagtgtggtttctgacttctgatatgcagtgtgcagggatcgatgcagcttagtatactcacattttgttgattctgccctggtaaatttggagagattttttttttttttgacgccattgccatctgatctgagtggtcatagctatataacctctcttctgaagtattggagcagaaaatgcagaatcaaactgaaaaggaatatcaaggcataatgcgacatggaagaatctgaagtctgaactcgcctgattgcatgcaggttcggcaacatcgcccaacatctctgattgtcaatcaatggttcaaggcatgatcctcatcacaatggcactggtagatcaaaggctacactaacaagaatccaagcatgatcgcgatagcgggttcgcggcatccaccagggaaaaataaagagggaaaaaagagcaaaaaaagaaaaggttcctacatgaatgaacatactgacagcagacatcaaatatccttatcctcctgccagatggctgatgctcttactacagccatatctcttgtgaaacaagcatctatgagaatgacaggcaaagctggagaagcactagcagaagcatcaagaggttgctgcttctaacatgctgcagcttccacgagaaggccgagtcaacctcgatcatgataccgaatctgcatgttccggtgctggggtcttggccagtgatcgttgcgaggttcgagaacccacaggcgacatcgtcttgatcgttcttctggtagtagctgttgaacgcgtacgagatgttgcttctggtgtccagtcccccacaagatgtcttgtaaccaaggctggtgcaatctgccagggagcaggcatagctgatgctatctgaaagccttggatcagtaaggcctatagaaggcttcagcacgcaccacttcctctcaaggtacttcacgttcttcgctttgagaaggccatgtgattgcccaagattcagttgatactttggcaagccatcataggtgaatatcccccagtgacgctcaaaattacctggctgtatgctcttctcatcctcatcgattagactgaacaagtaagcatcaactggtccaggcctcatcggcgttcctcgccctgtggcaatatgtgttaggaagccttggttgaagtgctgcgccatctgaatatttgcattcatgtccccgtcagttggccatccaatctccccaacaatgactgggagatttccaaagccattcttcttcaaagcccatataagtgtgtcatagtttgcatcaaacatgtttgtgtatgtcgcagagccatcaacaatgggtgatgcggcaccatcaaagaaggcgtagtcgacagggaagtttgaatcagaatagaggcttatgaaagggtagatgttgacagtgaaagctccaccagtatcgctcaggaattttacgatggtgagcatcagatcatgaatatctgtgcggaagtccccatcagaaggcttgctagtcgatgattgataaacatcagcattgagagggcatgtcactctaacttgactacccaagccagccttcacaagcgcactttgtatgtttctgatggcaggaaaagtagtttgcagaaagcttccattgtatgtctccaggaaaggctcgttaccaacagcaacatacctgatattacaataggaaaaccaagatgtgagatcagatggttcagtgagtaaacatcacagaggaacgaacttgcaggataaagttggtgggatatagaacatgagttatatgatgtgttgtcaatcatcttttcttaagagtgcggaacaattggatgattcaattatattgaggctccaaaccataggtcactgattcaaatccaggaaagtcagagtggaactaatgcacacacccaacatctcattagtggtaaccaaacttggccaccagcttggaggtggcacactagtaagaaatgatatggttgcgtttcatacaaacacacagaggtcagcatgagtattcagtgaacttcagttgttatgctctataatgttagtccaggtcatgttacttagcagtttagtatatatttataaagttgctgttttgatatatgtataataagggatactccatgtgtgaataacatgtaggaaaatttcttaccaacacaaacacaacacagcattgtttagttagaaaatctagtcttgttcagttcgcaatgatgaaaagcaacagatccactcatacttcaaataagtgtgtgatactttttggtagtaaacacagttcccttgtgtacaattagacatgacaagcaaaaggaatgggaggttttataagccatctacataaggggatccagtgatccacaaaatcctataagtgaaagaagaggcattagcatagtgacagaacaaagagcttatgtaaggtctagatgcgggcatgcagcaattcagagtggggacaattattattctctttcaacgaataaagaggacatgtcaaaaaaaagggttatcctccgcacagcaatgtccataccttccaccttatatagcatactactgaatgctactggtcatatcgatagctcagtttcagttgaaaaaacagtactacccagaagcagttgtttgtgaacatattcaaaacaaaaaactggtaaacttcacccaaatgatatgactaccatagtgtcacttgagtgcaaaaacctcatattcttgctacaattccatagaggagcaaaattctttactaacagtataatgatagcaagaaagtctcccaacatggtgtatgcattaatcaggagtacaagcacagatggataaaacacaactgtactttgtggtaattttgcctccagagacaaacatgctcaactgactcatcccagcaagggtgcaaatcgcgtgagccacgaaaaatgcaatgctatagactacagggggtttctaactcaaccactctaccaaatatgagctgcagttggtaggaaccaatcaacacagattgaatgcaacgctaaccactctacataaaaactctagacttaaccagtatgctcaaaaggccatatcacactagaacaaccaggttgaacgtaatgccaaccctctaccaaaagctctagacttaaccagtactgcttaaaaagcaaaatcacacaagagctactagagtgaactgaagaatcttcagtgagtgaactgaagaatcttcagtgagtgagtgagtgagtatactatacctgatgctttctagacttaaccagtatgcttaaaaggccatatgaaactagaactactagagtaagctgattagctccccagcaaaaactgcttgagagtgaactgaagaatcttcagggagtgagtgagtgagtgagacctgatcttgacgccgtcgttgaggtagttggagacgttctggtcgacccacttgttggcggccgccatgctgctggccatggcggcgagcatgtcgttggggatgccgaccatcacctccagcccgctcttcctcagggcgctcatggtgtcctccccggcgtcgaacagcttcaccttgtcgaacccgttgtccttgagcatctgcaccaccgtgtccggcgccagcgggtggctcgcctgcgtcccccagttcgcccctatcgcctccacccccaccgccgccgtcgncgtcagccacacccaacacgccaccgtcgtcgccgcccttccatgccaccaccaagaagaacccattctgctcagatcttgggatgattgatcaggcaagctaaagaaaccagcaaaaaagggggattttgggatcgatgaacacgaagagcaaagctccaagaaacactagaagctcaaagatcgaatcctttcttgagctgcaagaagtgaaggacgctggaatctctgaactattaaagcagcatcaagagctcaaatctttgggaataaatgaagcccagccgaactcatcaaactccacctaaagcttgaccacgaaaggagatttcctttgatagctaaatgcaaggactcacatcacacatcagtccaggggagagcattaatggctagcataccaagctcaggtagggagtaaatttgctgatgaggacagcacaggggacagatactagattagatgagagtgataataaagggctttgccaaagctggcaccaaacgaagagatgggcacagacagcacacaagagaaaaacttttctagtattgctcccaggatttgcaggaggggaaagtagaacaagatatttttcaggaaaaaggagaaggagaagaaaagatttgacagtgtgaaccaagaactgaacagaaaaaggagaagatgatcacctagacaacactctcacactcttgagctgcaagctgaagagaggatatatgctccataacagtgattagcacacagagtggtagtaactgaggtttttcagctcaaaaaaaaaaggtactagaaagattcctcaccatacatgccaatccaagatacatctagtactgttgagcagaggggctgagattaaaaggccaaagaaaagcaagcataa

SEQ ID NO: 76786 - DNA, 3757 bp, Oryza sativa
tactaaagaaaagatatcatgatgtttattttaagttggaaccatcagcacagtactacttttctaaactttttaaaaataaacattcgacccttgattctcaagatcaggagggcaaccttgccatgacagaaaaaacactgtagtgtaacaaaggattggcagaatgcctaaaaggttcttttgaaggaaaaaaaaaagtactttggtgggactattttgtttttcttgtttaaaaaaatcaaaaaaattaatatgaagtataatactctactttcttctttatcaatcattgttatacatgataatatcatattgataacacttcccacattttttctagcaaaagaatgtgataacaatatgtgatgttggtaaatctatgtatttatgagaatgtgataatctaattcttctggtttcaaagttgatgagaacggtaaatggtcttatagttctgaatttcctcctaaaacacgaaaatatgaagtcatttctacattgtaactctaattggcatttttcagtagttagttgctcataatttaattgaaatcagtacccaatctattgcctgattgctacaacggttacaaatttaaggttgctttaagttctgaaacacttgagtatttgtacaaagcatgatgtttaacatcagtacttaattatggctagtatttgtacagtaagctctagttctctattttaagctccagttttgaatttcgtctgtagttctgaaattcagctcttgttctgaattttgacttcgttctcaatgtaagctcttgtcctgaattttgtctgtagttctcaaattaagctctagttctgatatttatctatatttctgaaatctacctctagttttgaattttgactctagtcctcaatttaacccctagttatgtattttatctataattctgaaatttacctctagttttgaatattgactctagatttgattttcaatagtcatttaatttgtaggttattaatctgctttgatttgtgcaggtccaagtgtgaagaaatggagatactacccggatgatttgaagatcgccatctatctacaattgttggcaaagacagatcctcttgtgctgcaacgtggagttaccaaggcagttgcattgaattttgatttgccagttagagctgtgcagcaagtatgacgcagtggacaggattatggtgggatagaaggtgtgataaacaagttgctcacaagttgtggttgcaaaagagtacaaatagatatggaatctatcagagacgtgcctttgagagatcgcacaaccattcaggatcttgccaatgcgctcggtgtgaagtagtccacacttcataggcattttaaggaaggccagtttcgttgcctacacgcattaattccatacatgcatgcatgcgttacgaggaggcgtcagcgagattaccaatggcactagctctatgtgatgattaatatggcatttttggtttttgctagtgggatgatcaatttgggaaggagggagtatttctttagttagcaattattaatcattaattcaggattaggcagcaagctcgctgcgcaaccccacgagctcgtgcgttgccacgagtttgcttctttgatatgcggcagtagtatattttttccagtatattttcaaatatcactttgtgtcttttgtccacggcaaaacgaggttactagagcacacataaaaatggaagataggtgaattttaatactcttatctggtacattagtgagcacacttggtttatgagcttaatggttatgaactcaccagattcaaatgtcgccttctttagcgtgttaggggaaatgcatcttgcccctctctaataatgtattttgtattatctagttataataaaacctcacagggcatattcttttaaatatgttatttctttcacaatggctcgtacaatgtaagttattgcataatgcaaatattccattttaaaaatagttttggttgcctttggtgattggagtagctagttttattttctttctaaagtttcgaaagtacttacaattagcatctccatgaaatgccacaaagcactcaaatacttccttcaatcataaatatttgatatttatgacaagatttggttttaaaactcttttaatcaatcttatattagaataagtttacaatatcatgggatggtattttccaaggcaagactagtatttgtgcatacattttcatttgagaaataattgattatcaaagttttaaaagtctgaacaaatcttaccccaaaacatcaaatatctaggacaagattttgtcggacctctaacacttcaaccatcaataatatcttgaatgtgtgggttagagaaaaaatacggtatacccatatttaccttgaaaagcactattaaaatatcatagattttataaacttaatataatataaaaatgttgatcaaagttttaaattttaaccaaatgttgtcataacatttataaccaaagtgagtagtttattacaaatctaccaaaacgattggtcgaatatattcgaagtactgaaatcactacaataaatactaaaaagatttatacaagataactaagtaatggatagaagcaacttttttattttgcttaacttgcaagggaaacactgaaacatccataattacaacaattgcaaatttgccacttgtttaaatcgttattgtaaaactaccactagaaatatgtaaaattaccactagaacgatcattcgatggtatccttacaaaattaaaaaaaacagtagcaaatttacaaatgtcaataaataattctccacttgaatatttgaataggaaacataaataattttgcttgaataatatttgaagggagagagaggctgaagccctaaattcccctcctccgccgaccaaaagccctaaaccctaaccccagccaacgcgtcttcctgcccatccccggcggcggcggcggcgtcagcggcggaggtcggcgactagtaccagcgaggaggaggagaagaaggcaaccggagatgccgctggggcaacgcgcgggggacaagagcgagtcccgctactgcggggtggaggtgctcgacttccccgccggcgaggagctccccgccgtcctctcccactccctctcctcctccttcgacttcctcctcgcccccctcgtgagtactactccactagcgcctccgcccttactcgattccgcctcctctctgagactactagctcacttggtggtggtggcgctgctgcaggttgatcccgactaccggccgacgcccgggtccgtcctccccgtggcggcgtcggacctcgtcctcggcccggcccagtggagcagccacatcgtcgggaagatcagtgagtggattgatttggatgcggaggacgagcaactccggttggactccgagatcactctgaagcaggagattgcgtgggcgtctcatctctcgttgcaggtccgttggattcagtgaatttcacaaaattattaaatgtttaatgggagtttctaattgcgcatcaaggaaatcgctctggagagttcatcacttttgcaattttgcaaccaggaagtgctagagataattttgatagtgttgatgggcgattgtcatgtataagagttctccaccatttatgcatattttcaagcttgtcagtgtgtaaattagttatgcttccgaagtccataactagaaactaga

SEQ ID NO: 76787 - DNA, 2749 bp, Oryza sativa
cttctattaacagatgttagccgattgtaagttagatgacgatattgccaaggattatgtaagatatatgataacttgatgaattatatagacaagattagagtgtcataaagatggaagcactaatctcgagaacacaagtcgtcataacaagttttacctcttgttgaagatcgaaaccgatgcagctcaacccgaaagcaagaactcgtcgaaacaaaactaaagtaaaaaggtggcgatgcgccgaaattgtattgaacgtgtgtgttaaaaattacatagggctcggggtctatttatacccgagaattacaagatatgtccataccggacacgaccactatctctaacaaactctaagataccataagtctttgcggcagatttttggccaaacatatctctaaggaagttacataaaacatcctaattaataaatacaattgccttctcaggactctatccatgtgcggcaatcatcttgaagcacctcaattcaacccaatgtcatacaccaaattatactgtcagaatcggctgcatcggctcacctagtccgactcagacccagccgaccctaatcgtagccgatctggacttcagtcgattcttactctgttctcggatcaatctccgccttcgactctaccttgatctaatctccttttccgatgcggatattaccaaatttggtcgttaacagtagtatacgacaaattatatactacatttttttcaaagaaatgtcgatagaaattggagtaggtggcggtggcggcagttttgcatatggaacccttgggcctggaacccatctcaacaccctctttccccaccggttgccggcgacgtcgccgagggtttctctaccaacaggaacacgtgtacgcgccacagtggcccgcgtccagcgccgctctcctcggccaccaactccccagtcgcctcccgccccaacgaccgagagctgcctctacggcggcagcggcggcgccggcgacgatcagctcagctcaccaaccccgaagcttcctccgcttcttccggtgtctacaaccatgtggatgacgtatgcaaacgcacaaacattttgcattagcagccggaattttttactgttcatcgccgcatcatcggaattttttattgcgacttttcatggacaaagcgggattagttgggagcatttcaatcaatcaatcaatccaaccaagtcctagttaattcgcctcgggatccgccatgtccaccggcgacgacgacaaccacggcgatccgctgcagcagcagccggaggaggaggacggcggcggctatggcgatgtcgccgtcggcggggggttgtttagtgtccccggttacgagtgggcggacgtggcggcgctggggccggacgtggccggccgcgccgtgcgcgtgcggggcgcggcccacgcggtgcgcgccgtggggcggcgcgtcgcgttcctcgtgctgcggcaggggtcgtccaccgtgcagtgcgtcgtgggtggcggcggcggcggcggcggaggaggagacgccggggtggcgcggttcgccgccgggctgagccgggagtcggtggtggacgtcgccggcgtcgtctcgttgccgcgggagcccgtccgcggcaccacgcagcaggtgttcgacgttttgccgctcccacccatcaccaccatcccgatcacctctgcagtctgctcatggctactcttctgcaggaagtggagatccaggtgaagaagctgtactgcatcagcaaagcgactccgaatctccccatcagcgtcgacgacgcggcgcgaagcgaggaagacgtcgtgaaggccaaggctgtaagcttttttttgtcaatccatacactgccattgatcacagcaaacaatcatgtttcgttggagctatcattgtgaacttaattgtttcgttgcatgcacaggccggcgagcagctcgttcatgtcgggcaggacaagcgcttggacttcagagtgatcgacctgcgcacacctgcaaaccaggcgatttttcgtgtccaatgcgaaatcgaaaacgtaagatttgcacattgaacacgggatgatctcacggaattacccagaaacaaatttggcaaaagaattattcaggaaccgaatttgcgaaagaaaaatcttcagaaaccgttggtgtcacaagaatttgtgatctgatgagcgttgttgtcacactcttggacggtgcagatcttcagacaagtgctgctgtcagaaggtttcgttggcatccacacgccgaagctgatcggcgggtccagtgaaggcggcgcggcggtgttcaagctggactacaacggccagccggcctgcctggcgcagtcgcctcagctccacaagcaaatggcaatttgtggtggattcgagcgtgtgttcgaggttggccccgtgttcagggcagaagactccaacacgcaccggcatttgtgtgagttcgttggacttgacatggaaatggcaatcaaaggccactactctgaggtaatttagctccgttgtttgtgaattcagctgtgtaagtgatgtagctgcatgaacagtgacacaattttcttttgcttctcttgtgagaaacaggtttgtgatgttgtggataggctgtttgttgctatgtttgatcatctgaacaagaactgcgccaaggaacttgaggccattaacaggcagtatccgttcaaacctttgaaggtaagcaagtttatggat

SEQ ID NO: 76788 - DNA, 1684 bp, Oryza sativa
gttttgtgaaatgtactcgttataatatcatcatcaatttgcacttcgcacactgtcaaataattccaatgagaatggaagaaaaatggagatgccaagacacaagactgctcaccccgttcttctcgcagtagtcaaggtcagtccagcagcgctcgtcgcgcacctcgccggccggccagccggggctgggcacgatggcggagatggacgaggtcaccaccacccgccgcactccgccggcgtccttggccgcgcgcagcacgttcagcgtcccctccaccgccggcaccatcagctgcgcctgcaaacaacgggaacacggccggaggcggtgagcctggagcccgccgacgccgacgccgacgaggccggtacggacgtcgagaggagaagagtcgccggccggtgtacctgggggtcgaggacgcggtccacgatgcagggggaggcgaggtggaagacgccggagcagccccgcgcggcggcgaggagggcggcgccgtcgaggaggtcgcccgggaacacgcggaggcggcggccctcgccgccgccggcggcggcgagcgcgtggaggtggtccgtctcggccttgtcatctgcacagcacaacaccattgtcttcatcacctcctccgccttgcaagcaaacaagcagcagtaatggcggtttcgcactgaccggggttgaggacggcggcgtggacggagtagccgcgggcgaggaggcggcgaacgagacacgagccgatgaagccgctcgcgccggtgaccagcaccgtctccccctcccctcctccgccgccgccgctcgccattgtcgccgacgagagagactcgagctctcgtgtgagagagctgtggcttgtgagcctggagcttttattgtcgatgtggctggtacctactagtagcactgtagcacagtacagtacaaagcttgactgacagaagcagaagcagatgcagaagcagccaactttttggatctttcacagcctcacaagtgacagtcacacggatgatttgtcatgattcatctcgaattggggatctcccaaatctggattgattgagctgaaagcttgaaacggattgtccaagtagtagtacatgatctcaacctaccacaagggccacaatcacaaccgtgtgctagtactttcagtttgatctcaacagagtcagcagttgagcactagagaaagtccagattaaaacaaagattacattgatcaacaaacgtcttctatctgaaagaagaggggcaccagtgatagcgtgttgttacacattggactcgctcatcaaactgagggttgcaagtacagaaacaccgtagtttagtccacgagtcagtcccttggttatccatggtagatggatagtagcagcttagtgcgaaaggtagaagatgcaccatctgcctagtataaacctacagctccgacttcacatcctgagcactaacacggtatcctttctgcgagaacaaacctaggaagaaattggacatcctggaactgaaggaggaaggctcctctcttgccaccggccttatcttgcatagggcgtcgtagtcatgcttcaggtggggttcaactatcttctcctgtaaatgtagactggcattaacgagagatgctcagcaggtaactgctaaggggattcatgtttgtttctt

SEQ ID NO: 76789 - DNA, 580 bp, Oryza sativa
gtatcaacgaacttatttgataaacttaaacttgggaggaaccactaccttctttagcaacgattgcttcttccattgactggacaacgtccttgagcaatggcagtcccatccgatagtttattgactcaccataaccttttagcacaaagccctccagatcatctgtccactctagaaaataaacctgaccaaacaaatgtgttagtcattaatcaaaatcagtcgaggcacactaatgttttggtaacttgcacacaattatccaaaaagaacctacgagctacctacgagctaaaaagtattatgatgattaatgctctagaagcattcatgtgcagtgtatatagtttccagatgttatccagtgtaaatactactgttctacaacaaccagataacagaaagtacatagtgcagttgagaaataggtctgtctgagtaatcttatcactgaactgataactgctaaggaggcatagcatgtcaggctcataacattttcatattactggacacaagctagttaagtatagtcatcaatagtggtataattgagaaaaactgaaatccaaaagca

SEQ ID NO: 76790 - DNA, 3111 bp, Oryza sativa
  unsure (1)..(3111): unsure at all n locations
tgttgagattatgggcatataatgatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcacgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatatcgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaatttttcggaccattcgacgcgtacgtcgtgcacgcgcgccgcctgccaggccaggcgaggcgagcgagcgcgcgcgtgtttcccctcttctctcccccatacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaggtaaaacatagaagcaatcaaacaaaaaaccaaacataaaacgagataaaatataatctaatacaacgaatctagacataataaagtatatcccatcttatcctagtttttttaagagagtaacaaatactacctccgtcccaaaatataacaacttttagctataaatcggacacacagttgtctagattcatagctaaaaatgcttgcattttaggacagacggagtagcaatatagtactccctccgtttcacaatgtaagtcattttagcacttcccatgtttatattaatattaatgaatctagatatatatattaaattaacatcattataaacgtggaaagtgctagaatgaattacattgtgaatcggagtgagtactactcaactatacgtcggctaggagcctaatggatttcttaaaaaaaaaggggagcctaatggattcttcttttgcaattttatactactaccagctgatgatgattcagcagctcacgccgtgatcacatagaaaaggatcaaagaaggaagagacaacaaatctcatgcttccacgtagcacactctacttctgaaaaaaaaataattttacgcgggaaaagctacatctgaagctgtgattgtgtgaatacgcgttaaagatgattcctttatcgatttctgaattttctttacgtccattcagactgcctatgcctgaagaattcttttccttttcgttaatactgatctcaagaagaatcctgcttagtacaggagccatagtagcgaaacgatatatttacaaataaaaagtatttgtgaataaaatttttatttacgtatttctagcgatctaaaagcaaatgctgaaaaataaactttaataaaaaaaatcttaaaatcagctttaaatttaaggttaaaaatttaaattttagttaataattagtataagcataagcataaaactgaaagcgtcagtttgtttttgtcaaatctgatcacggtcaccgaccttcctgccattgtagtggtcaaatctttcagcgtgggcgtggacgccagaggaggaagacgcgtcgccgcgcggccaagccatccccgatcgatccccacccgcagcggcggcgaggcggccggagaggagggagatggagatggaggcggtgccggcgctggcggtggtggacgcgcggttcgtcgcgggggacgcggcggcgctgtccgtggcgaagacgctgagcctgtccgggagtgacttcaccgtcacggacgccgccacgggcgccgtcgtgctgcgcgtagacggcgtgctcttcagcctccgccgccgctgcctcctcgcggacgccgaccgccgccccgtcctcaccgtccaagaatcggtgcgcgcgacactcgactcccctcccatactctcttctcttcttccccaccgtgccaatctgatcggtggtggtgagctccggtgggtgnnnnnnnnnnnnnnnnnnnnnnggtggaaggtgttccggggggagagcacgagccggcgtgacctgctcttcaccgtggtgaagccgtcgggatccagctatggggttcgaccaaggtgagcgtgttcctcgccagcaacgacgccgagcaggccagcgacttccgcgtcaccggcagctaccacgacggcgcctgcgccgtctccctacggcgactctgacaccgtcatcgcaaaggcaagcaaagcaacccctctctctcccccttgctcgagccacttctgtcatttcatcgaacacctggtgggcgtgctgctcgacctgacgcaaaaagtgtttcgcgcgcagatcgaccggcggttcagcgtggcgagcgcgctgctggggaagaacgcatacagcgtcaccgtcaacgccggcatcgagtacgccttcatcgtcgcgctcgtcgtcgtcctcgacgagatgcatttccagccatgacaagatggaaaccaaagctctccctgctcccatcgattcaaaaagacacgatttttttacccttcagttttgctagctctgtatacaggcttgatagacgagaggaaggttgtaattggttgagaagtgaaaacaattcagaaaattatacggtggatgattgcaattgattattgttgatgaaagttgttatattttgtgataaat

SEQ ID NO: 76791 - DNA, 4813 bp, Oryza sativa
tactagatccatccaaaggcaatggatcctgttctagaacgtatgaaaatttcgtaataacagtgtaaaattcttcctcgcaaaaaaaaaggtaaaaaatctcccaatgaaatcgtgaaaatctcatgcatccaaaatgaagcaagacaaaattgtccactgagatagggtacaattttgatacctctcgatgccttagggtattatgatatatcaaactttatattagaaaatgttatacacgtatctttttaatggcagtaaaatttgtaatgaaaagaagtgcatcgagtctgtatgttgcctcttctcaaagatgataaaatcactcgtggttaggtggtgtagcaggtgacaccacccgattcttggaaagatgagataagatcagctcgatctggacctcgagcactccattgtcaaaaggagaatgaataaaccaagacagtttttgccatttcgtccctaccctacgtacggccggtggcgagtgacagcgtaacgcccgcatgcactcaccctcaccggcggtcatgtgtgtctctccggccgggccgtgctacctaacttcttctgctgtttctgcaggtctcaaagtgtggctgttagctatagctactagtcggcaagcatcttgcagtgtagtacatgtgtgtgtgttttttcaagtgcttttgacctgcacagtctgggtgatctggtgagagatgttcgttcatcaacgttgctaaatctgcacgttttggggtggagcctgatcctgatattaataaaaggagaggatgcacctgcaggctgcagatcatgtctgaatgttttttttccttgggattgaatgcttgatctgatggcacatttcagaagcaacatgtaacctacttaagtacgacagaaattcagaagcattttttcagataattgcctgaaatcaacttattacgaagaggaaaaaaagctgtatgtatttggtgaccaagatacaggcaaactaaagaataatcttccatttataatccagctgcacttcttcagaggtgcatgaagctgaattcccattttggctttcttattaaccgaggtaaggggggtcggagttttagtctccaaaccctcaaaggtagtgtattttgcttccgtctctctccaagcgaggtcagggggttcggagttataatctccaacccccatgagacggcaatttaatttaatccccgactcacttgaacttgatctggttgccaagaagagatgcatgcgattaccgctgtcaatgaccaaaaatttcagaaacaaaccttccttttttagataatcagaaacaaatcatctgaaccaaagcctgttagaaatgcatgaggccatggtgtctactatattaacatttcagaaacaacttatctgaagtctgaaccaaagcctgaattatctttgtgcttcttaacagaggtcatggaggttcggagttttaatctccgagcccctttgcatttggtctcgtcgccaagaagagataacggccaaaatggtaattcagtttcagataaatttctgaaccggcctttatttacgaaattcataagcgttttcaggtaatggtctgaaatcaacttattacgaagaaaaaataagttggatatattttcttcccgcttgattccggctagcaagatacaggcaacctcaattataatcttccagtaattcagctgcacttcttcagaagcgcatgaagctgaattaccaattctgttttgttctgaaccgaggtcaaggggggtcggagttgtagtctccgaaggtagtgtattttcctttcagtctgctcccgagcgaggtaggttcggaacccgttgcactcgatctggtggcaagaagagatgcatgcaattcccgctgtcatctgtccaaagatctcagaaacaacagatgtttaccccgaatattttcccctagggcttgatctgattagacacttcttattatcatcacggccatggtttcccacgggcttgatctgaagtctgaaccaaaggctgaattatctttgtagaggtcagggggttcggagttttaatctccggacccctttgaatttgatccgagatgcatgcttgtaaatttctgaaccaaggcctgtcagaaattcagaagcagttcagataacggcctgaaatcaacttattatgaagaaacaaagaaaagctagttgtatttacgaatttgagagccttttctatttgttttttcagccgattttcagtagcgtcggctgctctatctacttgcattgcctgtttcagaaacaccaaacctcaccaaacggcaagcactacgtaccgtccctgttcactggccacctgctccttttgcctgtccaaatcctcattctttccctttagcctttgcttagactctacagaaaaaaaaacgtctccttttcaatttgttggtagtacatgttttctgctttacgatattgctttcagtacaccatgtcctacaatattgtaaaacaaaaaacgatttgctgtatgtttggtctatcacttttagagaacatgcttgaaagtgatgatttaattagtggatagaatttaggtgcaccaaatgctggcaatatgaaccgtggagtaaacgagtaaacgaccctcacctaaaagaagtttaaaggtagtcacaagtaacaacagctaaaaaattctctccagattttcaggcatgacgtgaaaaagatggattaatcgtcctggcttacaaaattaatccacacaaaaacagaattccaaccaagagaatcctgtctagctaactctaaccaaatcttcagtctagcagcagtaaaacgtaaaagttgtcaagaaaaaaagacgcatctgccgtacggtgctagcacagtgaacagtgatgaacactgcaggtctgcagcagtaaattgtggaggaaaaaaaaatgttgtttgttttgtaaaagttttggatttgaaattaaaaatggtggcctgaattcgtagggcaggagaaggtgtgtccaatgtcgtcgtccctacggtgcggttgttgggggatagacatagttagagccgctgtccctgcgttatatctgaaccaaccctccatctccttcactagccttctctaccaccctcactcgcgagctcggctcagctcagctcacctcgcacccagatcccaatgcaccaaccagccataatgcagcgggctctcgccgtcgtcgccctcctcgccgccgcagccgccatcgccgccgcccaggtacgcacgcgtagtgtcaacttcgtgtacgttcttttcccggacgcatgcatgctgatgctttgggcaacaatgcagggggagtcgccggagttgctgccgttcgcggtgggggcggcgccggaggggtgcgacgtcggggaaggggagtgggtgttcgacgaggcggcgcggccgtggtacgccgaggaggagtgcccctacatccagcccgacctcacctgccaggctcacggccgccccgacgccgcctaccagcgctggcgctggcagccgcgcgactgctccctcccaaggtaagctcatccacctcctcctcctccggccagccattgtcgccgccggcgaccaccacctcgcttgctccgtgaacaaggatagaatccaatgcgcggctttacccaaagaagcaggccgtgactgtgactttgctttgctcaactgcaacgagctgcaggggggaaggggcagttattactgggatctaattatgcttttttttttttacaaaggggttaaaaagagaacgggtttaaccgtggtatacgaaaggagatgggctgcatctcaactgccgtgctagtttgtgatgacatccaggaaggacgccaataatgcattgtgcagtagtagggcattgcatggaaggacagctggtaggttaggtcatgtccatgacaattgtaaaagtaaatttacttcctcctagtactagcagtaacaacaggaggaggagtacaattttcagttcatataggtgtgagcattccaagatccatgcactcactgcactcactcaatgatcagtgcacatttgcagtacctgatactccctccatcccttaaataatttaaaaattattatttattttatttatgacttactttattatccaaagtattttaagtataactttttgtttttcatatttgcacaaattttattgaataagacgagtggttaaaccatataagtaaaatatcaaaatcccttatattggggggacggagggagtaatagaatcacataaatgaaatgagtttcattagctctagcagattaggcagatgacccatgctaccaactctccccgtggtgattattttatctgcatgtcttggcgtctgcacatcgtatgcctctctttagaggaaagatttcattttgtgatgattcactcttggaaagtttggtttcaaaatggaggtttcagtgaaggaagtagacaaacatgcaccgtgtggtcctcatacgtgccagatattggttgttttggtgggtcagccggtcaggtatccatcatgcagtggactccagccttgtcgagtcagaacactaaaaaaaaggactaaaaattgaccacaaattttgtataatcatctttaaaaaagacgtaaacatgttaccagatgcaaaattccaatgcaaagatttgtttttttgattgttttccttttgtctttctcaaccgctatgtggactgctagtacaaacaaatttcattataaaaaagtattcattccgtcttaaaataaattta

SEQ ID NO: 76792 - DNA, 3640 bp, Oryza sativa
aacgagctgctctactggaagctcttcttccccgcgcgcgacgaggcgatctgacctcatgacgtcacgccgccgccatcgtcgtcgtcgtcgtcgtcactaatcggtgtaatctgctccgttcccgccatttcttttcttggcgatcgatgtaatcaaatctctctatacttgctcctcttctctcctcttctctttttgaacgaagtgaaaatacagaagctagcattatttgcttgcatgtgtacaaaatccacgatcttgcatcaagattaactaatgtgatcaccaattcaggatcactctgttgagcaagaacctggagttgcacagatgtttttggatctcacatccagaattggaggttgccttttgatgggccgaaattacaaaaacaaggcgggcttatgaggcccaattatagagattatttgggccataacgagaggggtcggaaactaaaaatccgaatccctaataaacgaggtcaattttcttcgaatgcgcgtgccactatatcgatgcaattttttttattcacgccatactttttttgtttggaataattgttatcagttgcttcttaattgcgggaagcaagaactctggtcaattcatggtagaactcaccaactctctctagtctccaccttactgtctagtggctgctgcagtgtctcgtcagataatgagataaacatgtttaatgctggaaaaaaatatcatgaaattagaggagttacagacgcctatctggttatctgaagactctgatttttaagctgttcagccgggtattcgacagttatatgatctcttctccaaagtccaaactgatgctgacttcgggcagacaacaagaactgtttatgtcgatggcatgaacggtagtaggttacatctcctctccgtgggttttattgtcaccatcatttcgtgatgtgattcagttaagatcgagtatagtagatcgatatgatatgaacaacgggatgccttcttctgaacttttgtgttcagcaagtttttctggcctccatttagaaggaaaaggaagatatccatctattctatttgattcaggtttcagttgtgcagtcaagttagaattgtttgtttgtggggcgcttgctctagtgctgatcaatgtcataagtacaaccttgacaaatttgcttgagaagtcggaatacagataggccaaaacatattcatccattctgaaaacaacctgttccaaccgtagtctgtcaggctggcatacatatataccagttcagaactccatagttagtccttcagataagacaaatttattcatcagagtttaagcaaacaccaacagatcagagttttgctactgaaattaaagtaaattaaacaaatgcaatccagggattgctatcagaaaaggaaaacccaattagatttcagtaaggtcaagcgaggatagtgtgctcatgaaataggttttgtgaggcccaaatctatagattttatttgggccgttttgaaatgcagttaatgtttaagacgctcattcttggatttggaggttaaatttatctcatttttttcctcaatcagataaaagtattatgcttcatttttccaaccttaatttagtactatgtgctggacaactaaaaggagttgcaacttacaaacacctatatctggctgtttcaagagtctgattctctgctcctatcacttttcgagaattagtagtatgcagaaagatgaccttacaggctggagaaggaacttctatctcatgaaattcagttgagtattcgacagttatgtgctatctgctaccaagtgtccaagtcccaagtaatgtcgatttcagcagacaagaacaactgttcaggtctatgttatgcaacgggtaggttatacaccctctctctatgggtttgatggtcaatatcatctcgtgaacttttgtgttcgttaagtttttctttcctcagacttagaagcgaagtaagacatcaaattgtttgatttgattaaggtttcagttctatcgcccaccaacagtcgctattcgcatgctcgtttatgctccccctcccaacgttttgcgctatcccttatcataagttcccccttgacccttttgctctgagaactcccgaattaatacaccacacgcctgctcgtctggtccattgcaacatattggcgtcactcattctgagaaaaaacacctgctccccagtgccacactactccggcattcccgctgacatgcgtacacttctttggaacttcagagttttaagcaacatcaacagaagagagaaatacgtaaggagtatttgaaattagactgtcagttgtgctaatgaaagtaacttacaaaagtgataagaaagaaagaactgaaagagcacattttcagggtactagtgtgtacctgacaaaaggcgtgaccaactgttcctctaactagtcggatatgacactccacagacataatccctgaaaaccaaacttaaagtttcattagtagctctattaatctaatcaatctctgtagttagcactagtttgtagggcaagtatgtgtactattgacctttgttagaatcatggaaccttcaccaaacgatgttggtaattggtcatctgctccacatatatactactcctacttgccccaattcccgcaaaaacctttacttgcaagacatcaagaaattaattttcactttacaaatcaagtacaacaccagtagtagtaatcaacagattttcttcagacagaaagctaaataccctccatccaagggtgaaaacggtaatgtgaattccaaaacagtaacgaaaattttcggtcgaccgatattcgtttctgattttgtaccgaccgagccatatggaaatggtaatcgaccgaaataaaaatagaaatggtaaaaaaatataaataaaaattaaaatggttttgatgttgtaccgatcatttccgtatttactgtattcttgtggagattaccgtttcttataatatagtaattaccgtatttctaaatatgtcgatattatagagtatgtcgctattttacccgcaatttagagacaaattgactctttaattaaatccataacttgagtgcatggttaaaatagagttaatttgtaatttatatagtataaacttgaagttatttatatgtattacatagttacacaaagttaaatatattttttatagtttaatgttttcgtatttgttaccagttttcgatttgtaccgacatgtttccgtccatattattctgtttcccttttttatatttccgattttattttcgtttctaactttaccatttttaattccatttccaaaaaaaaaaaggttgagacgattttccaatcgtttccgaccgttttcatcccgactccatccaatccgctagttgtttagtcgtcagaatcacttctcagctattctccatcactacgatattagtactataattttttcaaatgtacaaatatgctatgtgccaatagtaatcaactttccgatcgtttcccggctccatccaatccactaattgtttattcttcagaatcacttctcaggtcttctccatcagtacgatattactactataatttc

SEQ ID NO: 76793 - DNA, 10394 bp, Oryza sativa
ttgttcccacctccctccttttatcctcttcctcccatcttttgattttttttttttgctttttttcactttccaccacccccttcctccgaagaacaacatgtgttgaggaaagcacaggaagaacttacgggaaattcctttctgtcttttttttttttttgcttttcttccctttccactatccctgagttttctgctgcttccctacacaaaactttattatataaaaactcataagcaacacaacattaatctggtctatttttttcatgtggttgtaatgcaaaattactgcaaaaaaaaaactgccctcaactatagaaaatcttgtgcagagtgtttgcttttccttatgcccaactaggtgactgaatttctaaagagtgcacaactcagaaatatcttgattcgctaactgttaaaattgcacatttgttctcttgtagtcatgctttgaattatgggagctctcagttcatgcaaatgccattacattgtacagaaaaaaggatgtaatgccatttttttcatctatccaaatgtgcagggcacagaggcagaatcaaatgaagactatgggatgttattcagattatcacaggagggaggcatcacctatacaaatttaatccagcaagtctctgtctcacctaatgcaattcttcctagtgctgaggtggcagtgagtagaaaaaataaaacacatattaaatgaaatatttaactaaaactttatgtgcacagtcataactcccacactgtctttttttttttgcaaaacagggtggtcttcctctgctccaaaacacttatggcagtttcatgcagctattgcaagctcctattgaatcagaggtgtgttcccttttgtttatttgatttgtgctgtgccatcccattatttgattaaaaaacatattcatgattggtgtggatatatctaatctggttaaaaagttcaaatcaaaatagaactataaaaaagatctctttattagaattttttttcttaccactgcagagtgctctatatttgacatccaatagatttgagtatgacaataccttttggggttttgatcctcacaatggttatcaacaaaatgacctgcaaaatgcacaaacagacacctctcagatgtgcaactctttgccataaagtgtagctgtgcatcctcctatggcatctctggacatgctatatgatgaaatgcagaaatcaagcgctgatgttgataatcaagctgagatgtgcaggccaacagtacaattgaaagcatcatctgtagaagtgatttataatgaaatgcagactcaaactattgaggctgatgcctgttttgaccagcactttgagcaagcaacagaagaggatttattgtctgatcatgcaatagttacatttcagcaagttgaggaaatagaacacgataaaagtgcgcaaaatccagatcacaattttagtgaggaagatataaacatatttctggagaatgaaagtgtgtccattgttccaagaagggggccagattcttaaagtgccccttgtccctcattcaccaaggttttgcttattaaaattaaacctttgacttctacaatgggtatgcttatatgggtggtttctctacatgcaaagctagcaattaccatagcagaaaaaccgatgttgtgacaaggcacacgttcaaatgcaacaggtggcggaaaccaagtgatccaaaggagaaggacctgcctgaggttgatgaagttgagaattgtttgcaaacaaacacacaaatccattggtaaaaaagagaacagaataaagtggtttacacaaattgcaaagctgagatggtgataacattgaagaggggcttttggtacattacaaggctcaatctagagcacaatcatccactatctccaccagaagaaagaaattcctaaggtctcacaaacatatgacagaccaggagaaacttttgataagaactctgaacaaaatcaatgtgcccacaaggatgattatgtctgttttgtcatatgttaggggtggcttgtctgcagttgcttacacaaaaaaggctgtgagcaattatagagattttgttagaagagaaagtgggaaaaatgacatgatgcagtgtttggatttttttgagaagaaaagatcagaggatccattgttttatttcagattcagaactgatgagaacaatgttgtgaagagtctgttttggtccgatgggaacagcagaaaattttatgagatgtttggtgacatagttagttttgacatgacgtacaagacaaacaggtatgatttgccctttgctccatttgtagggataactagtcatggtgacaattgcctatttggttatgcattcctacaagatgaaacaagtgagacttttcagtggttattcaatacgttccttgattgtatgggtggcaaggttcctgctactattataactgatcaagacttggcaatgaagactgctattgccatagtttttccagacactgttcataggaattgcctgttccatatgttatcaaatgcaagggacaaaacaggaaggacattcaattaagaggatgaagaagtttacaaggatttccatgatattgttacaaaatctcagacagaggctgaatttgaatatttgtggaaagatttcataagaagaaacaatctgtataatgttaggtattttcagcttatgtgggtcactagaaagagatgggcaccagtttacttcaaaagcaattggtgccctttgattcagacaacagcaaggagtgaggggacaaattcaaggtactaagctgacatttgttcatctcatagtgtttctgcattcctagcacagtatgaaaggattgcagaaacaatttatgagtgcttcaaagaacaggaatcgctgactaggaatactgttctagatacttggtcagaatatcaatttgagaagcaagctacaaaattgtatactaggaagatattttgggcatttcagcgtatcttgcaaagctataccaagtatgatgtgaccgtgaaagtgcgtgattctatttttgaggtgtacaaatcagagattcatgaactacaggatttcagaaaaagaaagtacattgtggttgttgatactatatctgaagaatatgaatgtatctgttcaagatttaagaaggatggtattttgtgtgttcatgtgctcaaagtactcattcacttgaacataacaaaactacctgagaaatattttattgaaagatggaggctgaaagacaaaaaccaagaattatctgtgccaaacacattgatgtctgctactgttcttgaatgcaaccctttactcaggttcaacatcttgtcacagaaaatgattaagttggcttcagatgcatcaaaaacaaaacaaaagtttatatatgtgatgaatgaaagtgacaagattgaagatgggttgaaggcaatgagtgatacggctcctaacgaggctactgttcatgttcaggatgcggcggcgatgtcacgccctaaaaatcttaaatatataaattgttgtttaattggaatttttagaaattattttaaaagcctacaagctaaaccctaattttctaggaaaattttcaatataaaaatgagctagataaaattttattaaatactatcttgctcctctatttctagaattttctgggaattatttgagcaagggaagtatttttaataattgaaacaacatttcacaaattgtttttatttaaaaagttcaaaaatccccctcctaggccgttgggccgatttcggcccgactcctctctctccccgcgcgcggcccatgcctgcccaagccgccgctcctcctctcctcagccgccgacaggtggggcccacctgtcggggtcgtcccctacctccggccgccgccgcgcaagccgtctgagtcgccgttttgcgccgccaaatccgcccaaatccgacccggtttcttccgattgttagaggggttttgttcctctcgttctcctctttcttttcccccaagaatcaaagagaatcgttgaggatttgatccgaatcgagttcgttttgattttatccctaaaaccgagtttgatttcttcccaaatcgattcctctcgtttggagctcgatctcttcgatccaatgccatataaagcgtcccctcatcgtcctctttcgtttgccccctctcccgagttctcccgtgcctcctagcgccgccgcgacgtgctccaagtccgccgccgccgccggccgtcttcggcatcgtcgccgcgccgtctccgtcgtcgccgccgcttgccgtcgccgccgttaggtgcgccgtggtgagaggaagctcggccgcccctcctctttcgccgccgaccaccggagcccctccgtcgccgtcgacccgagccgccgcgccgcttcttctcgtcgccggccgccgtcgcgcaccgtttgttgtcgtggtgagtaccaatgggttcgcctcgttgtcctctacgcgtagatgccctccgtttccgcggccgacctctctagctccggcgagctctccaacccgagccggccgccgttgctgacgtcagcgtgacgtcatcgccagggctgacgtcatctctagggctgacgtcatcgtccccttttctttttctttttcccgattttctaatagattaaaacttcggaaaatcataactaaataaccgtagatccgttttaggtggttcaagtttctaaatttttctaaaatcaagatctacatgataaaaatatccacatatactgttcatgcttgtttttgtactgttttgttgattttgtttatttgctttagtttccgacgttccggaggagagcgtttccgttgaggaaggtttagaagcgtttgtggaagcccaaggcaagtcacacagatcccaaacaaccctttgagcatgttgatcccgtttaaagctattattttatttcaactatgcattgttttcgaatgtcatcgggtggaaaacctttcccagttaattaatggccgaagatgactttattttcctatgggttataatttgattatcatgaaccttatatattggattggtttagctaaatgctatatataggtttgcttagtcatgcttagaaacattagctaactaaaaggggttaaatataagttttattgcataattattattgttaataatggttatatttaatggtagctcacgatggtcaatcgtgcgatgttaattaattgataattaaaacctggataaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgatttgttatagtgcgccagactgagaagtggcgagaagtccacgggggtcgctggggagtccatgccttgtttttaaagggggtgattatgatccaggaaaggtgcactgtaatgggttacgttgtgcaaggggtattgtcacaattcctttccgagataccgtggtggtattgaggcacatggtgacatgatgtggggttgtgtcttgtgggtacagtggtacaactctgatcagagtttaaactattcgaatagccgtacccgcggttatgggtgagttgagcaatgttttttgttattagtctcacactactcattaatggtaattatgtggtaactaatttaattcctggtttggaggtttaatttgttcaactggggttggttgttcaaatgtggttgggcctatgcaacatgggtgtgttgtatggtgtttatttaatattgattaattattcaactgtttttactattctcttaaatatttattaaatgatgttttctgcaaatgagctatattgtgccatcctttgttatcctgtgcacttgcatatttgctgtgtggcttgttgagtatgtcatatgctcattcttgcaatattcattcatcagaagaagagtatctcagtgaaggtgatgatctggaggaataggcttgttctcggttaagatgcctgtggagtggagtcgccatagctgttccgtagtttgttttagttttgttttccgctgcgtagaatgttattttctttgagaggaactatctacctctgtaataattttaatttgtgactattcgatagttatttatttgtactctattatcaaattgtcattgtgtgcctcggttgattcctggacgagggcttaacacacatgtaagcgtttggaattttggatagaaattccgggcgtgacaggcgacaacttgtggtgtagcttctgttggtgctcaaactggtatattgatgggtcctagtggtgttggtattgatgctgagagcacaaagggtgcggttgctgaaactgaaataatagatatggttggaattgcttctacttctgttttactggatccaaaatgctctaatagcaaaggcaggcacaagagtgagccaagaaaaaagaggctgatagatgtgattagaagcaagggtttggtgacatgtagtggttgtggatcccatgaccataacattcgcacttatcccaaaaaaaagagaagccaaatgcaacagaagtgatgcaggagaggaaatctagagaactttagggacatagaactttttgggtagcaaaaaaatgactggcctatgtcttatgagtagaaacatcaagaaaaaaatggcattccacattatgtctttacccccctttttgtttgtgtgttttttggatggtgcaaatacaattacatggttggctttgcaggcataactgattattaaaaagaaaaagaattgcttgtgtgaaaaatggcgtaccgtagtttgtcttcactcccttctgttgtgtttaacgtatatctatcctccccccactccctaccccccatcccccaaaaaaacaattggacctgcacacagttgaaaggagaaaaaaagtcactcatcagatatctctcattagtaagacgatcagtatcatgtaaaacacataaaagaaaaatccaggtccttttttaatatttgggtgttatgatattggatttatcatatctagtacaggaattaagctccacataagagaacacgtagcacacaattttgctgaacatgtcctagaatttagaactcagctgtagtacatagaatacaagcaagcacaaaagtatttgtatatataagtgtatcttatatttgtgcaccaaaacaaaactgaaactgtatgttactagatagtattttttttcaataggttgaggactgagataaacccaaaaactgcatgggcttgaaaaaaaaagaaaatgtgacatctctctctctcttactacctggtagtgtgtggccccatctcatgggctatacagaaaaaacaggattgtctaatctgttggtacagaaacaaaaacatctcactgttgccttgcatattttccatgctttgttggattgaagcttctagctagcatttttgcttcttcttgtgaattgtattctgagaacaataggtcatttgcaatttgcttcctcatgtttgggatatattctggtctgatcatatctttcaagtgcatccttgggtttcaccattccatgcacttcatagcgtagattccgcaatcatgccttgatgagacaaaaacaaaaataaatcatttaagaaaaacaaaatcatggaaaaaaagggaggagttttggacaaaaaagaaaatgatatgtaatttgtggatgattgttggggttgataggtagttacccattgttttggcgagtaattggtgggtattggatatcaaatttactaaagtatttctccacatctgagaattcttcccacattgcaatgaatcctggtatctgtgtataaacaagaggagcatgaaaaaaaaccagaaaaaaaatcagtggacgcggtctttttaaattttaaaaaaaaaaaaaacaaaaattggtatggaaaaaaaagaaccaaatttgtatagctcacacatagcccttggattttcttatgaaaattgccattttcctcataaatggagttcaggaaaaaaaagtgatgccccctgaagttccccggtaaccccaacccattattgttcatccaacaatgggaaattaagttccataccataaaacccaaaggggcttccttttatgttattcccccccccaaaaaaaaggatcatttttatgtttgaaaaagaaaaatgaccaaaccaagtcatagtagtgcagaggtttcttgttctggcaaatgtaaaagcttgtcttgcgcaattttcatagtcttcctcttttccagcaccttcccaattcttcaagaaataaacctgtgaaaaaaaggtagagaattttgaagtgatacaactggagatgagaaaaaaaatgtatgtgatagaaagtatgaaaaaaacacatacactagttctatggaagaagtaaaaattcatgtattcattttcttggtaattctggtcgttggcaatcttcttggcatacgcgttgaggacatatgtatccaccactccccttggtgataaagatttagacaatgatgatcatgtgacttttacattgtccattagaactgcaattttactgtaccacaaataaagaagataaatgcttttagtaatgcttagtactcttaaggcagaaagagtacaaaacaaaaaagttcagattacttaatttcagaaaattggaatagtcagcacaagctgtttgttatgcatattatgaaaaaatgcaaaaataatttgtaatgtcatagatttttcacccttctttgcatgccttgttgtgttaaacaaaaagtgataaactttcatttggttgtcaatgcaaatttcagctgcgcctaccaattcaggatgatcatacaaaatataaaatctatgagacatatgtatcaaatctatctgttttcaagcatttctttttgttatctatggtgctttttagatgcctgctcttcttttaaaaaaaaatttaaggattggatcatttcttcttttctgaagtcttctggatgacaacttggctgacaaagtgaaaactgaaaaaactgaagtgctacttgttttcaattgaaaagaaatgcaaaataggatgtggtttgcacacgttagtaactgcatggttagattgccaaacaaaatcgcttttgaattaaggtgtagattaacgaagaacagggccaaattcatccgagaattcacattgcactattggttgattgcagaaataatgatgcgctaaatgcacccccagttcatgaactatagtcgctaatgctttgttgcttgtgaggtctgtcagaactgactgccgtcaccagtgatgcaaaaatgttcaggtgataggggtacaaatcaagcaccgacaaacaaggaacatacatgctgccattaatcgaactgctgctacaacaactacacttttactcccagtaatgtgcaagtttcaaaatatttcagaatgggcagaactgagcaatgaccacaagtatggtcaaaaagatagacaaaagtatttatccactgcctgaataactaaaacgaaaaaaataactactgtacatagccacacatagcagatgatatagcagaactgttgctgaacactggtccgctaatcccagatcagacatctatgcactaatcccagtggtacatgtaaccatccaaaatcatccaaaccctagcaaaaatttctctctgccctgtagatgcatgatgggatctcatcaaccctctgaacaaaacgaagaaaaaaaaactacaattccctgccccgtcacttgttgtctgtggctgccacttcctgcgccactccctcattccagaagcagaggcgcaagagcgccactcccccatgacacccagaatgcacttcagcggtacatgttcgactatgtgttttgaacaacgtttgtaaaaactagagaaaaacacccccctcccatttatttttaaatagaaaagcttgaaatgatcacaaaatctaaaaaaagcaaatgtaaaaatgcaaccattataatgttgttttgtgacacttactatttatattgttgcgtctcaccaatgctgagtatgttgttgtagtgattgagttcagctgccaagattgtttggtgccgtgtgtagttgtcatatggtgagctcttgtatttacttggatgtacaattcttttagggcgataaagattgtgtctggtaccagaacagttgccagaagcatttagtgagtcgatgattcttgtcattgaatattgtctttcttctggttgatcatg

SEQ ID NO: 76794 - DNA, 10496 bp, Oryza sativa
gcagggcgccattgggtcgaagggtataagcagagcaagaagggcgaaagctaagcgaaagggctcgaaaacgagagcgtacgcgcgagcgggagcaagaatgtgtatgacggaagggaaaatgacggcggtgaaaagtgaaagcgaaccacggcggggttatataacccgactacacgacggttcacctcccacccaatcccagcccgccatgtggcacccaagggtagacgaaacggtaaattcccgttgtgtagtacaaggccgagcgaaacagtacacacggcccaatactgttaaaaaaaaactctcaagatttcgttgaacataggcacatgtcgagaagacaaaccacaagctccagaaagataacaagtgttgagttttgtaggtggaagataggtttcagcaggaacatcggccgaaagggggcgcctcatgccataccatatattttgcacggtctcagccgaagctccctactcacccttgcccgtgagaggcttgttggaggcatgtcacgaggaccttcgaccggacctgccgaaaccactgaagccatagggcaaagcgcctgggcaaagccgaacggtgaagatcgaagggcgaagtgttttgggcgaagccgaacgatgaaaaccgaagggcgaagcgttttgggcgaagctgaacgacgaaaactgaagggttcgtccccaagctcaccacttggccaagtcactgctaagggcgaaggctataaggtgaagcaagaggcctttgctcgaacagaaggggccttggaggcttggactataggcttgggaggccttgcagcccatggttcctatcgccattagtgggccggcccaaggagatctcctgagggcccatgaatacaagacacactgtgtacccacactaatgtccttatcataagggcgtccatgtaaattccgctgtactaaataaaccctagagtgtatgagcctgtactaaagactataaatagccccctagggctatgtaatggggagatcccaaaaatttttaccaattaatatattgcttttactattccatcaactcactgagtgaaccacgtctttcgatgtgacgcagttatctttcgacaagagtgatggtttctgaaccgccacaaccaactcgtcagtgatgatacaccgccagtgatgttatgtgaaaaccgccagtgatgtaattttccaaaatccataaaatggacaaaaaaaatccataacaatagtttcaggttaggagaccttcccctcgcgcgtagctcccctaaccaactgcaccacacactctactgtatatattatagattttcgttctactcatatcattctcaaccgaattcaaattggttgtttgatataaagttcgtcttcatcggacatcatatgaaaaagttatgatttttttcacgcagcctgtcattcgcccagcagagataatatcagtggcagttcgtggctcaaaccggcagtgatgcacggactgtgcggttttttaaaaatggcagtgatgcactatcagtggcggtttttgaaaaagtcttaggctgtgatctttcccatgggttcccaacccatctcccttgctttccgggtatacgcttttcaaactgctaaatggtacacgttttgcaaaaagtttatataggaaagttgctttaaaaattcgtattaatccatttttcaagttttttaatagctaatacttaactaatcacatgttaatctatcgctccgttttcgtgcggaggggaggagttcccaagtcccaaccccttcaaaagaacacagccttagtcgttgcgaggtgctcgcattttctcttcgacatagcattacattgtcaagaagcactgctcgcccaagcaattcaattcgttagatgttgcttccagttgaatcatgcatgaagtatccatgcgtaaccaacgttattctaggcggtagagaataaatattagatgaccttttgtttacttgttttttctgacaagagaacatgtcaaacatcggttaccatgttagtatgcatgataatttcaaaaaacagcaatctagctcaccctggtcaaaatatatgctttatagaagattaaacctgtcatgtgcggaggcaggtggatggatccatcagagttaattaaagagactaagcaataccataattgaaagtccaaataaaaggataactccaaaaaaaaaaaatgatagaggaaccattgagctcgctcacatcaaaatatatgctttctcacaaggtcaagccaatcttgtgacgaagcaaatgggtagatcgatcagagttagctaaaaaataaccagccaagatcataatagaaaagcatgacttaacagaggacaaccatttattatcatatacttagcttgtcagtttccttcaatcgagatgtcaattatgtttacacctatgtgacaggttggttcacatgcgtaatactctctcgtctatataaaatataaagcatggttatactaatttgaaatgcaaatttaatgcaacttcttttaaatttcaatattaatgtacatgattagttgaagtcaactcgctaggatcgacgccatgtagtattattttagacctatgattgtcttgcagtaagatagtgtagaagtcttggtcattgcgagctgctcgctttttgtcattgatgtagcattacattgtttagtcaagaagtactgctgctcgctcgagtcattcaattcgttagacgttgcttctgattgaatcatgcatgaagtacctatctgtaaccaatgttattctagatggtagacaataaatattggatcaccgtttgtttacttgttatacttgacaaatagacacagaacgtgacaaacatcggataccatgtccagtatgcatgataatttaaaaaaagaacaatctagctcatcaccccggtcaaaatatatgctttaatttcttacaagattaatcctatcttgtgaggaggcaggtggatcgatccatcggagttaattaaaaagactaaggaagaccataatagagaatccaaataaaaggatacacattgaccgtaactatcaagtgcaattaaaagtacaacttaacagaccacaatcatgtgtccttccagtcaagatgatattattgagatagtgatcgagtagtggtgcattaagatattattggatcggatgcaaatctgttctacgatgaatttaagaatacactctgcctccaactatatataagaatatatttattaaatgtgcaacatatattaattaaatgcccaagttaacaactacgacccttcctgttgaatcatccgtttgtttacttgttatatactccctccgtcctaaaaaagacaaaccctggtttccgtgtccaacgtttgaccgtccgtcttatttgaaaaaataaaaaaaattaaaaatataaatcgcgcataaagtattaatcatgttttatcatctaacaacaataaaaatactaattataaaaaaatttatataagacggacatttaaacgttggcacggaaacacagggtttgccttttttttgggacggagggagtacacaataaatattagatcaccatttgtttacttcttacacctgacaaatagacagagaacatgccagacatcggataccatgtcagtataaatgataatttcaaaaaagaacaatttgcatggctcaccccggtcaaaatatatgctttcttacatgtttaagcctatcatgtgggggaggcaggtggatggatccatgagagttaattaaagagactaagcaagaccataattgaaaatccaaataaaagaatatgttgagcccaactatcatgtgccctatattaattaaaagcccaagctaacatactacaatgatgtgtcattccagtcaagatgatcaaaagtcagggtcatgtaggagtggcgcgtaaaggtattatgggatataaaacacttctatgatgtatataagaatatactctgcccctaacttgaataatatcactacgccagatcctcacacatttgacgacatatctgtgacatgcataaggtgttggtcaacaatgagggtcacctttgatgggttctacaggatgccgtcatcggtgagccatccggctacggtccgtcacaggcatctagtcacctgtgacgggtcaagaatggaaccaacgggccatacagatccagctcgtcaaagatgttatgaaaccatctctagtgggtccctttttttccgtcacaggtggaatctatccaacccaatccttatctatcacccaccgacagcctgagaccacccatatctcgtttttttctttcttccttgtccatccctctctctcaatcgtttttctttctttcttccttagcatcgagcgtccacgcgccgagcaccgggtccggtggcggcctctgactccatgcgtgagtagcggccaccgccggccaccggatctggcctatggggcgcggatccggccaccacagcctcttcccccaccgccggccgcttcctcctccgcctcctgaccgccagctgacgctgcctcccccgccttccgaccgccggccgccggatctggcctacagggcgcggtttcggccaccgcggcctctccccccaccgtcggccacttcctcctccgcctcccgaccgccggccgccgccgccttgcccgcctaacgaccgccggcctcgacacgtttggggaacgcggatccggcgcctatcccccgaccgcctgtcgcctcctcctccgccaccccaccgccgcctgccagatccgacgacagctgcaccgccaaccgtcggattcggcggcctctacccccgactgccggcgtcatccaccgtctccttcttcacccgctagcgccgccgccattttcaactcttgtaggttgtgcaaattttcattgccaaatttcagattgggttatactcacggttgcttgtgtggatttgtagttgcttgtgtggatttgtagtttattactcaaagttggtgtggatttgttatgtatattacttgtgtggatgtgcttcatgtgtcaacatatctgtcaatgaaatgcaaagttattctgtcatgatatcttaagatgttcttcatgtcatgagatatggcgtgtgggttgagagctgagagctagaggctgagagcttttgaattttttttggttgatttttcacacctgtgacaggtggtgagttgaacctgtcagaggtgtttgtcacctttgatgggctaaaaagatccactcaggtgttttattcagtctgtcagaggtgtcaatcattattgatgggctttcacccgtttgagatgatgtgtagtcatcagtgaccactaatctgtagccaagaccaaatccgtcaaaggtgagggttagagcccgtgacagataacgggatccggcctagtgtatattaattaaatgttgtatatatgttaattaaatgctcgagttaacagactaccaccatttattagcatataaaagcttgttggtgtcgttctagtcaagacgatagcggagcagtggcgcacgtacaaatgaattatcagatgtaaaaccctctccattggcaaatttaagaacacactctgcatttgactttaaggataaaaatggtacatttttgtcaccacgctcatgccctaaataccaataggcagagaacatgccaaacatatgttaccttagcagtgtacacgattaatccaaattaaaaaaacaactttggtagagcaaccattgagtttgctcccgtgtcgaaatatatatgatttctcacaaaatcaagccaatcttgtcacggggcaagtggatggatccatcatccatcagaattaactaaaattcactaggcaagactataatagacaagcacgacttaacagacgatgaccatttattaccatatattagcttgtcagtgtccttcaattgagatgtcacgtgacaggttcgctcgctagcgttatagatcctctgtaaaatttttttttcgagcccctcctctataaaatatgaagcaaggttataataatttgaaatacaaatttaatctaattgcttttgtactaaattttttttggcagagatagataaccaatatgggacagatggagtaattaagaagatatagcaagatcacatggtaaaatgggctgtatttttgaggactcgaggttgcagtgaccttatcaattataactagcaattattaaacaggaaacgtactttgattacttgaagtcatctcactgggatatacgccatgcagtattattgttttagacctacacagcttgtctttcaataagatagtgtagaagtcttggtcatctcactgggatttcgctgatggctgggctgctcgatttttctctttgatgtagcattacattgtttagtcaagaaggacagctttcccgaatcattcaattcattagacgttgcttccaataatgcatgtaaccaatgctattctaaatggtagacaataaataatagatcacattttgtttacttgttgcagtcaaaaagatagagagaacgtgccaaacatagggtaccatgtcagtatatacatgataatttcaaaaaaacaatatgatcattgatcaaacaacaatctagctcgctcccgtcaaaatatatgcttccttacaagattaagttgtgaggaggcaggcggatggatccatcagaattaattaaaaagactaagcaagaccacaacagaacagtgtttttcagccgctttaatccagccagaacagtgtttttatctcacaacaaatcagccagaacaacagttatcatttgaaaccatagttataagggcatccacaatgtgaccaaaaagcagtccttataactctatatgggtacctttaccattgtgggaggtggcattaggaagagctatatgataagctacccatagctataaagaccacctatatagattaaaatatactatctctctccttttgcttctttcatgagagaactatagcatttggaagtaatttttttagagtgtgggtcccatcttaatgtcaattactatctatatacattgtggaaatataaataacaaaaaaaccacttatgtgggtcccacctatatagactacttggtccatatacattggtgatgccctaacaacatacaagagacttatcatatggaagcctgtcattattgttctggtcaggatatcaaatgttacatctaatatcatgtgagtgtgaccagttcaataatcttcaatcactagtttgatagtcggtccaccatagaaatagaattaggcgtgatttaatttaatgcatctggatcttcaatcggatggtttccaggtttcacaatagtagcaattgctaagttccctacaaaagtattaaacagatggaagtttggatggaaggtacccggcctggtacaagctagatatacctagaggctagagcctatctatcggtatataaaagggagtatgcctacccatttacaccatgactgaagagcagaaggtgtctagctagttgcctagttagcaccgtgttgtactgttgttccactcactcgctcgtgcgcatactcctgctccatcttagcagtcaggttcaggatggcgttcaacgacgatgagaagcctgctactactccaattccgaatggaggtatcgtcttaattccatcagccttccattgatgcattacatactggaatacataccgtttgccgcaatttcgaaatgatcctgcattgaggcggattcaatacatgtatatatgatgtgcagggagcaaacagggcctcgtgacgatgaacatcccgacgtacagcaagaaagatgtggctctgacggcggactcagtgacggctgtggtggagatcaaggcgacgtcctccaccgccgtgagggagggcctggacctggtggccgtggtggacgtgagcggcagcatgcgagggcacaagatcgagagcgtcaagaaggccctgcagttcgtgatcatgaagcttacccccgtggaccgcctctccatcgtcaccttcgaaagcagcgccaagagactcaccaagcttcgtgccatgacccaggacttccggggcgagctcgacggaatcgtcaaatccctcattgccaacggtggcaccgacatcaaggccggccttgacttggggctggctgtcctcgccgaccgcgtgttcacggaatcccgcaccgccaacatcttcctcatgtccgacggcaagctcgagggtaagacctccggtgacccgacgcaagtcaaccccggcgaggtctccgtctacacctttggtttcggccatggcacagaccaccaggtatgtatgtacaattgctagttgctacttgctactccagttgctagctattgctaaccatcctcctgccttgtaattggacgaatggtattgccattggtagctgctcacggacatcgccaagaattcccccggcggaacgtacagcacggtgcccgacgggacgaacctgagcgcgcccttcgcgacgctgctgggtggcctcgtcaccgtggtggcgcaggacgtgcggctgacgctcacccccaagacggccgacggcgacctggacaagatggaggtggccgacggaacggactacacgcagaccaccgacgccaaaggcgagatcaccatcaaattcggcacccttttcagcggggagacacgcaaggtcgccgtcaacttcaccctcaacgaaagccccgacaccgaggagtacaacgcgaccttagcggtggcgaggcacagctacgccgcccaggaggcgccgcagcctgcccagaacatcgtgcggctgcgcaaaccggagccgaccactcccggcagcgacgacggcatcgaggagcggtccgtgcaggccgaggtggtgcgccggaggcacgccgacctgatcggcaaggccagcgagctggcgaatggccagaagctgggcgacgcgcgggaaacgatcatggacgcccagaacgcgctgggggacatcctcctggacgacggcgacaggatggtgaacgcgctccaagccgagctgctgcggctgctggaatacatggagacgcaggcgctctacgacaagctgggccacccctacgcgctcgccaccatcatctcccatcgccgccagcgcgccgctggaaggggcgacgaggaggtcatctccctctacgtcacgccgcgcatgatcgcctacctcgctcaggccaagaagttcgaggagaacccggaagcgccggtgcccagcgctgacgaggatgtcaagcaggagatggctgccaacccactcgccgctatctccgccccgctcggcttctacctggagaacgccatccaggcactgcaggccatccagaagatcatcgccgccaacacaatttgatattatatattgccttgcccgtccaattcgaatttactatcccagtcccagacgcgcatgtgctaagttacgttgttcttcatctctttcaatttcctttctcgcttctgatcatactacttatatgtatgtaaccgatccaataagtgcgccggcccctaagatgtaatcaatctatatatgtaccactgtaatgtaatgcaagaccctttttagagcaactacaatagcacatttaaattcagatttgctcctttgcagacgattgatattttgttattccatcagtcacatgtcttggtgcaaagttttgagcatattagtatgaagttttataatgtgatagttcaaagttttttagcagtgcctgatattttgttttcatatcggtcaactgtcttggtgcaaagttttgagcctattataaagttttataatgtgatagtttaaagttttttaacttaccagtacaaagtttgtattgacatagttcaaagttttatatttttgagtccaaagttttgaacctagcggtacaaaatttttattgtttgagtgatggttaaacaaactttggggctgcctattctgcagtcgattgcaattttttcatttgatcagtcaactttgtgcactattagatatgtatctaacggtaaagctcaaaaaatcaacacgtgacgtgcaaaaacaatcacaacctgatgcagatgtttgggcccaaaagctaacaaaaagcccaaagcccaaagttgtttaaaacacacttttgggtccaaaaaactaacaaaaagcccaatgtttgggccccagttttttgggctgtgttatgggccagcgaaagtgtgggcccgagtctttttttgggctgtagttcagtgagtctggattttcagatttttagctgtgatttgggcttttttcaacaaaacaaatgggctctcacatgatacccgtttttgggctttttagctccgatttgggttctgtcacaaaaatggtc

SEQ ID NO: 76795 - DNA, 1869 bp, Oryza sativa
gcgagctggttcataccaagtaacctttccatcatctcatctcactcccacatgatggagaactactagcttgctgttgagtgttgaccactggaattgttatattagaaaatcttacttagacctggtttggttcccaacttttttttcaaacttccaacttttttatcacatcaaaacttttctacacacaaacttccaacttttccatcacatcattctaatttcgatcaaattttcaattttggcgtgaactaaacgcacccttactagtacttggtattcttcaactgcaggtatgacactgatttctacatgctctgccggtacccgtcggcggtgaggccattctacaccatgccctgctccgacgacccacgctacagcaactccttcgacgtgttcgtccgaggtaattgacaaaactcatctcaagataccaccgatcttctcctgagactagatcattctctcgcaatttggagggaaaaaaatgaaataagattttctggccatggaatacaggggaggagatcatctcgggagcgcagagggtgcacgtcccggaggtcctggcacgacaggcggaggagcgggggatcgacgtcggcagcatcgccgcctacgtcgacgcgttcaggtacggcgcgccgccgcacggcgggttcggcgtcgggctggagagggtggtgatgctcttctgcggcctcggcaacatcaggaaggcttctctcttcccacgcgaccccaggaggctgaacccctgaaaacaaaaaaacacaaccaactatccaccccaaaaccaactggtttctttcatgtttgtattttgcgtggcaagaattctatctgaacacaaacattcgattcaggaatccattcatctcgaacttgtgtcaaaatgcgtttctatttgactacgctcgcgtggcatcactaacgggagaatacatatagccacattattacaactgaaacatagctacattatttcacgtataaatacatgcacattgttggtgctgctgctctgctcgtgctgaactacttgtctgcggccaagacgcggcgacggtactccccaagggcccaaatagggaagatgtttctatactcggagtagctgatcatgcagtttttgttgaagactccaatgatctcctgttatatggttggggggggggggggtaaaaaatgttatttagcatctcggatgatggtaaataatacatagtgaaaggaaaaggataactcatgtcagcaatttagttttcctcgttcaatatcgagtgaagcaatgcgtgttcccctagcatcaaagatcttttaacaacattgcgcaatgatacttcaggataatttccaagcaactttggatctatggtcgaccggttagataacatgcctagaatagtctaatgattagaaacacgcaactaagggacaaccctcagtcaattagtttagattatattgcttgtcaatacctaaaccctatatttctgtgcttctacttatgcccattggaacttctatgaaatgctctatttttaaaaacagaagtttgaatcaccacaagattattacaggctgaagtaaatgcatcactttcttttctagagcaacgtttcatgtcatgaacccatgggatggattagaacttacttgctggggaaattcaccatcttccgattgtaagttgatcaaaaccttcgctgctcgatgcaaaggaattggatctctctcagcctgcaagaggaaagtactatcacgaataagcatatgtatcattttacgataactgaaaagtcaaccatacacaaaaatatatttaacaaaagacaaacctgccctgcatcgattagggct

SEQ ID NO: 76796 - DNA, 1320 bp, Oryza sativa
aatggttgggccctttgcaacagggtatgttgtatagtgttggattaatattgtttaattatcacttaactgttttataattctcaaatgtttgctaaatgctgcttttgcaaatgaaaccctactatgccatcctttggtatccttgtgcacttgcatatttgctgcgtgacttgctgagtatgtcatatactcaccttgcaatcattcatcagaggaagagttctacaatgaggctgatggtgtggaggattaggtgtagccttggtcaagctgcctgtggagtggagtcgtctgcgccgtttaatttattttccgctgcttagattttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcatgacaatcagatagcttacattttagtttctcgcacctatgttgatgaatcttacttagtgcaagatcatatacataagcatggagtagatggatcactcatattctttttccaggttgtacaaatgaaatcccgttacctaacccagggtatcatttgtataattgtcttgagctaactattcccctgcagacgatagaggaatttcgtgctggtacaatacatagagagccctgttacatggcatggagatgaacatgaaggatcaacgtcctcaccatcagtgcagatgtacgaggctgactgggaaccaactgggggatgctcctggatggacccaagtatccgactacgctggaggttcagcctggcagagtgccagtgaacaccgatggcaagtgcctcaagacacatcctatgggaactcccattcctccagcactagtggcatgccacccatctccaagatgtggcgctctagttcctctcgaggggacttgtgggagctcactaggagaatggacacacgagagctgcaagcaggagagatccagcacaacctcgaaggacacatggcccaaatgtaagtatggccaacctctgatgctcagtacgccaacctcaacaatctgatgcagcaacagcaggctgacctacaggcgtactttcgctttcagcaattcaaccctatcaggggccctgagcgaaaagcaagcttgggggagatatctcttccccactgaggtaacttgtagtagattgcatattttgcttttccaaatgcatatttctttcatgcactgcattcatgaacttgaaaac

SEQ ID NO: 76797 - DNA, 12629 bp, Oryza sativa
gccgcggcctcacgctgtcgtcctcaagatgctgccggccggcgccacgacggcccgcctttccgcgatggacgccggcgcccacctctcccccatcccctccacctcgctgcgcgccgccattcgcgccgaccgccggcctgcccccgcgcgccgctgcccatcgcatcccctcaccggcgctcgcctctctgccatggcgtgtcgccgtgcgcggcgctgcctgctgctggccgacgaagagagagaaagagtgtatgacatgtgggtcccaccattttaaaaaaaataaaatgctgactggactgccacatcagcaagtctatcccaaaaccacctaaaacagtgctcagtggggtaatttgcccggtttcaatagttgagggtgtagaatgtttggtttttgagttcgggggtgtaattcggtcgacctcgatagttcaggggtgtaattcgtactttttccaaaacataatagcaacactttaaacatgttttctcgtaaattatactccctccgttttttaatagatgacgccgttggctttctctcacatgtttgaccatttgtcttattcaaaaattttatgcaaatatataagatataaattacacttaaagtactatgaatgataaaacaactcataacaaaataaattataattacgtaattttttttgaataagacgaacatgtgagaaaaagtcaatggcgttatctattaaaaaacggagatagtatatcatatctatgatctgatcacataattgtatctgttacaatatatctttataacaaggtctattatatttcgatgaaagtattttgaaagttttttcagtgcattggattatttagtgttgcacatagtgttatttatatgtttcattaagtattgttttatgttttactaattcatttgttaatgttgtacacaatatttttttggatgtttcactcattattttatgatgtttcacaaaaccataacttgatgttttatgtgtgacataaaaatgtttcaattaagttaaatattttatttttgtttcactcattggaattaattaatgttttatgtagtggtttttagcgctgtagtcagtattttttcagtgttgtatctcactgaaacatttcatggagtgagtcaaaatattttttttatatgggatgaaacaaggctagatttttaatatacgtatttttttatcaaaatataactgtatttgatcttgttataaagattaattgtaatgaatacaacaatatagtcgaattattgatcggataattaatttagtgagtaaaatcatttaaagtttgataaaaaaagtattagtatgatgaggagagagtagtcgaggagaacatacacgtaggagcttgtggtcctgtacaagcagctaggaaaaatggtactcctacatgaagtccgatacatatttgcttccacaataatctaatgaagtcttcaggcctgctgctgcacagcacaagtgcagaactaaccagccagcaccgcctctataaatacatacatgttgccactcgcacaattgcactgcagactgcagtgcacatctgcacacgttctcgccaatcgccgggcggccatggcgatgaacttcgagatgtggggcgcggtgtggtctgcgctggcgagcctcgtcttcctctggcccatgctgcagaaccacgtccccgccggcctccgccactggctcaccgccatggccgacaagctcgcctcccacctcagcccctacctgcacatcaccatctccgagtacggtgaccaccgcttccgccgcagcgacttcttcctcgccgtcgaggcctacctcagccacgcctgcgcccgccgcgcccgcaggctcaaggccgacctcggcagggacgccaggagcgtccaggtctccgtcgacgaccaccaggaggtcaccgactccttccgcggcgccacgctctggtggtacccttcctccatgtccaacaagtccagcgtcatcagcttctaccccggcgaggatgagcgccgcctctaccgcctcgtcttccaccgccgccaccgcgacctcgtcctcgacggctacctcccccacgtcctcgccgagggccgcgccgtcaccgtccgcaaccgccagcgccgcctcttcaccaacaacgccagcaccagctggaacccctaccgccgcgggaagggcgtctggagccacgtgcccttcgagcacccggccagcttcgacacgctcgccatggaccccggcgacaaggacgccatcgtcgtcgacctcgtggcgttccgcgacggcaaggactactacgccaaggtgggcaagccatggaagcgcggatatctgctctacggcccgcccggcaccggcaagtccaccatgatcgccgccatggccaacttcctcgactacgacgtctatgacctcgagctcacggccgtcaagaacaacaccgagctgcgcaagctctacatcgagaccaccggcaagtccatcatcgtcatcgaggacatcgactgctccatcgacctcaccggcaagcgcaagaagtcctccggcgacaacaaggcgtccgacggcggcggcgagggcagcgacgacaaacccaagctgccgaccgaggcggacaaggacgacggcggcagcaaggtgacgctgtcggggctgctcaacttcatcgacgggctgtggtcggcgtgcggcggcgagcggatcatcatcttcacgacgaaccacaaggagaagctggacccggcgctgatccggcgggggaggatggacgtccacatcgagatgtcctactgcggcttcgaggcgttcaaagtgctggccagcaactacctcggcgtggagcagcacgagctgctaggcgacatacggcggctgctcgaggaggccgacatgtcgccggcggacgtcgccgagaacctgatgcccatgtccaagaggaagaagagggaccctgacgcgtgcctggcaggtctagtcgaggcgctgaacatggccaaggaggaagcacaagcaaacaagccggcgaaagaggacgaggaggcaaaggcagcgaaagggatagaagagatgaaaaccaaagagcaggcaacgaccaacggtgaagacgaagggaaggacaaaaggacatcggaagagaacaaggccaacggcgacatatagatattactagcaaggtgacaactaaggataagtatttttctacacctaggtgttatggcacccatcatttactagcgactcagatagttattgaaaaaaaattgtaacattaattgtgatgatataagtttaaacacaaacatgcaagactatctacaactagagaaacaaaattaacaaaattagatagttaattgtacccgtacatcgcagataaaatttgttatttttattttttcatgtgtagatcgaatttagacttacatatttgtatagtgtcttatattatcatagtctatcttattaaattttatgaaatttttatataactgttaaactatatgcatacattaggtgtggaaaatacttttcgaacaagctgaacgcaaaatactacagtacgttctcaactaaagctcgtccctcgtttactattcctacagtagtgcaggtcaattctgtgtgcttactggttgtttgattacgattctctgttctttttcagtgggatcatatcgggcagctgcagatccctggagttgcaagccatgtatcctagcagagtgctcatgaagattttcaacctttatttttacataacagtttgctaatagggcctgcgaaattgttagcatttccgtattatattaaggctgatagttgcttgtattttgtaagaatataataatgctatgcacgccttcaagcaaagagattggaggtaatctggccgggactagtgcctagatttcagacgccaaatcaaacggttttcatcgctggccttagagcaagtttaatagtatagcccattactagctctaaatcatctatagtcaatataatagctaattcatacaatagttgattactatactattaatacctggtcccacctgtcatacacacattacgtcttggagtccgtgctgcagctgactacagatctgtagcctgctgctccactacgccggaccaggccatctctgacgggcccaaacgtaactttgttgatctctgacgggcccaaacgtaattttgttgatctctgacgggctaaacataactttgttagtcatctctgtagcccgctgctccacattacgttttggttgcttgatctaaggtcgtttgaaaattttgaattttcattgtgagcaattcaaacgtaactttgttggatagatgatttcaaaagaaaaagttatcgactacaaaattttttaactttttgagatcaacaactatcatttttcccatttctccgtcggaggtcatttgaaaatatgaatttcaaacgcaattttccttgaatagatgagccaaatgaaaaggctgtcatctacaattgtacaacttttcgagatttacaactttcgtttttgtcgcttcttcatctgacatcatttgaaaattttgaatttctaatatgttcaattcaaacctgattttgttggattgatgctttcaaataaaaaagttgtcaattaactacaaaattttctaacctttcaagatcgacaccttttgtctttggtcatttctacatttgaggtcttttgaaaaatttgaatttcaaatgttgggaaatttcaaatgcaaacttccttggatagatgagccaaattaaaatgttgttaactacaaagttgtatgactttttaagatctacagcttttgttttgttcattttctttatccaaggtcatttgaaaattttgaacctcaaatatgagaaattcaaaggtaattcgttggatagattatttgaaagaaaaatttatcaacttgcgttttgggtttttttttccattcaaggtcatttgagaaatttgaatttcaaatatgagcaattcaatggtaattaaattggataaatgatttgaaataaaaattatcaactacaaggttttataacttatcaaaatctttaacttgcgatttggtcggtttcatcatccgaggttgtttgaggaatttgaatttcaaatgtgagaaagttcaaacatacttttccttggatagatgtttccaaatgaaaacattttcaactacaaagtttgacaactttgaatatctgcaacttttgttttgatcgtttcttcatctgcatttgaaaattttgaatttcaaatacgagtaattcaaacataacttctttggatagatgatttcaaatgaaaaagttttgaactataaagtagcataacttttcgacatctacaacttcgattttggttgtttctccatccaaggtccctaccactacacactcaattgtgaccatggagcatttggattcctttggtttaactttgtcgaaaagttgtcaactataaaggtgtagatctcatcgaggatataactatattggtcgagttgtgttttaactatgttgggcctaaataaatttgaactgggacgaaattggaagcctccgagcatctcccaaagtattctaaattctcttcctaaaaatatgggggttttaaaggccccaaaagatagagagaaattaaattgcctatcttccaaaggttcccatattccacttccataaagatccaacttttggattttttttggggcactatttcggagagcgctacgggtcggacgtccgatatttcactatatatcggacgcccagccaaccactaagcgcatgctactgcgcttctttgctcctcgatcacgggcttatggctgtgtgttggatggctcttttcatgtctagatggcagcatatcacttcttgccgctacatgcatgttatggctgcatgtctactctttaaacaaatcataacgtgtcttctccttttttttctctcatatatctactctttaaacaaactttaatcttaaaatgcaaatccaatttttattcaattacgccataaaatatatgtgtctcaaaaaatcaattgtttttatcatttatagaaaattgtttcaccatttgtgcctatgtttcaattcatctcatgtgatgtttcagagaattgcaacatatgaaaaatactagttgcaacaatcataaccactagatgaaacactaaataccatcatgtgaaacataaaaaaaacatacattatatttgcaatttaaatacttgattttattaaaaaaaattaaaccacacatgaagcatagttgttattgttgaaaaaaatcattcaaaagaacaccacttgtgcaacattttcaaataacatagtggaacattaggaaatactcattggaacatccaaataatattaggtgcaacactaagaaaatcagtagctgaaaaataagttttgataaagttgtggggtcttgttattaagatttaatcgtaacaaatatattggtgtaattagatcatggattggacaaatagtttaactagaaaaatcatttgaagctaatgatttctttttcttccctttcacacagtgtgccaggttaacacctgggctggcagagcactagagttgtatgggccacgagcgtccgatgccatccgacgtacgacaggaagcatttccgcactatttctttttcatgcgaggtccatctgcttgcgctggactcttcgcgccgccgctcggaaacgacgacggggcgttcgtttgcccgggcatctatttggactgccgtccaggtacagaacgctgaaattctgtgtgcttgatgccatacaatgtgtgcttctgtaggtctgttaggctgaaattctgttggccatacatcatgagatttacggctcaggttgtgtacgtttatatgtgtatttgtaaagtatttctgggattatttttctaaaggaaaatgaccatagataaagcaaaggcacatgcgcacagcactttcgttgtttggagatgtgacgtcatcaagctaacaaggagcacgaatcggccctcttggcgttgcgtgcgagcgtgtgcgatagccgaggccgctgctcaccggagtcgccgccgcctgtgccgaggtcgaggacgctgatgctgccgcacccgctacccgccgaggtcgctgctcgccggcgcgagggcgtcgcctctcccgctactcgacaaggccgaggtcgctactcgccgaggccactgcttgccgccggtgcggaggccagcgcctctcccactgctcgacgaggccgaggtctctgctcgccggcgggagccacctcagccatcgttagccgctccggcgtcgctcccgtcgggattgcgtgtgtgcgggcacagagctggcctgcggggctcgcggtcgcggccggcgtcgcgcagcagcgcgcctggtgtgcggagatgggacaaaagcggcgacgaccggtcggagtggaggatgcaggcgccagcagagcacgcagcagagcaatcagcgcctgtaggcgtatacgtacgtaataaccgcaaacagggtaagaactgaatttcttcaaggaaacggaaacggaaaacgtacagataccaaaccgagccgcaacgaaacggagacggagagcttattgatggctggagcgctggagcatgatgcagacacccaagtgaattgcctgtgttagcgaaaaccaacgattgaacacctttcgtgcgttctgcaccaatccggcaagacaacgacgaagcacagtgaagaacaaagacgatattcagagaagaagaaacagaggaaagcagaggagtttcagaactttgcagtttgcacgagaaggaaatgcgtgtggaattttctgtagatttcattcaactgaataaagaaacttacaaatggaaatttagctattctgctacttatactccataaacagaaaaaggaatcctaggctcaaatcgcgccatcccacgatccggaactcctggattcaacgccgtgcaaaactcacgcccacaacgcacgacctgacgcggtcgccaactcctgcagctcgccacatctctcgtgcacgcataacaaactcaaaactgacttattcatccagccgttgcaaaagccacagtctggaacaccttggggccacagctgaagtaacaacgtcaatagcctgatcatcagcttccttcagcagcaccgcttttggatggtgaggtgtccggtcatgtgccaaccctctttctcgccggcttcgccgcgcgcgtacgggcaccacggcgtgaagttgggcaggctctccagcatcttccacttggcgttggggtcctcctcgtcgtcggcaatgccggtccatgtcggcgtggagtactcgtagcggctgtgcgtgatgcggtggaactcctggatgtccctgttcttggccatgtccgtggtgtcacgcaggttgacggagaagatgtctccgtagggcctgaccgagtgcgtgaagtggggcatggagatggggtcggcggagaccgcggcgaggtcggcggcgaagacgatgctcttcatgtccgggctgaacacggggtggttgatgtgcccggcgatagtgggcgcgctgtggatcacccgcacgggcaccggcacctcgcccttcttgatgtctttggcgttcaccaggtacacggcgaagtagcctgggtccaagccgtggtccttctccggctcgtccttgcccttgactatgtctttctcgggcctgccggtggaggagaagacgatccagtcgcagccctcccgcggcgaccagctgcagtgggtgtcggtccaggggccgtcggtgagcgggaccacaccggcggcctcccccttctccgcgtctatgatgtagaggttcttgtgctgcctctcccctccggccaccctgttcctgcttgaccggaacacgagcttggtgccctcagcgttggtggacgggaacgcgcagttgtactcctcgtcggtgagcgggaacgtctccatgttctcgtagtcctcccgggacacgttggggatcctcatgatctgcaccggcttgtcgatcgagaaggccggcccctcgcagacgtagagcgtgtccaggtcgtcgttctggttccacgacgtggagaagacgctcttggtggccctcaccttgtacaccacgcggaggcccctgccgtcggcgagccacacggccttgaactgttgtccacgaacgccagcttcttgccgttcttggagacggacgggaacacgccggtcaccctgaagagccccacgtcggcgtgcgactccgggggctgcaccttgtcgaacctcctctggatgcttgtcgtcggagtactcttttggttttggaccttgagtagcttgtcggttcgacagcggtggtagcccacgcgtgttcctccgtcgagcacgaaggggttgtagtggtccccttcaggcctcgtcttctgggtgatgggcaccgacgtcttggaggccgtgtcgaagatctcgatgtgcctgtactgcgtcaccacgcgctccaccttcatgaggacctgcttggacttctcgcggacggtcgccacggccacctgggtctcgctgatggccgccggagtcatggcatcgatgctctcatccgtcacgcgttcctccttgccagcggcgatgtcgaaccggaagacgccccacctggcggtgttggagggcggcgtggtgtcgaagcctcggtggaagaagatcacgttgtcgctgccccacgtcggccagccgccgtccttgatgagcaccttgcggtcgctgcggccctgcgctcgtttgtccacgttcatgaccacaatgtccgtcttgaggttctcgatctcgccgttccacctgttctgctggaagttggccaccgccaccatcttcccggacggcgacaccgccgggctcagatcgtactggcccagcggcgtcaggcgctcggtcttgccgtcggcgaggtcggttctgtacaccacggtccacggggtgcgccgtgctttcaccggcgccttggtggacacgtacaccagggagtggccgacggtggtacgcccaactttgaagccgccagcgacgcagccgctgtcctccatgcgcactccgccgaaggtgtcggcaccgtagatgttgcccaggctcagcaccttgacctgcttgccgccggcgacgaagcgcaaagccacgtgcagcgtctccaggcccctgtccctctcggagacgaacaccaggccggtgacgcggcctttctccgcgtcctccggggtggcgccgcactccgacgccagcttcgggttcttcttgcccaagaacgtcaggagctctttgagcgccgctgctgggatgggctgcccgttctggttgtatgactccccgtcggtgaggagcagctcgtccttggcagactgcggcggcggattagcggggcaggagaagatatccaggggcaccggtggcctgtaggtgccgaagaaagcgatgctgccgcggctcttccccattccgatctgtccaaagaaagaacaaagagatgttcttcacttaatgatctgtcggtttgtgtttgtgtggttagatgatgagcttggatgcctcatttatagagtagctgttgattgatcacctggctttcaaagcatgtgtcttgactaatctctgtatatcgaaatccgcgcagattagtgtgcaattgtagtgaggcaaaaatgagcggttcgtgcatatgctcttcccgtgaagggctaaaatgtaaaatataaactttggttctctaaactttaggtgtataaactttaggtgtatagaagtactatatataaaaatatttaaattcaaattcaaatttgaatcggatatataaacttttgacttgtaaactttgggtctttaaactttaggtgtataaactttagatatgtaaacttgaggtgcacaaattttaggtgtatatatttactaaaataggaaagtaatgtggtgccaaaaaaggaaaccacgtggagggggtgattgatgtggggagggggaccgatcgtgcccggcgatcgatcgccccttacaactaatcggcctctcgtcctctcctgaagggtaagggttgaccacttgaccccatgtctcttccccttccaacgatcctttctcgatgcctcccgataatggcgctggcatctaaaaatcatgaaccgtcggatggagcagtcgactttattatagccgtacactactacaaatagtagtatcaaataggtgtgccactataggtgccagaagtgataaaaccggcaactatagtgctcttcccaccctcaaaagaataaaaaaaattaaaaccgacacctttaaacgaagataggtgtcggttttagagaaaaaccaacacctatattataggtgtcggtttttttacacctataaaatcgagcctagccagctgggggagatatttttcctcccggtggggcccacacccacactggcaggagataaggtcaagccttctctcggcttctcccctagctcctcaatttcctctctctctctccacttctccccttctctcggcttctcctctcctctctctctctctctctttgcggcagcggcggcctcccctccgctttatcggggggaagggaggtgcagcggcggcccggacctcccctccgccagatcggggagagagaggcactagtaaaggaatgatttttctagacgccggccccgatagattccagacgggctataagtggctccgtttagaaaaaccgaatgaccggcgttgggctgtcacccgcacgggaatatacattttcctgtgcgggcgtcttaacccgaccgcacagaataatcatcattatcccatgcggatgcggttgacttaagaggaccgcactgtcgacggtggatacccgtagaccggatatagagggtattggggtacgttggtacgaggatctacgtagtacgacatcaagcaaacaaaagacaaggattatactggttcaggccccttggtaggtaatagccctaatccagttggtatgggattatatgatggagaccatagtcgagttggttcgactagatcacccgatgacttggctcctgtaggctccggcttcgtaggctgtggtggatgtgttggcggtgagattcgatgccttaggtcttgctcagggggtcccttttataccacgggttagttgatctccaagtaggactcggagatattggacccctcacgatatggtaaagacctagtcttatccgagtaggactcctcccatctgtggattctgtttctatcacgtgatagatttccttacgtataaaggaactatccgtatacgcgcagggtataccgtatcggcatacaacgtacatccaaggatagagggtataccttatccgtaaccctgacacacatggaaaaatcgattttcgcgtgcgggctttttaagtggaccgcacgaaaaaatacctctccctcttttccctctcaccacttcaaaattttcacatcctctctcttcttttccccttttttattct

SEQ ID NO: 76798 - DNA, 2764 bp, Oryza sativa
aagaaattccatagttcaaattttagtgagtaaccaaattggaaacgacttgtggtgagttagaagagtaccaagcctggcataaggaacatgggaccaccataatccccaggccagtgtccatcatgtgcttgaaaagtagaataacgagcaattgccctttttagagaggataatacagcttcgcctgtaacagcttcatgctcctctagcttgatagctggaatgtccagcttaagaggatttgctttagcaaactgcagaatatacaaaataaatgcttaaatatcagggatgacatgtgcattgactagtgaaaaagacactaatttcatggctaatacatagaattcagggcaagccaaacagaagtaaataaatgaaaaatattcagcacaaaattgcacgtttaagatattaccggacagtctataaaatcgtgacgtcagaaagttacctccaagtataatcacatttgtctcacttttttactgtttgcacatgtaattggtattagacattttgaagtaaaaagtacctgagttctctgcatcctacagtcctcataagaggctaaaaacatgctaacccagtttgatttgcccaccggccactgcacattaaaagctactttgagttaaggcatatccctatccagccagctcttcccattgccgtccccacaagaacccaaatttttaggtaatgaactggatggaggccccccacatggtacttcaccagatccccaaatttaattccaagctactcggtgcacaagcaacccggaatcaccaaacaatttggatgcagagctctcagggaacactgaaacacagacaagacaatgataataaaaaaacaagaattcactagtgcagggcatcctactactgctaattaacatggatagcgaaacatctctatattgtcaatgggcaactctgcgccgcaacctcgaatcgtatggggcgtatggctggaattgaatgcagcatccacatcaaaatccaccactggaacatgcaaacggatgaggcatagcgaaaagggaagagatcgatcgccggcttgcatcgcatccaccacgaattctagcacgaataaggaaaaaagaaggcgcgtgcaagttgcgagagcccatctccgctcacccacccatccacccgatgcgcattaaaccgaaatacactgtatctgaaacagcaatcacatcatcaccgcattgaacgcttccagcgacagcgtcgcgctcgatcggtgacgccgcctcccgcgagagaacaccgcgcgcagatgtgcgcctcgccgcctccggccacgagcaattcagacgagctaagcaaagggggtagtatatagtacagtagtaggagcgagagggtggcggcgcggggagaggcattttacctgcatgcgcatgaggaggtcggagctgtgcttgagctcgtggcggcgggcggcgaaaccgcggcgggcggcctcgacggcggcgagctcgtcggggtcgcccgcggcggggtcgaactcccagacctggcgccccacgtggccgttcttcgtgcgcagccacgggtcccccccgccctccgccaccctcagccgccacatcctccccccccccctccccctcctcgccgccgatcaaccaaccaaccaaatcgacggcgtcagctgcggcggcggcggcgagagagcgaatcgatcgggagcgcggggcggcgcacgagcacgagataccgccgcgttataatacggaggagcggcacaggctggaactagtggtgatctggattctggcctgctgggttttttttttggctcggcttgggccttggggcccactctttctttgcggttgtgtggtggtgatgtggcactgacagattgggcccacaaatgccacgccggctgtatgaaaaggaggtctcgtgggctgtgtccggatccggaatgtctgtttttcttttcaaaaaataatactattacttccatcccatattacttatttatcgctttgattttttatttataatatctgatcattcgtcttattaaaaaatttagaattattatttattttgtttgtgacttgtttggttatcaaatgtacttcaagtataacttatcttttttatatttacactaatttttcaaataaaacgaatggtcaaacattttaagcaaaaagtcaaagcgacaagtaatatgggacgtgaatagtactatatatagtctcttcgtttttaaatatacgacaatgttaattttactcaaaaattttaagcaagatcaaatataagttcatgcttaaaacctttaataaatcaagtcgcataatacgtaatttttttaataaatattaatggttaaacgtatccaaaaagttaatagcgtcgtatattaaaaatagaggttgtattatctcaagtggttggtgcgtactatctctattctaaatatagtaacctatattagacacatcataatacaacgaatttatagtatcttaaaccctgggtttgaaaagctcaaatgtttttcacatatttcaaatgaaatttgtatgaacagggaaagatatttcatgctcgatagatttcattatacaccactcaatttgcaaaccttttcaaatttgaaattcaatgtgcacgcctttttaaattttgccattgaggatgtgaattctttcattccgtgccgctttatccatttgacgtctgtccactaccactgcatgataccatgacgctaggcaccc

SEQ ID NO: 76799 - DNA, 4338 bp, Oryza sativa
tgccatcaaagaatggttgctgcttttcattttttatgtacaatttatactggtttacttgtacatggagtagatggatataagaaagcacagggattaggttatgccatggggatggcatttgaaaaaaaaaattactcgcatataaaatgcgcatatagaagtagtatgtgtacatgaagtttgaaacaatacttactgaatcttttatcatgtaattttgttattgatcagtccggtaatgtgcaagttaccatgagtaatttcttacatgaagcttgttaatttgaagtttggcgtcactcgaattacaaaacaaaacttccagattggtatttactgatatttttgcttaaacacaatttgcgtgcacagctgcagagaacaaaaatgctgctgaagcatcaaatcaatgatctttacatgacctttgataataatctttacatgacctttgattcaggaagggaagacaaattgagagcaagaggtatggtaggactggagaggagagagccaattgtttgtcatgtacatatgattcttttctcggtaattaactccgaaagaaattatcaattaataaaagccctaaagctaccgattctctcttttttttgaaatattatttttttttgctcctcgttaggagctcctcgattgggtgagctgtggagcctttccttttctctctcttcgggttccccatcggttctgccggtcacgcgctgcatgtgcgtcacgttttgcctccttggagcaaatgacgcgtgctgatatttatgcaaaaaaatcctcgtgtttgaacggaatagcgtgcactgcctcccaccgactaacatcacgttccattttatacgaaacaaccctcgtattttatagaaatacaacacgaagaagatagagttctactcttagggggtagcgatgtaaacataaaaaacaagaggttttttccaaaaaaaaacatatcatacctatcccctcccctcccagctcccacccccaaactctatcctcacatcccctccccacgacgcttcgccgccgcccctcccccttgctctctcccctatcccgccgccggccggcaatggggcatgcggcggcggctgacccagccgcgagcgccagccgtccccatcaggaagccgcggcgggcgaacagggcaagcagggagccggggagcaagaaatcgtcagcgtggaggagcttgcggaactcgacagcggcgaccacaacaggagcttggcggcgatgccggtttcgaccgcgagttcgccacccctccccacctcacgcagatcgaaagacgtggagctccaccacccctcctcgcgcatcgccgcccggccgcctcccaactcctcccgtgctgcgccgcggccctctccccgcgcgccgccgcccggccgcctcccacctcctccccgctgtgctacgccgctaccccctccctcgcgtgttgtcgccgtccttccgcgcgccgcctcccacctcctctccattgtgctgcgccgccgcccccttcctgtgcgccgtcaccactgcaggttcgtatgaaggccgagaaggagaaagagaaggaggattttccggtgatggcgatggtggcagggctgccgatgaggatggggccgaggggtagtacgaggcgtgggacctctccgacaatgaggcggtgctgggcagatcttgggggtggaactccgcggggaggcattaagtaggtcagcggcgcggaggagctctctgccctcgagtcggcgcggggacggtacagactttgttggcggcggcgaggaggagcaaggcggagctgccgccgtgcgggcggcattcggtggcccgtgcgacccccccccttccccaagtgacggcaacgggggtcctccggcggatccgtcgccacacgaccggccttcggcagcggcggatccggacgtgcgcgccctatgcatatgttagcgtgcgcggcgtggcgccgcgcttatacttctagtggatttgatttgcataacaatacaagtcctcggactgtccagctgaaattagccatgaagatataaacatgcactttaagtttagttcacaacccaacagcaaaaatgaaataataataataaagctgaaactacgacttacatgcaaaaaccactacatagaacggaatcatatgcaaaacctgctttcttgtatagagcttgcaatcgtaatcaataaacaaatatggttaaattcaatcaagtggtcttcttctttttctttgacttgagcataacaagacccatgaacacgcttaagaaagataggagaatcacgccagcaagcactgggatcaaaatagcatactcttgaggcagaaagtacttgtggacgaagtgatcactgtcaacaaatggctatattgaaaaaaagaggaacagcttatcatccagaaataaaatcatagatgttatatttgaaatgaaaaacgcctagatgttactaaccaggatgatgacccagaaagtatagtatgtaaagatggatagacttgtcaaggttaaaataaagcctactgccttgtcccccaattccatttgtgcagatattgtacaaatctaaacttgattcagatgataaaatctacttcctacatgcacacaaaaacagtctgcattagaaagcacaccaaatatcgaattgcatagaagtaaaatctcatgaaagttagtcctatttggggaaataaaacaagatataataaacccaaagtatttatacagcacaaaggtggcagaggtggcaacgagatggagacggagagacagtgacaggacctcagcagctgcagcgtcgtccctcacacagtggccttaataggaatacaacagtttgcatgttagttttaaccattcctcataaaataaattatctgaggaagataataagataaaattcagaaacaatattcaggtaagtaagtcagtgtgttatcataaaccctataaatcagagtgttcagagccacatggtattctgaccagttcccaggcattttcctagacaagtttatactcccaaaactttgctagtgaattaccacatttatagagtgcaatgaacttacccatgtgcatatctcaaaaatcgaatgcagtaagcacaataaagaatgtaattaaatatgataaaataaaatccatttctattagggtaatgttataaaattcatgacccacataattttagtagccgttccatggtaaaataaataagagcattaggattccagtggcagttgtaaataaaatccatttctattagggtactgttataaaattcatgacccacataattttagtggcagttccatggtaaaataaataagagcattaggattccagtggcagttgtagaagccccatcactgcttgtactcataattcttctgaagcctagcttcctattgctttgcactaaggtaagaatactctccttatcacgctttctccagaccttgactatagtaatgtgcagcacagcagtgcagataattttagaaaaagattatcctggaagcaataaacacaactattccccaagaaaacctgctgtacatgctacataatttcttgcctcaatcaccgtgtatgtgagttgttagattcaagaattttgggtcattggatttgatgaatgaggtatgtaggagtgaagttggtgaattatagggtagataatcaaggttagcagtgacctgatagagaaataaattaaaatgataaaatttgtcaatagcaatgctatgtcattgttacattttaaaaaaccctcagtgaaattagagccatttcttttcccattttagacggcacaagagaatgcattctgcaggtagtagctgaatatatatcatgttataaaatcccactcaatatctctagcatcatctcacaattaaaggaaaggagtaatgtaagatactaagattgcttaacaatttactcagatttattatgtattgtcaattctgaatcgaaccaaataaaagaagggataatttgcttgctttcgttcaaagtgcagaaaacaaccaaataaaagaaagccaatccaatcacctacttgtttaccgctgatccagatggggatcctgctcccgtcgccgatggcgatgctgctgttccggttggaggggagcggtccgcagtggccgtgaatagaggcgcgaccagtgagatcgcaagcgaagatggtgaggggaccgcgggatccggtgctagatgctccgagacgaccagggttggggttagggttagggtttggagagcgagagcgaggaagggggcggg

SEQ ID NO: 76800 - DNA, 1687 bp, Oryza sativa
tcatattaatttttaaattttaggtatatgttaattttgactaatatttttctcataaataaatagacaataaatcattattttatatttctcctataaaatgtgaatagtgaattatataatttgaaaattatattataagtgtatataatttaatgtttgacttatctctactattataaaaattgaagatgtttttgccggtattttggtacatcatctgtgtatgagtcagtttttaagtttgtttgcttttggaaatacatattcgtatttaagtcggttttcaagatcgttcacttttggtaatccataaggaattatgtaagaaatttgtttaaaaaactcgcatgctaacttgagatgatctactcctaactgcatcatgattttctaaaaaaatatatatccaagcgaaatcccacagtgaattttatcttaactaaaccatataacaataatgagattaaaatatacttcacccgttacaacgcacgggcattttttttctagtagataatcatgcaactgtaaaacgaaactctctcatgccagcaatgaccacgcgttccttctcccttgaaagccgtggaataccaagcgatagttcgaactgaaacattcattcgctatttgctgaaacattgtttttatataaggtgaaacaacacccgatttaaacgagtgaaacattttcgatctacttagtgaaacaattccgatatatctggtggaacatcgtgcaatatttaaaaataattcaataataagctaaaattttttttcgtcggaatatatccatgtgtggtcttgttttgaagatttaattgcaacgaatttaatggtgtaatcagatcataatttggataagtactttaagagataaatcagtttaaagtaattttatacgtaaatcgagcgctgacgtcagcacctgattttaccatctcccgattgggcgcccgacccagagtcatctccctaagaaaataccgtctcccccaaaaaaaaaaaagttctccaagaaaaaaaaaacctaacccatcataagaaaccggtaccggaaaaaatcgactcatcataatttatgttccattcatgttacaaagcacggacacctaactcgtcatttagaaagcgatgtagagatgcatcgtactaattaagttgccatgataaagaaaacggtccattaactagaaatagttgcacaaaatggatacaatttactcccagtatttcataaactacctttaaatatatatttatctcgagacaaaacgctgaattatttgtcagagaactattctggtttccatcaatcaatgtcataataacccccaaaacaatttttgccacatgggctgcgaatgtaacggagtacttaggcaattgacaggcctacatgcttttagggcatgtttagttggtgaaataaaaacttttggatgttacattggacgtgtttgatcgaatgttggaaggggttttcggacacgaatgaaaaaactaatttcataactcgcctagaaaccgcgagacgaatcttttgagcctaattagtctgtcattagcatatatgggttactgtagcacttatggctaatcatggactaattaggcttaaaaaattcgtctcgcgattttacatgcaaactgtgcaattaatttttctttttatcaatat

SEQ ID NO: 76801 - DNA, 3846 bp, Oryza sativa
tcaataaagctcccgtcgtcgtcgtcgtccggcggcggcgagtgcgacctcttctccgggaggtgggtgtacgacgaggcggcgtacccgctgtacagggagagcgcgtgcagggtgatgtcggagcagtcggcgtgcgagaagtacgggaggacggacctccggtaccagcattggaggtggcaaccccatggctgcgaccttcctaggtacgtatacgtatactatacgttgcacacatcgtacgtatacgtacgtagtgtgtacattgtagtagatcttggcgtgatgaacaaaaatagtctgccggttgttcatcaactggatcatgtagatgcatgttggtagctagaagcacactgcagtttcctaacaactcaaatttaattaagtacgtagagatcgagatgatgctcatttggggtaaattaaaatacacgtaacttaaaatatacttcccagaatacttgtaactttaagttttttttataattttgatctttcgtcttattcaagaaattatgaaattatttttttttatgatttgctttattataaaaagtactttaagtatcacttctccatttttatatttgcactaatttttcaaataaaatgaatggtcaaacgctacaagaaaaaagtcaaagcgactattaatctggaacggagatagtatgagtactagtttaattggttgtgtagtgactagtgagtcagtagaaataatctgaaacccctacagtcctagtactactcaagaactgtcattttcatgtttggataattatggccgaattcatttttttactactgtgtgtgtgtccaaatataaatcttaaacagactggacttaaactgcattatacgtactcaacttataggtttgacgcggagaagtttctggggaagctaaggaacaagcggctggtgttcgtgggcgactcgctgaaccgcaaccagtgggcttccatgctctgcctcatcgacaccggcgcccctgaactccacacctcaatcaactcctcccgatctctcaccaccttcaaaattcacgtaaatataactgaacgattccaaaatactactgaattttgcccatattatgtacgagtttcatatgcgtgatttgagacgataaaatacaatggcgcgcgtgcaggagtacaacgcgtcggtggatttctactggtcgccgttgctggtggagtccaactccgaccacccgctgcgccaccgcgtcgccgaccggaccgtccgcgccgcctccatcaacaagcacgccgcccactggaccaacgccgacgtcctcgtcttcaactcctacctctggtggcagcgtcccgccatgaaagtcctgtgagttttagctactctctccgtcttaaattataagacgttttgtctttggtcaaagttaaactactataattttaactaattttgtagaaaaaactagtaataattttaacataaaactaatatattatgaaaattatttaattatagatttaatgaaactattctgatgttgtaaatattactccatccgttctataatataagagattttgacattttatttgtactgtttgaccactcgtatggttaaaaaaattgtataaatataaaaaataaaaaattgtgcttaaagcactttagataataaaataagtcaaaaaaataaataataattctaaattttttaataagatgaatggtcaaacagtacaatcaagagcagagagaggactactttttttatatagagttagtcaaactttacagacacgaaagagagagagtagccagtagcaagcttgcatcgatccatggatgcagttgatcacctcgctctcgctgacggacgcgttcttgctgcaggtgggggtcgtttgacaatccggcggcggtggtggcggcggcggcggaggaagggaacgagtacgcggtgtccaaggtgattgacagcctgcgcgcgtacgagctggcggtgaggacgtgggccgactggatggagttccacgtcgaccgcgcccgcacccagctcttcttcatgaccatgtcgccgacgcacctccgctccgacgagtgggaggacgccgccgccgccgccgccggcggaaaccacgggtgctacggcgagacggagccgatcgcggcggaggagtacagggggacaagcgggacggacatggcgttcgcgagggcggtggaggcggaggcgcggcggctcggggagcgcagcgtggcggtgcggctgatcaacgtgacgcggctgtcggagcggcgcaaggacgcgcacccgtcggtgcaccgccggtactgggaccccgtcaccgacgagcagcggcgcaaccccagcagctacgccgactgcatccactggtgcctccccggcgtccccgacgtctggaaccagctcctctacgcacacatcgtctcatgagccatgagacctcatatcgcatctcctttttgatatatttttttctcttcttgtatgctttcaaaaaaacaaatgtaaatcctccaacaattgataagtattccgtcactttcaaaacacaaacatttgtagattgtttagtatagtactactaaggttaagaaaaaataattaatagtaatctctttgccctgaaaaaaaaacaacttttagtcacgaaatctggaaatagatatatctagacgaaggtggattctaaacactcaagtggatgtccactcattaagtgcatgtcaactaaatgatcatgaaaaaaattcaaaaaaatttacaagataaattgatatataatatatcactacacaaacatgcaacttaaaattcaacttttataagttgtaacgaaaataacaaaattaattgcgaatatacgtatgctaatcagagtttgattttttatttttgttacaacttgtagaagtcaaatttgaacttgcatgtttgtgggggtgatatattacatatgattctatcttgtcaaattttttgaatttttttcatacacatttagttgacatgcaacaaatgggtggatgtccacctaggcgattagaagtgtttcccatatctagatttataatcagaagttattttttttctagcgcggagagccttaggcttgacttgaaaattcaccaacattcgcatttctttcctttgtgcaaaatgtagtttgtataaaagggttaacctttttgcaaagtggtcaaacattatttgaattctgaattgcttacattttcctcccaagcatccggttggttggaaaatgtatagatttatgtgtattgaaatcaatgtcctacaaatgcttatattctgatacaattttgaattctagatcgaaatgtttatattttgaaactgaggtagtaccacgtacatacccaaaattcactgaatcattctgcatttgtgtgaccggagtagtaataagcactgacaaaactgaaggtttcagtcttgaatgggcctgaggcccgaatggaggtcacacgcttggaccaggtaggtgatctgccacaaagcagatcgccactcaatataggaataagttcatctaaggtcccttaactttacactgagttcgatattcatccctgaatcacaataccagatataatgggtccctcaactatcaaaaccggtgtagatgagatccctcagtggtttagatggcggttttaactgatgtggcgctgacgtggctagtttgacttactcctactcctatgtgacggtgacgtggtacttggaagcaaaataaaaggtgggacccatgtgtcaatctaaaaaatactggacccacatgtcagtcggcccaccctgctctctat

SEQ ID NO: 76802 - DNA, 1606 bp, Oryza sativa
  unsure (1)..(1606): unsure at all n locations
gtttctttatttctttagagaacaaagaatatagaaagcatttacgtgaaatacctcatcattactagtataataagtgtgctaaaaaagaccgaacaaataacccgtaagtactccggccccctactcttaaaagagatcgttttacctataaacattgctattatagaagtagccaattttaaaacaaaattaggtacaagtagcgatatattaggatgagggagtagatagcaaaaattcagtaaagaaaaacaaaagggggttaatttctagttttcagtctagtaaaacccctaaaatttaagccactttttagacggtcgagatcgagattcacacgtgaagagtgaaccttatatgctcatttgtttttctcctcccctcattcccgctcgcgcgggagagatcaagcgatccggtgccgccctccccctcccctagccctcctcttaccccaacgtccaccctcagaccctaaattctaaacctagtgcggcagtcacctattgcgccatcaccggagaagacattgtcactataagtcctggccgaccttccctctcttttctctctagagcttaaagatctattgccttctatgggctcttttgctggagcttaaagatgacttcttgaccggtagagagcaggtgagcgagatttttggagatcttanggctggtttggtcttgccacgttttaccaacgtaagcttaggcatgcaacgagtacttaggttacttggagttggcttttctactaaccataggcttgctataacttgatatgcatgtttctgcatgctcgttgtgtcttttttcccccaaattttatagtgttccgtcacaaatacggtaactatcttaccttagacatggcaactttaggggttgtatggtttgtaaccacacgttgctatgctttgccacacctcaacttaggtagctctgactaagttagctatgcgtttggttcatttctacacttgcggtgagattctttttctatcactttggtctcacacatcatcgtcttagaaaagtgtgataaggtcgtggattgctagccaaagtgtatcgaatttgttcgcctaaccttagacaagccgaaaaaaaaaactatagtaacccttggcaatattactatgtgaacaaaacaaccccttaatcaactgagatgctgagaactataggagcagcaaattggttaaaacaaatttgtagtgaagccattttttcatatggagagctgttcaacagttcaggtgtacagcagctagtactgctactagcttgctaatgcttttatcagtgtactgctcgtactagctgtggagtaaaaaagaaaacagctggctggtttactaggacaggtggtcaacggaggtggcagcagctacaactccataggagcaggcacaataccaggctataagggcaagtgctatggtaaatgtgactaacacctccaaatttatctattttattcacttaccaactaacagtcaacccatacaatgtatcacctctaacacacaaataccaatatcttggatactttaacacacttcttaaaatttgtgtggaggttgtctcttgattta

SEQ ID NO: 76803 - DNA, 1117 bp, Oryza sativa
tgtatttggccacctttccggccagagccaactcggcctgctgtttgttgccccagaggaggacaacagggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctagggttctgaat

SEQ ID NO: 76804 - DNA, 1606 bp, Oryza sativa
taatcctataactagtggaatatttattattctaacacaaatatgcattgcaagcataacttgttcttctttattttgatagtattggcggtcgaaactgtttgctaacgaccgtcaacaaaaccccccaagcttgaacctttactcatcccgagtaaaagacgaaaggaaacaaaaacttggttgttgatcaagagttgctactatgctatatatctcaagtgtacaggtgcaaggtatatgtattctctctcaaattgaataatctttggcacggtggcttacccttacccctgattcccatgagacactgcctctccttgccttgagctgttgaaagacagaacagcaatagaggcgggtttaaaaagggaaaaacaaatatttcacaatatttatgtagggtttattttggtcttacagataaattactctcttggtgtgactgtcacatctaacatccttccaattgcaaggatccacatcttgttcacgccagttgaggaatatcccatcaaaagttgtaactgccttcttgaaagcaagaagtgcttcatctgtagaaaaccgtcaaaagaatcatagcaaatgatcacagattgtcaaatgtaccacacaaataccaaccataactatggactgttacataccatctgaacttagtgctcttacttcacgagcaccaaggtgcaaaattaacaaaattaagaggaatctgggctattttctcagaaaagagcccattggtcaccagttggtgaagcatataaagatcaccatagcttattacagagttcatgtgtgaggtatactatgtgcatcctcttttatgggagatgaactccacatgtagatgtggccctgatgagggaggcaaattgctggcactgtaagtaaaaacaggaacatatcagcaatcatgcaaagttatcaaataaacagagcagcaatcagaaatgcagatcaaatgcagtacattgtgacacacttatagctccaccttaccaaaatggatgaccataaggaccaggaatgacaatttattaataaaagaatttcgatgtgcttccacaaaattgttttagggtaattgaattacctagaacatgcaatttgaagtttccccaaaaattctaacaaaaacaatttagacagcgtttaatttcgaaaaacaatttagtcacccccattactgtaaatcaacatctttcagttacctctgaaaaagaaaaaaagggaccaacttagttagccgaagaaacaacaaagcagttactgccggcgccaacaccaccaagcaaaaatagggtacagccacaacccaacccacaagcctcagggacgctaccgacactaaaccaagcacaccagatgagccgcccaaaattgcaagctcgatcgcgcacaacacaactcattgcatccaccaccagcagtaatcggcaatgcagcaaagcagaaacggcttaaggcaaggagcgagttataaccttgacgtagaggacaccgtcgatctggatgagatgttgcccttggtgatggcggactggtcggggatggggatggcctcctccttgagtgagtggacgtacgcgatgtgggcgac

SEQ ID NO: 76805 - DNA, 8838 bp, Oryza sativa
  unsure (1)..(8838): unsure at all n locations
ccggtaacaaatgccaagtcaggtcgtgtgcacacttgcccgtactgtaggcttcctacaggtgacgcatatggctttgttttcatttcattgagctcatactgatttctgggacattgcaatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggacaagaatttctttgtttcctgcagtagactgacatcactactagccagtagaatgtcatccacatacagaattaggaaaataaatctcccatttttaaactttgaataaatacagttgtcctcgacattctcttgaaacccaaatttctttattgtcccatcaaacttcaagtaccactgtctcgaagcttgctttaatccataaatggatctctttagacgacatcccatattttcgtttcctttcatgacaaaacctttcggttgcgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgtgtgaagccttttgccacaagtcgcgctttaaacttttctatattccctctggagtcatatttggttttgtagacccatttacagcctactgttttggctcctttaggaatttcttctaaatcccaaacatcgtttagtttcattgattccatttcatctttcatggattccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatctatttgagactgttgtagctcctcctctggtgtggcaaccatttctgttgaatcctgtataacaggttcctcactctcattcattgttgccacaggaagggtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacggcgtgtctcgtttctacaaactttgtataactgtttggacagtagaaacgatagccttttgatctttcaggatagccaataaaatggcagctgactgttttggggtccaactttcccaatatttgggttaaatactttggcctctgcaggactcccccacacacggaggtgagttagcgagggtactcttcctgtccatagctcatacggtgttttgggcaccgatttgcttggaactctgttgagaatatgaatggcggtttttaacgcctccatccataaaccgagtggagtgtggagtagctcatcatgctgcgcaccatatccatgagggtacggttgcgcctttcagctaccccattctgttgaggttcgcccggtgttgaatactgggctactattccattctctagcaagaaccttgcaaaaggtccagggacttgcccataaggcgtatgtcgaccatagtactcccccccacggtcagatcttactactttaatctttatatcatgctgattttcaacttcagctttgaatatcttaaatttatccaatgcttctgatcgctctttaattggataaatataaccatagcgggagtaatcatctgtgaatgttatgaacgagtcatagccatccacacttttcacaggaaatggaccacaaatatctgtatgaatgatctctaaaattcctgcgcttcgttttgcaccctttttgatgctctttacaaattttcctttaatgcattctatgcattgttctaagtctgagaactccaatggaggaagaatttcattcttaactagtctctcaattctccccctcgaaatatggcccaaacgacagtgccataatttcgatgagacatcgggagttcactttcttttcttgttttcttttgtcaacgaggacacaacattcacattctcagaaagagataacaaataaagctcgtctcgcaacacagcaagaccaatacatgcattattatgccatagttcacatttgccacttccaaagcggcaatcatatccatcaaaatccaactttgatacacttattaagtttctttgcaaagaaggaacataaaagacatctcgaagtaaaagtatgaagccattcgcgagctctagaggaaaatctccaacagcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaagtaggacaatctctcttgtagtgtcctgtcttcttgcagtggagacattgatctttctcaacagcgaactgttgttgttgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaatttggaagccatgttgctcattctaagtatgtggtctctaacaccacctccatggtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaagttcagtaggttctataggacatggggtagtcaacacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaaatagacataacacatataaccataactataatattgcaattatcaacgttggtcagaaaaattacaacatcatagcacataattaatgttcctaaaattaaattctcccgttggttcgaaatttaattttagaaacactaattttcatcaattacatctatttgcagcggaaaactatataaaatcatatgaacagtagcaaaatctctgtaattctctctctgtgaaaattctcccgttggttcaaatttaaacagaggtaaaacatgcaaaaatctattcaaaattctattgaaatttgcatgaaaaattgacaaaaataaaatggaaaaattgctactgttctcttttattcattttcggccccggagggaccttatatggactttttccggcctttgccggtcggcccatggccaccttgcgcgcgggcgagcgccccctcccctcccccaggccgcaacctgggcctgggccgggaaagccgccgccgcgcgctccccacttgggccgatttcggtccggccgccgccggccgtcgatcttagggtttgcgatcggacggccgggcgccgaaaacggggatcaaaacccctcgcgccccggccggccgccgaaaccctagcttctcctctctttctctctctcgggcgggcgcggtcgcgccgagcggcgtcgcgacgccggcggccctcgcgccgccgcgccatggccggcgctcctttcttttctcttctccgctccccccaccgtctctaacccccaccgtgtgagagagagatggcgacgacggagatggcggcgccggcgcgggccccctccccggcgcgcgcgtgcaggtgcgcgcgcggccgtcgagtggctcctaggcggcgcctctttgcccctccccccctccgttgccggcgtcgacgacggccggcgacgaggtaagattagggttagggtttttggttcttttgatccgtgcggatctgtgcttttctctctttggatttcttttcccgaaccgatctaagccctagggttgctctgataccaatgttatactttgcactaggatcacctaggttagatctagtcgggtggttctatttgggcttgaggtttgaactatagagattgaaaacgggagagggtttaaatagaccgaccggttgaggtgttggaggatgaagaagtgccggccatcgtctccgttggcgctcgttgtcgtggatgcggcgccggtgaggtcgacgacgatgacggctgcggaagtgacggttgtagatgtcccggcgatgaggtgtggcgcggcggtggcgcttcccgtcactggctgcgccccctcttgatcggattagggtttgtagggtggagttggcggcggcggtgaatctcgaaccttgtgccgtgccggcctccacccctcttttattatggcgcagtgtgacgggggcccaccagccattgggctgggcgcccccgatcagggcgcggtcaaggcccccttgagccgttgggctcaaggggagagagatctatctaacagtgggatgagagggagcgggcggcagcggctagggtttggggggccgacgatggtggcgggggcggtcgacggcgacgcgaggcgacggcgacgacggcgcgaggcggaggtggcggcgcgaggcagaggcggtgggagagggagagggagagagtgggggacgagggggagcaggtgcggtggcggctaaggtttaaggggccggtgatggtggcggggacgatcgacggcgacgacgacacgaagcgaccgggaagccggaggcggcggcggcgggagagggagaggaagagagtaggggatgagggagaacgtgcggcggcggctagggttctgggtggtagggttagtagcgtcttctttccaaaaagcccttcggcttcaactttttagagcgtggtcttaattcgcaatttttctctccttcacatgaaatatccggattttataatgtcctccgcatgaaaaacgtctcataggtactatttgcttgggacctatatcgaattacagaaaaatcaatggactttttcgcaaaatcgccaacccacgtgcattgctatcctacgtggcatcgcccagcgccgctcttctacggctgtttacaattctctgatagcatgctgtgccactgccatccacttcttttttgtgccatgacaaattttagatatccatactgattttaatataaagtcatgattcacattggttgcaattgtaaaacacacgggaaagtgcttgttcaagaaaaccaatttcatactccctgtggaacttctaggagcctatgagatctacccatttcttcctactgcagatgggagagcaaagagatgaagcaggcaaagctatctttgatttgttattgtctattgagccgctatgtaaagtagcccttgtgagttgtgatctaattgtgcttatgcgcttcgcaaagcttcatgacaaggaaaacatcagtttcatgaaatttgacacatgtgcgtggatgtagcaaaaaccgatgatttacatgacaaataaagatgtactatggtaaacctttttgtgaagtttgttttcctagagttgaataaataggaattgtttctaagattgatgattttttggaaaattaacttagaaatgtaattcaagttttattccctttgtactaagaacttagccatattatcttttacctcctgatttcttggatgtaattattttctaatacatatctcttctttctataaagttaagacccaaagctgcctcctcaattcgccacatcatcaacattatattagttgttcgatcaaatatgtacatcagatatacgcagatatacgccattggatccatcatcctcttgcccaacatgcatggtaatcacttgctccttcccattcccctcccttaatcacatgcattaatttacagtagaaaccgccaaatcaattgggatatgaggtgcgatggttaatacgatttatgtgcctcttgcgattctcttccaaaccttttaataagccactttgcaatcccctctataactaagtctcttttctcttccccctttgcatgaatcttttcatcgtacgttggattctacttcttctgtcccaaaaaaaaaacccaatcctagatttgaagtatttggtaagcctgaatttaacatttattttggccggattctctttgagtatatataatgatttgaactaagcaggagcactatgaaagctttgttgattagtttctctaaaattgaagaaagaatccctatcctatgcatttactgttgttttagtttcttaagaaaagattcgtcatacttacaatcaatacttatatgtcttatcactttaatttatttgagcagttgggaaggatacagaggattgcaatatagctgtcctgacatagcgagaagcagcttaacctactcggaatgtattttgttttcaggttcaatcaatacaatctaattgtttatactaatatgcatatttacatgttctcaaatgtgcccgcagcaaagcgtggggtttcatctaggtataaataatgtgcatagcacttgtatggttactgtaaattttttattgtttatttcattctatgtttacaaaacatatattctttcggttgtttgatttttacttctaaacattgccgtagcgttagcacgggcgaattactagtttgcttggttaaaatactttagctttcaatataatttctaaaaatgcattatttgatgatttttattcccgaaggaaaatcggggcatgacaaactctcagcgtttgcattgtaatcggacggcaagccactcacgatgggtgccttgggtcaatttgggtcgcgtcccttcacctgcagcctatcaaaatcctcatttgtttgggctagaatatacgcacgcaaaaatatattctggcccattcagccattttgctccctttctcgagaaggagttcggcacttgcatttccatggcttcttttatgattccaacggtaccgtacgnnnnngnacatcaagtttaatcgacatctctaaatcataatactagaaatttcacatctcattttatcaaaaccgtccagacagatcctagggcagtatcgctagctagtttcgctaacgcggcatcctaatcagcaaaagaaaataaaaaacacatgggcccatatgtaaagtgagaagaaaaaagttgcatatttaatgcctgggctatggtgaacagagagtggcgccgatcggttcattcgagagcgggtgttatgaatccatcaacgttgctaggacttagatctggtggagagcgcaaaaactctccaccgaagagtcttactatcgagagagaagaaaatggtgagaaaatctaggctgagagggactcaacccagaccagtgacttgctcctggtagctccctaccagctgagctatccactgttctctccaccaattacttttaggctctttagttacaccctgatcgaccaatcgaccgggcaacatccacggaatttgatttgatctcagcggcggccatcgatcacctcatcggcggcggcgtgattccgagcacagagcagaggcctagctagttgttcatgtaatttagcaattgctttcgtcactcgtccacttggagcacgaggacgacgatctcggccgccacagttgatgggcagagaccttgttgggaacatctcttggggctgagggggtgacggaagcgtggtgcttttgctccttctcttcttggaactcgtcgctgacgatggcgtggtaccggcactccatgctatagaaggccctcttagggccggtcctaagtttttagggccccagtgcgaaactaaatgtaggcccttaacatactactacataacaataatcaacaatttctagatgagaaattatcgatgacatggcttgataatgaaaaaaattaacactattatgattgtttaactcatataaattacacaacaaaattacaaatctaaatttaaaattttaccaattggttgatcgcaagcgtctagatgtgatgcgtaatgcatgaggacgattctatcgagtgaaaagaaacaaacaattaaacgctaatgcccgcgacgccgtgcgtcgggatggcct

SEQ ID NO: 76806 - DNA, 6578 bp, Oryza sativa
caaagggttaggtaacccatattgtttccggtgttacactaaagggcatacaatgcaagaatgttcttccaagttatactgtgaaatttgtgaaagtaaggatcatgttgctactcgttgcccgatatttaggtcaactaataaacctattgctcagttatgtggctatgctgcagatggtcttggttttttccatattccactttcagctggacagaggattaggcatgatccaaaggctgttttggttaaagtgactaacggtcagatgacaataaatgctgtcatatctgagctacatagattaatccctggtaagtgggagtgggtggttcatgacaatggagatggtacttttcgcactatctttccttctgcagctaaattgagtcgcatggtggagtggggcaaggtacacactaaggttagtgaggctcagatggagattgtagaatggggtgtaggaaatgaggtgaaatatgtggttccgaaggtgtgggtacagtgcaaaggccttccttctgaattgagggagtttttaattatttgggctgttggttccattcttggcattactaaagccgtggatatggttttcactagaaggtatgacatcgctcgtctgcaggttttggtccttgacccatctttgattccggatgtagtggatgtggttattggggatcacctgtatgagctaacctttagagttgaacctgaaaatgggcctgaggagcctatgcccatggagatggaaaatttggaggatggagatgtggagaagaatgatgaggggaatataaatcagaaagttgggaaggaagctggtcttgatgattcaggaaacggttctaagttgggttctggtgttcagtttagtgagaggggttgcccacctgctccttcctcacagctaaatctgatacatgaatatgatggcttgactgcttctgatgaagattttgatggctttgttgaagatactttaatggttgacaaggttcagactcagcaaaatttggtggcaaaactctctgctatccctgaggcagtactctctccatcaaggaagagtaagagaagagcaagtgacagtgatcagcttgttcttgaaagggcggagaagttgaaggctgataagaacttggagaatctgcatactaaaggtatttatttaataatgtttcttttactgaattttcaaataatcaaatttctgcttatttggatagtcttggtgttatacctacttctgaaaatgttgttttagatgatgtaattaatgatttgaaatgtgtggagagtaagagattaagtgaatatgattgttctgctattaatcaggtttctacccctaatgttgatactgagtcattagatgactagttggaggacaattttctactacaacatctatgtagtgaaattatggaggaggtcatggatttcagtgaggactgtgagaacaatcttacaaatactttaaatcccttggcatctccctctaactctaagaataagagtaaaaaggggaagaagaagaagaaaatttaaaacaatttaaatgaagggaatcttttggaattgtgatgggttcaaggacccgaaaaaacacaagtttatttctgacttaaccaaggaacatcaacttgactttatagctttgtctgagacggttaaaaaagagtttactccggctgcacttaaaaatctttgtgctggtaaggagtttttgtggccctgtaaacctcctagaggtaggtctggggggcttcttttgggcatcaatttactaaatgttgatattggtttaattgatgagggcgatttctatattaagttccatttatgtaacaaagtggataagttcaagtgggctttacttttggtttatggaccagcacaaaatgaacttaaggatcaatttctcgctgaattagttaatttgtgcagtcatgaatctttaccaattcttattggtggtgattttaatattttacgtagctcagaggaaaaaaataatgacaactttgatgatagatggccctttctttttaatgctattattgatggtctgagccttagggagttgcagatgtcgggtaggaattttacttgggcaaataacttagcaaatccgacctatgagaaactagataggattttgatgtccactgagtgggaacataagtttcctctttcatcagtggttgctcttaatagagatatttcggatcatactcctttacttttaaatacaaactcatcttctgtgggtaatacacaccatagttttaaatttgaacttggttggttgttacgtgatggctttgttgacatggtgaaggaggtctggtctagtgtcaatgagggtaatactcctatggagcgttggcaggagaagattcgtcgtttaagacaacatttgagaggttgggctaaacatacaagtggtatgtataaaaaagaaaaaaaaggagattctggataggttggatttgctggataaaaaggctgaatctgatcttttaactcaggaggaaattgattttagatggttttgtaggaatagattatctacacttttgagagaagaagaaattaggtggtatcaaagggctaaaactaaggatattttggagggtgattcaaatacaaaatattttcatttggttgctaatggtaaacataggaaaaccagaatttatcaacttcaagatggggatcaagtaataaatggtgatgcgaatctaaaatcgcatattaccacttattataaaggcctttttggtcctcctgatgattctgatctccaatttaatgaaaatcattttgtttacattcctcaagtttctcaattggagaatgaagctttaatacaggactttactgaaaaggaaattaaagatgcaatttttcaaatggaacataataaagctccgggtcctgatggatttcctgctgagttttatcaggttttttgggatgtcattaaagatgatttattaaaccttttcagagatttccataatggtacattgcctttattctcccttaactttggtactattattctcttgcctaagtgtgcggaggctatgagaattcaacaatatagacctatttgcttacttaatgttagttttaagatctttaccaaagttgctacgaataggataatgagcgttgctcaaaaggtgattagtcccaactcaaactgattttagccctagaaaggaatattatggaaagggttgttatcgtacatgaaactatgcatgaattgcttcgaaaaaataaaagtgttgtcatttttaagattgcctttgaaaaagcatatgataaggttaaatggtcttttgttcaacaaacactaaggatgaagggcttccctcctaaatggtgcaaatggatagcttcttttattcaagggggtcatgttggtattaaagtaaatgatcaaactggtaataattttcaaacgcacaaaaggtctaaggcaaggagatcctttgtcaccaattctttttaatatagtagcggatatgcttactttattaattaagagggctaaggatgttggttcgttgaatggggttgtccctcatttagtggatgatggtttgtccattttacagtatgctgatgataccatcatttttttggagcatgatttacaacaaacgaagaatctaaaattgattttatccgtgtttgaaaaattgtctggcttgaaaataaattttcacaagagtgaactattttgttttggccaggcaaaggaatattatgaccagtactcttaacatctttggttgtaagcgtggctcttttcctgttaaatatcttggtatcccaatgcattatagaaaattaaataattaggattggaaggtgattgagcaaagaattgagaaaaaacttagcagttggaaaggaaaacatttatctgttgggggtagactggttttgattaactctgtgctttcaagtctagctatgtttatgatatcattttttgagatacctaaaggggttcttcaaaaaattgattattatagatctcgtttcttttggcaaggggatgattataaagaaaagtgtagacttactagatgagatataatttgtcaacccaaagatcagggaggtttaggggtccataatttggaaatacaaaataaatgcctcttgagtaaatagttgtttaaattgattaatgaggaaggggtctgtcagaccttattaaagagaaagtatctttataatcagtctataacccaagttaataggaaacaaggggattcacaattttggtcagggctcatgaaggtcaaaaataccttcttaaatatgggttcatggattgtaaataatggaagacaaataaggttctgggaagataaatggctaggtaacttggcttttaaagacaaatatccacctttatattctattgttcgaaggaaaagttctactattgctagtgttatgagttctgttccacttaatgtttcctttaggagaggcttagttggccataatcttacatattggcatgaattgtgtacttctattatgcatattcaattgaaccgttcttctgattgcttaagatggaattatcatcagagtggtagtttttctgttaggtcaatgcatctagctttaattaataatggatatatcgaaagaaataagattatttggaatcttaagatgccactcaagattaagatctttatgtggtacttgcttaaaggggttgtgctgactaaggacaatttggcaagacgaaattggaatggcaatttaagatgttgtttctgcatgaaaaatgagaccatacaacatctttttcttgactatcattatgcaagatttgtttggagagtagtacaattctctttaggtttaaaccttccaagtaccatatctaatatgtttgatgggtggcttatgggggttaataagaagaagtgtaatctcatacttgtaagagcatctgccttatgttgggccctatggttgagtaggaatgatttagtgtttaacaaatcaccatatacttcatatatgcaggtaatattcaaggtaatatattggctccggttttgggcaaagctgcaaaagtgtgaagaggatggtgaacttatgaaggttgcatgtcgcaaactcgagacgacggtgatgccactttttgccaactaaggatggagattccccaataaacttgaaataaagtggactccttatcctgggttgccttttaatttggtgagggcggttgattacatttgaactaccctctttgtatgagtgatactttgtaataattggctgtagctctgtcgagtcaaggccgggatataaattccgttatctaaaaaaaatttgagtaaggggccgaacacatttcttgaacatcgtttacccttccaccatgtagttttctttcttaattaggtctatttttgataatagaaacggttgacgtctccggtctctgccaacatatatacaccaagtaatgttgttgataaagaaaatttcaaacgacgggactagtccgaacctgcttaaaaaaagaccagttggctgattaaaatttaaaaagcaagtaattttataagtagtatgccatctaaaacggaacagaacacgttttgcaaccggttcaaaaattttagcaccatgtagtattagtgtttgcatgcttttctttgtgatagtagcatatcccaagagtagggccttgtgtgtttttacaaagtggatgacaaaagaaggccgatatgattagattggagttttattaagagcataacaaattgggaaaaactttgcggcccccctaatcattgatcgtcatatcaggcaaaaacaaaccaaaaaaatcaaccccccgaacaatctgcatctcgagactccaattctttcagttccaaggttatctacctcccattgaaatttccattctattttattctttctccgaaagaggaaaaactattatttcttctagttaaaaaaaaacgaaatatgatccatacatgtagttacatcggaaatatatataagttacctctagaaattagttccaaaatttgtattacaaaattaaatcatgcatctgaaatatgtaggtacgtactccatgatgacaagcactgcgccatcccacagccgtccatgtcgcacaagacgtgtgaaataggaattccaaccaaaaaagctagaagattagcgcaatgagcagaagacgcgcgcgcatccgaaaatagtaggcttccagataatttaaatgaagccatcctactaaggactagtgttatctgccaaaggccctgtttagattccaacttttttattcaaacttctaactttttcgtcacatcgaacttttctacacatacacaaatttttaactttttcgtcacattgttctaattttttcaaactatcaattttagcgtggaactaaacacaccaaagttgtcatgtctttattgcaggtttcagttggatgaaaactataagttatgtggttgttcacaagtgtaggcctatgctatttc

SEQ ID NO: 76807 - DNA, 6203 bp, Oryza sativa
tttgctatatcggacgaaactccgcactatcttatgcgggttgtttcaagaaaaataaaatgaaaaagaacaaagaacttcattgcattcttgttttcgttctcatatggttggttggttgcatgttcccggccaatatctctccctctggcagcactggcactgggcagtgatggttagctttcatcatatacattactcgtagtcattctattgtgattaaagcttctgagacacaacgtgctagcaaagaggtaggttatatgaatgtgaattcaacacatctcccagacgttctgctacatgaatggttaatataaaggctagctacaaaggtgttgtgctaattacaactttggaatgaagggccaaagtacagaacaataatgtaagccttaggattgtgaggcattgggaactgaactactgaagctacagaacatccccgctcaggatggttaggcaagagttggcgtactaccaagctaagttgtgcctgtatggtgctttgtaggtaacgtgtgctcaaaacttgttcaatacgtgggatagttgatcaaacagattgatgaatcgtgcaatccatcgtgaccgtgtgagactaatttgttttgcagccctaggtttcaccaaagctttgtgtataagcaccctgaacacaacatgtcacgcccggaaattcactagtaatttacaaacttatttgtgcataaaatcctcgtccaggaatcagccgaggtacacaaactgacaatttaatatacagattcatcaaattaactaaaacgataagtacttacttaagaggcacttagtcctcaccatgaagaaaactgcagcggaaaaataaaatctagcgaagctccggctccactcccacaggcagctcaactggggtataagccaaccgtcttctccttctggatcctttttcttcaactgaggttgattgattattgcaaggtgagcatatgacatactcagcaagccacacagcaaatatgcaagtgcacaaggataccaaaggatggcataatattggctcatttgcaaaagcagcaattagcaaaacatttaagagaagtaaaacaatggagtaattaatcagaaattttaatcaacactgaacagcacacccatgctgcacaggcccaaccatcctgaacaaccatacccggctgtacagatctaatctccaaaccaggagctaaacaaattattaccaggtataacatctataattattatgagaggtgtgagactaatcacgaaaaacattgctcaactcgcccataaccgtgggcacggctattcgaatagttttactctggccagaggtgtaccactgtacccacaagacacagctccacatcatgtcaccatgtgcctcagtaccaccacggtacctcggaaaggagctgtgacattaccccttgcataacacaacccaccgcagcgcaccattcctggatcataatcaccccctcaaaaaccagaggcatggactccccagcgacccccgtgggcttatctccgccacttctcagtctggtgctccgcaatgaatcatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattggccatcgtgaactatcattaagccattattaaataataatgagtcataaattatcccaatagtgtgctaatgtttctaagcatggctaagcaattatatctaatatctagttgaaccaatatatataaagctcaactagtccaattataataacccaaggtatcaaggaatagaataatcaatgcaaattggccataacaaaagaataagttcacaccacccggtgacattcgaaaataaatgcacagttgaaataaatagagaatttaaatataggaacaacatgctcaaaggattgtgtttaggatctgtgtgacttgccttgcaataatcggtcttcaattaatcttcttgaatacttccggcgcactcgcgaaccttcacaacgacggaaacgacaagctaacaagcaaaacaaagaaaagactaataaaaaccaaataaacaatacataaaaagtaaacaaacatgtagatcatatttttagatgaattatgagacttgaacggcctcattctgacttcaaatgaatttattatgaattttacaagattaaatctatttaaagcccatttaaaaagaattaaataaatttaattcaatttatggacaattttagtatgtagatctttattttacacaacttttgcaacttgaaccacattaaactgagttcaaatgaattagttatgaatttttaaagattaaatcggattaaaacctttaaattgattttaattaaattatgacgcaataatgaattatttttgaaaaggaaaagaaggattattgcgtcagcggctagggtttgcggtggaccgggtgcacggcagcggttcacggaaacaaacggccgagatcaaccctatccaaaacggacggccgagatcgatcggtccacgaccggctcacgggagagggcgacgatgacgtcagcgacgacgtcacctccggcggcggcggctcggcggctcggacggcgcacgctcgccggcgaacggcggcgcttcggcacgaacggaaggcaccaacagatagaggacgacgcagcgaactcaccggtgaccaaaaccacggcggaagagcaacggacggtgccggcgacgaggaagaagcgacggcggagattgggtcgacggcggcaacggcgctccggcggtcttcggcggcggcgaaacggtggacggggacagcagcgacttggcgatcccgacggtggccttcccgagtgacgacgacgaccgtagcgacggcggcgcacggctggacgaacggcggcgacggcggtgcaaaagctcacgaggctagggcgctacacacgacggcgggcgaaggcgagagaggcggcgggtagaggagagctcgggggtccttataaaggggcaaggaggcggcggcgaaggcccacagcggccggcgacgagaaggaaagatcgggctcggagagagaaaagccgatccgattcgacctcgaatcaaacactttccaagccgatttagccgatgtttccaaaggagaaaaggaagaggagatcaagaggattatttcccctcaaaagattcggccggagaaggaaagatgaggccgaatttggaaggagacggcggcggcttgcgctagggtttcgggcggcagcggcggcgcgaggaagacaacgacctgacaggtgggtcccgcctgtcagcggccgagagagagaaggaagggcggcacggcggactgggccgactgggccggggagagagagagagcggttttgggccgactttcggcccaaagccaaaagaagacttttaaaaacctttttcaatttaaattatttcttaaatgcaattctatttattaaaaatacttccttagctcaaataaatcccagaaaaatctaggaattatagaattaagcaaagtatttaacaaaattttatctagcccaattttatattgagatttaacaaattaaaattagatcttctcttttaagcttttaaaatcatttctaataattccttttaaacaacaatttataatttaaggatttttttttaaacaagaaaagcacttaacaaaaataattagatcattaatgatcaaataattactgaactgttctttgtattatttaagaattgagctctgaaaaatccgagaaaatttcagagagtataattaaccatggagaatttaataaaaattaaatccatccatgctttatatttaggaaattttatttcccacatttaacttcacttgtaaattaaagatcatttaatataaattctattattaatttattaaataatttataaaccctgaaacaaaaatcaggatgtgacacaacacagatgatcactggtgatagcaaccctgacaaggaggttgaatcgatagcacacagacttggatgtgtactgatattggcagtatcttctggagtggaggaacacacaacacaaggtgttctgatttccccgttggcggtggggacccactccaacaggtctgggcccgggaccgggtctaaatgtccacctatggggcagtcggggcatgacctgcatcttgagcagggcttggggtgggtttgcagtttcacctgtgggtgacccaagaggtcccgaaaatacagaattaatgaaaaaagttaatagcctattacaaattttgctcaccaagacaaattcactggagcacatatacatcaagtaaccttagatatctttgactcagtcccacatcgttcgccacccgcatgcgccgtcacacgctactcgtgattcctgagtcccaatgctgccctctgatattgcccctgacacttccaacaccgccgctcgcacattgcgccgctggtgagaattactgcttctcgcttggcctcttcttgccacaggaagcacctcccagtttgccaccggtgagccctgcccttggattttgtccgtcaactcctctcaacagtctgcctagtcccttatgttccaacttgcctcctagccagcggctgatttcgatctcatctccctcaatcctaacaatggctcagtgttcctccgacatggcagcttttggtggattgccttatcttctcagttcttgtgttgtcttcaccgacagttccaaccccggttgggggtggggactcacagtggccagggctagagcaacattgagcccgagttggagatggggccggggacaggtgaggaagtcgagtgtcagggaagagggcattctggcccaacccatccctcaccagccctgttactacccctactcaacaccgacaactctataagactgctaccagcgtcagggatattcagaggaagatgtgcatcatcagatgagggacttaagaggagtagaacttgaggaagtgttctctcctagttatcaaattcatgccgatctgcatttacttgtcatccggcgttcctttttttttcccattcgtttcgaggcttgtagtctaacagctcttatagtttcagttgtgtatacctacggatatatatccatagaccgaatttaatagaaaacaaatataccttacaaactcccttaaaattacgctgtcaagatcacaatagctgagattaattttagatgagaaagctgtaaaaattcgaatcttgctttaaaacgatgaagtgagtggacatagtgcgcacttgttgacaaaaaccctcgggtggtgcagagtcagggagatcgatgtatagtgccgtgtcgtgatgtcatcgccagcggagttgaacgcggcagcggagatcgatacgacgacacgggcacgatctatcgaagcccggctagatacgttgttgggcgttaaaaatccactgatataatatttaatctacagtcataatttatgatctacctaatcaacggttagataattctgattaacgtgagagcttctaaaatgtgtccaattaatataggtatggatagattagggccttcatgcacttccattgaccgatattactgtatcattgcattgttgttggtacttataaagtagcaactataacctaatttcagtagaattagtgcatttgtactaccttacattgatctggaagctttgtttctttgtcctttctattttgcctggtctgaagaaacatgcgacctactgtgctaatactggaagttcagaaatgagaattcagagcaagaacacaagaagcatagcgtgtatactgaatgcaggtagaaagaaagtaatagtgtacttttgctgtgttgcagttataaacacagcttacgctatgaggccaataaaattgtactagcagtaaatctttggttgtatattagagtttgtgtcgaatatgtgtatgtagtcggttatagtttagtatttacaaaatatcgaccctcggtgtgattaatatcgtgtatggctcttttatggtgttttttcagcatttgatttacgatggt

SEQ ID NO: 76808 - DNA, 520 bp, Oryza sativa
ttcacctcaaaacgcacaaaaaagaccacaaattttcaaccttgccatgagcagcagcatcagattaacattatactagaggagaggagagagcatccaaaatacagcagagattaaacagcaagaactgaagaagtcttcgatcaaactaggtcgatgatggaagaagaggagagagagagagagagagatgatgatgacctgctcgctgtggccttgcgggaagtagacgacgaggctgcccaccggcggcagcgacacgagcgggccggcgcacgcgtgccacagctccgagttgatcgccgccgccttccgctcccctgcaccgccgcagccgccgcgtcagccaccgccaccagacgagcgaggagaagagaaaaaaaaaagcagtataccttcgcatgcggccacggcggcggtggcggaggaggaggccgccgccgccgcggtcaccgcggagctcgccggcgtctgctgctgcttcatgctcgccatggcagttcacttcagagtcctcctc

SEQ ID NO: 76809 - DNA, 2131 bp, Oryza sativa
tgcaagtagttcatcacaattctgctgaggtgtaatatatatccactagttagttactttatggatgttggtgttcttcacccttggcaattcaggacgatagaattaagatgcaagatcactttgtgttgttgtgaagatatgagatattctacacgctgagatcaaaaatagagagaattacatcagtatttatcctgcatgttgcgtgcacaaaagtagttgaggtgttgcaggcaatctaatgatatttgcggccacaagcactgctccagcctccatatgaactgtttatttgtgaggtgaccatcaatataaatgtatcctgacgagcgggtcagatggttattccaaaaattattagaagacatgtgaaaaattaaccttttttaactctcctcagatggacggcaggaaaccatggatgtgtagaactcattcagctgtacgaaaccgagcatatatttgctacaatcagagttgggaagaactcgtagttgtagtggcgtatattttgtaccgaggctgctgagcagtttttcctcattcagaggctgccttattttagcttgctgacacccgcacatacttaattgctaccgtactgctttcagaaaaccacaggatccatccggaaccacatagaaaaacagaaaaacggttcatcccggacgtccgatcctgtgattcacgtcggacgctcaggacacatagaatgccatttgcagctgctagggcccaccacgtctttaccacacacgcccttgtgctgcacgtgtccccactacatattccgttgtacaaatcacccacatattttgaaaaccctctattaagggaattcattctatttttctccattaaaaatatttcacctaatgtactcacaatgtttcactatgtatagatataatgttgcaatgaattgaaatattcttttgcaacacatcacccacatattatggacaccctctattaaaggaactcggtttatatttttgttcaccaaaaatatttcacctagtgtacttataatgtttcactttgtatggatcaaaagttgcaatgacttgaaacattcttttgctatttgctgaaacattatttttatataaggtgaaatagcaccgatttaaacgattaaaacattttcgatctacctagtgaaacaattccgatatacttggtggaacagcgtgcaatatttaaaaattattcaataataagctaaaaaaattttcatcggaatagatccatgtgtggtgttgttttaaagatttaattgcaacaaatttaatggtgtaatcggatcatgatttggatacataatttaggagaaaaaatagtttaaaattgttttgcatgcatgtattcttgatgacgttcggatggttgacggcgtgcgcgtggatcggatggcccattgatgtgtctgatttttcgtctcgcgccgcacgtccgaggcgtagtgctctccagaaaaacaagcatgcttatcttgttgctaaatgtactgaaggagctagagggatgccttattgttgtgatggctacaagttataacttgacactgatgatatgatctcagctctacaccattttttcttactaactttctcgccaatccgtagctgaagataccaagttagcagtgtgaatcatgatcaaaccatgacaaggtctgtgtgctatagcctgtagaattgtgttcatcaggccttcaatcaacttttgggttgcaccaacaagaagatctctcttaatatgtgtactgtttctcccttcttccgtatcgtttgagcactctggcttccccttcataactgatttttaattcagaaccacatgaggatttcctactcagtcttataaatatttagactctacaccactacagattttcttatctgtaaccgcttttcccataccgggggcttgcggaccgtcgcaacatcgtcatctctaacgggctaaaaaaaacaccgacaaagatatactcgtgagtgaagtatgagcccgtcacggatgatctccatcggtgacgggctttattttgcccatagtttgactcatctggcccgacacgtggcttagccatctttagtccccggttgttgtcgatttttagtcc

SEQ ID NO: 76810 - DNA, 2820 bp, Oryza sativa
cttctattggagaaaaaaaaatactagtagaatattgttttttttaacagtggcagggtttagttcccttcaaacttcaaaaaattccgtcacattaaatgtttgacacatatatggagcattaaatatggacgaaaaaaaatcaattgcacagtttacatgtaaattgggagacgaatcttttgagcctaattacgccatgatttgataatgtgatgctacagtaaacatttgctaatgacaaattaattaggcttaataaatttgtctcgcagtttacaggtggaatctgtaacttgttttgttattagtctacatttaatacttcaaatgtgtgtccatatatttaaaaagaattggcacacgaactaaacatacggctagtgtaaaaaaaattgtttccttgcgaagagtaataacttttgtgtgggcatgcaaatatgcaatcggccgtttgggaaaatgtcgggaagatatacgttggtcctccgtgctctccctcttatcataaaaccatgaatatataggtggaaatagtatgacagtcttgagttagcatatatatttggtagagtttcaaatctctgtgtttggcagagttttaatgtctgaaatagcttagttgtggagctgacaaaaagcaatctcacccttcttatgtttttccaatagtggatccttctaaattgctcttaaaaattaagaatctagtattatttaattcgggcgactgtatactaaacagatatccgaaactgataatagtattaagtatctagggaagtccatcatactacaactactccctccgttccaaaatataagtattttttatcctgacatatggtctccgagatgctactttgatcaacaatatctataaaagtaagatattttaaataaaaaagttgcatattagaatagtttgttcaataataaatctagtaacatcaattttacatgattgattttttttccctattaatggttaaaataaaaaatgtttgacttgttacttttctaaaaatgtttatattttagaacggaggaattactatgttactatctccatttgaaaaagaatcaatttctaaggataaatttggatctagaatcatacctaaagttgattctttgaatgaggatgtaccactcggcaaagactttttttttccgaaagaccctaggcaaagactcaacaagacgagtggacgatgttagtcacgatcgagtagctaggatatatggtacgattagttgggatgttcaaggaaatcccgcgatttgtccagctaattataaatcgatcctggagcatgtcttctgtaagctagcttgttcgatcgacgtcctcatcatcaaacgccatttgtgtgttttgtactactagtacgtgtgtgttgcgtccacttgacacattggtgataatttgctaatcattttgtcagctctgcatcgtggaaacacaatgctcactactagtagtatactagcatgtagcgtgctcgtccgttcatcctagtattttcataaaaataaacgtttcagagcaggtacaatagtaggctataaaccagctgtaaatataatttaagaagataaataagaagagaaaagagcagcgggctatatatttatagccagctgtagcacagatttcaagacgcagtgtgtgtatgacaggtgggaccaggtattaatagtgtagtatgtaactattgtatggataagctattagattggttatagataaattaaagctagtagttggcttggataagctattagattggttatagataaattaaagctagtagttggctatactattaaacttgctcttagagtatatccatacaaacatgccaaacttaccgtcttggcactaacatatttatatggtctgctcatggtgtgttttgtagtacacgctccttaatttctactccctcgtctttcgcacgtacgttttccgaacatctaagcattgtatattaaaaaaggttatatagaaattatttttagaaaaacatattaaaccggccatttttcaaggtttttatagctaatacttagttgatcgtgtgctaatgagtcaccctgtttgcatgcaccctcaatagcctcatggcatgatcataccaatgcacagaatttaaacgatttttgcgagagttttagccatttagtcctataagaaacattctaaaattctgttgtttcaaaggagaaatcagttgcttaacctttaaaaaaagagcgggtacaataagctgatactataagtataaatgaggcgtacaagttatcacatcatacttgtatttatgtggaggagagagaagaaaaacgagctctaaatttatagtcaaccgtacagcacaaacttcaatatactgtgtgagagagataagtgtgttagatattaatgatacaatatgtctatatctatatattacttagtattccatgagtaaactattaggttggtcatatataatgccttaattttttaagctagtagttattatattattaaacttgttctatgattttttttatagtatgttaagagggttgggattgtgattagcaaaatgagtgcagggttacgataaaatattaaaatgagtgagagggagatgataatggaaggcagaagaaatcgactaacctctaatatccaaaagagaatcatgttgataggtgatttttttttctcttaatccattatccaaactggctcaaacaccacctaagatggtatttgaatcttctgaagatggagatgaagatgaatattaagttttttacgtaaaa

SEQ ID NO: 76811 - DNA, 1129 bp, Oryza sativa
cacacacccaaaacatgcataaacaataaagatggagttcaacatttatcaggtacaactttgaccctttttctctatacacataaaattatttttttgtactataattaatttattttatagacgtaaatagtaacaatcagagggggggaatcaaaatgtctagaaagaataaaaagattatctagccaaatttatatttgcacaatcatgttagatgttttttcttgttactttttttttattttttatgtggatgattttttgttagcaaacttcactgcaaacatggggaataggaggcttgagggacaacactgtgatgaaaacgagtaccaagatgactttgcagaattcttatatgaagaggaaccatcagataacatcgatatggttgaacaacgtgcggtaataacctctgattttttttacttgtctttttttttcaaacatcaacccttttttgggtatgctccttattggacaatttcatccttgcagcaaccacaaataaacaatgagcaaagtagccctcaaacaccactgcacataaacattgcttctgcaaggacacctgctacaaaacaagtaatgcaaattgtaagtactttcctctctattttttgcttaatttttttcaatcagcatgacataaaactatgtcttatactcttaaacattattacaataaattctgtttttcccatttttcacttgttttattttttaatgcaaagttcacaatcatcacctgatataggtatgaattctccaagaatagcacaaatgagggaaccaaatcaacatgatcaaccagaagaaagacaatattcaatgacaagaatcatcgactcactaaatgcttctggcaactgttctggtaccagactcaatctttatcgccctaaaagaattgtacatccaagtaaatacaagagctccccatatgacaattacacacggcaccaaacaatcttggcagctgaactcaatcactacaacaacatactcagcattggtgagacgcaacaatataaatagtaagtgtcacaaaacgacattataatggttgcatttttacatttgctttttttagattgtgtgatcatttcaagcttgtagttttaca

SEQ ID NO: 76812 - DNA, 936 bp, Oryza sativa
atcccccatccgttgaaaagaggacttggagggctttccatcaagtactcatggacccaaaacggagctcgtatgaaaatttggcggccgtttgaagtcagcaatgtagcaggtggccgaatcgaattccagcttttggaggacttgatcttgatgtcttcttgttgatccatgatgtgagcaatggttgtatccatagtagccatggtcacatcatatacggagggagttaatctacacagagttgctaaaccagaaatataattatgacagcttaggttgtttgactacgaccttattgttaagcttttgtttatacttatgtgaatcgcttatcaacagtttttaaataacttatgagtagaaattttatactgtatactactccctccatttcaaattgatctacatatatatttttaaggttattcctaaacgatatacatatttgtgttcattcattaagtctattcgttatctgtgcttggagtaaatggacattgatgcatgcatccatgcacacaagtatttataacccatatgcaatatctttatttgctattggctaggaaataatggggatggtgcatacattaagtctattcgttatctgtgcattggagtaaatagacattgatgcatgtatctatgcacacaagtatttataacccacatgcaatatatttatttgctatttgctaggaaataatgagtatggtgcatacatcgagtttgttgctagagtaaatatagtaggagagagttattattttttcttggtcttgatgtacttatgaaatatgtaaatcaatttggaatgcaggaaatatatctttagcgattcaaaagtttttaaataaactacaatgaaaacctataaaaccaattccaaaattaaattttacaattcaaaagttaatttataaatataagcat

SEQ ID NO: 76813 - DNA, 7013 bp, Oryza sativa
aaaactagagcagaaaaagattaaattggataatgttgggtctgcaaattctagtttaagtgagaatacaagtgatggaaggctatcatccaaggtgcatcccctcgtatcttcctccttcgatgattcagttgaccagtcattggcaggaagctcaaagtgtaatggaaagcgcatatttccgcttgatctaaatacagtggatgcaggaaacgttgtaaatatatcggatgacgaggagatgcctgagcgtgatgcgccagattttgagctagaacttacggacaacaattctcccagaaagaccatgttttcatttctttcccctaaggttgaagaaaatcggagtaaggaacattcattgcctaccgattcaccaggttccctctccctctctcttgcctttccggcatctagggaacatgctggtaagttgcaatcagagataccgaagcagttgcctgagatgagcagccagaataagatatcttcgatttgggaccgacaatgatggctgcccgctcttgcgttcctgatgttttgcgggacagatcgatgtttgcgtcctctggagaaactatcttgaatactatgtatctgcaatgatgccactcaggtgtgctgacaagtagttacatccagggggcagaactattgaactgcaaagaacagagttctggacgtaagtgttattttgcaggaaacagtgatatgcttttcaagacatagggttatgacatgaaagttcatactctgcactgtaaatttctgcacaactcatgtaaagttttggccttaagctggaagtcatctcaaatttgagagatgtctgccgtggggggaaagatggtggttattatctgagattagtatataaatgtttctcttttcttgaaatgttctcgtggtacccgttagtttgtcatatctgataaaatgactttccgacactatcatttttttttcctaaaatgacatccctgagctgatccaatctgctggtttaaatataatcatgctgtattcggattctacgcatatactctttggaattgtgtaattaattagagcaatgaatgtactagttaatccacacgaaaacatgtctcaaacatgtcctaaattaccctacaggtcccttcactttgcttttttggaggtacaagtaagaacacaaatcaatgcaactccacacttgcaccatcgcatgcacacacacgtgcgtgtcttacacacataggagtactttttggtacagattatatgccacggacctcgaaacacggaaaacgtgcgttcagcgcacacttttgggtagagattagatgccacggacctcaaagcacggaaagtgggcgactcccgctaagagccggtacaatagcaggctataaaccagctacaaatatattttaagaagataaataaaaagagagaagagcagtgggctacagatttgtagccagctgtagcacggactccaaaacgcagtgtgtgcatgacaggtgagaccatacattaatagtgtagtatgtaactattgtatagatgagctattagattaactatagataaattggagctagtagttggccatactattaaacttgctctaaacgcgcacacgtgtgtatcccattctatgggaattaatctcacgattgatccccaaggagcgaggaaaaaatcctcctaggccacactcggaatattggatttcgtaaccaatcaagcgtgaggggcatatcatgacggtatgttgtcaccaaaattccttgtgacggcatttagactttttgtgatagtaaggggtagtcactaatagtccattttctagtagtgtacctttgtcctagagtttttttttaagataatggaagctttattagtattagtcaattactaacactcttttttatagctaagatgcacataaccaaaatacacttaaaaaaagtgatcacaggaaaagtattaaggactatcaattatgagactagatatctagatcaccgcctatgttcccggctaaaacacatccttgaccaccttgtccaatcgtggacaagccacactcaccaggtccagcaaaccaagcttttgaagaataactcatgtacaaaactagtaagaaaataacatgtagaggagataaaatagctttaacaatgctatttgcacatcataattgcaaaactaatctgtacccaaaaataccgtggcaattctctcctcttgggctgaagtagaatttttattttggatgcgaaactaagaaaatatgttgaacgagtatcgcacaagattgaagaaagttgccgaaaatctgttgaaaatacaatgcaatgtacacatacgttttgctaaaacacacgttagtattttgtaataactgaaatatggattagatacattgctaaaacacaatgtatatattatatgttgcttaccatactacaaaccctactacaaatacactaaaagcaggggcggagctactatatattaccggggtctaatgatctggatgaaagtttctaacaccatgttaattactgttcatcacccttaagcagaggagagcaaccatatagtgtaatttgagtgaccccagtaatattttcctatagctccggcccttgctaaaagacatacttcctccatcccattttaagtgcatttgtggatttccgtatccaatgtttgaccgtccattttatttgaaaaatttataaaaaaataagccacacataaagtattattcatgttttatcatctaataacaaataaaatactaatcataaaaaaatttcaaataaaatagacggtcaaacattggacacgaaaatttacatctgcacctagagtaccatattaatgttagttgatgccttgatggtaatcatggtatcttgtgatggtacctgtccaacaacttatattagtttgataatatgatcatatgatttctgcacgtggagggtcctaaagaatgtaacaattcgatcgcatggttgcaacttcaaaacattcatatatacagacgggcaagttttgaagaagagttttcaaacagcagtgaaccaaatcaatttgccctggctcaatttacaaatatacatacattcatatataaacacgctaacacgcagacataattcctaaccaactgccaaccaccattagccaactaactaatcatcgtctacgtaggctgtctccatcaccatggaagtcgtcgtcgctcgccggggcgtcgtcgtcctgcggctgcgccacggcgagccgccgcccagcgccgccgcgcggtctggcgggcgctgctcgaggctgctcctcctgtggacgttcgccgtcggcttcgccgccgggctgttcatgttcgccagccacgtcttggccgccgtcgccgccgccgtgctcttcgccgccatgtgcctgtacacgtgcctgtgcctgaacaacgcggcgccggaggaggaagaggagcagcagcagcagccgcctgttctgctgcttcccggtcaggcgctgcgcgtcgccgtgatgccgccatcggtggggcggctgcagcagcaggaggtcaacggcggcggcggcggcggaggcctcaggcaggaggacgtcgaggccgccatcccggcgttcgagtacagtaagggttcgggcggcgcggcggaggcggagcagtgcgccgtgtgcatcggagtcgtgcggcgggggaagacggtgcggcggctgccggcgtgcgggcacgcgttccacgcggcgtgcatcgacgggtggctccgcgcgcacgccacgtgccccgtgtgccgcgccgacgtcaaggtcgccgccggcggcggcggcggagcgccggtgtagtcgtcgtcgcacacgatgtcacgaacgatgtacaagctgttccgtgacggcaagttgattaatttcttcgtagtttttccccatttttgtatacttaattagtggttgatatttttgcatcgtgccacgatgtacttctgatttggaacagaagttaaatgtaacttttttggacataaattaaccagcatagcaaatttccaacaaaattatagttgttcaatagctcggatcggaattaataaattgagataatcctgaaaatgacgttggagccatttaattaattacgcttgaaaacgaagtaataagaaggctcgctcgtgtgtggtcgttgttgctgaccaaagttgtttaatgcatgcggcatcttgtttaagactgagaggaggattatctactctctagcttcagtacgaaaagaagagaaatgtcccgtgataggaactctatcttgtggcggagtacagcacgtcaatcatagtttggttagccaagttgtaattaagccgaaccttcttcgtatttgctgctcatatataaagatatccaagttgtcatgttgtccgctacaaattgcatccagcgcacggcctatcaatgatctttagtgtgcagactatgcactaatgccaataaaagccagtaactcttttaattctaactaggaagatagcccgcgcattcgcgtgggcatgtatgattatatttgtttgaagaatttataaggccggaatatcaatcgaatgacaactgccacactttaaaagtaatatatcttttcacaaattttcttcatcggcattgcttggatatatatttttttctatctaactattagctttaagctacaacatttaattcaaagaaaatttggcactttatccaatcatattgtttgtattgattaaatctacctcttaaaaggtctagtacttaagtagcaagaaccacacgaaaaaaaaagctcgagcagtaatccttcgtacatgcatgtgttaatacatgagtgatatttctcttctattagttatgaatatttgtgggataatatatgatgaaataatctatgttgttaaatttattttttttactaattgtaagactatttggatgagaatgacatagaagaatgtaaattttggtttcatgtggtatctgtttaatcaaaatatagttaatgtatctataaattgtaaagaaaatatgagtgttgaagattcaaaaaaatcagacaatttggatgagaaagatagagctaaatatattttcatgtaatatttttaaattaatatatagttaatattatatgtaatcctatataatttacatatatttagcaggaggctggcggatattttcttgtacgtagaaacataataacgtttttattcaagatgtggtcatagcacggtggcagtggttattggcattcatgatgcacccatcaacccggtttcgagtctcttcaagtatgcttagcagaaaccattgacaccaatttcttgcttggtgtctatttctttttatttgagaattaggaagcactactataaaaaagcacataaaggttggtatattggtgccgaaatagataaacccactcatgcgatcgaatatataatcggcacctttgaacaattatatgtgtcggttttagagaaaaacaaacaccaatattatacgtacctattatttattataggtgccgattaattaaaaaaccaacaactataatataactataatatattataggcactttctttttaaaaaaggcattctacaaactgagccaagccgcacggggagggagagagtcacatctttctggagatcttatctatttgctctctctttttccctcgctcatccttatctccttctccttctgtttttttatgggagtagctatatttatggcgtcatattttacactaaaaaatagtcggcatgtatttacattgtaagtccctaaattaaatatgtaattttagtgtattgacaatgtaaataccaaaattacatatgtaagtcctaaaattacatatgtaaatcccaaaattacatcctaatacatatgtaagtggtgtgtaactgctgtgtaaatttgtaaatatataaataactacctgcagcagacacatacatataagtgtgaacgcagcaaagcagtggctagcgatggtatgagcacaatggatttaacttgacaagaatctcacagtgtatccaatggccacaaaactgactgctatggagccagaaatctggtgatagaaatatagtaaaaccgtttttttatttggtggaaggttaggtgggatgcaatcttttaatagatttaatctaatggcttagaataatgggtcccccgctttaattgaaaatattttttttagaatttctaatgttttttctaatttattagagtgctatgtggcagcgtaggaacgtttataggagtgccatgtgatggtgactataatctaataattaaaaaatgggcgcatcattttaaatgaaaattatcagcccttttttgttattttttcaagaaggcagtctacaaaccgagccaagccgccgcacgggggagggagagagtcgcatcgttctggaggtcttatttatttgctctctttttccctcgctcttccttatttccttctccttctgttttttatgggatagctatatttatagcgtcatattttactctaaaaaaatagtcggtatgtatttatattgtaagtccctaaattacatatgtaattttaatgtattgacaatataaataccagaattacgtaggtaagtcctaacattacgtatataaatcccaacattacatcctaatacatatgtaagtggtgcgtaactactgtgtaaatttgcaaatatataaataactacccgtagcagacacagacatataagtgtgaacgcagcaaagcagcggccagcgatctaaaatgccacgtgtcgatctaggagcagcatttgtaggagcgcccacatggcggcgtaggagcgtttataggaagattaatgtacttttagtatataatagataagacgtattttaattttataatatcttcagaattaagtaaactttataattaactaggaagggtgcccgc

SEQ ID NO: 76814 - DNA, 1263 bp, Oryza sativa
acgggggtttgggcgtaggtcggggttggggaggggcggcggcgcgtgagagcgagagagagggggcggagaagagggcgcggtggagacgatcctcagcgttggattttaagcagagatgatcctgaccgttctacgaggaataaaagaatgagtgatgagtaaaatcatttgttgaattataaggtatatagatagaagaagaagaggatgtggatgctcaccaggatcccctcctgtgctcgccagatggagaccggcgcccctctcctgttcagccacgagatggcgcaaccgtgcaaggagcggaggagacgagtcaggggatttttcttttacgcaaagggaagagggaagatacttgagtgcctcacctttatctcaaatttagtgatgttatccattttatttatcatgactgatggtggttcacagagaaaaaacgcaacaaatttggttgaggatttatatcagtgccgctccatctaccaccaccgctctttctccatgaggcaccatcgttcctcctgctccatctaccaccactgctctttcttcatgaggcaccatcgttcctcctcttcactttcacatgtgcaattgcactctctagtcactgatttgtctttccgcctcccgtattttcatgcacgctattgtcatggtcgtcgttgaggccagggtatcggccttgcaaggactcaggacgataggagctgacctgaccgagagcgaatacgctagatctaggctcctccttgttggatctggcggttcctagctattagagggaaaaagaaaaaggagagagagtgtgtgtatggagtggttgtagagtcactggatttggaggtgaagcaacggtgattccaccggacttgaagatggatagaatggggttgtctaaattgaaacaaaaatataaagttagctattttataaatgaaaataatgattaaagaatgatataatatgaaaatttttaaaaatacgttgtacaaaatgaatttactatttttgtccattagccgtagtctcatgctatcctaagtcactacagatttatcgttactatatggtatggttgggcggtctacttaactattactaataatctcatgatatgttaaaacataacaatacagagttctacttaaaaaaagataaaaaaaataataccctcgattttgctcaataataaagtattcgattgtggtcccttttctcactgccgaataactcatgactatctcttatatgtat

SEQ ID NO: 76815 - DNA, 2542 bp, Oryza sativa
  unsure (1)..(2542): unsure at all n locations
atgtgtggtctagtttaaagatttaattgcaactaattcaatggtacaatcaaattttaatcagataagcaatttaagagaaaatatagtttatagtttattaaagaggtggctatatgtgtacctagaagagaggagagagaagctattggcttaacactagaggctaaggggacaacggaagggtgtgagggtgcccgatatatttttacccgaatcgggcgtccggcccagagcaatcgcgacagacatgtgtcatataaaatcagatctcctaccgtagatgccaaccacgggtgtgtttaattcacgccaaaattaaaagtttggttgaaattggaacgatgtgacggaaaaattggatgtttgtgtgtgtatgaaagtttggatgtgatggaaaagttggaagtttgaaaaaaaaatttgcaactaaacacggcccacgtgactttctttagacagttcagagttccggatcgtcaggttcaacaagatttgcagcattgaaattgaaattcaggggatttaacattttaacactttttaatagatcagtttaatccctctcacaatcgcatctctcacaaaacggcaaatctattgacactacccatccagagtggcaaaacattaattattccaaaattcagtggtagaagcaacaagttcaggttctaatatcttgattctctttagatagataaagaaaatggtcatattgatgtatgaagaaatattctttggttcgggttcagttgctagtaaaaaaatacaaaaggttaagcagaaaataaaatgaagaaaatcaacgggttaaaaaaaatttaggagaaggttaaaaaaaatgaagaaacattaagggtgtgtttggataatgggataagagtagtgggattgagatagggaaatggatgaaggctaggatgaaatgagggagggataatggatggctaggatttgaagaaactctttggtgggtggaaaattattttcctaatcattagctaaacatgacctaaggagtaatagcgactagcgaccaccatgggtttacgtcagtgtagagtgattcgatcaacttcaaatccatagtaacatcctgctctttaaggtcggttttagtgtagcttgaggggacatttgcgtccaaacaaaagacggatcgatgaaaatatgtcaatgccgccgggagttctctttttcagtagctaaccgtttccgtatttgtttttttttcttttttntcccttcttntgngncncngcccntgnggcaacggccnccttntnctgaatgtttgttgtgtaactaaactctgctatcttcttctaatatattaacgtgcgatttttttgagcgttcgcgaaaaaaaaaatatgtcaatgccgccagacgacgacgaccacaaatggcacgaatcagatttgacaagaatacctgtaacatgattacgaatagatgattattaaatgcatttatctaaaatggtaattttttaagggttaattggatccatgccactgtaaatatgccaattcgaaaaaatactactactattcgcgatatcggctacgtgccactgaaatttagggaaattggaatcatgtcacttccgtccagttttatgtcaaccgccgttatctgtctccttcttcttttcttcgcttctccgccatagacaccggtgagcactccacctcagactcgctggtccttgccactgcctactgcagctagtcaggggtcccctctctatctctcgctacttctccgccaacagccgccgcgacctgtccattcctcatcgtccccgccggcggacgtggcaccctcgctgccgtcgtcaagggaatcagcggccaggaagcttctccggcatggacgacggtgagcccaggaggacgaccgctgaggggaatcggcgaccggggagccgagggcgaagcccggcaggacgagcggcacgggggaaggagatcggtgacggcagcggcgagggttggggacggcgacatggcggtggacggggtggcaatcggcacatgggcagtggccggggccctcgccgggggagtagatgatgacaacgcaggcgcagcccggcccgccgactccgagacgaggcgctcgacaacgacgacaaagtgcagcccggcttcgagatgaagcgcttgacgacgacgacgacgcaggcgcagcccggcccgacccccatctctgagacgacgacggcgacgacacctcctactgcatctatggtggtggagagagaggaaaaggaaagagaagagaggggagggaggtggggcccacgtgcagttgggggctaacagggatttttgacggaaaatgtgatggagtggcacggttccaatttctccaattttcagtggcatatgtagccgatattctgaatattagtggcattttttaattggcatatttgcagtggcatggatccaattaacccttttttaatggcaccatcaatttaaccttaacattgtgggctaccgggggagcataccaattaccactacat

SEQ ID NO: 76816 - DNA, 10048 bp, Oryza sativa
  unsure (1)..(10048): unsure at all n locations
tttgaaatgacccagttaatgatcacttgatggcatatttcttctgttatagaaaaacccaactgcttatgtctaactcacggtttcccttatcgccggtaaccacgtggttactgcggttatcgtcctaaccgtgggggggggggggtataccataggggttaccggtgatagggtttgatgaaatttgtccaaattcaaaattctgaaaaaaattgaaaaaaattcatggaagtagttcttggtttgtagtggcagatggtgaagaattttttttgaaaaagaataagataaattcaaatttgagggcaaaaccaaaagtcaattagaaaatgaaaagaaatggaatgggccttgtttggcactgttacagatagcgcattaaggctcataagagaagaaaatatctcctgggttgttgggggctctcctcacgctcttcctccgcagaaaaactaattcgcgcagacgcgtcagttggttatctcgcgcacgttgcccacacatgcccacatgcgacttttaggtttttttttcgattttttccatatacgcatgatttcctcttttccggatattttttttgtgatttttttcatgaacttcttttaatctaagcgcatgattcaactcaaatttggagtcaaaagttttcaaaattgtagttagaagttttaaatttttagtttgaatatttttaaatgtaagataaatgtttttaattttgagatgaaagttttcaaattcgagttgaaagtttcaaattctgagtagaatgttttcaaatccgaattgaaagtttttaaatctaagttgaaagattttaaatctcgacttaaaatttttcaaatttgatttgaaagttttcaactctcgatttaaagttttcaaatctcgatttgaaagttttcaaatctcgagttgaaaagttttaaaatatgagttgaaagttttcaaatctggactgaaagtttttaaatctgggttgaaagtttcaaagttgagttgaatgtttttcaaatttgagatgaaaagttgaaagttttcaaaatttgacttaaaaattcaaatttcgagtgaaaattttcaaatctagatttaaaattttgaaaatttgacttcagatatagatttcttttcaatttgttagtttaaaaaaatcctaactactaccgtcattatctcaaactgtaattatctaaaactaattgaatagttaactaccttttagtcccggaaaacggggacatctaactccatgccacttttaagatgtggcaattaattattcgccactcgctgtctatgacatgtgggccctcatgtgtctatgatatgtgggtccagtggcaaataattaattgcaccactcgtaagtggcaaatagttaattattcccggaaaacgtgcatcgggggcgcacacgcgccaactaggcgcccccctttctctgttggcagacttggcacagggtgagggaggcagcagcggcgcctaatccgccgcatacgagccggcgagcatgaaaatcgcgcggtttctgaggtaaccgcaactagggaggaggttatcgcctaggagaagtgcctcgaggtaaccctcatcctcctcgcggttaccgctggcagtggatctgtgttttatgcaaggaagtggtgataatcgtcccaaattgcacggtaaccgtggttcctatagcagttatcgcgtggaaaccgtggtttacatagttgaatgttgtgtctttagttcaatgttgaatgtttctagggttcgggtatagtaagtgcaaatgtggaatgttgaatgaaattatgtagtgcaaatgttgaatgttgtggaagatttagtttggtaagttgttgagtacttctgtttgaaaagactgttggaaatattggtaattaagcagtagtgaattcagtgcatccggtgtccttttttatatcattcgtttcgaactacaactttctatattcttgatgcttgcttatcctatgaacaatcatatttgtagtcgtggataatatattgtggactgtattatttcagctttatgtggacttcataatgctttgaaatatgaggtcgttgaattgttgttgttgaattattgtgctataaaatgtttcagctgtttggtagccagcttctgaaaatctggaaaagctctgaaacccagcttctccagcttctggcttcttagttcatttttcagaatctgtaactacagattcttagaagctgtggactgtttgggacagtttctagcagaagcagcttttgggaaaagctgcagctgggacaagctcccccaaacaggaccgttgagttgcttcaatatccacaataaagaaagatcatgccgattttttgtattttacacccaaaagttatacttggaagtatcctatatattcttccaattatccccaatttctacacacatccggcgataactgcacgaatatcacgattatccttccaaaccgtgcggtaactgcgaaaccactgatttttttgaattcaaatttttggagatgaattttgcgcggtggcgctgtgtcgcagcgtaggattatcctggccatcaatcttgtgcatgcgcgtctgcgtcgcgccaatgaatcggtcgcacgcacctgccccgtggtatgtgtatatttccataaatctttcaaaaacacgtgcataattgcaaaaagttcaaaaataacgtatattttcaaatctttttacgctccaatttgccgccttgtagttcaccacaatgacgttattgtcctgtgcatgcatcagcagcagcgagacagcatgctagtgatgatagaggtactccctctacttctatattaattgacgttttgaacaaggttaaagttaaacttttataactttgaccatcaataactttaaaaatatttaaaaatatttagtttaaagaaactagaaaaacataaaattagaaactagagcgtgttattgtccaaagcgtcaattaaaatgaaaccggaggaagtatatggataaccaaacaacctcgcctgtcgacagatccatagatgtaaaacataattagtttctgttagagtataatctcatcggtgtcgaataacgggttcctattgtcatctctagttgttggtacaaaaaggatttttcttagtagccaaatgcttgtcatttgatatagataaaatggccacgcttattaaatagtatatgttattcaaatattaaactattgtataatgttaaaaaatattgggactaatttataaaacatgtaaaagcaaatgtggtggacttatttgcagaatcacaatcatcactattgcaagaccaataaatatgtgggggtttacagttaattaagtgcataaataacaacagctaccagctgattccgttactgaaaattcagtacatgctgaccgctttcaattgatttgctttattcacattctttttgaacgaatattgagcgttcctatactaatagatttgggccatttggcactcattttggaagggcccacacttgatggtaatgcattatgattagttatttttattgttattagatgataaaacataaatagtattttatatgtgactattttttttaattttttcataataagacagatagtcaaacgttgtactacatgaaaaatccaaaactgcgttatttttgggatggggggagtatcatcatcatcaactactctctccgggctgataatatttgtcgttttggataagagtaaggtcaaactttaaaatctttgattatgaataatttctaaaatatttatgtttgaaatatggagactatatggatagattagttttaaaaagtacttcaataaaatcatatatttcttaacacttctattcatattataataaaaaatgagtaaattacactagaggtgcttaaacttgtaacgaggtttcacttaagtccacgaacttgcaaaacgagcatcgagatctctaaacttggtttaatgtatcatcccggtccaaaacctcatttgaccgtggtcttgcttacgtggcatgccacgtggacgatgacatggattttttttattttttctcccttcttctttttttctcccttttgacactgacaggtggggcccacttctctcctcactactctcctcttctctctgacctcactttcccctcctctctatcctctctctcttcggccggttaagcgggacgggcggccggcgaccgaagtaggcgacaagcgggtcggagcggggcggccggccgactggcggagcaggtcggtggaaaaaaacagtgccaggcgaggctggtgagggggcggggaggccggcggcggcaacgacttcatctccgccaccgagctcgcgcgctctatggccgacgcctccctcgcacacgtggccacggtcggcgacctctcctcccgggtgtggtcagcgacgcctcccccacacgcgtgctgctcctctcctctccggccgctgcccgtgcatgcgcgtcctcccgtcggcctcacccgcacgcctctcctttctcgccgaccgccgtccgtgcacgcgcgctgctcctctcctctccaaccgcagcccgtgcacgcgtgccgctcctctcctcccgccggccggcacccgcgcgccgctcctttcttgccggccgccccgcccgtcgccgcttcggttgctggctgcccatacgtcctgctcaaccgcacggagagagagagaggatagagagaagagggaaagtgaggtcagagaagcccactgacaggtgggccagtggtagaagggagaaaaaataaaaaaaaatccctgtcatcgcccacgtggcatgccacgtaggcaagaccacagtcaaatggggctttggaccgggatgatacattaaaccaagtttagggatctcaatactcgttttgcaagttcatggatctaaatgaaacctcgctacaagtttaaggaccgctagtgtaatttactcataaaaaatagtggtcaaagttatcttttaaagaccgtatcgttatttaaaacgacaagtattattaaatctagagggagtaataaacattgttttgtgtgtaagtttaattggtgagacgaggatgaaatggtagttgcgcagtactcttaaaaacacatcatcatcattgttttgtgtctaagtttaattggtgagacgaggacgaaatggcagttgcgcagtactcttaaaaacacattatcatcatcattgttttgtgtctaagtttaattggtgaacatatcatcatcatcatcatcatcatcatcatcatcatcattttatgtctaagtttaataggtgacgttgataaaattaggtaatgcaattaatgcatcccacattaaggactattaattcctccttcattatatatatctccgttttattttattttatttgtttcattatctttatgaagcatgcaaccgacatggacggtttacgggtgcacatgtatctatccgtttaattatatggatgctgatgcatattagaaactattaagtgtggcggatctctttttatagttgctaatggcaaaggcaggcgaatcttgccatctgctagccgtgatgccctattaccctcctcgtctagaagaaccaaaaaaaaaacactaaatattatctgacaaagggtcacacatgttagattatatgagatataacacactacagtatataaaattataggttgtctatacatcatttgatagaaaatccttctataaatcctgcaaagtttagaccacccaattgcattaagatttgcgccagagcaacaaattaaaacccacaaaacctcctcctcatcccctttctcacgacagaaacccacaaaacctcctcctcatcccctttctcacgatacagtcgctgcttagctctcacgcgtccccccccccctcctctcctcccttctggagccatcggtagcgagatgcccctaccccgccatcttccttgtctctggtggctcctcgctgttggatcagccaccacctcctaaccacaagctagctattccactgctaccaaccggcaccgacgcctccaccttccacaaccatccctctaagcccggcaacctcccccttcttctcccttccccttccacccctcccatccccactctaacccgggaccctcatttattggctcttcgctagagtttgggttgtcaccggcattgaagaagaaaaggaggatgtcagagttggagaaaaaacatctagagcatgaatcgaaaagcacatctagtgaatcaaaatctgtaagatttgggaatagattttctatcgacagaagggtagccattctgataaaattactaatatggtgtagaaaagctccacgagtaaacacggttataagagttgtggcttaaaagattaatgtcctcgctgtatatgtaagtgggttgttccatatttataccgaaagtctcaaaattcatggaattcttgacgtttgatttattctagctagccgaggctagtgtaaaataatcttcaggtttcgggtctgcaaatcatacagtgtaaaggctgcgttggattctcccagaagagttggattaaattttggatactcgtggcacgcttttcaaactgctaaacgatgtgtttcgtgcgaaaactttctatatgaaagttgccctaaaatatcagattaatctatttttcaaacttgtaataattaaaacttaattaacacacgttactaccatctcattttgcgtgaaatacttaatcttcatttttatcttcaggagattcaaacaccaccccaagctagcatgttaggcgtgcatgcttcgcttaattctcagattattctcatatgttttcactgccgctaggcgctacagagagcatgtcagtcccatcacttgttcaattcaacctttttcctttccatatctgaaccccttctcatagttgagaaaaaaaaagaaaaaattaagggcccatttaaaatcataggaataaaaaaacagagaaataggaaaaacacaggattctgacaggaatacaattgtaaaacagagaactgtaaaacacaggaaaaataccagaatggccattattttggactacaggaaaaacgcaggaatcagatgagaaagatagactcagaggaaatgttccaagaggttatacctcttgctaactttcctccaatatatgcataggattacccatttcataggaattttaaaggattggatagaattcaatcctttgtttcaaagctttcataggattttttttctataggattgaaatcctccaaaatttctacattttcctacaaatcaaaggggccctaagtggaggaattgattgcattgtataattccaaagtaaaaagacaaattatgttttaggttaatttcattcttttacttagaaatttataagtttttatgatcgattttccttacaatcacataaaacacacacgcccgcagatatacatacgccagtacgtatacatagcccttatcgccagtatattttatgtgccagtactaataattgtaagaccacaattaaagaaaaaagtatgaaatatcccctgaactatcatggtcgaccgaattattccctaaatttaaataccggacattttacaccctaaactatatataccggacaaacaatccctgaaccctgttcggggcggttttgatttcagctatcacatgtggcatcaacgtggcagcctaatcagaaaaaaaaaatcccttgggcccacctgtcatccagcttctcccagcccattgcgctctctctctcgtgcgcgtactcggacggccagcggcggagctcgctcgcgcggctggggacggaggcgagctggttcccctaaatccagccgccgccgccctcttcttccctttggccgcccgcggaggaggcagccggagctcatggtgggcggcggcgcggggatgggaggatggcaacgtcncggggacgggaggtgtgcggggtcggcgactgcgagcttcttcgcggcgccttgggaggaacgaggcgaatgcccagccgctgcaggtgaggaacgaggccggagtcgaaggcggcagacaggaagatcggcagcgtgtggtggcgagcgcggaaggacctgtccgcgagcgtggtacgcaccagcgcagcgggggaagggaggcggaggagtcatcgccgagcacctcgacgccgcccatcgctgccctccgcgccgaccgcaagcgccgacggcgcacctgacccgccgtttctgcctccgcgccgacccccggccgctcgacctggaccggcggccgcacctcgcgccgcccgtcgccggccctcgcgcgccgacccccgcgccgctcgacctgcgcccgcgcggccgccacctcgacgccgcccgtcgccggccctcgcgcgccgaccgtccgcgccgtcccacgccgccgcccgccgtgcgcgccgccgctgccgctcgacccgcgtgcttgggggaggatgagtgagagagacggagagtgagatgagaagatatgacaggtggaccccactacttttttataaatagaaagctgactgtactgttacacgtacaccacgtagaccaaaatcaccgtggattaggtcgaggggggtaattcgtccggtttacatagttatgagtgaagaatgtccggttttgtggttcaggggggtaattcagtcgatcgtgatagttcgggaggtaattcgtactttttcccaaattaaatagctagggtaagggcatgaagaattttacatgaataattccgctgcaatgattctctttgcgtctatatatatctagatatatattgcacactgtaatttgttttataagtttcatggctactttgttccatacacccttttatttgttcttgccgtgtatttgactcctttgttttgcacctcttttcattttctacatgtgtatgttctgatactgtaatttaaaaatctagtaaaagcttatcgctctggattttcattttctttttgaggaaaactgatttttatctttatacttgaatagttagatttcacaacacaatcagagcgtgatgcatgtgagagtgagacgattgagattttatttaggagtgaagtatatgggcggtccctaaacttatgcgggtgtgtcatctaagtccctaaactcctaaaatgcatttttagatatttgaacttatcatgggtgttatataggtccaaacgagttctaacccactccatgtcctgacgtggtattgtcacggtggtgcctacgtgtaagtggaatccatataattaaaaaccataattttctcatataaggtagatagaaaaaaatctaaagtagagaggagaaaatatgtttttttaattttatttttctatgtgattggcacgtgggtccaactaatacgtaggcactatcgtggcatgccacatcaacgcatagagtgggttgtagctcgtttggacctatatgacatccaagacaagtttagagatccgaaaatgcattttgagagtttggggatctaaatgacacacatgcacaagtttaaaatagctataatatgttgcgtggacaaaacaatagaagataaacttccctatcagatttgacagaaaatttacttataatttcagtcgacaggcagattggaccgcagataattcgcatgattaatttgatagaaaaaaatctactcgttctgtcctgcctctttttcttaaaataaatatgaacagtaagcaaacttttgtcaaatcgggttttacaattttatgacatggactcctacgccatcctaaaataagttaatctaatataagatgtgacattttctagcactacgacgtctgtacagattcgtacgtagtgctagaaaatatcaaatctcgtacaaattaacttatttcatcacagcattacagtgggacacactgcgaatggtagttatcccacgtggcatcatttgg

SEQ ID NO: 76817 - DNA, 2061 bp, Oryza sativa
  unsure (1)..(2061): unsure at all n locations
gggccggccctgggccctctctcctctatacatgaagatgtccttgctgtgatgttgtcgagctactgccggcaaaggtcacggcaatgccagaaactccaccacccagaacgccgtcgtgccgacgccgaagcaacacaggatggtggtgcaccgcagctgcacccaagctccgaaacatccagtggtacggactcaacatataagtacggaagagatacaaagaagcgactgaggcttacccaagtggttgttttctgaggcatgaacgtttgtggacgcgggttcgaatccttctctacatgtttttccaattagttccaaacgtgctcttttaattttcttttgaaaattcaagtgtattttaaattcgttttatttttaaattaataccgaaaatatgcaaatttattattatcaaacttattattattattattaaattgaggcaaatgttatataatcgaaatagtcaaattggtccttccatgttaaaaattgcaaaattttaatttttcttgttaaagttcaagtgcattttaaattcgttttatttttaaattaagaccgaaaagatgcaaaattattattattaaactaaatattattattttttaaaaaataaaggcaaatgtgtggtccttccaagttaaaaaaaatcgcaaatttttagctattgagctaaattatatgattaatatcataatataagttctcaaattttttgtccaaatttaaagtaaataacaaaacatgtgatattttaaaagaaaaacaacaaggtagagtcagaggataaaaaacggaagaaagtatcgtactggtgtgggaacatatggagaaaaaacatatgctaccaacaggctagcgctccttttgttgtttactatttctatgcattatggctgtgtttagatctaaagtttgatccaaacttcagtcattttccatcacatcaacctgtcatacacacgcaacttttcagtcatatcatctccaatttcaaccaaaatccaaactttgcgctgaactaaacacagcctatactcagaaaagaggtcagcgccagctactacggtgccgcgctcccctcacgtggcggcaattgatttcgtgccaccttggacatggtacgttatatcctggtgccatcggggttgacgttgaggtcatagtttatttttggaattagttttttatatgggttattttttaaataagttttggaaaagtgtcaatttatcaaaacctacctcgtcgcgtttagctcaccgtgagcagtcgagagctcaccgtgtaccaatccggcagatcgccaaaccagttccgagcgcgagccgaggcggaaacacttccatttcgggcgcgagaacagcgacacgctgccagagtggctgcctggctggagacacgtgaggcgagacgcgcgagtgatcagctaacgtgcacgtggcttacagctgtgcccttgttcactgtcaagtgtagctggcanaagaagaggaggtaaaatatgatgcggcttattgctgggcagcctggggccctgggcttgatgagaataatccgctaggaaaaagtacacgcaatgtccctcaaatttgttagccagatacaaaatcgtccccaaccataaaacaggatatctggcgtcccccaacttataagaccgatcacaatagcttcctcggcggttttgaccacggttttatcccacgtggcggctgactcagcatgggacccacgtgggccccacatgtcatggagactatgtcagcaccctctctctttctctatttctctccttcctttcgctctctgctctcgcacaggcggcggcgcgcgcggccagagggtggtgcggccggcgacggcggctcctgggtggcggcgcgcgggcttagggtagcgcgagctcgctggcctcccaatccccctcgtgcggtcggcaatggcggcgcgcggctgcagccatcatcaccgatgcggagaggagggccgatgcggcggcaacggcgtcaccaacacggtgggaaagaaggtcggcgttcttaagtgctt

SEQ ID NO: 76818 - DNA, 3160 bp, Oryza sativa
gtgttgcatgagctagtggagcaaatctatcggttggttagctttgtgcatgcagctggtagtggatcgagtggagcatggatgtgtggcatgacctccgccgccagctccaagccaaggagaagctcgcgccgtcgcaagcaagtgccgaaactcatgccgccacccctccagcccagacgaaactcactgccgaaactcgccgggcacctcctccagctcatgcacgcgcggggacggcggccggagatcgaactcatcgccatggtcatcgcgaggcggcggtgaaggcgtggctctatttgttcgcggctgcgcaagttgaccagggagccgtcgcgcgtgtggctccagctctgccgcggcggtctcccgccgctccgccccaccaaacggcagccacatcggcggcgccgtcatgttcgatctccccttcctctgccgcctcaccccgacgatgaccgccgcgctcctccccgcgcgacggcagccatcggcggcgccgctcgtcccatcggccctcctgtcgcgccgctccttccccgtcagccgccggccacgccggccctcctccacgccgcgtcgaagacgctgccgccatccacgcccagaggaaaaaggagagaggaagagagagaagacgggaaaaagagaaagggtggtgacgtggtctatctgacatgtggggcccacatgggtcccacgctgagtaagccgccacgtaggacaaaaccggggtcaaaaccgccgagggatctattatgactggttttgtaagttgggggacgtcggatgtccggttttgcggttgggggacgattttgtatctggttataaagttgagggacctttggtgtactttttcctaatccgctatagctatacatggccatcaggcccgaggcccgacggcccggcccacagcacagtattttggccgaccctaccactgggccgtgcctgggcctccccaccggcatgttgggtcggcccggcatgaccgacccggcacggcacgatgggtcggtatgccaggcccaacgcataaagtatagggagtaaatatagacattatcgccacagtccaaagaatagggacgtaaaatagacttatttcagcccaaagaggagggagggaaactagacttattttgctggaccaagagaagggtggaaaaatagacttatttaggtagccctaaggaaggcctgatgggccacccgtgcctacaggccggcacgacacgggcccgactgctggtgggccgtgcctgagccggaggtgcagcccatgggccagcacggcacggcatggtgtgttggtcgggccgtgccggcccgacagattttggcccgagcacggccgtgccgggccgggccgttcgtttgaccatctatagctatagctagctaattacttaaacagcatgcaaagattaagactgcactgtgttttaattttgtcaagctaggcaaggactttgtgacgagttaactagagtgagtaatatattttgaggtggcgagtgtacggttgagcttgcagtatgcatgcgcttgctatgcatatgcactactaacttttaacatatcagtgaaaggccaatggataacttcagttattatacatatgccctcctgagtacttgtatttgggaataaactaggcattcaagataggaataaaaaactccactacttatactttgcagataagctgagaatcttgttttgatgagcatttgtcattttgtttataaaagaaacgaaggaaatttccaactaattttatcactggacaagttcaaaaatccacaaacttgacacagttaattagtggaacacaaaacatgatgatgttaagtgatgtgtttattttgtagctggatggaacaattgtagccccaaccagtgctaaagcttgggattctggtttgcttcaatggattgagtttacaaaactaaatggagtatcaattcaaggcaatggcatcataaatggtagaggacaacaatggtggacctattcagacacagatgacgacgaaaatgatgacacagtaagttctcccatcccttttagcatatccttataaaccaaccattccaaagatgggtcatttagtacttaccttggatacttccacagtacgatgtggagtttgaaaggatgccacaagttaaacctacagtaagaagatcactatatcaaatcacatttgtaattgtctgggtgcacacgaaaaccaagtcataagaactttactctgatgcaggcactgagattctatggtagtttcaacgttgtagtagctggtatcactattgtcaacagctcgcagtgtcatctcaagtttgacagctgtcaaggagtgatggtccatgacgtaacaatatcctccccagaaaacagcctcaacactgatggaatacacctgcagaactctaaagatgtcagcattcatcataccaacctggcttgtggtactacctccataactgaactgaagcagaacttagagcctatatgaatctaaagtacatcaaaatgcttagcgattttcttttataaaatcctccatacatgaaacaagggcaagagacatgtgtatgctcaataaggcctagaaacaactgaaatcctgtctccctgtcctgcaaattctgcagtgtataggacaggagggtaccaggaaaaacttcaagagtactgaactatgaagctatcttttgcagttactcaacaaaagcagaaaaacatagttaacatgtaatttttggtcgaatatgatgcaggtgatgactgcgtctccattcaaacaggatgcagcaatataaatatacacaatgtgaattgtggacctggccatggaatcagcattggaggcctaggccgggacaacacaaaagcatgtgtctccaatgttactgtaagagatgtcaacatgttcagaaccatgactggtgtcagaatcaagacctggcaggtaagcacatccctttataggtacaaacaaatcctacttaataggacagtcattacattgtcaccaaagaaaaggataaatatatcatgttcataaacttggacaatcagatgtggtaagagatatatatgagaaaagaaatgatgatcctaagtgaagacttaatacttact

SEQ ID NO: 76819 - DNA, 5992 bp, Oryza sativa
  unsure (1)..(5992): unsure at all n locations
agaatattccaacttaaaagccaggtattggggtgaaaattaaagatagttccaatcttatgtatggacaaatttaattcatttaccctatgctgtgattcattccatgttaactccatgcaactttttattaaagcaaatttgtgtgttggcggtgcatccatctaggtgcgttcagtctagtgcaatatcttgcaaaaaaaaaagaagctcaaactagtgtgctatcttgtttgatggatgcaaaacttgccaacatgggtaaccaggctctcttttgcattcattaaacaagttcttgtaccagttccgagtattttgcaaggtgttgcactagattgcatccaactcacatgtttttgtacccttagctacttcccacaaattctacttagtttctcaataaatttagattgaataacaaacctttagcacctgcgctagagaatcatgccttgtcttggcacaccagaagctacaaccgagtaaaaaaggaatattaagctgagcttatctccttcaactaaaaggcaagagagaaataagacaaatgcatacctatgtataagatcttcattaaaaccaacttttgttaattcagcaatccactgatgcaagattgtgcccggggcaacaatcaataccctttgtgtcaaatcggaataaaaaaggccagctagaaaggctgaagcctgaatagcaaaaaaaaaaactagattagaagcctatatgaaaagaacacatcatacaagaattcaagggaaggataaaggaaatttcaactaaacctggcgggttttgcctaggcccatatcatccgcaagaattcccccaccggatttttcacagtggagcctccagagccattcaagcccatccttttgatgagggaagagactagaaaatatctcactaggaaggagaaaggggtgttttatatggtgtccagttgctgcgataacaaaagcacctgatctattaatagacacctgcaacacaaatgaccgaaattctattaaaacaaacttataaatcctctgtcaattatttgtatagcatcacatattcatgttgtatagcaataacactattgtgagttgtcaatttctgccgaacagtcaacacattttgcactatagaatatcgcagataggacaaaaattgatgatctttgtaattaactgcttatgactcaccttttcaccaccaagattaacagtgttgccatttgagagaattttaattacagctagctcagaactgaagagcacaaaccctgatccttcagaaagtttattttcatccttctgagtgatctgatggtcaactactgttccatatggagagaagaagtgcacaatatcatctgagaaatcaaaataaccatcaggttaacactataaggaagcagatgactatcttctgtattaataataccattggacactgtccagggaaggccatccagagttatcctccggtttgtcttcttgtccttatactgaatggtgtcttccattaatgttctatcaactacaacctggaaatatcaatagacaaaccaataagtacctttcagttgggacattatggaactgaaaaatatgtgataattctagaggaacaaaaatccatatggtttttacttgcaggtagctgggaattaggatgagtaaggaagtgcatttggatatgtcgaggattaaaatcctccttttgaaaaataacttagaatatttttaaccaagttatttagattgggaatattagaatacaaaaaatttcaaatgagcacataacagacattgaatgatgagccatgttgtttaggtaggaatatggaaattgggagaatgacttacatgttttcctttgataatatgcctgcacttgattattttatcagaaatggcagcatcggcataagtaattttagcagaatcccctgcctgggctgtgcccttggccctgataataatcaaatcaactatctttccatatttaatgaaatagtctgctaggtcagctgtcataaaaaatgacagaaaccaaattagtattacaaaaagttagtatgccatggaaaatctgtttaccaggtagctgactgtaaatattataactatggaattcagattagttaatgagaaaatcgtaatcattgaaccggtgcaatagatgttataatccatcatcctccattataggaattattcactgttgttcttaccagtttcaactcataaagtacaaacatctcttaaatcgcatgatggagttatgcctttgagtcaattgaactgtatatatttataaggaaacataaataccaaccagggcagacgaatgggctcatgaaataggtgcgcaccatttgctacttgcatagaatatagaaacaaaaacccagaaactgagcacacagattgaagaatttgcctcagcaacctagtgtgtcattccagtcagatatttattgtcaagtacagtacttaacggaatctatgaatatctatcttccaggacttgctttgagctgttagaaacttttatttggagcagaaaaaataacggaataatatccccaaaaaatacctgcaataatatggaaatttaaaccaccctacttaacagaatatgatgtggtttcattaactagggtataaaggagcaaattaccatatgacaattcgctaggcagccctcttataacaacttgcctgcagcaccaaccagaccacactgatgttaattaagatcaataaataactggtgaaatggtgggaaggggtggggatagtgtcttacccagcatggctgctgccctcgccaagttccttaatctgtaccatcgctgcagtttttcctttcttttttcctggaggccggaaacaccaaaaatcaaaaaaaaaaaggggaaatagtcaaattgcaagagagagagagtgtgtgtgtaaaaattagggttagggggagaggctctagagagagatagccacagtttgccggcggattggcggtgatggcggcgacgattccgcgtatcgggaggggttgagcacggggagggcggtggatgtgggaagcaacgcggccggaagtgtggagcacggcggggagagggatagtgttgggggttttggaggaggggggggggtggggggccnnngggtggtnangngacctgcgccggccggggtagtggagcacggcgccgaccacccggaggggagggagggcggcggcgggatctttacctcctccgagacggcgaccggcggcgagcacgatggcggcgcggcgacttcccggtcggcttccgagttctgattgctgtcgacgagcacggcaggagagagcacgggtgggttggtagagtcaattggagcggatttacaacggtgggctaatggaaataggaaaatgtccactttgcatctctcgaccgcaaagcacggggaaaatggacaagtggctacgtttaaaacgtgattttaccggaatgccatcttaaaaacgattcgttaaaatgccaagatgaagcgcgtgacactcgccgctttaccattttcaccattttatgcattttcgataggaatttcgcttctctgccaagtgaccagacgaaattgccctgcagttacatagaaaggggatcgagatccagagggggtgcttggctgtctctctcttcctccactctccagcatgtttgctcatcagcgaagaaatcaatttggtcatggagacagctcgttgcggaaggagctcaccgtcggcacaccgcatgtaggcgccgccgtcgcactgcatcccacttgggtgaggatggcgaatatggagtgtacatggcaagaactcgtagccaagtaagtgaatccattctcaatcctttggcgatttgaatgttgttgatgttgcgattgtgggcgagttcgttgtagtttgtgcatcgtttaacttgcttccatttttctatctcaccaggctcgaggaggagcctgagcgtagtttagctgcggtagttggtgatgcaggagcggtagatgctgacgcaggagttaaaaccgttttctatgccgcacctaatggggttgtcgaacttgtgccacctccggccgatcaaggcccagctgttgatgcacctcctgatgtgatattgcctgtatggtacctctaattactaattctgctttttggatctataaataatatcatgactgaataaaaaataatttgtttatcatcataacttaggtcttgtttagatcccaaaaatttttggccaaaaacgtcatatcaaatgtttggacatatgcatggggcattaaatatgggaaaaaaaccaattgcacaatttgtatgtaaattacgagataaatcttttgagcctaattacgccatgacttgacaatgtgatcctatagtaaatatttgctaatggcggattaattagtcttaataaattcatctcacagtttacaggtggaatctgtaatttgtttttgttattagtctactttttttgcggggagttattagtctacgtttaatactttaaatgtgcgtccgtatacttcaaaaacattacaaccaaataactaaacacacccttaaaaaatatttacagtaacaacatatttaagatgtatcatgaatttaattatggatttcagaacctcctgaatctctaggcaatcggaattttcttaggacagtcctaaccctccacctaggatggtgtctatagcattaactacattgccatgtaggacttttagcttatgtggcactatattaattaagagagaaagagtgaagagaggaagaaactgagtctcatgcaagacacagcttcaacacgagaacctatgcactagacactatcaagtttagacactatcaagttttgcattgggagagaataatatcttcataatagatgaagaataaatatgattggtagagaaaagagatgatgtatttattaatggcccactttaagaaaccatgggttgtagagtgtagtttctattgtgatgtcttattgacatggcaccatagacactgcttatggacactatgggttgggactgcccttagcatgcgtccaatacgtcaacccaacacaggaccaaaaaggaaggtgatcccaaagctcgaggtgtctctttgcctcctcttcggctggaagcaggcaaactggcaaaggtttctgtttcctccaactcctaggaaaactcacggtccctgaggcctttcacagttcaccagccgacgagttacttcatacctccacgcaggatgcgtgatgatgtggaggagagagggtgtgggccctcgtatgttggaaatatggtcataaatcggtatattttaatccaaaatattaagacaataaacatgacatttacaatgtgaagcgatctagtgataaaactaaacataaccatgagtatgcttaaggtaaaataagcatcaacattgagacaacgcaataatattgcaactggcagttttaacaaaaggaacggtaacagaaggatgttataccctgtgaaagttccttcgctagattgtgaggcagaattggctccgttggtgttgtcgatcggtgcgccacctcctaattcgggcgcgccacctcctgccgcaccgggtgcgccacctccagtagacatcacgcgatgcagacggaaccgaacgacgacgaagaagcgaacagtcgtgcggaagcactccccaaaaacttgatcaccctcctacctgtgcaaatctcagacgagggtgtggttccggaggccctactagttccaatcacttgtgcgcgcaagcgatcagaaccggggaagaacagaacctaatcacccgcctacccgtgcagatctcaggggagtgtgtggttccggaggccctgctcgtcccaatcacttgtgcgcgcaagcgatcagaaccggggaagaacagaagcagcgcaggcacatgcacagag

SEQ ID NO: 76820 - DNA, 2341 bp, Oryza sativa
cattgccattacgtgtcgagatggcccagccgctgctccactcgacgctcgtccgccaggggagcttctcggccgccgcccttcttggtagcgaatgtgctggacggcatcgtcgtcaacggcaactccgacgacagagcggctgcgcacggtgagggaccaggcatgatgggggcgcggggcgagctgctttgaccgatggcttctttgtaggcgaggaactcattcctagttgagggacgagaaattctgcaaaaatacgaggacccacaccctctctcctccacatcatcatgcatcctacgtggaggcatgaagtaacttgtcagctggtgcactgtgaaaggcctcatgatagataggaaaagttacctgatactgactcctctttgtccagttgcctcgccatgcaggctctgttcagttttcttttctggtaaaccttgaggccccatttgattcaaaggaaattcataagaattttaggatttcttttctatagaaattttttcctatatagccatttgaatcaaaggactaaatcgtatagaatcccataaaattcctatggaatgcctaatgccattcaagttttagagaaaatctaatatgaagttctacctcatggaagctttccttcgagtatttatctctcctctaattcctatgttttttctacggtccaatcaaacggtcattcctgagtttttcctgtgttttgcaattctctattttacaatttacacttacattcatattaaaatcctgcgttttacctattcctacgttttctcaatccagcgattcaaaggggaccctgaatgacgagtttaagttcttggtggttgtggcaggtgttgaaaccaggaagttctgactactaacgctaaattttcttcatcagcaacagaagataaacccatctagatgcccaaccaaactagatgggtttcatatcataaaatgatcagagatgataagaacatgtttagttcattaccctaccaaaaattggtaggttgttaggctttattagataaggttgttaggaggtttgttaggctttattagataaggttgttagtaggggtgaaaacggtaacggtaattaccggccgaccggcgttcgttttcgactttctaccggccgagccatatggaaatggtaatcgaccaaaacaaaaatggaaatggtaaaaaatatggaaatgaaaacggaaatggttttgctgttataccgatcgtttccgtatttaccgtattcttgcggaaattaccgtttcttataatatggtaattaccgtattctaaatatgtcgatattataggacatgtctatacttgacccacagcttatagattgaatgactcttcaataaaatctctaacttttgtacatggctaaaatgaagttaatttataatttatatagtataagcttgaatttatgtatatatataacatacttatgtaaagttaaatatatgtttttatagtttaatgtttccgtatttgttaccagtttccgatctgtaccgacatgttttcgtccgtattgttccgtttccggttttccaatatttctgatatctttttcgtttccgactttaccgtttccgatttcgtttccgagaaaaatatggttacggaaatggttgaggctgttttccgatcgtttccgaccgttttcatccctaggtgttaggatgtttgttaggagccggctctatataaagagaggcaccacagtcatgtggaatcctatcttactataaagttataccccactaactccttaagtttaacatacaaagatgccacatcatcatccactaacaagatgccacatcatcatcgactaacaatcatcacatttaaacatcatgcaaacatgctatatctttatagtttttatggtttaagagctcttcaaatacaaacatgttaaattatcatccaatataattcacataatgtttcaatgtatatctttattatgttttatgatatcctatatacttatatagttcatcctcacttagttagtgtttaaatgattaatctatggtccaaattatctttctcctttttcctctaattaagtcatatcacatcaattgtttttagcctttagatgattaatctacattccaaactatctccctacttttcttcttccataaagtcataccaccttacattttacgtttgaatcaacattctatatactatttaaatttaaattatcataaaccacattaatttacttaatctgatgttatctagctatcttacacgttattttttattgttatcatactaaattcccgcagcaatgcgc

SEQ ID NO: 76821 - DNA, 920 bp, Oryza sativa
acttgtgcatgaagatgtccttgccatcgagtggctgccgacaaagatcatagtacgcctgaaactccaccacctagaacacagtcgtgcccgcactgaaacaacacaggttagtggcgcatcgccgctccccctgagctctaagacctccaatggcgcggcatgggaccatgtggtggtggaggacgacgatgacacaacaaatggcaacggtgaagatcgccagccttccattgatgctgccgctcctcctccggcacctcaagtatgaccagaataccaagcctgacccaaacctcacctgcatcgcggtggcgccacccaccgcgtggcgatggcgccacatgaagtgtcgcatggtccatggggctaatcggcgacgggatgccatctatgccatccagataccagtaacgcctaatggaaacgttgagcttacatgccacgacgctggccttcaccacggacacaagatactgggaagtctggaaagttttaaagatgtatttttttccctctcacttacacgtgagtcgtataatttctattttgtttttgctaactaggatgtcacgtcaatcaactgtcaatgatgtcttaaggtccatcttaaataattttgataagaaataaagatttatgttattatgcaattataaactcgactctaaggtgagagacaacaagcgggtagagtccgattccaacagacgaacaaatatctacgattctccactctctattgacgcgaatatttttctcccaccgggaaattaaacgtggctacctcgtcgcgtttagctcaccgtgagccgtcgagagctcaccaatccggcagatcgccaaaccagttcgagggggaagccaaggcggagccacttccatttggggcgcgagaacagcgacacgctggcagagtg

SEQ ID NO: 76822 - DNA, 649 bp, Oryza sativa
actcatgctagataatatgcactggactagtagatgaacaatatagcctaattcaaatacatacaaaatgttaatgaacctaaggatccatgggtattcatcggtttctgtggctttcatgttatgtgaaagttgcatcgctacctttgctcctgctcaattatgcaggttctgtggatatctatctattgatctttcaaatggcaaccccaatatgtgcatcattcgtcgaagaattgcattgttacttggacaatgtgcttttgaggttccgttattaacttcaatattttccctcagatattaaacagaaattagaagcagagaacatgttaaatttcctacttgtgtgtctgctttaacataaaaaataataattctacagataaagggcgttattcagaaagaggtctgcgatgctttggttggacttcttggggatcaggacatggccgttagggtatgtatcatagttaaaaaccttagcattaaaagcgagaaatcctttttctttagtttactaattctgctgtcaactttcagctggcagcatgctcttccctatgttacgctttccgagtttttggcatctgggaagtagatttgcttgagtgtattcctacatgtgggcaatgtgcttcaagttgat

SEQ ID NO: 76823 - DNA, 4457 bp, Oryza sativa
tacgatctgaaaacgccgtgctgatggttacgagttcagaacttcagatcgatcaaccaatggaagagtacagtccatggcgttgattacagtaccctcatgtcaataattttcaggcatgcattatcggattatcctgcgagcaatgcacgggctagagacttcacatgcatacatgggtacggcaagattgttgtctcattgtttgtttgaaggacctaaacagaggacaacgtacttgtatttctgcgtggctctcaagcctatacacgtaggagtacctgcgacagtatcagttttctgaaaatgcaggttgatcgacaaactgacaagcctacggcagtgaccacacagcccgtgcagacaaatatgaactcgttgaaaacacacagatatatatagggggaaacatttgagatcgcttgtcagatggcaagagttgataattcccttttccaacagagcagacgttgctagcagaatggtgcgctacaaacgtctgagaacttaaatgcacaggaagatgggatcttgttttcagagaagaggatgaaactgcatggcaagtacgaccggccgtcgcttttgcatatgcttccgacatggcgtttttgtgccggactagtcgcatgcagcaccagtatggacgccacgatgagcaattgagcagaaatgcagcactagactagactagtttacaacttgcgtttggaccaaacaatctacctaagcaaggcacataagatggtcagaatgaaacattatttgcgcttgctttgcagaagagatgaaatcgatcggtgccttgtcaagctcagaagcccgtggcaaaggcaggaggcagctccccacattttaggtggaggctaccacgcgaggagctagaaaagcaggcacacgcagctaacgttttcaagtcaaaccacaccctccatgcacatcaatctgttgctgaatttgggttgaactttatttttttttataagttggaaccgaagcccaccagttgcaggtacaaagttttcccaaatataaaacctggacgcccaaccgagggtgttgtctttctacgcacgttgtacgctccaactccgaccacaactaggttgctgcaggtcggtcccgtagcagcagaagcatcggcaggtaggttacaggtacccgtagagcacttgagctcgaggttaacctagataatgcccaagaccaacaagggtttgctggtggcctttactctccgtaatataaaaaaatcaatctaaaattaaaagtgacatatcctaatataacgaatctatatagatctttattcagattcgcagtactagaatataccatattggttttttattaaacggagggagtacgtctgctgtgtcatgtgtccttgacaacttcaacagaaatttcggagaatacctgacctatttcttcagcggcggcggcggcggcggcggcgacgcagtgcgggcgggcgggcggcgcgaagagagaggaggcccagcgattttcgcggcgaggcgctaggccgtgtggcacgggacgttgggctgtttttgcagcgggggaagccgagcggccggagcctacgggccgccgaatcgggatgtccagtttgttgggccaggctgggaaagagtctcagcctgtgcacgtcctagcacgcaggccgatttgggccttgttggcagggaatcatgtatgggccactattgaggcccatccaaacgaggcctttgaaaatccaattgcaactcttgaccagcagcgggcagtgagtcatgcgaaatccttagtcagagacgaaggaagtttctctttttccatttgttttgttggtggtgttgcttgctcgatctgacgatcttactattgaggtgtcaacgaaaggggagtccaatgattgatcccaacctgggtgatgcgaagtcgtaagaacaagatcccccgccgcgaagcaaaccgtttgaaccgcgaaggttacaacgacctttgagcgcttcaaagtctccgcggccaattgctcgttcaagtgccaggcttgtactatggcgtactaacctacctaccatcttgcattcttgctcgctagtagctctacattggcccttcgctgccgtaagattggagctctgctgctgacttccctagctagtgcctgatcaggaagatcaaaagagtcaatgacaatttttttctcctatctatgtctatgactcttttggagcctgttcactttaatgccattttcaaccatactattttttagcaaagttaccagaattttggctatgtttagtttgttgtcaaattttagtaagtacatatgaaatcttaccaaaaatttggcaaccttgccaaaattttgacaactttactaaaatttggcaatgccaaaacttgataaggttgaaaatagcagcaaagtgaacaaacccttaatcttcaggtgacggttagccttgtttatgattctgcgagcatatgcgggaagaagatacgtataatcttacaattcacttttcgtcgatcgatcgttgatctaacagtgacccttgagtgaggctgaaacgaaccgttcggagcaggagcagacgactcctctcctctgactgaacacacaaacacttcgcgctcgccgactgcacgtttcgttcctggaagaggcatccatgatccatggtgtccttcgaattgctccaaaaagatctctgctctgcactgatcataccgtgatgcattgcatgcacacaacttgcgacttgcagtagcttgtatcacttgcactaaacgtacatatcatattttttggagatgggattattaatatatttccatcagatctaatacgctatgaaaaggtccaagaatcaaatgggaaccgctcctccctatcaaaagtctattctttttgtcagcagttgcatttctatattgcttcgtcagctcatcatcatacatggatttcgcattacttttagcaagctgagctatttgacttggaatgtttcttcttccgttttatatttaaatctgagctatatatgatgacgccagttcagggctaattgaggatctggatcaggcacacggctggatcggttcggtcggtctgtagcggcatcgagtaatttgttatagcgaaacggaagcagttttgcactttgcttgtgcaactgatctataatcattaacaagtgattagtactaatgtacactataatccaatgaacttttcccagttagctgtccaagcgtgattcacatctatcagagatgctcatgcctgacaaggaatcaactttgagtattgataagctgctcttgccctttacctgaattgaaaggttgagccactgtcactctgtcgcactcggtgacatcggtccgtttgagatagctgaagtatatcgatggataataggaaaagtattttctggcacctaggtgtatgcatgtagtttaaacatagtttaaacagttatgtaaaaattttataaaatttaataagatagactatgataatataagacactatacaaatatgcaagtataaattagatctacatatgaataaacaaaaatgataaattttatctgcgctataggatattattcactgtctgattttattattatttttctctagttgtagatcaaatttagtcttgcatgtttgtgtctggacttatattaacacaatcgatgctactaaattttttcaattttttctataaccatttgagtcgcatacaaatgatggtgccatggcacctagatgtagaaaatccttgtcgacggataatatgatttaactactacaaagttaaaaacagttgtttaaaataatatttcaagaaaattttatataaaaaaatttacacaaaataccttttaagtgcttaggaagtgtgtaaacgaaaatccagaatcactatcctccaaacagagaaaatccagacatgcttttaaatgagaattcattaaggccaattttgttcttggtctccctctctttaaatgtatccacattcgtggatgtatggtgtgtgcgtatagcagtgtatatgcgtttatcaaaaaaaaaattaaggagaatgggggatattttttacacacgtcgttgctcgaactttttagataagtaacgcaaccagtaaattaaataccaggtgagtgaaatcatcacggctactaaccgacattgttgacgcggaataatggcattattgctccgcccaatggaaaatttctaggttaatttatggcaattaagcaaaagtttagtcaaatctatcgatcatgacacgctgatgattgcatgattttgctttgtataatgagcatggtcctcgctctctaaagattcgccgtgtgaattatttgcggcttaatataaatccatttcgcgtgccatgaacggatcacacggccagctaccacatgtagaaagatct

SEQ ID NO: 76824 - DNA, 3129 bp, Oryza sativa
ggaggcaagagatctagccgctcccgacgccgccaccccctcgtccctcctccctagtccgcttcagccgggggcggtagctcagtggtttcaactttaattcttagccggatttatgggtgctggtgttatgtttgaactttgaatcctcaacactcaattttctttccacttcttttttctcccttacctcacgtgaagaagttaccttaacaagatgagatagtgaattcagcatcctcagcatgtttctttgccgtctgccggggaagttgagatgggggatgcctggtggtgggtttagaagggaagaaggggccaaaaaggagttgaagacggagagagcgctaggccgtggaatcgcgttggccgccgggccatctcactaccgtcacctccaggacaagaggaccaggggggaaagaccatgtaccccatgaatcaaagggcgcaaatgagaggaaaatgggatgcatctacaggggcctctccggcgcaagcaaaggtgagacggcatggaaaaccgctggcaaaaaacctcgtcgccaaatcaaaaggaggagcaatgagagattgcggaggtgtgaacagaagacatcgggtaaggacaggaacagaatggcgctagctagatcaacctggaacaggcttttttccatctctgtcttgcccctactaaatcgaaggtcggatttgccacctcctcgaggatggtaaaaatactattaaattaatgtaaaagtattatcttatatgaaatggtgtaagaacggaacgattataaggtctcattttgtaaaatttcgttgcaacccacgggtgtatatttagtttagggtgtgtttagttcacgctaaaattagaagtttgattgaaattgaaacgatgtgacggaaaagttagaagtttatgtgtgtagaaaaattttaatgtaataaaaaagttaaaaatttaaagaaaaagttagaaactgaaccaggctttactatctgtaccgtacatgctgggcctgctgccacctgtatgattgatttgatattcatattgctgccgtcttacgccgctcgcaccgtcgttgcggccggcgcacgtggtgtatccatctatcgcgctgtctccccttcttcccttcgctcgtgcgcccgcgcactaccggctgtctgaaacctaccgactcgcccgcacgatgcactcaccaccaatctagctactacagtactatctctatctgctaattcggtctggctccgttggccacagcgcgcgcgcgcggacggccagcctaatcaacggcaacaaaacctgcaggcccgcacgcccacctgaatcacgcgcccgcccgctcaaaaggccgggaaatccacaggtggatgagtggatcgggcgtgacgcgagaccagctcgcgcgcgcgcgcgccggccgctagctgcgctgcgcccagacgcgggctttgccgctggatcatcaattcatcatcgatctcctccgtgaattcggggttgtataggtttgtaggaaagcaagtaacgccgtgctacgcattagattggatcgtcggtgttaggccatataacagtcgtagcaacatgcgcatcatgcatgtgacaggtgctgcaggcctgcagggctttgcttggcgaaaatcttgagagcctcaccttcccagccagcagctgtaagataaggacgtaacacagtgatgatatgctgttttctcttcttaatggcagattaatttgcagccagcgtcacatgcaccaggaggatcagtcttgggataagcacagtgaagagtgcatctaattaatatctggtgagaagtactgtagaatcttcactgttatcttactctctttctttttctatcttaccttctcttcttcaccaacctggcccttctctggttgacagctccacgtcgatttcatcctttattacagtatggttttatctgaaagattattccatagttcttttcaattggatggttttattttttttcttttggttttctaagttttatcctccaagacaatgtattagagaatatccacggaactcaaagttttatcctccaagacaatgtattagagaatatccacggaactcatctttagtcccagtttataatccctttatttctgaatcgaaaaccggacatccaatccggaactagagatggatcattaccaactagaactaaatgtgttttttttctttttttcattgttttttactgtttgcatattaattttcccaaatcaagttgctctctacactacatccccaaatcacagattcgcaaataagataatatcacggattaacaaataacatcatagattcacacattcaaatacatcacaaattcttaaaaaaaaaaagaatgaacatgcgccgccgccatctcctcccctcccaccgccggagcaagagagagagcttgagagagagagagagggagagggagaggggatcgagagaggcgccacacacatcactaagtgctagttatatacgccgcgttaatctatagtctaaagatagtggggggctaacactttttgaatcgggactaaaaatgatcaaaaagtacagctgggcttttgaatcgggattatatatatcttttagtctcagttcctaatagaatcgggactaatgttatttttagtatctgagtaaagatcagttatccagtagtgatcttaccccagctcctataatttggttttaatctatagtaatatcttaagttttccaaaagaaaaaaattacatcccgtacaacatgggcctgaattcttccaagaccgtatacaacgtgtttatactgagtcttgtagtagtaacttgtaggaacgccaactcaccatcaagcaaaacgtgtttgctccggttggccgtcggcattctaaagtcacgtagaacacgcgcgcgcattctaaagtcagccccggcccgcctgcatcagcatgcggaccggcccggccgcgctgtcgtgaactcgcgcaacatgcgcgcgcgtgcgtgatgcgtcgaccgatcgggacgcggccgagcgctttgctcctcctccacctcctccgtttccaccgcatccgcggatcgatcgatcgatcggtgggg

SEQ ID NO: 76825 - DNA, 4137 bp, Oryza sativa
catcaaagttagttcgtaccgtagaaaatttggatctaaacaaatctccttcttatcattacgttgagaagaattttgtgacatattattctcgtcgtggagggggtgcaagtaagactgagttggtacgagaagacttggagggggaaggagagaagaagggacctttgcttggaaatgatttatgggaggcaggaccatcaaagagacattgcggtagtgatgatgtggatgcagcgagggagatgaaaagggagttagtacaagaggggcttgatctaagtgaacatttgtcggcgagtgttcattggtcatcgtacggagtcaaccctgaatacccgacagaagtagcaggccaatatgtgaatccagatgattactttgatgtcgaattgagtggtggtcacgattctgtctcagtagaagtcaatagagatgatgttgacgaggaggcaagtgttgagcaatatgatgttgaatttgctgaagactctgatgatgaccgtccattctctccacttactaataatgacaagttagcattagaggaatgtcgtgcgtttgagaaggtgtttgggaggaagccggacattcctgagtttagggacctaacacatgcccatggtgcactactagatggcggcatcaacctagatcagttgccagaaccattccaggtggatggtctcagaaagggtttagagttcccatccatggtcgcattgaagctatggctccaggattacgccatcgtgcaccatcatccataccgtgttgtcaattctgccgcaaataggaggtacactgttaaatgtgaaaacccacggtgcaaatggaaggtccatgcaactaagaggtctagtggcacgtggaggatatcacgggtaggtaaggaacatagttgtgctactgccgaaggttcagggagccaccggcagctgacatcaaagttcatagcaaataggttatgcaatgccataaaactgcaacctacactctctgcttctgagttagctttgtatatatttgaggttttccagtatagggtgaagtatggaaaggcttggagggcacgagaggaggctatgaagctcatttacggtgaatggggtgaagcgtatgtccgtttgcccactttgctgcaagccattaagcagaggaatcctagtatggtctaccacatcaatactcatcctgatagggttgtcaacgttgatggagtgaccaagaaaatttttatgcgtgcattctggtgctttggtccttccattgaggcttttaagcattgtaggccagtactagctatagatgcaaccttcctaactgggaaatacggtggtgccttgatgactgcattatcagctgatgcggaggaccaacttgtacctttagcttttgccttggtggagaaagagaattcacgagactggtgctggtttatcgatcttgtccgacgggttgtggttgggccgcatagggaggtttgtattatctcagatcgacatgctggtataatgaatgccatgacgactcctgttctaggattgccaccggttcaccaccgatggtgcatgaggcacttcagtgctaatttccacaaggccggtgcggacaagcaccagacaaaagagctcctaaggatatgtcagattgacgagaagtggatatttgagagggatgttgaggcactaagacagcgtattcccgaaggtcctcgtaaatggcttgaagatgagttgttggataaagataagtggtctcgtgcatacgatagaaatggccgccggtggggttacatgacaaccaacatggccgaatagttcaatagcgtgctagttggtgttcgtaagcttctagtgacggccatagtatcatttacgttcatgaagtgcaatgactactttgtgaacagacatgatgaagctttgaagcgagtccagttagggcagcgttggtccaccaaggttgatagtaagatgaaggtgcaaaaaagtaaggcgaacaaacacactgcaaggtgtttcgataagcagaaaaagacatacgaggtcacagagaggggtggtataacgcgtggtggtgttagattcggcgcaagagccttcaaagttgaaggtgaggggaactcatgttcttgccaaaggccattgctctaccatatgccttgctcacatcttatacacgtttatctgattcatgcaattgatgaggaatctcccaaccgaatgccgtatcagttctcttcaagagccgttgtgaacacatgggcaagtcgctttgagccatacctcgaccccacacagtggccaccgtacgatggtgaagaatttgttgctgacccaaatttgaagattaaaacaagaaggaagaggagatcgaaacgattcaagaatgaaatggactcgggtctgggtggttctggaaggaaaccaccttcatgcgttcaacttgatgctgcgccggtgcaaaatagatgctcattgtgtcaccaggagggtcacaagaaaactaagtgtcctaagcgtccaaaaaagaagaagtccaaaaaaaatataagtgttagggaggtaaatattttgttttcctactcatgttctcgcattcattttctgttaatatatgtcacattggtaactaacggtgaatttattactttttcatgtaggatggccgaggagagacaaccgctgacttacccagccttggaggcgtgctacgaggcccgtcatcgcggggctgcgatcgagacagggagggtatgaatcggcattgatccacttgtgcataagtatctgtagcatgtatttgacattatattaactaattgatttacaattgctaatgcagatacttcaaccgctccgagtcagagctcatgcccccccagtgttcgacgataggtacatcccgtacctaagggcggtcgggttgctcggggtggccttggtcgtgagcagaggaatgccagtgttcaacgctcctgcgttgacagcacttgtggacagatggaggcctgagacacacagcttccacctccctagtggtgagatgaccatcactctacaggatgtggctatgatcttggccctcccattacgggggcatgccgtgacgggcaggacagagactcctggatggcgtgcacaagtggagcagctgtttggcattccactgaacattgagcaggggcaaggggggaagaagaagcagaatggaatacccccgtcttggctgagtcagaacttctcacatattgacgacgacgctgagccatggcgtgttgagtgttatgcccgcgcatacatcttgcacttgttgggaggggttctgtttcctgatgctgggggtgacattgcttcgccgatatggattcctttggtcgccaaccttggtgatctaggctgtttcagttggggctcagcagtgttggcgtggacatatagacagctctgtgaggcctgttgtcgtcaggcaccatcatccaacatgagtggttgtgtgctattgattcagctgtggatgtggttaagactaccggttggaaggcctaagtggaggcaaagcttcactccttggccctacaatgagccagacatggagaagacagtggcctacctttttgagagtactgccactgcacatgctcactgggatgtggcatacaagcattatgtcaatgagatggactgcttacagcctcaacatgtaagtacttccaatatcacttctagttagacatttacttctttaattgagatactaactaacgacatctcttcaacttttgcagattgaatggttaccataccacacaaatgaggcttcaagcctgaccctgaactcgatgtgcaatcgagactctgactatttcatgtaccagtgcccattgatttgtttctgggcagttgagtaccaccttccgcaccgtgtcatgcgacagttcgggaagaaacaagactggccggttgaggacatctcaactggagttgaattacacaagtaaatatttcttatctttgtttgctttcattgtcaatgttcaattttgtaccatttaacccttgtcgatgctcactattgtttcatccccttctacttgtctaggtatgacagggtgagaacaaagaaggtgaaaga

SEQ ID NO: 76826 - DNA, 2685 bp, Oryza sativa
ggcagtgttcattggtctgcatttgccaagattgagagcgagttgactttgcgggtttgtggcacgcgactcggttcaccagacggctgacgtgtgcgcacgtatttgtgcatgcatatggttcgtccaatgtgcggccaagcaaggccaggtgtaaatttgaacatttttgtttttgatttttaggcctcaattttggtatccgagatatccgaactgtggaggcgatcgctcttgcattgttgatgatgttctttcttttttatatactagcaaaaatgcccgtgcgttgcaacgggtgaagactattttaatcttattattgttatatggtttagttagatgaaattcactgtattaaattcacttggatatatatatttggttagaaaatcatgagttgcaattaggagtccgatcgtctcaaattagcatacgggttttaaagagatttcttatatgattccttctgtatttttaaaagtgaacaaacttaaaaaaatgactcaaatacggatttatatttccaaaagcgaacgaatttaaaaaccgacccatacaccgatacacggatgacgtaccaaagtactggcaaaaacatcttcaatttttatatatatattttttaaaaagtagtataagtagaagagaagattactgacgagaagtctttttcgagagagtcggacatttttttctttttttatggtagaagttttttgtttttttttctcggcttttttttctccacagggagtccgactttttcttttaagtcggacgttattttttttgcgattgaagtttttttttctcttttttttgttttttctctctttttttttaccgctggatgagtcggaccttttttttttccgagtgaagtttttctcccttttttttgttttttgtcgctctttttttcccaacggacaacggaaacatgttttacttttttaagtagtagtagatatatacatgtctcgtgtaaattgctatctgcagagtcttccatttgaagatgtttataccgtgtgcacttgctaaatggtatcacactacttagaaaactgtgtcgatttaaaaaccaggcgcgttttacactaaaatggaactttgaccatggatttgtgacaatataagccattgttgacataaatttgcaacacacaatagtgacataaccattctaaacatttaaatatataatatgaccaacatttgaaaatttgaacttatgtatatcggtatgacattatccacgagaaaagactagcaccattcagagtgacagccatggcacattcaaaaaaaaaaaatcaagcgtcacgagaaagtcccaggcgtaggccctagttgaatataaagcaaaggcatgggccggcccattccatgtcagcaatgaggttggaatttttttcatttatagattttttttaatatttgcagaaataatctatcggccaaaaaaattgcaaaaatagaccctgccgccccagaggtgggcggcaagatgacgtggcagatggagggttgaccgcgccgtttgccgccgtcggccaaaattgcaattagccccttgccgcccatacaaagggcggcaagaggctaattgcaattttggccgcccataaagaggttgcgctcgtacttttttcatttaggccccttgccgccccagtagagggcgtcaagggacccagatgcaaaaagtaccgccaaacgatttttctatgttatgttaataataaataaagaagtatttattggtaaaacttgttaatattgttataaaaatgtattgaagttggttgtttcgcaatttcatatgttaaggtattattttgtaacttattcgacgtattagtactcggataattaatataggcctatcgcagtctcggtcgtagaaacattatatggacttaaacaaggagaattagtaacatgaagaaatagtagtacaatttgaacatgatacaactatttccattgcggttacatagatgatattagattcgaactaggagggaggtagtgcaatagttgaacacaacgacgatgtagtaatgggacaaggaagcatgacagtagaaatttcaatatgccaagttgtccgataatagctaaccgctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcgagcaaagttagtaaatgttgtgagaaaataaggattcatgtaatcaaaatattcttaccatgaaatcgtcgtcaagaatatttggacaaacaaagaaccttcgacccaatattgtaggctttatggaacgaagaacctaacaacgatcaccacacctgcatcttggacgggcttcccatggagggagtgccatagttagcacccgccagtcattctgttgttcacgacattgtcgttcataagccgcttttctctgtaagtattgctcaatactttcggatgcgaaatactaacgaccttcttgtaaacaagtggttaggtcgagaacgggattttctgtattgacccactcaatgtatgcgcaagccgtagtgcgggt

SEQ ID NO: 76827 - DNA, 4732 bp, Oryza sativa
aaggatggacgagaaagagtatgatgctcctcattaattgaggggtatatgtagggagtgaaaaagggtagttggggggtaagatggggaaaattttgaatgagaggtggttggagggaaaagtagtactctaggataccttatatccgaggacaaattttgaatgcttggatcccttgtatctggggatgggaggaagtaaatatcatgatgcatcaatagaagtgaatggaaaaaatatagtcatgtgtcaaatgtcctaccaaagatatactagcatatgatgcgtatataatattaataaatgttctggtcaatgagaaaaatgcatatgcgagtttttgttaccaaccatccacctatctcattgtaaaatacatatctgtgtcactgccatagtgttatttgttttgctcaattaggatttttttccctaaatatagtttgagagaagaggccattacatgaacaattttgtgaaaaatgataaagtacagtatcttctaaaaaatcatatatatgcaaacactaatattgttcacatattccttcttaggaaatacagctcattcatcactagcataatttctggttgtaatatcactggtgttgcacaaaactagatacagcaagactggcaaaaagtagaatgacagaagaatatgtgatactggcaactgttctaatacacaatcttcaatgtgaagctcagcaggatgttttgaaaaactgccagaacctgttcaagaagtaccagagatagaattttcagcattgcctattacaagatgggaagtcaatcaaattgaaaggtattaggatgaaacagagtaacaaacctaccgaaagctattcatcttgagaaactaatgagatcctttcttcctttgtagttctcaatactttcagggcttactagccctgtactttcctcatatttcttctctaggtcctattgtaaaagtggagttttgacttcatgtgagcaaaacaagtttgtcgtaaaatgtgttgtaaaaaatatatatacaggcacgccagcctacagaaatacttatgcacagttattagttgaagtcacatgagaggtgccttagctgggaggatgttgaaatataaaattttgagttaaaaggcaaaagatatagcaaactcttgatacactaaaaactcaatatttgtaactctggtagaaaaagtgaagaatacattcaaaacaaaggaataatatgttattaaacagttctagcattaacaactgctatcagatagaatttcgatgcaatctcattattttgcactataatgacgtttttacaaaccttcagtccctcacgcacgctctcaagaacatcaagagacatcctgtcaaagaaaagaatcccctgcacatccacaattaaatggttagaaataatatgttgaaccgttgttaggttgcttgagggaaaaacagcaagggtatatatgctccaatatgtcttaaataattggagaaattgatctctagattatggtgttgaatagtatatgctttatacgcacccatcccacattgaaaattgagttatccctaatttgggttctttatcaaaagtagcctggacaggtaagtataagcatgagcttgatttggtggacccttgcatatgttcgctacagaaggaaactgaagcgaaagagtagctgctggcaaacctttacagacagtcttgacaatttatttaacttttaccatggttaagcacgtacctgtaaatgatcaaattcatgttggaaaactcttgcagacagacctgacaatttaactttaatctttgcccctgtaacatcctgagcatcaattttgacattgtctggtctctgcatgaataaagtgatcataattcataagtcattcacccaaaggacacacagctgcagtatgatggaaattttgtttgcctatttcacatctatatgttgctaaacttttgggtatttcagtctctaaattatatagtgcttttgtgttaaatctagttaatatgtgcatattagtagtaggcttaaaacgagtaaccaactcttgaattctcatattgttacaaggtcagaatttgaaggatggttcatttgttataatcatgttaatacgttatcactgctttaactcaaatgcatagttaaaaatatagttcagtaaaacgtgcagggttaatctcagcaggcaacttcactgattgttcactgaatgcatataacagtccgcagaatgaagaattcagcagcacagtgcaaacacacaagcttaataaattattttccaatgtactacctttgtttttttaaacacaagcttaatcaattattttccaatgtactaccttcgttttttaatagatgatgccgttgactttttatcacacgtttgaccattcttcttattaaaaaaaattacgtatttataatttattttgttgtgagttattttatcactcatagtactttaagcatgatttataccttatacatttgcataaaatttttgaataagacgaatggtcaaacagatgttcaaaagccaacagcgtcatctattaaaaaaggagggaatatcatgtagactttcaagagtcatcaaataacaatatggcttgtacacaaagtatcctcaccaccacattggcatatatcccagggaatgataagcagccttcctcatacactaacaatctcttcgacattttgtatacaaccgggttgacaaggacaatctcctctccttctcccttcacaccagctggattaaataccataagctgtacattcaccccaacttgtggtgcagagagaccaattccatcagtcctgtagcaagaaaccaatggttcaattggaggaatatcttctcgagcaatagtagatagcaagcctttctaaaaatgatagcaagatatatgattggatatttcccccacttaacaaggcatttcacatactctgagaaataactagtatgccacacaatttcgaccacttcaaatcacgccgtagtagtcttggagatctgttaaacactagacctctctaaagcccagggagcctcgtaagcacaaatggtaccttaatttggttatttaacaaagtaacacatattgaatctgaagcgctagaaaaaaaatcaccatggcaggatcaacttaacattttcatgcataattcgtcaaaagagtggcacggtaccctcacgcgcatttcatcaaacaggtcggcgcacgcaaacagaaaaccccagcaacgaaaggcacatatgactcaaacgccagactcacttgtacataacgtcgaacatctcatcagtgaggctgcggaggttgtcatcgaaggtgttgatgcgcttgttgcgagcccgtaggattgggtcggggtacttcacgaccttgagcggcggctcgaactggaggtcagcagctgcatcgtgcacacacgccaccagaagcagaagaagaacaaaccgcgtgagaagcaccacagaggaacccctgagcagaggaacgcgccgtgaaggcggcggctaacctgtggcgaagtcctcgtcctccgccggcggcgcggtggcgacggcggaaccgaagccgcggcgggcgcgtgccgccgcgagaggcgccaccgagcccatgcgggagaggggcagcgctctggggtgcgcggcgaggaggggggcgaaggaggacgcgaacccgcggaggcgggggccgaggcggaggtgaaggcgcgcggccatggtggtgggggagtcgacgattttttcccccgcacgcggcagcgattgggcggtgcccgctacagatgcctcgggggtttttttttttttttttttttttttgggcgtgcgggagcagtttggccgttggcggtgcggagcggttgcacgaggagcaactctcagcgtttggattgtaatcggacggcaaagccactcgcgatgggtgccttgggtcgatctgggtcgcgtcccttcacctggctcctggcactatgcagcctaccaaaatcctcacttgttaaactctaaaaaaatatcctcacttgtttggagataaaaaaaaatcctcacttttttgggcattcggccatttttctcgggaaggatttcggcactttcatttccattgcttctggtacgattccaacggtaccctatctaatatctgaaccgtaatacgagaaatcttcacctcttatcacaaccattcaagacagattccaggatggtatcgacgacgggtttcactgacgtggcgctctagtcagcaaaaaaacacatagacccatgtgtaagtgagaagaaaaaacttctatctttaatgcctgagccgtggtgaacagagagtggtgccgatcggttcatgcaagagcgggtgttgtgaatccatcaatgtggttaggacttggtttggtggagaccgcaaaaactcttcaccaattacttttatgctatcgaccaatcaattgagcggcatctacagaatttgatctgatcggcggtggtgtgatcccgaggaggaagcggatgtctagctagttgttcatgtaatttaaccattgctctcgacgctcgtccgcttggagcacgacgacccgatgatcttcgccgccataattgatgggcggcgaagaccttgctggggacatctcttggggctgagggggcggttgtagcgtgacgcttctgctcctctttttagaa

SEQ ID NO: 76828 - DNA, 3545 bp, Oryza sativa
caaaagaagagaagaaaggtaaaggtgctgttcttttctcgaataagagttggataaaaattaaaattttcgtggcacgctttttaaactgctaaacagtgcgtttcgtgcgaaaattttctatatgaaagttgctctaaaatattataataatctattttcaagtttgtaataattaaaattcaatcaatcatacattaatatcacctcgttttgcgtaaaaacttcatcttcatcttcatctccatcttcaagagaaaataacaccaccaaaatatgatgcggcttagagcaggtacaatagtaggctataagtcagctacaaacatattttaaagagataaatgaagagagagaagaacatcgagctacatatctatagccagctgcagcacggactccaagacgtaatgcgtgtatgacagatgggaccaggtattaatagtataggtattaatagtatagtaagcaactattgtatgaattggctattacattgactatagatgatttggagttagtagtgggctatactattaaacttgctcttagccggctatttctgggcagcatgggcttgatgagaatataatctgctatagcttgctaattactcaaacagcatgcaaagattaagactgcactgtgttttaattttgtttggcaagctaggcaaggactttgtgacgagttaactagagtgactaatagatttttgaggtggccggcgagtgtatggttgagcttgcaggatgcatgtgcgcttgctatacatatgtaacttttaacatataagggccctctttagatcccgacaaaattttatatcctatcacatcgaatatttggacacatgcatcgagttttaaatataaatgaaaaataactaattacacaaattgcgtgtaaattgcgagacgaatcttttaagtctaattgcgccataatatgacaatgtggtgctacagtaaacgtttggtaatgacagattaattaggtttaataaattcgtctcgcggtttacatgcggattatgtaatttgttttgttattagactgttcaatactttaaatgtgtatccgtatatttgatatgacacgccaaaactttacccctctgatctaaacacagcccatgtgaaagaccaacggataactccagtttttgtttttttgaaaaaaaaagactagtttttcgattcaatcattctgtggactttatccacattgtggatgagcccgttccctcaaaagatgatccgtcaatacggacaggtttggacttgtacccgccgtcccgaaatggaagcgcctcaaaagaaagcatcccttttcttttgccaaactcggcaagtttgcagcatttcgcaagctagccacgacttcggagagcatgtggctccactcacaaacatgtgcgcaatgcgtaaagcactaaagcctcgtgacctcgtcgcgtctatataaacaccgacggcgccgggtgtccgatcaatcaggatccaagtgtgcggcagcaaatccaccgccccctcacccgtctctgctctgctctgctctctgttcctcgcggcacgctagctattcgatggccaccaggatgtgcggccgcgccggcgagccggcggtgcgcaagggcccgtggacgctggaggaggacctcatcctcgtcagctacatctcgcaaaacggcgaaggatcctgggacaacctcgcgcgctctgccggtgagctaagctatacgctcgatgttacgttccttcttcgttgctggaaattgttgggatttgatcgatcggagctttaattatctcgcgactatgtgatgtccgaactcagggctgaaccggaacgggaagagctgcaggctgcggtggctcaactacctgaggcccggtgtgcggcggggcagcatcacgccggaggaggacatggtcatccgggagctccactcccggtgggggaacaggtggtccaagatcgccaagcacctccccggccggaccgacaacgagatcaagaaactactggaggaccaagatacacaggaagccgcgcggcaggagccagctgctgcaggaccgtgcgaggacgccatgggcatgggcatgtccaccaccaccagcgaggcggcgtcgacgtcggcgtcgagcggccagagccaggccagccccggcgtctgggatgagtacatgcaggcgagcagcttccctcacccggagcttgtctccttcgccgccgaccaccacctcgaaatggccggcgtgggcgaggtcgccgccgccgccgccggcagtttgtcccgactgagttcggtttcaatgacggcttctggaacttcgtggacaacttttgggagacgatgccggtttcagacgtggtgtgacgcgcgccacgcaaaccaattaaccgcgcgcgcggcagcaactagctagcgaatataatagcactatagcctatagagagaagatacaagatacagaaatcgtcaacgatgtctctatacttgcttgtagaggcggatgtttcagatacttgatctcgctttttgttcgtgagagaacttttttggcgaggttaaaaagatgctcttctgcactctgtgaggttctgaattctgatacttcagaaagctacgacaatagtacaagctaagatttaatagtagcacatgcaaatgagtgaatctgtaattccgaatctttttgacaacacacgttgttgtatctgcgtcactgcatgtgcagtggccccggtactaatactactgagatttggttctatttatacgttcctggatgttgttctctgctaagtgaacgtacggctctagtctcaacgtggctagcgaatgcatgtgcactttaaattgctgacaagctcgaccgccggttcgttacgtcctaaaaatgagaccggcaaattggcgaccttctcgccatgcccttgtgtctaatttctcaggtcatgctaactgtcaatcggcagcacatgaccacatgcacatgatgacttcgtatttggataaaaagcagaggcaaaagagctatgtaaggccaccaatccagtcttaaaaatcagctggcacgccctcgagactagccttagatctatactggagttaaacaaatgtctcaggtcaccatgttttcacatcatcagtctcatgtgaaaaattatgcactcagtcaacgaaatcaagattatttctttgctcactgatgaccatgtgaccccagtagtgcactagacctagttgtcaactggttttatatttgtttgttggttatttacattgcattcctccataattattcctatgtttcttgcaaccatccaagcacccatcctataaaattcatgtattttcaaatcgtctgttttacttacgtgttcctatcaaatcccttagccttttctattcctctatttttactatttctatattttgaacaagccctaaaagtttctccaaaccaaataagccctcagcctttcttacgtatgtacaataccccaaagcaaatgggttttgtgttggcact

SEQ ID NO: 76829 - DNA, 6762 bp, Oryza sativa
  unsure (1)..(6762): unsure at all n locations
tactttacttgttaggcaagcgtggctcactgttcattgcttttctatccaaacttttgcctttgttaaatgcatcacctcgaacatagaagggtgcatcaaagattttgagagtaatgcttaaaatgggaaattggacacgaggttataaggacgactcatcaggaattgtgggttgtctgtctgtctcattgaatagaaaccacttacataatgcatttgttttcaaaagaatgcaacaaaagaatggctagttttcagtcaaaaaagaaaaggaatggctagttaccatgcatgttgattgaacccaaaccatgacaataagacatgccattttgtctcaagtaaactagcatagtagtccgcgctgatttcgcggctagcatcattatattttctcttatataatagcatatatacattcttattttaatattaaaataacaacataattttaaaatttgtactaaatttacaaaactactaatgtgtaaatattataccggtatggactctagtcttatctttctatattccttattgttaattccaaatttcagctattttaaaattgtattcctgtatgggctctattttttctcatattaatatgagaatttctaggccatgagagccaacatggaggcttttttttcggttactttaataagttaatagattttacgagcttatgtcatcaccacaacttttattagatgcacacaaaaatcagtaagcggttgtagcatgattttttttaggtttttcattgatcaataagacatatttaaaattccaacacatagcaaaaatatatagcaggccaaaaccttttttctttatggtagtatagatggtcctattctatacacttcccttctacctggtattatttccaccaattcaaacttttacaattatacaaaggtatactcatacaccggaacgggatcctcctgttgcaacatgcatgcaagtatgcaatggcagatggctacataaaggtgcagggatgtttgtgcacaatagcatagtaaccatagcgtatgacctgatacaccgtattttgattgaacggctatgagatggtcctaatttagaagacacaattatcctctatattagcacccatgttgtatatgtttaagtgacgaatctctctattaaaagaacattttatagatcgactggagttgagattactcgactcttctcaatttcatcgtttgaaaatcaatctctgactaacggaaggacccgagagcctagcgtccttctgaatcctaattctttgtgctctatcctcttgttctaccatcttatctcatgaaaaaaagcgctattacatccatcttaaaaatataactatctttaaacttaatttttatctcaaataagtcaacctaagacaagtataagggacttccccccctccaaaaaaaaaacaccccatgctacccctagtggccttatcaccccactagcccttaagacccaagccccacccatatcatccttaatctcatcaacccccttgtgtattactgggtaacattttagacatttcgtcgcaataacacaatccttaatttctccaaaacattcttagacagatatattttgggtaaggggagtacatgatagctccatataagtctaagagacgactcattatcgtctctctaagtgcccttctcactcaactatggacctatggatatggtgctatgttgtatacaggcaaccagaaccatgtggatggagtattatttattgtttcagatatcaacacaatctcagtgtatattttttatcactacttttaataactatacttaattacataatgctaccttcatattaaaatataaggagttaggtattattctgcagttccgttgtgtgaagactgatagtcacattgtttcgcttattcatacgcttatccaaatcgcttttcagcaaacaaaaaattatttgggagtaaaatttttatatatgcgtccttagcaactccaaagcaaatattgtaaaataaactatgatgaaaaaaataaaattaagttctaaaatttgaagtttatcttatttttttaatggaatcagcacgagagtgtgctttttcattgaatatagtaggagaaaaaatgcagcccctagagcaaagaaaaggcaagaacaaaaaactgtacactatacaagatgcaggataagctcgcgtagtctcttggcacccgctcacgcccacgtggcagcctcctcttttatttttgcaatgaggtactttgttgtggcctccttgtgctcaaagattctccgattgtgttccttccatatttcccaaacaacgaggaggatcagggtgcgcagccccttcttggggatgcctgctgaagcagcaagcgtttcccaccaatccttgatcgtctgagtcgtctcccaaagccgagggtcgaggtgaagatatcccacccagttcgctaccatgctccaaatccttttggaatatcgacattccgcaacaaggtgcaaggccgtttcatcctctctcctacagagggggcactgcccgttgttctgccattccctgtttgtgagacggtcagaggtccatactctattctggatgatgagccaggcgtgaagcttacatttcccatgcgcccaagctctccaaattaacgggtcataggtcgtgcctggcgcgccaatgcactgagctttgtaggctgacgaagccgagtactgcccatgagttgtgaacttccaagtgatttggtccggttcttcttcatccagctgcatgccacggactgcaatctatagtgccacgagttgttccacaagggtcactgagatttgcgggtttgtctccaaggccaaatctccgacccaggcatcatacgccaaacaatggctcttaaagaagtgaagagggccttctatttttggttttctgtcatcagtcatcacccttctcttttttgttttgtgtgatgctaatcgcgtcactgcgtcgttcaccacgagcgttccatgtgaagtttacgtaagcggtgacgaagcaagtgcccatgttccggggcggctcctctccaccagtatcagaagaactcaggagatagctgttcagtcgtctcgtcagcacgtacgcccatctttgtcagttttctcttggcaccaacgcgcggttatttatgttgaattattcataagctgaatattcttattcatacattcggatcaacgcaaagtgagaaaaactctacctcttacaaatttctgccaaaagtattcactacctgcgcaattattcagagcccgtgctaaacttggacggcaccccaagcaattggggagatgatcaccaagtcagatacgacttattacactagttttcctcgatggttccgctcgataatgagaactgaagtcatttcgattagaccctataaaatgggtggttccggtcttccgtagagcacaaagttttcaggcatctgaagttttggacttgcaacacactctgctttcaagttctgaactagcattctactctgttctagctgactaggtcacacatggctatcaaggatgagcagcagccactgcacatcctcttcttcccattcctcgcgcccggtcatctcatcccgatcgccgatatggccgctctgttcgccgctcgtggcgtcaggtgcaccatcctcaccacccctgtcaacgccgccgtgatccgctcggccgtggaccgtgccaacgactcgttccgtcgcaacaacggcggcctggcgatcgaactcaccgtcgtgccatttccggacgttgggctcccgccgggcttcgagagtggcacggcgcttacgacccaggacgaccgtgacaagttcttccttggcattaggctgctccatgagcccttcgaccggtacctgtcggagcaccacgtcgacgccgccgtggtggacagcttcttcaggtgggccgcggacgccgccgccgagcacggcgtcccgcggctggggttcctcggcaccagcgtgttcgcgagggcctgcaccaacagcatgctgcgcaacaacccgctggagaccgcccccgacgaccccgacgccgtcgtgcccctgccgggcttgcctcactgcgtcgagctgaggcggagccaaatgatggacccgaagaagcggccggaccactgggagaagttccagagcttagacgccgccgaccagaggagcttcggcgaggtgttcaacagcttccacgagctggagccggactacgtcgagcactaccgcacgacgctcggccgccgcgtgtggctcgtcgggccggtcgctcttgcgaacaaggacgtggcggtgcgaggtaccagcgagctctcgccggacgccgacggctacctgcggtggctcgacgcgaaccacgcggctcggtggtgtacgtctccnnnnnnnnnnnnnnnnnnnnnnnnnnngcggagatgcgggagctcgcccgaggactcgacctctccggcaagaacttcgtgtgggttatcaacggcgcggacgccgacgcgtcggagtggatgcccgagggcttcgccgagctgatcgcgccgcgcggcgaacgcggcctcaccatccggggctgggcgccgcagatgctcatcctgaaccacccggccgtcggcgggttcgtgacgcactgcgggtggaactcgacgctggaggccgtgaccgccggcgtgccgatggtgacgtggccacggtacgccgaccagttctacaacgagaagctcatcacggaggtgctcgaggtgggtgtcggcgtcggctccatggacttcgcgtcgaagctggagaaccgccgggtgatcatcggcggcgaggtggtcgcgggagccatagggagagtgatgggcgacggcgaggagggcgaggcgatacggaaaaaggcgacggagctgggcgtgaaggcgaggggcgcgctggagaagggtgggtcgtcgtacgatgatgttggaattctgatggacgagttgatggctcgccggggctccgtcaatgtgtgacagcactccctaacaaggtgattgacggcttgacgcatcaagaagatggtgatcggacattcggacatctccagagtccagactattgtctttttcctcagagttttttttttttggagtaactatatttatggcgccatatttttcatcaaaaaatagtcggtatatatttacattgtaaatttctaaattacatatgtaattttagtgtatttacaatataagtcataaaattacatatgtaagtctctaaattacatatgtaagtataatgtaattataatgtaagtgcaatgtaatttctatattttgcattgaaaattacatatattgattacttatgtgaaagaacgtgccaacgagctacggttaaagcagtgcttcgagccaatcaaatgcaattgatgagaccaatgccaccgaaaaaagcggcgctccagccaatcaaaggcttagaaaaatttcgactgagaattgagaaaaaatatgtcgccatatttatagcaataccgtttttttttctttttgactattctctcagattgtaagggttgtatgaaccgtcaacggtccaattttagtacaggcctccattgataagtttgttctggcaatctggcatgataacctttgtgcaattatcctagattgatcggcccagatattggtatcagccgtattggtcagcccagtccgaaatgtttaaaatttaggaaaaagtacactcaaggtccctcaacttatcatcgagatacaaaatcgtcccccaatagcaaaaccagataccaggtgtctctcagctagcaaaactgttttcttttggtccttcgatagttttgaccctggttttgtccgtcgtggtggctgagtcagcgtgagacccacgtgggccccacatgtcatactaatccatgacatcaccctctttctctcccttcctcctctctatcactcttcttctcctctccgggacttggggcaggcttgtcgacgggtcacgccacgcacgacggcgtcgagcccaggggcggaccagcgcgaggcgacaagcttgacctcggtgacggccacgaggtcgaccatggccaggaaggaccccggcatggcatcaccgagtgatgcgcttcaagctccacgctgcacgcgacaacgcgggagtagagcaggcccagctccaccctcagctcccgtggttccgccgccagccacggccgcagcgccgcctccgcgagcaccatttgtggcggggctagggggctcgtgctcctctctttagtgtcccatggactcgaagcggcggcggaggaaaacccggaggcgagcggtgaagagttctggcgacgctaccagcgccatcgagcgcacatgaagagggaagaggtggggaggctaaccgactccagcggttgggggccctcctccagcctatgctctggatcgatgccgtcctcctcatcacgctgcaccggtcgccatactcctcaccagcagctgcagcgcttcatggaggtgaggttctcgcggggcaggccgctggtcccagcggaggaagtcgacgatgtggaggcggtgaggtgggacactatgtcggagtcggattccatgacacagtccacctccgccgccggaggtcgaacgccgcgtccatgagggacgccactgccggagcactgcgaagagcgtgtggtacctgcgcgccactcctc

SEQ ID NO: 76830 - DNA, 2249 bp, Oryza sativa
ccccccacccgcagctcctccccctgctgccgccgccttgtgggcaccgtccgtctcgctttcgacgccagcgtcaccgccatcaccgctgtcgcgtcgccacctcgcactgccgaccttgctgagaagagagagagagagatgaggaagggagagaagaagggaaaagagagaggaagctggcgtggccacgctaacatgtggggcccatgtgggtcccacgctgacttagccgccacgtcggacaaaaccagggtcaaaaccaccgaagaacctaaagtgaacggttttgttagttgagggacgcctgatatctggttttttgcgattgtgggacgattttgtaactcgatgacaagttgagggaccttcggtgtactttttcctaaaatttaccccatacgttccaaaatactactgtaaatatatttaggttatttagcaaaaataatattaatattaatatatgaattttatattgcttaggacctttcccagcttttgattggttgaaaatgttttgctttctatggttggaatgtgccccggaaatatttatattatgtttaaattcaaatactacctccgttttttaatagatgacgccgttgactttttctcacatgtttgaccattcgtcttattcaaaaattttatacaaatgtataagatataaatcacacttaaagtactacgagtgataaaacaactcataacaaaataaattataattacgtaaatttttttgaataagacgaatggtcaaatatgtgagaaaaagtcaacggcgtcatctattaaaaaacggagggagtactataaatacttgtattttggaggatggggtactgctccaacttggataaattcagtgatgagcacaaaaccaaatacaaactcttattctaaacattctctcttgtacatacacgaaaccgagaatattactaaggattaataacacagaaattaggcgtccatgaagaaaaaaaggaacaactgaactcagatgttccaaatctcaacaccttcaaaaacgaaaagttcaagcacggaccaaaatataggcccgtgtcatggcctttttctcaatggatccagggccggacgcagcaaaacccaatatggatcgatgaagttggggagcggtgtcgtcactcagggcatgtttggcacagatcttttcttgctccagctccacctcttctggagttggagctcagcccaacaatttcagctccactaaaactgggagtggagctgggtggagctctctcacaaaatgaactagagttgtggatctgggtttagacagctccacaactccactccagacccaactcctggagctaaatttaggagttggagatgtaccaaacacaccctcaccgtcagcttctttctttatcgcatgcgtaggctagggccattcatagtgtttgtggcattcaatatcaacatgtcatgtaaaagattcttctccacgtatacaagtgccaaatccttggcgagcccctttatcccccataaggcccttcacggtgcagtgagttggagcgttacctagttctccagctaggccaaaatctgacgtggaggagaaaaagcagtgggccccgtgtctttgcaaggttttgcacatcctagctaggatccggtttccttacgccaaaaagagaaactgtgcgcctctgcgctctgcggtcccctccctaatcctccccattcttccccaaaccgattttcgttggtcgtcaccatccacgcgattcacacgggcttgtagctcaccggccgcgctaccgagtccagcctccggtgaggaaggggagaagccagaggatgggcggaagagaagtgcgacggtggtggcgggaagatgtcgtcggttgcggtctcggaagcgaggacgaccacgctgggcatgggaggagaggagagccggggtcgccgccgtgccgccgccgtcgtcgagtcatcgtcgtcgacgccctccagatcccactgccgtgctgccgtcgtcgagttgtcgtcgtcgacgccctccagatccatgtcgccgccgtcgtcgagtcggcctcctcgaccgccgccgcctccgccgccgctccggatccacgctgccgcctcggcctcctcgaccgccggcgctccggatccatgccaccgcgtcggtctcctcgctctccgggcggcgtcggtgttcatcgtcgaggtggggggagaggggagaggccgccggcggcgga

SEQ ID NO: 76831 - DNA, 6511 bp, Oryza sativa
  unsure (1)..(6511): unsure at all n locations
atcaattaccggtagccaattcggatttaattactaagaagatagccgaatattatatttaattatagaccaagttaagtcgtccaatattctaggatttcgttccgacgattagctcacaatagaaatttctaacctattaattgttacgattgctcgggtaggttagattaaaaacttatgaccacaaaatatttatacccgcaaaatagtttaaatcgaaattgggtttgccgtagttcgcagatagtaaagctaataaaaaggaatcgactttcgcattcgacttttactcggatttaagtgaaacttgaacctaaattcatctaacttcataagctttacaatgatatataattcactatttaacaagatataattatgattataacttaactaatatcaaataattagatgatagttaacctaaatagtgtgccaatgaataaaaaaaatggatattgtacagtagcgtaattatctttaacacgtcttgtcgctgtagcaactaaataaattagttataatcaatccttcaaattaatgggtgtataggaaaatattagtgccatttactagtctgtgtccaaatataactaaatccatgacttataaattatttacataaagtttagcctcatattttgtaactaaaatataaacacacttagatgaaccttcaacttgtctgaggagaataataacttagctagttgtaagtggaccacttaaagttagttggaataatgtcatatgaagtggaatatatatagttcggttgacatccattagttaacaaaacagagccatcttaatcacatatatcgtatagcttctagtaaatagcaactattcagtaaatgatccaatgattaaatattgttgcacccacatacattgtacatcccaatttagatgtatggtatatcaaaaacctacccttttgggtatagtaagctaatgagtctatgacaaacatctatagtggataaaatactaattatagatcttgacctaatataattgtaaattaggattattcattgaaaaattatgtgatgaaatagccgtaaccataatatgattgacctagacaattctaacatacaaagcaagggtaattgttaacctttataatttattttgacaagtaaaatatgtacataattaaaataaagcctccaccaataaaataataatacaaatgattcacagtaattatttgaccaatccaaatccatccggcaacagaacctctagtgtataaccgttctatttagatagatgcatgaataaccatttgctagactaaaccacatagtagccagatacgtatctcattcatactacgttggttagctcctatatagaccaccatgacaacagaaagattaagaaaccttaacccctagcgtgattggaatccattggtagacatgaatagtatattttgttatgcatatttggttgttattcgaatatttttcttgcgtgttatagaatttaattatcgggtagtcgtgaggcaacgtcagcaacttccaggaggtgaaggttgatcaggattatatcaataacaaggactattctgagcaggcaagtcatcactattccttgaacatattgatcccaattgcgaaattgttttgtttataaataaaaattgcatgcaatgatgaacaccctacttgtgattatgccatgccttgattattgtttacccttaaatctttgtaaccatgtttacgtatgagtccctagtcaattatgacaattgcttagaaatgctattctagattcgtgcatactcatatttatcaaatgctatatgcttgggcaattacctttgggaaggtaattgagatgcggcatgtggagacatgagcgccacattgccatgatattgatgacatgatttgtgaatagagaaataaaaactaaacaactgttttcgactggggcggatggaggatttgggtggtatccggaaaaggctagcaccgtccccggtcaattaaggaccgagccatgaagttaaacatgaaacgacccccgtacaaccgtacttctcgaatgggtatagacctagcggattaggtagctgagcggaggcagtatccctgcatagtagtttcttgatgtgtgaggtaggggctctacggtggggcagccattggtagaaccgcgaggcgggtgtctacagtggtgtcgtcatcagtaggactaccatgtgagaatttaaacataattacaacttaatgcaagtgtgagtttttccttcccgggtgcgccagaactcctctcactgctagaaactgtttacgcctagagtgcatgaggatgtaaagttcatggagcgggtactgccgatgcgaggttatcgaaaagctttgccgtgacgcgtctcatgtgttgggacgaggctcatgtgttgggcagtcgcggagtgcgggtaaagtgtacatccactgcagtgtgattaaaccaaatctattcgaatagccgtgctcgcggttaatgagcaccgggacatgtattacacttggctagactctaaattcttaacttgtgtgggatgggatattgcatgatgaattttatgctgatggagccacatcccgagaggagggaaggtggacatcctcagaaaaccatgacgaatcaatggcgggaagctatccttgggatcacaatggatggtggacagaaccgtcgttgtttaaagtgaacactggtactaaaatttgatcagtctatgctaggttttaggcttgtgaaaagaattgtaaaattagctttatgcaaaagaacctgaagccattccttgaaataccctctgtcatatgcattgttgttgtggtggcttgctgagtacggttggtactcacccttgctatttatataacttttaggagagtgttaagagagggggccccccccccccccctttttttggggtttttcccgggggggtttaaaaacccggggccccttttttttgggggncccggggtttaaattccccnccccaaccccaanaaggaatgnatcggnnaagtgcgnngtctttgttctaggtactcgttccccagtcgactgcctgtggcatgttaaccgggcccttatattattttgtcttccgctgttgttctctgatatttgttggcctacctggccctaatgtaagtatttaactcttttagcctaaattcattcgtgatatgtcgtgatccaactatgtatgtgtgtaccaactactgatccagggattggtacggataaacacagaagatttccgatttccaaaatcgggggtctacagagggtgcctgggtagggttgagatttgtattattttctccactgtaaggtgttcaatgtaaaatttatacttatttgtaaattaaccaaaatatgagggctgaaataaaaaatgataggggcttaaacgaaaaaatcaaagtcacccatgaggccatttgcactgtggggaatcaaaacttggacacggtgctttttagcctacgtggcattttaggttccgcaagtgagtagattgcactgctactggcctaagaactaataatagccttgtcagaacgtcaggaaaaacataagagagaagcaaaaagcataagcgagagggaagcaccgagggcaaccttggggaagtatatatcaccgctgccgagctctatgttcaccgccatttccccacatctagctgcatatggagagctcaagaccaaaccgtcgaacggaggagaggacgacagaggcaacttgcctcaatatgcactggtagtagcaccatcaaccaccttcgcaccgtgatacgccgtgccagattgaggagagacgaggttgaggtcgcacagcccctgttggcggtgacctccacgaggaagatgatgccactcggctaccgtctgattgctcgatctgcctgactacaccactgcagctagaggaggatctctgccttctttctcgtccaacccatgccgcctctaagctcaggggggaaggaggcagcgaggactggggaagggagagaccagcacaacgaggggataaggggataatgggtggcctcagttgaatattcgctatattttcaaataagggaaaagatcaaagtgctctttattaacaagaaaatatcattagggatttagggtagatttgtaaaggcagtgaaagaacaaaatttctcaatttacggatcgagtatacgtaagtggatacaaatttcaaaattgatttatttgaaaatagagcgaatattcctgtagtaacctgctttatagacactggactgcttgccagcatcaaaataagtgcggtttcgtctaccaaaagtccaaaatgctgacggatggaattcgatatcttctcgatctgtttggtggcctgttgttttcttgccctatcctatttttttgagaaaaattgtcttgccctatatgctgagatggcctacggtttgggcgacgtacgtcttcgtttaaaaaataaaaataaatgagcaacaatattatcctgataccaacatgcatgtattatttatatatgtgtgtgtttttaataggaacttataataccatagatttgctgttgttttcgtcgctacaggaaaaacatttgcacgtgcgtctgtgtatagtgtgcataactagtggtggatgcactgccctctccccagatttcttgctcctattctcacttcaccaaaacaagtaggaagcgtggtggatccgtgtttttttaatacttctttcattgcttcctattcgtcctgttcattcttcaaaaagaaaaattctggaaggttcctcgcatccgacggttgtatttcatcgtgccagtttttgtcttcatgtggatccaacggtcaatttttttagcttacgtggctcattatcgttccatcatgagattaatttttcacttagagagatgtgcggtccaatccaacctgatcccccagagtcgcagataacataagctgccggcagattctccaccggaactcactactgcacaaatgattttccagtcatggacttatttagattgtagacggaccataattggtcacgtctgtgaaaatatactcattttcgcgtgcggtgagagccgcacgcaaaaatacccaccctctctttcactcctacctactttaaattttccccactttctctcctctccttttctcctctcctctatcctttctcctctcctccccgttctatctcctctcctctcctctacggcggcggcgggcttaggcggcgatggcgatagcgcgcgacggcatcggtggcgcagcgacggccaacccccgcacggatccggcggcggcggccggacgccctctccctcgcgggatcccgctcccctcccttcccaacccagatccggcggaggggaggggcgtcgacggcggtgcggccggaggggagcgcggatccggcggccggccgccctccctcgcgggatccagctcccctcctctccccgtccttccctcccctgatccggcggaggggaggggcgtcagcggcggtgcggccgaaggggagcacagatgccgatggcggatggcgtgaaggccggcggcgcggaggccgccgtcgccgacgatgagggcgggagcagcgtcctcggtcgccgccgccgacgacgacgagaaggacgatgacgaggaggaggtggcggccaggagcaatggcggtgacggattcgttttttttttttgaaattttatttttttggatttttatttttctgaacaggcgacgtaagcacccagaatttattttttttttgtcatggagaaactgaaatgctactgatcccagaacaaatatataaagttttccaaagccaaaatatttaagtatttggagtaggactagcaaaagtgcccgtgcgttacaccgggtgattacggagtgtgtatattgaccataattgttgtttggtttagcaaaagtgcccgtgcgttgcaccgggaagcgcacagatcagaaaaaaaaatgcaattaattaaaatacaaattcgctgaaatatttggtatttttaagtaggtatgtgtataattaaataaatttacaagtaaagcaagtgtgagaaataaaatgacattgttaaatttaattttactaagttctccatgattagttatgctttttggaattttattagaattttcagagcttaattgctaattttaataatacaaacatcatttaataattatttaattggaaaaagaaagaaaatccttccttttaggtttgcttagaaataaacacattcaataacaattgtaaatgcttctaaaaaaatcactaaaaatgaacttctctttttttttcgcccgagggacctaatatagacttatttccggcctgagggacctaaaatagtcttatttccgtcccatgccggtcggcccacggccttatcaaaaccctaaccctaaccctaaccttccccacccct

SEQ ID NO: 76832 - DNA, 5766 bp, Oryza sativa
ccccccagccggccgcctctcccaccacggacgccgcttcccttcccttctccctcctttctcgccggcaggctgcggcggcggcgacagagggctgcggcggtggcggcggcggagggctgcggcggcggcggcggcttcccccacgctagcggcagcagcacctttccctacactagcggcggtggcggcggcggctctccttcccgtctcgccggcacggcgcaacgacggcggggtgcggcagagacggccgtccctccccctctccctctccctctccctctccctctccccgtcggcgtcgacggcgacggcggcgacggcgtcggcttcgtccgagggtggatcctccggcggcggtggtttttttttttttgcaattttttctatcgctattgcctattggtaactgaataggattgtgtattgacgaaaaatggacgaaaattagatgtgacgaccggaaaaatacgaatattagttatagatatataatgttcgaattcaatcaattctggagttgattactagagagtaatgatcaatgcatctttgatactaattccggtggataatctatttcatgagatgaattaattagcttatggaagcacagcaaaatcgaaattaaacaacaattagtttgatactaacaaaaaagcgatgacacaaaaccaaatgccatgcattattcctcctttcgtaactagaatgccgacatcaccatagctgactcacacctcaaatcataagctacttcactacaccactactaaatatgttactaaaataacaaataatctagttcccctatatcgccttttgaaattcgaatatcacccacttgtgcttggctgcgattccattcgattcatatgatgaaaccctgttaatttgaccagcctaattaaaaacattatgatcaggagagagaaaaaaagcagtggcaagaacgcaacattccttcgcgatatgagaatcttttgcagggcttaagttgaacatttttttttgtgtgtgtgtgcagcagcggccagtgggatcacctagatacaattatcaaatcacagccgagctagttgcacatatataagttgcacacagtgatgatagataaaatttagaatagaaaataaaatgaattctgataattggaaaaataaaaataaaagttcaagtaggaatataatttataaataaaaaatgagaatgaaaaatattgaatgttgaaagaaccatcagtataaaacacaatggtagtaaatgaaaataaagtggagagaagcagcgagctcataaaggagcaggcgagtagggtggcagtggttgatgggatatctaaaattataaataaaacctcaaaaagattatatttgatttttagaatacctatgatgaataagaggaggataacaaacatgtcgttgagaacctcagtcacggtggttggcgtcacggtggttggcgggacttttagaagtaaaaaatataaccaatgataatcatttcgatttttaaaatcccactaacattaaagagcggaggaaacgggtgggcattaaaggagtatatttgagacatttgataggacttctaaaaattataaaaacgaaacccgatgagataatgaactctataaactaaaaggtccaatttttaaatgttataaggagaaggaatataaatcgtggtaggttagggaaacaaataaataaaggagtaagggtagtcactgtgacttttaaaaaactataaaattagagactctaggatgacaagatctcataaagtcataagacaacacgatggctattttacatttttgaagtaaaatcatgtgaataaatagataatttagtggttgctagctgcgcaattgtgcggcccacctagctagaaagtaaaaaatgaattccaacaatagttatgttcgatttttataatcctaatgacaataagagtaggcggcagacgggtcatagaggagaatagtggcagcgtttgacaggatttataaaaattataaaaaaacctaatgagacaatgaactctaaaaactataaagtccaatttttaaaggttcgggcttataaaaagtaaaaaaataaactccaatgatgatcatgtttgattttaaaatctcaatggcaataaagaaggcagcagcgggcgagtcgtagagaagtatagtgacaaagttgctgacgttttggcggaacttctagaaagtaaaaaaaatgaacctaaatgataattatattcaatttttaaaatatcaatgactataaagagaatattcaacggatggctatagaggagtataatgatagcgtttgtcgggacttctagaaattataaaaacaaaaccgaacaggacaataaactctaaaaactataagatccaatttttaaaggtttcaaggagaatgaatagaaaatggtagattaaacaagtaaataaagaaggatatgacagaagtaacgggcagcaactggtgtgacttttaaaaactattaaattagaaatacgaggatggtaaggtttggtctttcaaagtcttaagacaacgagataactatttaataaattttaagtaaaacatatataaaatatataattttatatgggtactagccgtgcaattgcgcgggccaccccagctagttatagattaattaggcttaaaaattgtctcgcgaatttgctctcatttatacgattagtttattattaatctatatttaatatttcgaattagtgtcaaacatccgatataacataaaatttaatccttgatccaaataccacctgagaaggctttatagtctccgatgtgcagtccaatccagcgtgtaccccgcagggtcgcagagaacacaggctgccggtagatctagtaactctatgttggccaaaagatcagcagcacgggcacgcagctagccaaccatggctgtcggcgagggggagcagcagccgttgcacatcctcttcttcccgtttatcgcgcacggccacctcatcccggtggccgacatggccgcgcttttcgccgcccgcggcgttcggtgtaccatcctcaccacccccgtcaacgccgccgtcatccgttcagccgtggaccgtgccaacgatgcctcccgtggcaccggctcaccggagatcagcatcacgctcttccccttccccgacgtcgggctcccgccgggcgtcgagagcgttccgggcatctcctccaaagccgaacaagagaagatagccgaagcgttcctgcggtttcgcgagccgttcgaccggttcttggccgagcaccacaccgacgccgtcgtggtcgacagcttcttccactggtcctcggacgccgccgcggaccacggtgtcccgcgcctggcgttcctcggcagcagcctgttcgcgcgggcctgcagcgacagcatgctgcgccacaacccggtggaggcctcccccgacgaccccgacgccgtcgtgtccctgccggacctgccgcaccgcgtcgagctgaggcggagccagatgatggaccccagggagcgggagggcgagtgggccttcctccagctcgtgaacgccgcggaccagaggagcttcggcgagctgttcaacagcttccgcgagatggagccggactacgtcgagcactaccacacgaagctcggtcgccgcgcgtggctcctcgggccggtggcgctcgccgccggcaagggcatggcggagaggcaggacacggacaccggctccggccgccttcgccgacgaggaacgctgcctgcggtggctcgacgggaaggcggccggctctgtcgtctacatctccttcggcacgatcgcccgtctattggcggcggagctgacggagatcgcccgcgccctgcaactctccggcaagaacttcctgtggatcatcacccgcgaggacaccgacgcatcggagtggatgcccgaaggcttcgccgatctgatggcgcgcggcgagcgcggcctcgtcgtccggggctgggcgccgcaggtgctcgtcctgaaccaccccgccgtcggcgggttcgtcacgcactgcgggtggaactccgtgctggaagccgtgagcgctggcgtgccgatggtggcgtggccgcgttacaccgaccagttctacaacgagaagctcatcgttgagatgcttaaggtcggcgtcggggtcggcgccagggagttcgcgtcgttcattgaccatcggagccaggtgattgccggcgaggtgatcgcggaagccatcgggagagtgatgggtgaaggcgaggaaggcgaggcgatgaggaaaaaggtcaaggagctccgcgagaaggcgaggagcgcggtgaaggagggcggctcttcctacgacgatgccggacggctgttggatgagctgatggctcgccggagctccggcacgtcgtgagattgcatccgggcggtcgccggtcgatacatgatataatgaaataatgaccggacagctctgatggttagttggttactgaggcgatttcatcgtcttaggcctaacagcatgtattttctcccgtacaatacatttgtcatttggtgatgggcatgttaatgatggcttagactatactatactatactactctgaagcaaattctctagtacgttgtgactttgagagcctcatcttttcactcatgcttatgtttatttgaaaatttttgaatttttaactttaaatttagagctgagaacacgtatataaaagttttatttttgatttaaattttaattttaaggtttttttcatcgaagtttatttttcagcctttacttttagatcgctaagaacacgtatataaaagttttattcataaattatttttcgtttgcaaatatgttgtttcgcttattccgtgattacgtgagttattgagatgttgacctactttatagcggatccatgtatcaccgtcagtaagtaaattagagaatctcaatcccactttataatatatgagaattttaatgttagacatgacatctaataatttgtcattgaaaaaacttaatttgtcagcatcgtttattttattatgatatattttatcactagagttaatttaaattagactagcaactttgcatatttacatcaaattttctaatgagtggttaaacttatatagaaaaatcaacacatcatttttttaagaaaacataatatataacattatgtggactttggatcactctttcgctgtcatgcatctcaaaataaatataacccgtactagtttgatgatggactagattatgacgcgtctctttaaaacctcggtgtttttagtagacttcataccaccttttgctgtaattttctttaaaaaaaacactaccgaacacttcgtcatactctgtacactatatttctaggaacgttgtatccgtagtgatggaaaaaattcctaagagttttatttcaaaaatatgacatcacacaaaagtggtatgatgtatcacagtatcagctacgtcaaaactgacaggctaggcaaaagttagggtgtgtttagtttgtgaaaagaaaaggtttggttgtcacatcggatatttgaccggatgtcaaaaatggttttcagacacgactgtagcacttatggctaatcatgtaataattaggctcaaaagattcgtctcgcgattttcatgcaaactgtgcaattagtttttatttttatctatatttaatgctccatgcatgtgtccaaaga

SEQ ID NO: 76833 - DNA, 1715 bp, Oryza sativa
gttgttatatgttgggacggagggtgtccagattcatagccaaaagttgttatatgttgggacggagggtgtccagattcatagccaaaagttgttatatgttgggacggaggtagtcacaatatttctatctaagaccatgttcattcagtattttttcattacactggagcaactatgcaattcttttacttgatatgtaaaataaaagcatgagaggcccatgaatttcacctatgattgtcatgtccatttctgtgtggatgttccaatgttcaatacatgcttattgcttttgcattgttcaatacagtcttatttttcaatacagtcatattttttgaagaaataaataccctttttgttagtatgatttggttaaaagctttggggttcacttccctcattggggtgatttttaagattcaggtctttatcatctaataccatagtttccactagtaaaatatctacatttgacattacagatcccttcttcaaagaaaggcaagctaagccgtggagccatgcaaaaagagcatgcattaagctgatgaaagttcttattatattacaagacaagtatccttattcatttgctcatgaaactgtgcttccagcagcagttgacttctgtttgactatgatcacaaatcctgaacaggcagatacatcttttgaggaatttcttgtccagtgcatggttttggtgaaattagtattggagtgtcaggaatacaaaccaggtcaaataggctttgaagcagttggaagttcagaacatgcaatttttgatcaaaggaagaacaacctttcagctactgccagcagcatggtgatgtctgttcttcctgctgaccgtattatgctgctatgcgatatattaataaggaggtattattctgaattgctagcaacccatatgccatatacaactgctccacagccaactgtttctgtttgcattcgtataatttcattcgtagttagcatcatgctgcagaccatctattgaagtctgtaagatagaactttggttctcttttaattagattacacaaattgttctgctatcactttactagacaagcaaatcattgggctaatcaagtaaagcaccatccattatataaacaacaataaatgttttgaagtaccattcgctgaaaaatattttattatagttacactaggtaattagtaattacaccttctttttaaaactaatgattattggtaaataattccataaatgtcttagagtggtttacaggagcaacgttcagcaacttataaagtatagacggacctatcgaatggcatgaggaaattatacacattttaattgctgtacggggaatgtgatgccgttatccatgtgtgagaggagtgtcaaattagtaaattacattggatgttgtttgggtttgatattttactataatattttatacaataccataatgtggtgtcattccctttggccttctcttctaggacccattaacgcaagttttaattcaactgcaggcacttcatttatacagcaacagatatgaatgaatggcattccaatcctgaatcctttcatcacgagcagaatctgctacaatgtacagagaaacgccgaccatgtgctgaagcacttttcattattttgtttgacaactacggagtggtatatgggcatttcatggtaattccaagtttaataa

SEQ ID NO: 76834 - DNA, 5071 bp, Oryza sativa
cgacgcgacgaggagagatcggacagggattcccatcgctaggcttcagcagattggggtctgattcgtcctcggatcgagctttctcaggggggggggggggagggggggtcaatttctggtcgggttcgcttctccggaaggaatcttcacgtgaaatttggtcgcgtttggaaggaaccggcggggggaggggaagaggaggaaggaggattttagccatggacggagccggaggccgccgtttttaaaagtggggcgtggcttcggggttcgagatggttcgggaacccggtacacgtgtcgcttgggcgcgcttccagcgaattcgaccaatgggatgcgagctttcgagcccgttgcgtggccgtcgcggtgtctgattttgaaccgtgtgccacgtaggatggcgttcgtccacgatcctcctcttccgtgtgccgtggaggtggaaaggggatataatcaggaccgtccgatctcgggccgtcaggccggatggtttagcgtttgacttcgtgtgccctcgaacagtagatccctgtaagcgtatgcgttcgtcatccgatgatcatgtgcatcagcatcagtttatcagccaagttatgtctgttctatttcaacgtaatcatttttatcggttgacggattatatagttgaatggcttgttgatgattttatgtagttgggtggttgtttcttatactccctccatttttcatattataagttatctgatacatcaagaagatgttgggtcaagtttctctttacatggagcctttgctcttagcctattgcagcccataagtttaacaaatatgagccgttgatttatatattgattaatggtggagattgtcttatcctttaaaaaacctaatctccattaagagagtacagcaagtgtccaacagttagttactactccatatacgtgttttgtgatgtctctcagttaattatattttttttatatcatgtatcaaattttacctagagattaacctaccattgattaacagtaagaacatccttcctccgtataaaaaacagcttttgggggtatgtatcaagcttttattcatgttcatctcatatccatcaaaagttgattctttttacacgaagggtttactaggtactccctctgtttcacagtgtaagactttttagcgttgcccacattcatatagatgctaatgaattagacattattatatatataaatttattagcatctatatgaatgtgaacaatgccagaaagctttacattgtgaaatggaggaagtagatgggagaaaacgaatcgagggtgcaatgataaaatggccttcatgattttcatcggtctttgtttaggcttggccttattggcttatgtgatttataagtcggtggatttaatgtcctaagtttagtggtggaattatacatctacctcaaaaaaggaaaaaaaacttctccaacataacttttggcttaatagtgttagagtggcttatggcttaaaaagaccaaacgaataaactgcttgtttgtttaggcttagacttttcgacttataagttagcttataagactaaacaaagagggtctaaggatatggtatccgcaaaagaaaccaataaccgtaaagcttgagagggccacgatgaccgaatcactaaaaaataatcagtcgcgtgcctcccctcgtggccacgtggcacgtgcggagaagagggctgcggtggccctcctgtgcggcgcatttctcgttttttttcttcgtttttttctttcaatttttcttttcggtttttctggttttttcccttgatttctttctgtttttaacatatatgtatataaattttgtattcgtacatatataaagtttgtatgtgtatgaatacaaatttttttgtatacgtggtgtttttcttggttttcggttttctaaatatgtatgtatttacgtagtatacaaacatggtatacgccatgttttttcttttttcttatttttttaatacgtatatatatatatataaactttgtatatgtcgtatataaacttttcatatatatatatatagtataaaagatatattttttatagtaatagtatagtagtagcaacagtgtaatagatagtagtagtggtagaggtagtactttaccactactacgagtgtgtttagttttttaaaaaaaagttggaagtttaaaaaaagctgagagtttgaaaaaaaaattagaagtttacgtagtatgtgtatagaaaattttttaacgtgatatgatgtgatgcaaagttgggaacaggtaataacttcacggcctactagtagtactgccgtactggtagtagtactactgatcgcgcgggggcattagcagtccccacgatgacaggtgggccctccaagtgccacgtcagcctaaaaccctgtcttcctcgccgcaaggccgcaagcatcgccaagacagaatccaagagaagaaaagttacaaaaccccattccgttattccagcattcgccgttgcgcttcagctcttctccctcccgccctctcaaatttcccccaaattctcatccaccaccacgccgagacgccgaccccgccgccgccttcttctgaagcgtctccccgcatccacctccgcttctctcctcgctgctgccgacgcgagcgcggcgcggggaggcgcaggcgcaggcccatggctctctccgccggggacgtgcagttcatctactccgtcctcgccaactcgctcagcgccgacgcggccacgcggcagccggcggaggccttgctcgcgcagtgcgaagcgcgccaggggttctgctcctgcctcctcgtgagccctcctccccttttcccctccgcttcgctactccaccccacgagccgcaggcccgctgatttcgggctaatttaggggcggttttggctttgcaggcgatcatcacgtcgagaggggaggaatccgacgacgatgtgcggctgctcgccgccgtacaccttaagaactgcgtcacccgctgctggcggaacagcgtcgattccccgtgagttctcatcctgtccaacatttaattctgtgttgatgtgtttaatttgaactaagtgcggttttagtagcgatcaatggtaacttgaaagtgcagcgacgtttcttacttggatgatctcatttgtggcgtttattcaataatgcaagcacagcaaatgcctaagttgctatatgcggaaggaagtctcagctgtaccatcacctgtacggcgtgtctagtggttttggatgatttttgtgctacataggattcttctatgtttgggcattacttgctattgctggttttggtccaacactttatgagctaaaaataagtgttcctgtttatgttttctttgttattttgtgcaataagattcacgatggtagcaaatcagcaaaacactttgtaacttggtacgatagatttttcttgtctccagtgaattgtacactagattagtttagtgggtcttatgtgtgagatttttatattagtagagtggcattaacttctgctggagccatcggcagaaatctcttgattaattcctggtgcttaaatgtccctggtggaaatctaatatcaactacgttgttatgtccaataggctgttactgactttggcctccattttttttgttctgaaacagcaagggctggattggcctacttctgtgtttttgtctatagacggcaccctgcatatttctcacttctggggcatacatatattgtctactttgattttctatgatacttttcatactgttataagccttgtgttctctctgcctttgataattaatgtttgatttctcgatgaatgagtttaaattgtattttgcagtgccatagataatgaagaaaaggtctacattcgaaaaagtcttctgctaaatatgcgagaagaaaatgggaaggtgcacatttgtaggcagtacatatttaacactgttgaataaacacagggagataataatggtagtattaactttgacaaatgatgtggtgtagattgcacttcaattggctgcactgatagccaggattgtatactttgattatccaaaggaatggtatgatatttttatcccatttcttatcaattgtcttatgttactccaactactggactcgtgactcgaaatgtttctcataattttggttattcaggtcagatgtcttctctgtgttggcacagcaacttcagacatctgatgtattcacttcatatcaagtgtctacagtcctattccgatctttgaagaaactatcaaaaaaacgtcttgctttcgatcagaggaactactctgaggtatgttcacttttcacaggacatcttcatgttcaaccgctcatcaccgctaagatatgaactactctttgatcacattgatcttctatttgatgcctactggttgtagttatcctgttgaaaaggcacacatgagcattaggttcttccctgtatatagctgacattactttgtgatgacgacatgcccaatacaggacactcacagattaatgttggcctcggccagtttgtttgataaacacatgacctttcacacttaattttaaggcttatatattttttttaaacaaattgcagatacatctgctctatttgagcctttgtctcattataagcacacagagtactttaattagcaattatgtatctcattctgcctttgtgaaaactattatgttatgcagatcactgtctacttgtttgattatatctggaacctctggaagagcaatgcacagattgtattacaaaatttttcagtgctttctcagcataattccagtttggaccaatcaaatgatctactgttaatatatgaaagatggttagtctgtttgaagatcattcgcgaattgatttgctcaggttatgcaagtgattcaacaaccatgcaggtactaataaaatatttatgttcacatatgcgcttttatcttgagctcacaacctgaggctagaagtctaacctaaatgtttc

SEQ ID NO: 76835 - DNA, 8793 bp, Oryza sativa
attccattgccaatctcttttctgaacattcgtgcatagtagtagttccggaacagtaggtggagtgaagtgatcactcagtgtaataaaatgaaaaggagaaacttaggaatcatcataattgaagaacggatgcacctcgtggcctttatacctctcttgagcatcaatgtactagaatggtgtaatacacaaaaattctttacatgtaaccctccctttttctttccccccttacatctcacatcacaccctttttttgctttctcctatccatgcatcctttatcagcaggacaagaaatgagctatagtcaacacagcccgcccacagatcctccttcaccatcctaaaccctccatttcttttttaacaaaagaatcacatgttaaacacagcacaagacagctttacgcaaccccagagaaagaaagaaaaatggtgaaaaaaagagaagaaaaaaaagtaacccaaagtaagaaaaagtgaggtggccgcggccgggcggcgggcatcgatggtgtgtcaacggtgttcttggctccttttcttgtctcgcagaacacttggaagctagccttatttggctctttttctactggtcggatgaccatggggcggaggcgatgcgggcgtagaggaactggttccaggtgtcggggaggcccgggaggcaccagtggatgcagtcggcgtacgtcttggggtcggactgctgctcgggggtgagcagcttcccctgccggagcgtgtgcaccgacgtgtgcgcatccttgcggagctccgacagcgccgtgatgtcgacgaggtgcaccggcacccggcggaacgtctggagcacctcctgcgccccggcgtacagcctccagtccgtgcccacgtccagcgacgtcgtccggttcgtgatcggcagcgtctccatcgcgcacttgatccctccgtagtttccccacgcctccggcctgccacaaaacgcgcacacgacacaagattataccaccatccgtccgtcaccacgtgatgccgtgatgggtagaattctgatgcagtactatggttaatgttccagcgaattggagccgtggtaccctagattctgtcgtgctgatgataccctgatgatgatggcactcgcatattggcgccattatcacagcatatgcacggaccgtgtaatttatgcggatactagctcgagattcttgcagggaccaaaactgatttaacttttgcttgtcgactactgcaagaatctctctgttttgagtattttgcaacagcaaagatgcaatggcaaaggctgatcatcattgtggagcacgattagtaggcttgattgctatcagtattatactactgtcttttgttgctaccttcaacttgatgtcgtttctctttcgtggggttagggctcgaggaaggaaagtgacatggagctcggggaattggattcgtatgcttcatctttggtagcgactagggtgggccatgtcgagatgcatgcctacaggtgggcctgggattttctatggtccaccaacatcagcttgtcaccgtagctcgcctctctccagctatccacatgactagttttgagcttactactctacacaaatacatactcaatttgaattattcttggttcaacaaacctcagttgtttctacacccacgtcaactagcatgttttgaagacatctcactaattaattaagctttttatagtattggctaaagaagcttagataccagtgttgaaaccgtgaaaaatgcaaatcttgaaccagtcagaacagattgtccggaccatgtcctgacgaagtacagtgacgcgttgtacgcaggtaccgtgccccacgatgccatttcacgagagacagctaccgatgagtagtacagtgctctatgatgggataccatgtgcagttgtattccgataccatgctactagtagctagttaatgtataagaggcttctcctactaatgtttctccgaaagctcaagagtcccctcaggctctcaccacctaattaaattacttgtagataaatattagtccagaaagcaagtgtgcctgctagataagtttcgtccatgcaaacgcaacacagttgctaggtacacctctagcacataattttgttttctgaacataccccaacacctaatcggaatggagttctctatgtaccatcactgtgcagcatatcttcctattgattggtagattaactccgagcgaactgtactgcgcgtgggcacgtgtgcactgtgcagcgaagtaaatcatggagaggggcaatgcaatgcagatgcaggcaaaggcataaatggcggcttacgtgatgtggttgggagacatgctcatgaagaagacggtcgtccggttggggtcaatgttgcggtcgacccacttcgcccacgtcttgagcacctccttgtacgccacgggccggtccacctccacgtactccgtcgcaccctggtcgaacgaccccttcctgtcacgtacaaccacacacatattttttcgcccagatcagcacacccacttctatatcactatatgtatgtgtgtacgctgctggggtgctaggagtacaacttacaggactttcatgtcgagggtgttgagccaccagatgtaggtgttgaagatgaggtagtcgacgccgagccagttgtgcgcgtgcttggcgatggagtgccactggatgacgcggtcggggacgctgtgcacctgcgggttgtccgagttcgactccaccaggaacggcgcccagtagaactccaccgtcgcgttgtactcctgcacgtagcacatacaccgtatcgtcagggggagatcatgtcggatcgacagcggagtacgtacgtgacgttgctgatgcctgctacgtacgtgtgcgtagaagatgttgctgttgccgccgttgacgaacttggtgagcgtcttcttgcccttggggatcacggactggaccaggcacaccatcgactcccactggttgcggttcagcgaatcccccacgaacatcagccgcttgttgcgcagccgctccagcagcagcctcgcgtcgaacctgcagtttttttttccccacaccacatcagctttcgttagacttttcctgcgttatttagcaaccagcgttgttggatcgccaactatatttgccactatcatcagactgtgccgagacacagatacagagcaagttgtagtagtatattctactcgcgtcactcacccactgtgtgactgactgggcgtcgctgcgtgcagctgttccccggttggaaaagagaataatttggcgtgcctgtgtttgatttaagtagtggctgcttcaacagcagccagatgctgagtgattagattaagcaaagcttaatccaacagggggtagcgcggctgcacagtacagtccgacgtcacagctcactaccagagtggtgtactggtgtggcatggtggtactactactctctgttccgtttcaaaaatctcgaacgttctattttaatttccctgacacgttcgtcttaattgtggcccgtaagtattcctacggttatttctgacttagcgtttcgaggtgaccgaccgatgctgatgaaaaaagaaaaagaaaagggtagaaaccggcatcaatttgggaaaccgacgatgatcgccggcgtgagtcaatgccggttacccggaatgcgtgaaacggcacgaaatgggcaagaaatggcgtgaaaaaattgtgggggaagaaatggcgtaccggggcaggtcgcagtcggtcggctgccagcgccacttctggtaggagtcgtcgcggcggccgttgcgcatgcaggtgacctgctccgtcaggaactcgcactgcgactccttgtacaccggcgcgttcacctcgtcgtacacccagttgccgcggtacaggtcgcaggtgtccggcacgctcaccacggtccgcagcgccgccgtcgccgcggcggccttcgccgaggactccttctcggcggcctcctcgtcctcccgccgcctcgcctcgtcggcgccgccttccttgacactcgggagcgtcacgtcccgctccctctcctgcccctcgtccaccttgacaccggcgtcggcggcgttggcgttggcgttggcattggccttggccacctcaatcgtgctgttgttgctgctgctgccggcggcggccgccatcgccgtggaggcgggcgcgtcgaggacacggacgatgacctcctcgccgcgcttggcgatgctgccggcggcgaggtgcgcggcgcccacggtctcctggaggacgtggaggtcgggggacttggcgcggagcgcgccggcgccgaaggggaagtcggcgatggacttgatgtcctcgttgtagaggaacgtcgcgaacacgaagagcgcgaacaccaccgccgccagcgacagcggcgcgccgttcctgcgcgccgccacgccggcccccagcgccgcctgcttcatcgcgaacggcgccgaggcgaacaccgacttccgccgctgctgcatctccggagcgcccaggaaggcctcccgctccgccgctttaaagaaaacttaccaccaccaccaccaccaagccccggcctttcccggtggcttgcaaacccgagaagtaaaaaaagcttcttgctttgcttcccctctcttcctcttcctcctcctcctcctctctatatgagtatatggaatggattaatggagcttcttgctgagctctttgcctctttgcttagctctgtgtaggctaggaggctaggagctccttggcctggctgtccttctcgactggacacctcgctctcctatatatgtgtcgatccctttacaagtttggtgacttttgctggatgtttgcccttttctttgcttccctttggtatgtttggtttggttcgcctgctttcttcttttatggttgcaagatctcttcccctccaccaacacttgtaaactcccccctgttctagctgcttaattgaatctcattccctttcattttgtatatagagagatagagggtagtactactactgaggggtgggtcaaatgagtaacatgcaaggctgcaaagcttccatggggggtttggaggttaagctgttgtacacatgtaacaacacaggcaatgtgcgtgtgtgtattctactactagtattctatttgttcgttgcatgttttaattatatgcctactatatcatacatttcgttttcattatcgggatacaggggtggagtatatggtattatggtgtatactcgtatggttgtaagtactcgttttttgtttatgcgatgtgagtgggtaggccgtggctgtctcggaagagtgcgagatggggaagcaaacaacggcgggggcggctacgtcaattgcccccctttcgcattctcggagatgatcattctgtatttggatgtaatcagcacgcagatactactacagtcatcgtctttgcgttgtgaacacactaatgatggaacgaatcgacgaatcagacaacgatacggtgcctgaatcgttccgattttcagatagtgttgcagcaggaggaaactgcagaatgtcgaattgttccgatcgacagtgttcggggggattggtctacgaaaatcattgttcaggaagtgatgttagtcatggtcagaggttgatttaataggaccaatgtttcgagcagaaaatggatattacagggggaaaatgaaagcaccgtgtacagcataggtgactgaaatttcaggtcacagaatagccttgcaaaaaaatcagagaatcggtgcatctttcagagtcggttgtcctgtttctgtagagtataacacgtttcagtttttacacagtgcttttctgcgggtgttcaatatgtttccaatcttgtcacgccaactcgtcttagctagtacgcatacgaattgatatcactgtctgttatcattttctttcaacttccagatctcaaatgatgtgcctatgtagggtcgaatattttcttttttcaaaagaatatcattgtcagatactattatttttcattgatcacttgctgtaaaaatgattcttctgttaagttgagaacattaacaatgtgtggagagtggagacatggatccgagaaatcggaagaaactgaaacatcttggacccagctcttgtttagtttgctgtaactcgtgaagtcgtgatcaggaactttccactctattattttgttgttcatcgggagaaatgctctcatccatcttccatgggtaacatcttgttacattgaggtctacagtttttattttcgagaacaactacaggtttaacagataattttctgagagacagagaaattcaattccctgttaaaaaaaaagagagagaacagcaatgtatgtataacacagtccattttccttcttcaggttattccatagctggaagcaatcagttgaatgttcagatgtccagttcttcttgagctcgctcacaagcaccgatcagtctggtggtatctttgctgtttggttacacctatgggaaccaatcctcttactagcatacagttactactatttttctggaatttttttgattttttttcatacctatttagttgacatgcaacaaataggtggatgtccacctaggcgattaaaagtgtttcccaacatgctattatagagaaaacggttgcacacaccatttccccctctgattgcaaccaccggtacaaattactccaaacttatgtcttgttcgaatactccaaacctgttgcctcgctttgttgagtgctatacggtatacttactgattctgagggaagtacagctgaaccactatcctgatccaatcttcagtccaaataggcatatgctacgtagtttaataacatcaatgttttatactccatcatggagatcccggtctgacactctgacctccatctcgtgttaagataataaagaaaacttcaataacctaaagtcacattgagctagctatgatgggttctcaacactgctggtcgatgagtgtagcgcagccggcatcgctgaagtcaactactctagctagtatgatttggttataattgagtccaggaacactggagcaggcacttgggccagctcaataaattttttccacatgaacatgacatagatgattgaatcgcatgcaacctgaacaccatgcttcttttttacctgaatctcgcccatcatccagacggacagttcagaataagcttgcatttcagccaacgtgggaaatagaggatccaagaccacgggagagatgaaaagttcctctctgcaactgctggaggaaatttcgtttttctgtagtgtttcttttgtcagaatgatgtttctctctacagtagtaggaatgtcaatatgtcattcacattttaggtgcaaatcattgatgcttttaaatcatgtcatcccagcgaacctaattctgataacagggcagtccaagtcaagtcgatgaacaatgcccaaaagtgaattgggtggttctctttttgaatcgtaggctagaaactatggcgatttttgtctattactcctaataatgtgcccctctttgtttaaccacacgagtggagcaagtactggcctatcagatatctatgcttcaacagaaccgtactatgtgatgaccaatcattcctgtgtagttactactagctcgcacttgcattagttggagtgcctatacttgtaaacatgtttggtcttctgaagaacgccactacaatacaattcatgtagggttgttttagcttttcttcctactttcggagcatatacaaatgtaagatcataacaaccatgaaagagagattaactactttatgttactaacggatccatgattccatatatgttgtgaaaatgttgcagagctagaggttgcttttgatcaaactgaaaacttcacccgacccactgtgaaatgtaaagcaccttgctgataactttgctagctaattcttttctttagcgaaagaaaagacctaaccgataatcttatcgctcaagaatatcgaatgcacactatatattcaactcagctggggtcaacaagaaggaacacttattcatggcgtttggtgtatacctcacggatggtactccggcagtttcgacatgcacccaacggtgtactagtttcggtggacagtggacacgatcatctgatcatctttcactgttgctctcaagattcagtattcaattagtactgtaccatctcgatctcctttctgctagctagtagttctactacaatactgattactgaatgatcacacataaatgaagtgacttcacttcatatagtactcagcgtaaatgaaactgttctctagcctgtgactagctgctataaattggtgcttgcaacaggtgatatgatgctgatgaatgtcactgcgtgtatgtgatgcacacatgcatgtacgatgcatcatatttcgcgggaaaaaaagaaataaaagcaagagaagaaaaaaaaatgcaggatcaaacatgcgtagtgtacggtgcagccgcaccaaccaatcttctcaggcagctaaagcggccccatcgatcagggtggtcagtcacaatgtctaaatgtcacatgtcagtggtagctagtttttgtctggtcaataaggcgatatacacatcgacggatgggagatgtaaagttgcaaatttgtaagggggcatatagcttaggctttgaacaaagtgggatggaagc

SEQ ID NO: 76836 - DNA, 31061 bp, Oryza sativa
cgccgcgccgaaatccgcgagcttcgcaccgcggccgtcgccgtcgcagccgacgagcacgttcctccccttgacgtccccgtgcaccacgccagccacgtcgtgcaggtaccgcagcgcggccgccacccgccgcacgacgccacgagccccgcgctcaccaagccctcccatggccgccgccgccgcggcgctcccgccggggaccagctccatgtgcaaattcctcgtcgtcgccgcgtccccgtcgtccccgagatactccacgacgtagggcgagctgagccgcctcaagatccttatctcgctctcgaggcacgccatcgccgccgccggcgcgccgcccttggcctccaccgacttcaccgcgaaggcccgcccggtggccctgtccaccgccacgtgcaccgcgccgaacgcccccctgccgacgcatttcccgcgcacccactccatggagaggcgcgccgcgcgagctcgatcctcctcgcgccacagagcagagcacgacgagaagccgaggagtgagtatgagaggccgaaacagagagagagggagaggggtgggtgtggaggagccgccaaaaaaggagaggagcagaaggtgtgagggatgcaagaaacgggggagtgtgctcgccgcgtatatataggtgtggggatcagttttatttttgtgggtaaggatttcgcgcggtttttccctctctcttttttccctcgctgggatttgaggattttcctcgcgattcgcgtgttgagggggcgatgggatagtgaattcgacggaatattatacgggatatatcatgagaataaattggggggtttgcgttggagagggggagtggggagggagagcttagccgtgcaacttgtgctgtgttatcttcggggtgccgctacgttgcggccacatgggcaaaaagatttgggtgagttgatggtttggatatatggttggatggcatttacttgcaaggtttggtttccattcacctttcactccgattcgctgaaattcgattatgtgttgtgagatttgttggtctgttatccagagtgtttagctcaatctattttgtcaagacagagggtggatatagaccctacttatgttgtttcaacattggcttgaagttgatttattttcatctccccagtaatccagtattttttaatgtagtttttgaaaatgagctaagccggcattcaaaaaaaaaaaaggcattaaaaaaagagctaagccaagccaaggtgaaataatctttcaatggaaattgactcattagcatgttattaatactccacggtccatacaaaaccgattatcaacttctttaagaaaacgagatttggagggaaaaacgtttctccaaatattttttaaaaaagaaattataagcgtgttggggattaaacatgggaccttgggattaaaacaatacaccccttaccaccgcacttgatagtgtatctcgagtatgcaaatttcgattgtttattggtctctcttttcttaggcttttgaaacaaactagcaaactttccaacgaaaagtgacctattatttaaacgttgaagtagatttcagttataattttaatatcgggttttcatgggtagaattgtatcttttttatatagaaaaacacagtagaaatacagacgctcacaacattcgcatactcacgccatatccctatgaatacattattcaaaagactaggacaacgtttcgtctcgctatcaatgggtgtgtcacctatcactaaaaaagataattagtcgtaaatgcgagaactcgtgccaagtctagaatttgaacctctgtgtgggtagtttctactacaagaaatctaaccggttagttacgctcactttgctaaaaactgtattttgtaccgcacaacacttaaaaagaggacaattaaatttgatatattactcttagcttgttctaattttccatatcaattgtattttgattataactacctatcaatctacattgttataatctagatctaccataacataagggtgcatccttttttcaccttttctttaattgatatgggaatttatatacgagttttaggagcgaacatttctttttaggtcgcattctttttagaggatgaatctaggttattagttgcacgcaaaacaagaaacatactacatgaatagttgagtattaattattaaaaaaattaaaaaagaaattatttgatttttaatacccttcctatgtaaaaaattttcgcacgaaacatacactatttagcctttttaaaagcatgctaatgaaaaacgaggggtagctaagctcaaatagcagtttagaacatacccttaaactatcaatcttttatatctatactaattctaattattcactccgaggaagcatcgatttgtaacagaccagttgctggttactaacatcaaccatgtatgtaagtagtaaccaaaacgccaccttaaatgaggatcatcatttttaaacgttgatatcacaatgcaagtagcagaaagaagccaaatctcgtgaaattttgttatgtcctcaagcaccggtatctctataaacatccaaaagacatatatttcggatttaggcgtccacgggtaactgcacaagcatcaaccaaaatatttcgttgtctgagatgcctccagctcaccaaaaggcagagtaaaccacactaccaaaaccctcgcaatagtagtgcacatctggagctcgatccctgctgctgatgtggcagcggagagctcaccgatggcacacgcacgcgacggtgacatggctggacactagtggcccaggggattcggctcgcggcacatagccaaccaataagaatcctactccaaaacacacacacaaaaaaaaaagagtgagactagtagtagattgggagaacgaaagttgtggcctgagacaacgaggcgtgtgcgatcggaggtggctcgtgggatccgtgggatcgcgtcgcctcgcgggcatttatcgcgcgctcccgctgctgcggcggcggacgtgcgcggcgccgagccacacaacccggaccggcaaagcgctctctcccgctggccgcaaaggccacgggaacctggccgttctaccagtactactactagtagcgcgtacttctcgccggaaatgtgtggatcaccggccgcgtcgtggcctctttccgcatttcggccgtatactaaagtttcgcgtctgcgtaggaggttgttgcgtttgacggcggagggtgtcgcgccacagaaaaagcccgaccggggttgtgcgtgcatgtaacctctgttttctcccacaaggggatcgttgacgtgcgtaagttgagaccggccgcgcctccaaatctagaatcataagtgggtacatgattgagagatcgcttctttataattgcggtttagatttgcatacattttggccatcatttgcaggtataatgccacaaaagccaacgagtaacgtggagcgatggtttccaatgattggaaggggaacattctgtgtgtgccaaaccgagggacaatccatgcgcccccacaggatatcgaaagattgtaaggcaacaatgcgagcttataaattcatttgtgccaatctcaacgttggggagtacacattggcacgataccgaggcaatgtgtggattatgaggttgttcgtgtatatctccttatctacgggtctggaagattcgggctgcgcgagataacagtttttgctagttattgccggcgtatatatccacggatggacccaaaaatattgggggctaagatgcctagggaagaaggaattcattcgcgcctgatcttgacttttctcggtatgttgcaggcttagtttttcccttagcgcaagttgcaggcttagttgatgcgatcaactccgcatgcatgcgcccatgctcacccctatgcctaggataagatcttctttgattctggttccatggtgagaaatatccaccaaaagtggcaccagatcggaccatcagattatccagctagcataattcagtccccgctgtaaaatgcgcagagaatatcactgtgacactgtcccgtatttcgctccttctcgatcgcctttgctgtacgcatacgctacctgctcaagctagataccgttccatcccaaattgggggtgcttctgctccctgataacttcataaccaactcatccatctagcattctagctagaaactgggaaagctgcctgccccacaacttgcagctctcagcatctcactatacgtctataccacctttcctggtcaaaaaccttttctgcgtcgctttcgggagggagctgcctccgttccaggacaaacccaaaccggagccggtaaactggaccttaattgattggctaaacccagggcaacaacagctgttttcccccattaaacaatccgagtgttcaccccagccagattctcagcactactcccctggtccgatccgaagatacggtgtacactgggataccggaagaaaaggggaaactatcacgacgggagaaagcagtcaggtcaaaaccctccccccacaaagtcggcacgactccagcagcatcagccgactggccaaaaagcacggggtttttttcgcgtgcgtgcgtacgtgatccccccgcgaccgggggagcagagccgcggaggttgacgtgcggtgccggtgcggggtggggagctcgtttcgcggcgtcggcgtgtgaggcagcagaggccgcgacgacgtgagctttgccctggattgccgcgggctatcgcgtgggatggcgcgacacgggagggcacgggaacgtgggtcgtggggtgggggggccggggagaccgcgcgcgggggccaggggccaagggtgtgcccgccgcgagggcgaggacgagagaaaccgccgcgcgcgggatgcgtgcgtgactgccgttttttcggttcaccgaccggtcgttttcgtgccagtttttgacgcgggtgggactgggagcgaggccaggggtcctgatgctgatgccgatacgtcatgtgtggcccggaacggctcggcgtgtgtggactgcggcgagtcgtgccgtcacgcaggcctcaaactcctcttcgtcttcttttttttctttctttttttggtcgagccaatatgtttagggaaatattgttcatttgttcgccgttaccttggcgtttacgagattagcaacgtatagggtagtattatatagcccagcaaaaagtatgcccacgttgccgtcacgtgcccatctccgcggtgaaagcaagatctctcgtgcgctgtttgtgattttggccctgtgttggagccatgttctgaaagcgatgcgtacactgtcactgtcaaatccgcgcaaaaaaaaaaaaaacattagcttgtcgactcctcacctgactcttcgagtgctgaaaaaattgtattactctagtacgtgctgctagttgattattgccgctactctccagtaaggtccacatgtctgtcaatacgatcaagggggccgtggcactgttacagacttacagtgccactgcagtaccaccctccttactgtcgcatggtgcattgtgatccaatatgacaaggatttcgccaatgaggcaatgagcaagcatgaacaacgagaaacggtcctacaggcatgctcaattcaattcaagggtgtgctcgtgtgtaggcatgccagtcccacaggtacatctggcaggttccacaggggtaaagagggaccgtcctgtaccggcaaacaaaccagctgagcagcagcccctcctctcctataccggcaaaaccgccttttctattacgcaaagccaaccgttagcgcggatcgtgccggcgcgcgcggcaacggcgcggcacacgtccatcgaatctaaccgcggcggcgcgcgcaagttgcccgttcgcggccaccggcccgtgagccagcgagacgtacgccggccgatcgatcgatccatctcgagacacggtctcgctccaacgtacgcacggtctcgggcccgacacgggacagggcaacttggtggcgaaccgaagctgttgcgcgcggctgagtgagtgcgaggtgaggtgcacggcaccggccagccgcaaagccagcctgacgctcgctgctgtcctccagaggcttgcgagagccggagaccgtttctttcctttttctttcttttttcttttttcggtagtagcctgtgacatctgcgtggtcgatcgctttgcctgataactcacggggtcacgtcgcggtgttgccgcaattaggttaggctagtggcggcgctgcttgcatgagctgggcggctgggtcccggcctcccgggcatatcctgagtatttagcctacttggtactacgatttttatggctcgaccgtgcaatggatcaggaattaggatcgctcggtatggcatccgacgtaccaggacatgctattgctagaggaatgaattccttccctttgggttattaaaagcagtaagtcggcacatttattttataatcgtcactgtcactgtaactgtcgccgtcacacgcaaagatatttatgtaccatgagatttgagatggttatcttgtttttcttttgtactaatttttttcggggaggttatcatgttagtgatgatgcagagattatatcatgcaggttatagatatcaattcgataattttgtatagtacagttccgcagttccattttcccaattggatcatcgtgatgcagagcttcgagacctttgtttttgtaggattcaactgctcatccaagttgacgaactgaattctgaagaaaaggggaaaagttgatgaagaacgggtcgctgtcgttctccaacgcacttgccgaaatgccaaacggaaaaactaacatgagctgagtgcatatataggattttatggggcagctgcaaatggggaagtgaaactggttttcagttaagatgaacagtggataattaaagcagcgaattcaaacactggcactgtttactatttattgttaagaactccggtcagaaactatattgagcacaacgagaacgtacgattattatacttgaaataatttgccaatcttttcacttatacttatgtttgttagtcaaaatttgaattttcaaccttaaatttgaaggtgattttaggtttttctcatcgaagtttattttcagcctttgtttttagatcaccaagaacatgtatatataaatcttattcacaaattacttttcatttgtaatgtaaatatgacgtttggcttattccacgaataagtgaaacgatgaggctgaacatcaggtcttctctacaaaacaaataaggaaaaagtccgaattacctctgaactattggtgagttacccctcccccgacttaatccgaagtggtttggtcttacgtgacgcgtacgtggcattccaatcagaaaaaaaaacaatgggggccacatgtcatatcttccccatcctcaattgctctcttcactcgagtccgaatggcagaggcggtggcgacgagaaggctgctgctgtggaagcaataaaaggagagatggaggaggggagcataatagagctaggccggtggccatggctatcttcttctgttgtggcggtggcggtgctttcagtagggtgcggcgggtctcggttgtggtgacggtgacgatagcgacaagctcatgaggcggctgtggaggaggagcagcctccaccgctcgccgcccctgccacttgagctcctccgcctcgtcgtacgaaccgattgatggggaggaataagagagaaaggagggggggttgagagggagagaatctgccttgcgttgccatcctcggcatccagctgtgcctactacccccataatagatcaggcattggcgttggcgtgtcgccatcctcggcttcctatccaccgcccctgagctgcctccgtccccgcccccgcccgtcgccatccttgacttctcctccgccactcggtgatagagagagatgtgaggggagggaggagagagagaggattggggaaagagataagagactgataagtggggtccgccgattttttcaaaaaaaaaaggatgattgtactgccacgtatgcgtcatgtaggtccaaaaccactccggattgagtgtgtgtgtgttgggggagggggggtcgttaggtattaatagttgagggtgaaagatatctggttttcggctccgcctccggggataattcatactcattcaatagtttagggagttatttctgactttttccatcaaataatgtgtgacttaaccttttcctttttaaagactaccaaatttggtcaggatatctgtttaatacgaaagtcaatgtctcaatgcaaccaaattgtgcctcagacttgggcagttgggctgaacacatcaggatatgcaccaggaatatcttcatcagcatgtgaactaattctatggtgtagtttatttctagtttatttcctgaagaacctaaaaacctgtcagtacagatagtgacaatgtcgcttttgttgtatggcccatgaactttagcgcctccgtcgtagtgacaatgtaatttaatatttttaccgtgtaaagtgtggaagcgacaagtacgcaatcaactttgtaagcttctttctttacttaaaaagcgatgaggcaactatgaaaaatgaagtgctcgaaacagcagccaatgcacatctgatcaccctgcacaaactctgaaaatgtagtccctatccgattcctgctgggaagataaatatgcaaaaaggtcattgaaattttctccaagtcgtgggtgattttacgcagagattcagagaaccataattctgtaccccggagggtgaatcactcacatgctggtggatgcacctcataacggttaaaagactttgcttgtgtgcatcaaattgtttgctcgagatgtggagtgtggtgtatcactctccccaactggcaaaaacgatcgatgcatgcattatcatttgcagcagagagcatgtgaccaggtgaattgttttcagtattggctgttgagcaagtggttggaaccggcaggggctaaaagaaagaatatacttactctccgataaagcattgaacgcatgaggcgagtcgatccttcgcaccggtatagacaacgactcatctgtcgatccagaccgtcgattctttggcccgatagcctccccacgatgtgtggtcgctgatggaccacgacgtatgtatgtacaatctagaaatcggcagggtcctacactcctattggccagccaatgagccaattcgacgctgtactgcagagatatgtggccgccgaaaaagatcttttatttggcttcgacgcagccccacatcccatgctgcaatgcaaccacatctgcgcgtctcactcacctgtacaaaacgccaggggcgcatgcagaattgcagacgagaacggcagcatcaggcgcggctaatgttgggcgggagatgtcgctgctggatgaagtggtgcgcgcgttggcgccttctgggtgggacggtccagcccataggccattggactccacgacgatctcgcgcaaaagtttgcaaatcctacggggaaatcttacgaaatctcgacgtttcaaacggggccggagaggcggagattgaggaaggcgtagcggtcgtgcgagcgtaattgcctggccagagaaagaacgtggcgcatggcgtcgcgggaggcggaaaacgaattgcacggagcgacagcaaccggcgcagaaagcgtgcaagcaccttggacgatcggtagttgcagaagcatgtgacattacatgagctctttttttttctttttcgcgagaggggtttttgtccccgtttttttgtgtggccagcagaagaggtagtagaagttagaaccggatccctcgagggttctttttcaccggaggatgcgagtgaaagaggatctatcacggcgtcgtcacagctcggaattggatgcgctatcctggcgcaagtagccatcacgatttcacgatgatgaggagggcgcggttgagctcaggtggtgcgcaagccagccggcgatgcttagccttgtgctcttgttgcgtcagagacagcatcttgtcccggatttggttgtcagtcagggaccccccttgtcccagctaacaagtgagatcttcagcaaaaggatccagcaatttatgtgttagtgtcagtactttccatcgcaagctgggggacatgtttgttaatcacctgtagcagctgtcctttggtttcaagttgtacttgaaattcgagggcagttgtctgtggtacatatcccagaagtttcactcatcaggctgaaagcctgaattcagaaacaatggatacaaaagcccaagtttgctactaatgggctaagcattcatcttcttactggtcgagggccgagcaataaacaagaccatcagccttccagtttcacacatgaacagttgagcattctgcatctaaaagaacagttgatcacagaagcaaaacaggccggtctacgctattgcaatttactactccatacatacattgcggtcatcagcacacttgtatcaaaatccaatagggcgtttcaccattattgattgcttagaatacatcagttcattgctccggccagtactcaactcttggctatgaacaatctaatgtctaggtaattgaacagatacttttccgatcaacgattttgagtttttgacgccttgtccctctaccaccgatccaaagtgatgaactgaacaaatttgagttcatcacttaagtacggggattacatatgagccggctgcagatatgatctctcatagaggcccatcacctgatcagccaccgcccacattatagcctgaccaggtggaatcctcataagcctcggaagcaaacctttccaaagggctctgagaccctcttcagtgtatattgtgcgtatcgcgtggaccatacccttgtacttgatgtcaccagttctcccctgggccatcagtctagtcttcacgacatcgaagggtccagtgcagatcggacctgcagttcctgcaagaaaacctgaaatcattgactgccatggctggagaaccttcccatctccttcatgcttcttccagagaacaatatcaaatgtattcttggcagtgaacattgcggcttggtttgtgccattacgcatgacggttggtaatgctccagcccacaggccaaaaagaccctcctcagtaacaatcgtcctagcacaatgtattggccccttatatctcagcaggtcagggcttagacctttttgttgctgcaacctgattttaaccacctatacccaccacaaagaaacatgacaccggtcattccagagaactgaacctttaaagaaatgctggtaaaaaagtataaactgacttccaccataaacattataataaaatgcatcaatgacgaacttgggacaaattgaaaacacactattcgctatgattaacttatttaacttcatagaacatggagttgcataaaaacaaagtgcttagaatgactcaagttttcagatcgcaccaatctaatatagggagaaattccttctattaggttttcaacagtatgaaaatatagaatttccaaaaccagagaagaataaccatctggtgttcacgctaacttttggtttgttcgttgtacttcaatttaatttctatctttgttagcttctaaaatatgtagttgaccatcccaagaaaacaatcagatgaatatcatggtacaccaaccgtttctgttaagagagccaaggagaacaaagatagactgacggccagtacacttaaaattcatatcgtactgatattgcctccacatcagaacatgtcatttccttttcttaagatcttcttgtcttttgctttgtaggtactaatactatatgttgatttccaataaacatgagttacacgatagcgatgagtgcttagatgataaaaatgaaagacgagtcattttctatagagatgaacagaagtgtaaatttaacaagattatgcttttaaaaaagaagcatacttcgaagtgcacgcaggcctttcgcatgtttggtctttttaaagcagtgggcgatttgtggtaacttcttggtcaaatactatgtttcaaagcatgaggtctttgacagagttctgatgggctaccacatccttggtaattggtttgggcatgataattatgatttgactgcaaagtgcaaagccaccatttctttaatcccagctcaaagttggcaataacacatctaaacatcattcacagacaagattaaataactggtccacccatgttcctccgttccttttctatatctaaagtagtgaatttgtacttttacatcggtgtcctatatggcagctctcgcgagttcttattccggcaagaagcacctagagatgttcctttgtaaatataatttattcgcgctggagcagtgaacacatttttattcaaattctataaactatgtcgcagtcgcagagaaaccaagaattcaagaacgattcaagatctcgcagatactccaggtaagtaaaaaaggaacagatgcaggggtgatcttgcctcgaagggggtgacgatgaggagggcctcgaggacgccggcgccgaacccggaggcgaggcggccgtgcgcggagaccttgcccgtgccggggtccttgaacgcggactgcagcacggcgttggagccgaggcggagcgcgtacttgagcgtgaggtgggtggcgaagggcgtgagccccttccagagcgcgcgcacgccctcggagcgcacgacggtggtgccgcagtgcgcgatgccccggtacgcccccgagcggtctagctgcagccgcgtcttgatgacgtcgatcggctgcaggcagcacgcctccatcacgccgccgaccgaccccgccgccgccttcacgtagggggggaccggtgccctcccgccccgccgatcctccgccggcgaagcggcctgcggtgccggcgacatcggcggcggcggcggggaagaggagggggacgcggcggcggcggccatttcggaagaagcggcggcggccttagcgggtgtggcgcacgaagcgggttttggatttgtttccgtgggttgctttccccgctgctgaatccgagaaaagtgtggtgcacgggcgctgcttatgtaggaatcgatccgagggcgcacgcttctcgcgcggccgtcgcgtcgcggctcggtccagaagaccagggcccacatggggccaacctggtccagcaggccgggtcccacacggcagtgagtgtaacttattactactggggtacacgggcacgttacgtggcggagagagattcccgggaaggtgggggccgcttagccgatctgctggtcccacttgcaagtggttgtactaccagacggcggccagttttcaggagcggcgcgctacctacccaccacaagcgtcccctcccacttctcattccttttgttcgcgaaagaaatactcccaccgctcccattccaagtgtagacatggttttcttcatccaattttaattgttcgtaatatttgaaaatatttttaaaaaattaaaaacataaaacacgaataaaatactatttatgttttatcatctcataacaacaaaaatactaattataaaaaaaattgcgaataagacggaaaatcaatgttgagcgcggaaacttatggttgcacttaaaatgggacggagggagtaagtctaggccgaatctgattcattataggatatatcgatcacatgactatttaaatccgatataatttgactccctcaaaagttttaaggacggttgtactgacgtgacgtctatattgtggtattgacctgatcttcgtccaacgtggccgttaatgtgatatttttatagcattagaattataaaatatatatgggtcccatttatcattcacacaaaaaaaatattatgggacgcactgacatatagagtccataatcatactctccttcccttcttcctcctctctctccttcccatagaggcatagagctgaagctgtgcaacggcggcaaagggtggaatggtgacggcgagcagcaaaggctcttcttgtcactcccacagagcagagcggtggattcaagccgtgttgctatgagaagagctgtagaccgtggctggtggtggtggccacgggcgagagcttggcgacgctgcctctccacctcccttctccacccccgatgatagcctcgaatggaggcgatgcttcaacaggcagcagcggaggtataggagtagctcgatgagctcggcggcggccgacgagcaagagcttgacggcgttgcgactggccctcgcccaaccaccactggcactctcgtctccgatctccttggtcacagccaccgtcaccaaccacaggacatgccaccatcgctccaaccctcacccgccaccaccgctactccgcccctttccactgttgctgctgctctagctctccccacagatgcgcgaagagggagagaaagagaaagagggaagtgagggagagaaagagaaagaggaagtgagagggaggaggaagaaggaaaggtgatgatgatcgtggacccaacatgtcagtggatcccataatattatatatatatatatatatatatatatatatatattaattctaatgttataaacgtcacgttggacgaaaactaggtcaacaccgttacgtaggcggcacgttagcgaaactatcctctaaaaccacagagggagtcaaatcataccggttctaatggttggggatcgagatatatgttatcgttcttcagggatacgaatcatattcgcccactagttaagggagacaaagtggacttattcctcgcgaaaatgcccttgggctgaattgtgaagttggattccatttcggtccattttttatgttgcgaaataaatatgttttttacactcaaaagacttaaaaaaaatccactgtttgaaataagccctcaaattcttactccccggtaccaaaatataacaatctataacattcaaattttatcttaaaaataacaatttattcatctatattccttcttcttagccaaatacaaccttccactttttaatttcttcacctacccctctactcaaccaatgacaatatttttatatttagtttcacatgctcatttctttccaaaatataataatttctatgattcaaatcatgttacttttctcattaattatttcccattcaaaattcatctcatcctactctcacctacccttacacgtctattgagggacaccaaagtcatttcttctaaactataatatctgctaaacaacctataaatgtttatattttagaatgaatgagtattttctttgatatttgtgtcaaatctgaaaacttatgtttttgacaaatggagtactacgaggtattatatttttacagggtggtatattttaaattagttggaatatggttcatattcaaaattttgaagtacattatactgcaataatcattttcaaatctctattttgagtgttgaaatcctgggaacgaagcccagtatatatcaaggcagaaaattaaagtgatagagaaaaaaaaagaactacataacaaaagcaattaaaccctttgtcccataaaaaaaattctaaagataaacccatacaaacgcttgtccatattcattcttagaagttgtctgtttttgggacagagggagtacatagcatactcttcctatatatagtccttcatgtggtaatccaaacaagcagtaggaaagtagagagagacataagcaccggtagggaagaccgcaattctaatacagtaaagaactgtatctaatagcccagttcgaatttggaggaaaattcctgggttctgaatctagagtggtccaagctcttgaattttcactttacgctagttatttttaccttggttatactctggaacaccctaacatttttgtctaaccacattcaacctctcttctggtaaaactctaaagatcttcaatttttgatcctgcattgaattggagttctgcaaacttaacaattctttttttaggagaaccaaacataataattctacatgcactgaagttacatgcctgcaatcctttcaggatgagggatgagctacgatttttttttattgagtaagcaccatgtctatggtgtgaccatgcgacagcctggggcatcatacctgttatttcgtgtgagagaaggtattaagccgtgtttagttccaaaataattattcaaacttccaatttttccatcacatcaaaactttcctactcacataaactttcaacttttccatcacatcgttccaatttcaatcaaacttttaattttggtgtgaactaaacacagccttatgcaaagctttggagatcagtttcttcacgaagaaccattttcacgaaaacatatgacgtgcaaggctttggagatcagccaaatttgtatgaaaagttttgaaaaaggtgtgtgacatatttacgaaggcattggttcttcacattttctaaaactagctgaacaatctgatttcagagggttgggattgagaaagagacaccgttgagatatcagatcttagttcaggttcagaagatcagctttgtgtattcagttcagacttcagagcttcaccaactgcgtttcctgcgagttccaatttcttctctccccagtccctttaccacttgaatgtccgataagaaactttggtcaaagtagacgaagctcgacacgttaatgacagaaacacgcatcgccgttttaatctccttttcacacaatcacacgggactaagttcacagcagaagcatgtgtttacagctactaatggcctccacgaacatttaacttgaaaagaaaaataacttgactgaaagttttcggtccgagcacacatggccatgtgcgaatcaaaattttagaaaaagaaagaaagagagaaataaacgaatcatagtcatataaaacattctttcgaaatgacgcatgccgattgacttgcaaactaaaagcggcactaataattggcacaagctagtaattgctttgtcgataatattttcagacaaagaatcgtttactcgatatatacaaatccatcgcattcaacgcggattggctgttttcttgtgttgataattgaacgcgcatttcatttggaagcagaaacaattctgggtgttgcttagcccggtggatcatggggggaagtcgcggccgttgccgtttcagtcattgcttccataatttgatttctcgtctcgcgtccaaatgcatcgcctcgtcgaaacagaaaactggttcggttaatcagtgccaatcatgtgcacacggcctgccgggtgcaacacgcctgaagattcagtctccggagcagaacagacggtagtagctgtacgtaaacgtcatactacctggtcttttcaaaattgtcattatgtttgggggctgtttagttccccaaaaacttttctcaaaaacatcacatcgaatctttagacatatatacggagcattaaatataaataaaaagaaagactaattacacaatttgcatgtaaatcgcgagacgaattatttgagcctagttagtccatgattagtcataagtgttacagtaacccacgtatgctaatgacggattaattaggctcaacagattcgtctcgcggtttacaggcgagttatgaaattagttttttcattcgtgtccgaaaactccttccgacatccagtcaaacgtccgatgtgacacccaaaaatttttatttcaccaactaaacaggccttgaaggtttcaaaaggagatgatattatcatcattcgatccactctacaacgtactaagtgcaattgtcctagcggaagattctgctacggttgggaaatggctcattttcccctatggatataagtgcaaactttttttttagataatgataagtgcaaatacattatggatcaaatgctctcaacatcttgttccttgtgatccatatacttcagtacattagcatgtgaagaatacactcgtgcaatgaccgaggaaaggttagatagttttcaatttcctttatgaattgaattatttccagttgatgctatgtgcattctaagtacagttctatcaccttaatgtacttaattgattaagtttaataaaaggctaaaagcttcccattatctttaaaaaaaattcttatagaacttgtgtgatctcagcgaagctaaagcttgcaaaatcaaatgtagattcctaatctgatattaagttcaaacttcttgaataacaaaagtggtctagcaaagcttagggtgtgtttggttgggctgtggcttttaaaaagtagctgtgggttgtagcttttcgaaaagcagatgtgaaatatgggttgtggcctttggaaaagctcgtttggttcaacagctgtgggcgtttgaaacaactagtcccgcttacaagtgggccccatatgtcacacacatattggatcttcttcctctcaccatcatgggatgcccgagcttgctggagctgctcggtcgttgcgatgcgccggccaaagcgcttgcgacgggcggaggggcggcgatgccccaaccctatggcaaagcagcgcgtgaggaacgacacattgagaagcgacggggaagaaaagaacgaaccggtatcaacatcataaccaatatcaggtgggtaaaaacttaacccaaaaacagctaaaagcagggggtggaggtgctttcaatttgtactagagcaaaagcagcttttgggtagaagcagctatggcttttgagccctttggttgcttttggcttttgcaaaaacaaaagcaagttcaaaatcccaaccaaagacacccttagttcaatgttcattcagtcaccatcagagagcactgagcaagtatgccaatcatctcaaactattcttttatgctcagagatgatgtagattccatggcgaagtaaaaaaaaaaaaaaacccttagggtatatagtatgaggtcgtatgcgaagtaatttccatactatgctttgcatttaagcttagctaggggtgtttgttcagattggagcagccttggcaaaatataaacaaagtaatcataaataatttatcggtaaaatatttatatttgtattgtttgcagtaaaatgtttatctatgtattatgtttgcggtttaaagactcaaattttgcctacaggctttcagccaacccaacaagcaacacaacacacccatactgggccaagaaatagaaacatcttaacaaagctagtgcgactcagataaatattaaaggatatcttaagctgctgtgtattgaatcaattaaaatctcagagaaactatccataccaactaaccatgtacagaggcaaatagtagccttacagtatgaggtgagtagtaactcgccttattacattagaatcaaagaatgaattgaatcagtttacagaaagaatggtgctatgaataaaaagaattgaatgttggaaccccagcaaaatagtgcaagctcctaaaattttgcttgccaagtgacatactatctgaataccctcctcttccacacttctttaccaccgctctgttagtgcgctaagctggagcgagttcagtctcccttcaacaagttaaaattatgctatctgaataccctgctcttccacacattttaccaccgctgtgctaataagctggagtgtgagttcagtctctccctccaacgacaagttaaaattatcttgagaattgctgcagctgtatgatcacaatgctgatatcgtcagtcgagcccctagtaaccgcagtttcgacgagcctcctgcaagcagtcatgcgagaagctttgtcgttgctgatgtaaagcggcctggcaatgtcaactgcctcctggttctccaccttgtcccacaaaccatcagaggcaagaatcaagaattcgcactgcgaatcaacacccagagttgtggtgtctggatcagacaccacccactgcttgaggtgtgcatcaccgatgcctcttgacactgctaaggatccctgaactcgccatgttcctcggtaattcaccacgaatccaccctgaaattgacagaagaaaagcacataagtcttcaactcatgatagctcagaactcagattaaaacactctgcaacaagccaacatcatcaaaggtctacttagctagtgcaggaaatgatgcaagaaagcgagaatggcaagtgcaggcaccacttaccagattctcaattctttccctctcatcctcgcgcgaggcccggtgatcagaggtgagcgcctctgccttcccggcgcggctgagcacggcacggcaatctccggcattagacacaacgaggccacctttctgcagcaaagcggtgacgcagcaggcgcccccgctctcctccctcttgaggaattcctcgtccgtcttcaggtagcaccgcttcactgcctgttcagtctcgccactgtcgccgccgtccaccttgcacatctcctcggccatgaacttgggcatgttctcggcgacgaactccgccgcgctcttcccgccgtggccatcgaatacaccaaaaaaggcctacacaatcgaaaataaattccagaaattttagtacagaagaagaaatctacgaagtctccccaaaaccctctcctgatcgaagagaagtgtgaacttattttacgcgaatcgaacggagaagtcgtgtggagcttaccactttggggtctccgccgagggcgaccttggccacatgccggtcctccatctccacccttctcctcccctttcccctccggcagtacaccgcgaactcctcgccgtcctcctccacctcgttcctcggatccgattccaccgcggccaccgccgcggcggcggcggcagcggccgccccgccgcacaccggaaccacgagaggggccgggcgccgccttttaagcacggaccccgcaggggcggagaccgccgcagccgcggcggccgacggctggggcgacggcgtggcctcctcgcgcaggtgggcgcgcagcgcgaaggggcggagcggcgacccggcggggggcgcggcctgcgccggcgaggacgcggcgacggatacggactccggcgaggcggacgcggacgcggccttgcaggagagcgggcggcgcgacggcgagaacaccggcgagctcgggatggcgaccgtgcaggacatcgcgactcgcgagggctctatctctctctcggagacgcggtcttcttcctcctcgccgctcgcgtgttccgcttttcctcgggttgtgtttctgttttggatgggtttggcgaattgcccgttggaacgggcgttatatatggggagggtcaaggacgcgtgcggtggggaaacggaccgataagcacgaagacttcactgccactagaaagaaatgggagaagaatagatgcttcggttttactgaaatgttctgttgcaaggtgtaaaacttttgtttaccaacaagaaattacaaatacctacagtagctttgcatagaaaatgcacagttactccattcagaaagtttttttaatatcattcagaaagtctggtctaaccagaaaattcgttggtaatttgtaaatatttttcaataatatcttcagtgctagtagaaaacatcatgtatgttagttttatttaaagaaagaaaaataagcacagatttctattaattgttgcattaatattcatgtagaataatttaaatttacatgctgtcaatacatttagccaatctgtcttaaggaaacgattacgttcatttcgatctttaaactggagacagtgaaagctaaataaagtgactaacttgcccagctatcatatcactataccagaaatacgttaatggagtagtactagtagtaaacaacaagaaggaagatgcgtgttagcgaggtaatttccgacgataaaacggataagtccaaacacggacggccacggaatagattactagtactacgtcggtcgctgcggcggattaacggaggagtgagcgcgcgggggagtcaaagatacgttaatcccgtgtgatgtgagaaaccaagagagaagcttgtgactcgcgaggacgcggtcagtggtaatttaacttttgttttgccgctccattattcaagcccccgaattaattgattggcagcgaccgtcccgtcgcgatcccgtcctcgcgggcacaacaccagacaccggatggatgcaccgggcgaagggggccgcgtggcgtggggagtctcccggtttgggcggcggttgcgtgtgtcgtggtcgtggtgctgcggccggagaagggagatcgccattcgcgaagctgcctcgaagctacaggcgttatacgagtagtagtttacacggtctagacctgttgggatttggatgcgtcgtcgacggttggggttggggaggagacgctgactgtgcctctgcaccgcagttggacctgacacggtggggacgggacgaacacttctccggggccccatgtcagtgactcgcgtgcatgtgctggcctgctgggtgagagcgagagtgtgaaaagagggaggcaatcccgacaaaaagacgggagccgggagaaaatgtagccgttggcaattgccacgctatggggtgcggcggaaaaaatgcgggacttcctccatcaaacgggttcaggctgtccgctgtcagtgcagtgagctcacgcagtgtggggtgctgagatgggtcatgggtgggtgtgtgtggactgtggaaaggtggcacgttccgttggcttggcttggcctggcctgggctggcgtgacgtgtggtccgagtcggagtgcacgcgcggctttggtcgggtccggaatgccaggtcagggtggcgcgtttacagtttcgacccatggcgacggcccgggacggtgctgactgctgagcagttcagagttcagacggtgcacgcatcctctgaagaaacaaaattacaggtacctttcttgagacacaacatacgttccagcagcacgttccatttagcatcctgaaggacgatttggccaaagtagtaaggcctggtttagttctcaattttttttcctaaaaacatcacatcgaatcttttgacacatgtatgaagcattaaatatagataaaaataaaaattaattatacagtttgcataaaaatcacgaaacgaatattttgagcctaattaatccctgattaaccataagtgttacagtaacccatgtataggggtggataacgagccagctcggctcgtttgagctcgttgtcttaacgagccagctcagctcagctcgttaatgttaacgagctaaaaagctaacttggctcggctcgcgagatggcttgttaagctcgttaggctcgttaacgagctatatctcattaatatcatattaataaattcaaatttaacattttattatgtattaacataataataaacactaactaatataatactcactgaatatgaataattttgatataattaaaagactaagcactagtcaagaaactccttaagttcgtgaagatatggtgatattttatactaacgagctaaacgagtagctcacgacctaaaaggttagctcgactcaactaattaagactacgacttcgaatcgatctgagccgagcttgctacgagccgatccaagccacgagtttcaagctttttatccacccctacccacatgtgctaatgacggcttaattaggctcaaaagattcgtctcgcggttttcggtcgagttatgaaattagttttttcattcgtgtccgaaaacccctttcgatatccagtcaaacatccgatgtgacatccaaaaattttctttacgcgaactaagggggtgtttggatccagggactaaactttagtccctgtcacatcggatgtttggacactaatttagagtattaaatatagactatttacaaaaccaattgcataagtgagcactaatttgcgagataaatttttaaagcctaattaatccataattagataatgtttaatgtagcatcgcataggctaatcatggattaattatgcttaagagattcgtctcacgaattagtccagggtttaatacctgtaaatagtatcaaaacatctgatgtgacagggattaaaaagttttagcctcatccaaagagggcctaatgcaacacaataatcaatatatcatgtttaaatactaatggtttaatttaagtgataatgattttcttgttttacatagccgtatttaatattttatcttcaatgaatttaaacggccttagcagcacatctctgacaatggcagatctaccgttggaggcttgtgcaagccccacctccaattgctactccctccatcctactccctccattccatattataaggcacaactattttttttgatgttccataatataaggcatacatatatgtctgtaattaactatgacatcttcttcattaaattactacttttttaaatcattcactctcacattctctaattctattggatgcatccattatatttattaggatgatttaaactacaagatgataataattatttcttggtctttgggttaagggtggttgtgccttatattttggaattgagggagtataatatagcaacttactccctccgtccaaaaaaaagacaaaccctagtttccgtgtccaacgtttgaccgtccgtcttatttaaaaaaattatgaaaaaaattaaaaagacaagtcagacataaaatattaatcatgttttatcatctaacaacaataaaaatacaaattatgaaaaaaatttatataagatggacagtcaaagttggacacggaaacgtagaatttgccttttttaggacggagggagtaggagtgaacgagacatttcataggatgagtaataatgagtgtaaagttgagatcccatgtcatttgttgaggggtgaccctctctagcgggaggctgtgaggcctccctttgagagttcggccgggggcagcgggtgagattcgaagatttggtgagcaaagctgtgtgatcttgagggggttcaatcctccaaaaacgatgagacaaaagaggtttatacaggttcgggccgctaagtagcgtaataccctactcctgtgcttagaaagtccctgaatccctggtatgcaagctagggttagacaagctttggctcagggatcctcagtccgatcccccctcctcgctaagcatggtcctccttttatactctaaggggatactacatgtgctgcgagtgctacctagggagaagggaaaatattctctatattaattacatgtcttgtgccttagcccagaagctatctgcacgtcggttgctgcgcggggcccatcaaatcatgcagggcgcccttgtcattcgccatttaatggatgaggacttcggggttctcgttcacaccaaaaaacgggaacctgggttagtttagaggggttggaccagctctgaccggggtaagaggctgtgaagcccctcatcattatgatgggacgggacggagcacgccgctcgtcgcctgacacactgatagggcgggggtatatagtcgccgtcccatcggtcattcaaccggtcacagaccggtcagatgcgcagcacgccgcattaaatgtggcatggcacggttgcatagaccgctttaaatgcagttaggtgggcgttaggcgcgcccacctaaccctgtacacgtgggctgatacgtggagggggtcggggcagctcgactccaagcgagggcagcctcctccctctagcttggaaggggcagccgccgcgccaccccgggctcgacccctcttggggggagccacgtgggtttgggggcggcccaaccccaagctgggagggggcagccgccgcaacaccccgggctcgacccccctcggggagagccacgtgagtttgagggcgacctcctccctctagctgggagggggtagccgccgcgccaccctgggctcgaccccccctcggggggagccacgtgggtttgggggcagcccgaccccaagctgggagggggcagccgccgcaacaccccgggctcaacccccctcggggagagccacgtgggtttgagggcgtcctcctccctctagctgggagagggtagccaccgctccaccccaggcttgatcccccctcgcggggagccacgtgggttggggggctgcccgaccccaagctgggagggggcagccgccacaacaccccgggcttgacccccctcagggagagccacgtgggtttaagggcggcctcctccctctagacgtgatactcccgggctcatatcaccgacatcgtttattgaaatgctcagtacctaaaacttagaaaaatgtaatgcaccatgtatagaccattccaatttacccatagattttttaagaaatgtgttaatatagctacaaattgaaccggagatcgatatgttttcctttatcatatgtgtatttgggtttcattggaaaaaaacaagttgctatatctctaggccgtgtttagttcctttttatttttttaatgtatacggacacacatttaaagtattaaatgtagactaataataaaacaaattacagattccgcctgtaaactgtgagacgaatctattaaacctaattaatctgtcattagcaaatgtttactatagcaccacattgtcaaatcatggcgcaattaggctcgaaagaatcgtctcgcaatttacatgcaaactgtgcaattggttttttcgtccatattaatacttcatatatgtgtccaaacatttgatgtgacggaaaagttagaagtttaaagggaactaaatatagccctagttcgttttagctccccttaatttatatcatggattggtccagtaacatgtatagccctggcagttggtggttggccagttccgttgcgtggatctcgttcgttcttgtgccacatttggaattttggattttaagcttggttcggttgcacttttgaatgcaaattgaaacgggacctttccgattaataataagtccgttgcgcaattcaattcggagaaccaaacgggccaggtcctaaccttggtccaagtttcttactacttgaattttattgcacgctgacgaagtttttataggtttacatttaggagtactagggtgtgtttagttccacgttaaaattgaaagtttgactgaaatttaaagtttgaagaaaaaagtcggaagtttatgtgtataggaaagttttgatgtgatggaaaagttgaaacttccgatttttttttcaaactttcaatttaagtcaaactttcataatattttagtgtggaactaaacacagccttagtatcccgaatattagtctgttcaaaagctgcatcagtagtcagtacgatcaacaataattcaatatgttcaacaatgcgattcttcttggatcagcacgtccaaatctcaaaaagcttatttatccaaagaaagataatttcaaaagcttcattcacaatgtctggaatggattggcgaccacattaaacctctccagtgctgaccaaattccgcccacataaatccgagcgatgacgccatggctctcgaagctggagtagtccttggttcatttaaaactttaaatgcacagcaacgaaccgttatgcaaacgaggttgaccgctagcttagctaacgtaaccacgtctaaaaacaaaactcccaacggtcgccgaagcatatgcgcgcacgtgccgcaacccgcagctgccacgtcaagcccaacacctgcgtggtacacatgcgtccagctccgctcgtaatcaacggtcaagactcgcaaatcctcgcttcttctccccaacgcaactcggtggacgacgtaattctggcgatcgcgggtggcggttgcgcgcgtactacgcgcggcggtgccgtcgtctcgcgtcttctctggacgactcgcgcgagcatcgcgtggtccgcgcgcgtgccatgtgcgcaccgccgcggccgctagctctggcgtcaccgcgcggtcgaacgaattgcacgggatggacagcctggactaccgctggagcgaggaattcagctgatcggtgcatagatgctcgacgcgtgtctgtcgtcaagccggggatgcgcgacacgtacgtacgggtgccatggctgggcggtttgacttgctcgcctctgctagctcctacaaatgtgtccgctctgtactcgtgcacgaaattaactatatagttcctgtttgcgctgacttggaccagtgattgcttttttttagataatggaccagtgattgctaatgtcttgttttaattagtcttgttctttgacagccagtcaagctccgtgatccattgcatcatgggagtcatggctggacaagtagctgctaccgatatcgccttttaagttgacgacgagaccgtgtgcgtttcggggtaggcagctcttgcttttgcgtccgtgtgtgtttagggtaaaggattgcagggaaagaaacgtggatccgatcaacctccgagccgctgttcggccacgtgttaaacaggccgatatggccactgttttctgtaaacgggccttcagccacagcccacagagataggccgaccaggtctaaacttatgagatcaggttgcgaaaatgcttaggatcagacgttagacgcaaccaacaaaaattggacgcctctcactgtggctttgctgcatgcagcctcgtatccttttgtcagatactctcttttcacacctgttagatatgctcacttacttagtattggcatgcatgaagaagagaggacacgagattatttgcatgtacataacacccttttagcaaacttgaaaatgatttttcttccagactactcatccaatctacgatctgtttacaccattgtattcgttacaattaaatctttacaacaagatctcacatgactatattataataaaaaacacacatatgtttcaaccaattaaatttaatgtttcacatgtgagaatcagatgtttcaactaaaattctattatgttgcacatatttaattattgtcgtaatgtatatatctttctttaatgtatcacatggtgctatttgtatgtttcagtaagtagtttattatgtttcactagtattttgtaaatgttgcatatgtgttgattgagtgtttcgataagtattcattagttaattaaaaatgttgtatacaatatcattcatatgtttcagcaaatattatatgatgtttcaatagttaataccttgtgattaaattataaaaataatcatgtgagatcttgttgtaaatatttaattgtaattatcggtgttgcacttagtatttcttgaatgttgcatttctctgaaatatttttatagactgagttggaatatttgagcaagatttttatgtctcactcattgagagccaatgttttataccgatattatcggtgttgcatttagtattacttgaatgttgcatttctctgaaacattttttagagtgagttggaacattttgactagcggtgaaacattttttttataagtggtgaaacaacgttcgatttttctcattaaaatataaccgtgtgatatcttgttgtgaagatttaattgcatggagtttaatggtgaaatcgaatcataaatcggataattaatttagaaggaaatttaatttaaagaaataaaaagtagggttgagataagtgttgaaccatgcagtcatgcatgcgcaagcatatatactttttacatgtgctaatcaactagagtagacggtagagattgtgcatgcatgtgtaggcgcgcggcagtgaaaggtcaggcgtccgatatttacgaactattggacgtccgacgcgtagcatcctccatcaggttaattacgctacaccagcagagtttgactgtcaccctcaccatccaccagctcctccattagttttcctctactgagcctgaacttcaagcattgcctgcagaccttatgcagtatcataggcttgccttgcagttgctgtgtctgaatattgtcactttgtcagtgataagccgtatcatactccgtatagttataacttagtacaatccaacgtactaaaaggtaaaacgaattcattatgcgcgtgatccaatcatccaaacatacggtgcagctgctttgctgccgaagttttatgagcacagcggcacaggcagcaagctgcacatccatatggacagatccttgggctcccggcctgtaccgatctgaattgaggggacaccggactgggcccaaaggggccgcgcagagggcagccactacaacggcagcctgcaggctttattacggcacatcggctttgtacttgggaatcactggaagcctggtaggcgacaagcgcaaagattcagagatgcaagagggcgtggaggggtcctgtcctccactcgagagtgtaacatcagttagatgcatctttgttacatttcagatcgcagctctctggaaagagtgtgcgctttttttttttgtcattcatgtggcctctcttacgagtgaaattgaattttggttacggaattgctaaccatatgttgacagaaaaatctatctctaaatcttgcagattttatgtgcttcgcaattcgtgctccagctgcttcttctccaactcctatgcccctgtcagtgacaacccaaactctggcggagggccaatgaattaggctcttggggtggggtgaggtgggatgggagggggagggggagggg

SEQ ID NO: 76837 - DNA, 6820 bp, Oryza sativa
ccagataagggagctggatcccattagaaaagcatcgcttgtcgacatgctaagagagaatttgaaagaatgtgcagctctgcatggtgatgcagtcttcaatgcagctatcagcaggatcgatcctttagtaattgcgcagttgtggcaggccctggagattgggataatatgtgcaccatggcgattctcttcgccgttgtcccttctccgaacaaacacttcatcacaactcacaagccatacaatttgcatggacacatgtggctactacatcgtttttactgacattgaagtgtgctgttcgatagttacgacaccatggcaccttcaaaaaaacactgacgtccaaaatttagcatacataaaacactgactatctgacgtctcaaggatattcctttcgtagtgaatgtaacaagtatggggtagcatattcagggatagccgttttcttgataggatatactcccaaagtcccaatactcctagatcagatattgacatgttataggaaaccatttgaaaagagaacatatgaaaatgtatagaatcgatatcctttgcttttttttacttcaaaaacgaaacatttgttgtttgcaacaaccatttacattctgctcatgtgcttcatccccccttttttaacctgtatctctactggacgtatggtccaagttctcagtgagcatggtatacgtcttttgatcgtgtaactgacccaccgatttgccgaaataatttagcagaaatctgattgagttgtgaacgcgcacccgttgggtatggtcgattcatgtacgctgatcctaggcacgtccactgttgcatctgtaactgacccaaagatggccatgctctgacaaagcacctattccccttgaacagaaacatttcctatgaacaactcaaaacaaaaataactggggaggttctgaattttgagaattatgtggtggtactgagaatgctcgacatgtaatctttacctgccccttagcaaggattagatgcccctggatgaaattttgtccccctcttcgttggatcagtttttttccaccttgcttcctgattcttatacagaagagtgttttgttactagccgcaggagttagcaattttggctcactagaaatgacatgatttttaaacctaaggtggggggcactcctcaaactgtgatctgtcgctggatctctcttctgtggcagtggaggattttgacgaagccgaaggacacactaaaggcctgtttggtacagctccaactcctaaatttaactccaggagttgagtctggagtggagttgtggagctgcctaaacccagctccgcaactctagttcattttgtgagagagctccacccagctccactcccagttttggtggagctgaaactgtttgactgaacttcatctccaggaggggtggagctggagctggagctgtgccaaacaggccctaagactggagctcatgatatcttgttgtttgaggctgctggctccctgcaggtgcgggagggtgtgagctgattgtgtgggatgtaccagtgacctggggagggttgttgccccgagtggttttggcagctgctgtgtgcacttgtgggttttttctgcgtgccctggtcacctggtggctaaaactgtagccggtcaccggcaaaaaccatctattgctttctatcaaagcagggttctctgcctttgttttccaaaaataaaaaaaaaaataacattggcatctgggccaaaggagcaccggtagaaccagccaaccaggccaaggcccatcccaaccacgacggcctgtgtccacccgtcgcttgccagttcaccccaacatcccagaaattcaaaacccatctcaggccgtaacgcaggtacgcaaccctacgagagacgcccccactttcccaaagccgagagccctttcggctgcccacgtccccactcctcccaccttttttaacctttctcctctctctctctctctctctcccccctcaccatcgcggcggccgccaccactacgcgcagcaaccggcagcagcagcagaggaggaggccagggcaacccgcaaccccaaaccctactcccgccgcgccaccgccatggccgacccagcggagcaccgtgaggaggagcaggaggccgcggcggcggcggcgggcgaggacgaggacaccggcgcccaggtcgcgcccatcgtcaagctcgaggaggtcgccgtcaccaccggcgaggaggacaaggaggtcctcctcgacatgtaagccgcctccccctccctcgatccagccccgatccgatctcccccggctttgatctgagcctgacgacctcgttttttttggatttcccgcaggaagtcgaagctgtacccgcttcgacaaggaggggaaccaatggaaggagagaggcaccggcacggtgaagctgctgaagcacaaggagaccggcaaggtccgtctcgtcatgcgccaggctaagacgctcaagatctgcgccaatcccctcggtatccaatctttgcggggatcttttgttgttggtttcgatctggattccagatggatggggttcgacttgactgggtgatgtttgtgtgtgcagtggcgacgaccacgaagatgcaggagcacgccggcagcgacaagtcgtgcgtgtggcacgcgctggacttcgccgacggcgagctcaaggaggaaatgttcgccatacgctttggatccgtcgagagtaagcactaaacaccccaagaattatgtagttgctccttttgtttcttaaccaaaatattatactgctagtagtagcatgtgcttggatgggctttgagcaatcagattgttattgggtgtccgagaattgaattggtgatggttttctgcttggtcgaggttcatcactcaaatgagttcgtagacagaccatagttttatgaattgtgtgatcataaataaagtttgatctgcactgtgagttttatttcgttagacggaccatagtttcctgaattgtgtgatcacaaataaagtttgatctgcaccatgggtttgattcacattcactttgctgtattgttttcatctagtttactatcatccacctttggtgtttggatctaaacgccttaactataatctggtgcacagtgttattggacgactagcagtcattggcgtgggactgtttttgtgcgaatgatgtacatgatttaaccatctaattgcatcaatttgcagttgctagccttcacatttgttttatcacacaccttgcttttggaagtctgcgcttagaaattgttctgtgattctagcatgttttttttggtgaattgcagactattttctgcttttcaagttctcgtcataatttgggaggacatggaatttgtgtcctgtctaaagcaaaattttgaaatagcaagagatctttaactttctggatggatttaagttcgaaattagtcctatttctttttgcatcaaaaccaagaagcaagtaactcactcaccatgtggcaaaaccaatgaacatgcaaccaataagtactagaatgacttcttggtttccgatccacaatttaatttagcacatagtgactacaaataggacttagatttttggaaaaaccaaaaaatgaaataagcctcagatttttggaaggagggagtactttctaggccattttttatcttttgaaatagcaatagtgccaaggtgacagcagccagcacactaaagagatggacaagatatgtactataatccttatactgctccatgttttatcaatccaaatattattttacttaagattttgattcatctggtatgtactttaagctaattaaaggcataaccacattgtgacgtggattattttgtgaaaatgatctatattagttttcattaacagttaggatctgctggtgcaattctttctcattaaggtactttgtccagtgattaaatgcatgttcgaattgtatgatgcatttaaaattattctacaattgtatgattgtgtcaatagttatgtactgtttcgtctgttcctgaggtttgacaacatgtaaattgaaatgaactgtcttgctatgaaatttgctgctgtgactatttgagacatcaatatgtagttctttgtgagagactgctatatttgtattgacctacctaagctctgtttcatctgcatttctttcggacttttttgtctgactgttgtccatgaattttgtttcagactgcaagaagttcagggagatggtagaagagattgctgagcagcaaggaaagaacgaggagaaagaaaatgaggaagtctcctctactgcagggttggttgagaagctttcagtgaccgagacaaaaaaggaggaaaatgcagagaaagaggagactcctgcagaagaggataagaaggacgctaaagagtgaaagcacccgcaacctctaggcagctttgatatgcctgaagcgagtgaagtgttaaatgagcgtcatttcattcattttgtggtcaaagttcttcctttcacaaattttcattgtgttttcttttggatgaatgtttgtgctaggcaaaatttgagttgtatcagtcgggttcttggttactacactgttacttaaaccttgagttgtttatccgagatggggtggcggagtgggggcacagcatgtttgtacaattatttgaagttgcttttggaatgggcacggtttgggttgtccaaaatttggacggtgatgccctgtcactcacaattcttatctctgtcttgcaattatatgcgatgtgaagctcttcgcctcttcggtgacgagttgtcgagttgtatgtgtgcatttttactgctgcaacctgcaaaggtgacgcactgcagagcatgacgcatatcattatcatataggagtagatccatgtgtattgccgggcaaacgcatttagtgtgaatcatgtagtacatatcacagcacgcggagcatatgtcgtctcataagctcgtaaaatcgcagcaatgaatgttggtaccaagtacttgttgctgtagtgctgtgcttgtaccgcccccatgttatcgtgaaaagcttctgtgcttgtacacaccccatgttatcgtgaatgcctgtcgcccatggcgtctaaaaggcatttctcacggtgtgtaaaccgttgcatcccatggcatatactacggcatctcgtgtgcatcattttgctttatcatcttcagtcaggtgatctgtagccagtagactttacttgctacgtctgtaacctgcaaaacactaccatcctgcacccatcgatccgcaatactaccatgctgtctgtacccatgttccgtggatctgggttcacccccagcatggaggcgtatgcactgcgcagatcgtgatacgcccccattgatctgcattaaaaaccgatgatttcccgggagccacataacctgcgtatcttcccgatcgccggaattgcgatgtactcgtactcgttgctgcttgtttgctcatgatgattgcccgtggtactgacacagtgacaagtcgacacgtcctgggagcgtactacggatgcgcgatcggaaggatctcccgatgcagaaattgcagatggacgcgcactactacagcttcagtacgacaagttcggcggcaaatgcatgtgacgtgagtgtgtgaaacacgcgcttccccctcgcatttcttttgtttctcaaacgaaagaacgtgcacgatgaatttgttcatggaattctttcccgccgtgagcccgtgcactgccccgtgagccttttcggccatttctcctactataccctgttctgaaagactgaaatctggcgcgaagtgtttgttacctggtcggcttagtttcagaatttgaaactgagagacaagaaacaggaccagttctcgcttccaacctggctttccaggacactggtcgtgtatgtgtcagagtttactactccattgccattagcctgcttgtggtttctcgatctgatcattcagacgaccatgtaagtaaattgttcccaggtacagtaccgtttctagataattagtaccacgaaactgtccccgcggtcgggttacggttaggcttcgctctcaagcctcgcgccgatacggtaaacgcatttaacgagacatttttccgccaagtgaatgggccaaaacaccagcacgccgcggtttccaactaggcaacaactaacctcgttggctggctgtctcacactctcatgatctcatccgaccagcagaggcagcagcagcgcgcattaccgaaagtcatatgcaacggaaaaaaaaaagaattggaccaaaatattgcagagaaaacggcggcttgaattgaacccaaaatatgattgaatcaatgagataactgtacatgacagcagccacggacgcaacagccaaccgagctcgcctagtgcgagctagctcgcatttatagtgcccatgctggctgtcacagcgatcacggccggcgccggcggtggcgacggcgaggacgctgtcacggccgccagcgatcacggcgggtggcccaccggcgtcggcgaccgcggcggggttggacgggacgggtgcattcgtcgctgtcgtgtccggactggacggtggggcccaggtgtcggccgcctcccaggtgggccccgcgccccactcgcgcccccagcttgcgtttgacgccaactcgacgagccttcccttggcgcgcgccatcatctcgtgctcgctgcgcgcctccgcgccgcccgagtcgtcggagt

SEQ ID NO: 76838 - DNA, 1882 bp, Oryza sativa
gtagacacctgcgaaaagtttcgaccaagcagccggtcttttggtcacctcggtacgtgttcaatatgttgcgcatatttgatctgttcatgttatactgtgtagtttacatgtgtagatctaatgatgcgttcatgctactttcatctgtaatgtcatgatttatttatggaatagattaaatcattatatgtctataatctcaacaatatcatgcatggtcatatcgatccaaatagtttttgaagagatattccaacttagtggctggtattttttgttttcgtaaaggatgaaagtgacaaccctgctgtctgcactacatacgaatcaaactgaaagttgacgcctgacaagcaactccagatccgacaactcccatttcccataaggccacacttttcttttcagcgagccactattatgacacacacaaaaagtaaaagaacatgtaaaactagtactacacacgcagtcaataaattgaatatccattgttagctctcagtaatttgctgcttaaaatattgtgaaccagaactgatactaagcatcatttaccgggttggcgacgatagtaatgccggtttggacttaggaactgaaagtgatatcaatttgttcggtagtgtaattcttttatggacaagacggtaggcatgaaaaactagggcaatgtttagcaaatggggaagggaaatgatttcccacccatctttaaatcctaaccattcattccctctcttccatttaatcctaacctttcattcatttcccaatcccaatcccaccccccatttcccattatccaaacacatcctagtagtgtcaaattgtgctagaggacaaccatattggatatattttattggagtttaaaaatctcttgcttcttcattagtatcacaatcatccaacacatctattagtttttctacttgaaatactagtaaaagtctaactacaacaatattatattattttttacaacttgtccattaatatatttaaaactaatatttagattatattctgttttgcaagaattatatatttatggcacacagccacatcttttcgcttatgcttatacttatcagccaaaatttgaatttgcatccttaaattttcatctaagtttatttttgagcttttgcttttagatcgctaagaacacgtataaaagttttacgtaaaaaatatttttcttttgcaaatatggtgtgtttgcctattcgccgaaataatgaaacgatgagctggaaaagtgcttaaactattgtaattatgtattatattaacataataaaaaattaatggtgatcaaactaaaaccgcatcttaaattaaaaatggacatactatgatctcgataggcgcgaagagaaggacggtgtagaagcgcttaaggtaggagtcggcgagaaaggcggccggaatggagaacatctgcagcgcggcgaagtagttgctcgccgtcgtcgacgcctgcgccacgcccatgtgcatggtgccccgcaggtagctcaccatgttcatcatgttggcgatgttgggcgcgttggtcaacagcaccatcgctattcagattcatgaaaggggtacgcatgcaatgcatatatctcgttgtcagttaattaagttgaaaaaaaaactgagctttcttgacagtatatacttgcatgcgttgtactgttttaattttgagcactgaaattttctttcagcaccgtgtaattaaaattcgagatgatgcatgacggatagaattgaaacttgggggagtttgtatttaatttgctgttgtaagcaagaaaaggttttggttgcttcgatagagaacatagatattccaagattgatggacccagcaagcaaaaaa

SEQ ID NO: 76839 - DNA, 1362 bp, Oryza sativa
ccactgatgcttcagaatcagcttttagtgctgggggacgtgttcttgatctatttcgtactaaacttaaacccaaaatggtagaagcactagtttgtaccaaggattggattgctggatgtagaagaggtgatcaattgtgtcatttctcatttatatttttgtaaaaggcattcttggttttttattaatagtctaatatagctttcttctaaattttttagatcctaataaaatgggagttggttctattcttaatgatcttgaggttgcggagaccttggttgctagtatgacacttgacgagattgatgatatggtatgacattttattgcatatatttggttgcatacattttgtagtcctattgtcaaaagaattgtatattgattgctcataattataggaaaagcaacagagcagtgatgatggagaatgagaattgagaagttatcaagtgaagtgtgaagggcatgttggtgtgtggctgtgtgcagtgctcactgctgtgtgttttgtgctgtacgcctgtactactactgctgcatgccagtatgcagtatgctgcgtgtagcactgcagcgtgctctactgctctatgcttgctgtatgcctgtatggcttgtctcatgccgatgacttttatttttatattttaagcaacgcagtgaccagtgaactattaaactgaacacttatattatatttttatggatcatggatgtaccttggattattttaactagtgaactattcaactgaacacttatagttatactattactattgaactgaacgcaatgaactaataatgttttgctatcgtattggggctaattgtactgccgccctcttattgtatggattgaatacaaacttgacatccgacaactttttgtctgtttctgaaccgagtccgcaccgactccacaccgaatccgacgtccgaaataatccgctccgcatccgcatccgcacgtcatccgcacccgctccgcatccgcttataaaaatatggtttaggatatggtatagctattatccgtctaaatccacttcgttttcacccctaagtgctagtgggtggtggaggctcatgccatcgtcatcctgtggcaccaactccagatctacgcccgccggtgtctcccacctcctcaaatctcacgtagtctgccgccacaagcatcattgctacctgtgagctcgaaagttgccatgagcacagacctggtccaagcttccacgccacctccgttggctcctctaaagcatatttttacaaaaaaaaaataatgttttaacacgagcatcacagaattgtctggtttccaaaatatcgagtaaaaaagaaaggaagg

SEQ ID NO: 76840 - DNA, 611 bp, Oryza sativa
cttccttccctcctctgccgccgtcgcacgccgccgcaccaccatgcccagtcgtcgcccccatcgcactcgcgcgtgtggacctgagaggagtggaaggagagagagcagagaggagaaaccgattgaaagaagggagagagagaagaaaagaaaaggaagtgggacccactagtgggagccaccatctggactattcctccccgtgaccctttggccggctaaaaagtacatatgatctccctctactttattcaccaagctccgaacatcaatccttataaaagtctatgttactttcctttctttcttggccgcgcctatcgtaagatgcaattttttttcacatattttgaaataaagtatggtatactgatttttgttttctccttgataatgatgtctctttattgaatagagtaataaagttccttgcatttctcctgttcctacaaattattgtacaaattattacacccacgtaaatgtaaacacaacatatttcatgattagatcatatcggcaccattcccagtgtcacacatagtccctccttgggtcaccaccttctgctcattcctgtacacgtacctcctcgcgaagaatacgta

SEQ ID NO: 76841 - DNA, 30528 bp, Oryza sativa
  unsure (1)..(30528): unsure at all n locations
tttgacacacacctagcattgaactttgcataccatgagccatcattttgttgtttgttctcaatgaacattacagcattcttaatacaactttcaatttctacaccacggtaccctgggtataactctgtaaatgatattagaccttgaattgctgatgatgtgcactcgacatgtctgcatattggccttatctttgtagttagattccaaggtaaaggcaaatggaattattataagatatttgacacttacggataatcaacgacaatgttccgaaaactctctgaagggttcagaatctgtgttatcaattacattcatgttagtacatacatagtcatagtatgctaaaatcgaaggactctaagataattttgaaatcaaaattacttgaagtatatacatatgaaggatgagcaaggataacatgatcatgatatcatagtcgagaaacgcatttgaccaatccgtggaatttatggtttgctggtttaacattgcattttgacaacataataggagtgttgatagatgcagaaactccaatagctagttatgaagaatacaatcatggatttgcaattaacagtggtaacttgaagtaacggtcatttgaatctattttgctagaccttaagttcatgtttgtctatcttatatgttggtgcatgtcaatgtcaagacattgaaatttgaaactatatttaatggtctgaacatcaaaatccagttttattcgttacaaccaaatagtgtttgaaatctgaaactgcagaatgaaagatcctttgaaacaactagtgtttgattgattacaacctctgtaatttttttgtgtttttcctttctttgtaaacaacccttttgatatataaaagttacacggctaggcaaattccaagaagtaattcacctaaaaaagagtctagtttcatacatagatatttgtctcttacataagtttgcacaatatgatatttaaaattacagtagttaagctagtacgatgagcctgtacttattgtgtatttgacaagtaataccttggtccattagtggaaacgatgcccattttattgtatatgttaattgaattagtcccatattgagagttaggtatgttggacaacatataaacacaagcattccaaacataatacccctgggttaatcatttttcacaccaagagatcaatgatgaaagtgtaagtggacttttatacatatgttggtgctggggtgttagcggtagtggagctagaaagatttttatatattgtcaatttgcttatcaatactaaaatttaatggagttctcgcagcagagccccgcgcgagggggtgggggggctgggtgttagtgtgttacgcatattgtgattgttaatgacgtaaagacacattttgctttcctaatgttataaaatgttttttggtgcatcatttgctttcatgtgtgttgagtattcttcatttttatctcacggaaacaatggaatgttaatttataataatttaggcaattgttcaaaatgtaagccaaagatgtgcacctctgtccacgaagctgttcttgtgcattcatacgaggagaaggtaccatctttgttctttgtgaaacacaaagaaaagaaattattcaaaagagcatgaaaacatcagtcaaaaagaaacattatattgctaagataataacttcacgtgaaattaacaaaatttaacatcatatttacacaactgttattttgtttgagaaagataacaaataacgaaatatattgacaacttcaacaactactacttttgaagaagtaattacctatccttttttattttatcttgattgaattgttctaatttctggttcttctcgaatagtaaggatacatcattgaactggcaacatatattataatgtgcacttaataaagttataatagaggatcactatcggtgatgtactataatttattacatgggaacaatgattattattcaatatatatgttcaataattttatattggtccatcaatctctcctacaagctagaatcttggtatgacttaaacataattgagctgttcaatatcatcgaatcttcttatgttcttttttactttatttcatttatgctttctctcaaggaattacaatacttagtattagtgctctagctattactacagcgttacctttttcatgatttttccactatcaaaaaatactttgtcactgagaggcctatactcaagaagagctatctgttcagaattaatgaacacagttcgttgtgcatcaacaaattctcattgaaatttagataagagaacacatacattagctaatactatcacacacgtaagctgtaaatttcttttattgtcttaagtctcttttaattatagatgaccacaatattaataaactgaaaaaccacatttcatttaacatgaataaaacaggaagaatactccaattgtatagtcataccgaaaaagacagcaggcagtccaccgcgtcatacaaacttttttcttttattggatcaccaacaagtttaggagaaatctttgacagccctagtaatgcctataataggatataatataaaatgtcaagaacagacaaaataataattaattaatgattattaggaaactatttgaacaacggattgcgctttggcaataaattttcttcaacgtaactgatggcgtatcgatattccaagatcatggcatataatgctcttaaaatgaaactcgacccatgggagagagagatcttcaaggcatttcgttgatggttgagtaaaagctccaaaagcctacacctatctatatgggaacactgttgtggtaggcagagtcttaatgcgtactttaggggaacacacaatgaggattcgtttttctttaagaaccagagtttgaggctgataactggaggacttacaaccacgctaaacacgttctcctcataatgctatttttttatgcttagatgttggactaaatatttcttgcttctaatattataagcaactgattgacatgttagaactagaaattgtacgaacagaagatattttagttaaaatctctccaagaaggccaaaaattgaagtaaaagagataatttaactgttttcaccactaagaaccatatccttttatagagtcagaataaggaggatgataacaaacttgtatgacctgaagtgtttctcctgtacaatcaggaactgaccaaccattgtctgctgtagaaagagtccatgaaccttttgatctatggcgatagaaacttttgccattagggaggtcatgaagaaccttcaagtaagaaaacaattttgagatttgtttctgaaagtgttcataactttccagttgcaaaaagttcaagaataatgaacctgcgaatttttcaggaaaccataggctttctcaagagttgtactgaactcatctactaagcccgtagagcaaatggcttgaactataaatgctgtctcccatgtctgacagccatcatatacctacgtacaatcaacacaataacaagatatgtctgtcattacacaatgcttgatcctcttttgtcttgaaaattaacttttgtacatactcatgcatgcagttgctaccaaggagcaatataaactttgtcaaaatgagattcactatacaaaacgccacagcatacatgtatgtcgatatcatactagaaaattgacgtgcccgttgggtttaaaatacatgatgaacaaaacaataagtgcatagtagatctattggtttataacaaaaacatactatataagaatacataaagatttttacatgaatacattcaattcctctgaaatatttacaaaaaccatacattccgcagaactcttcaatgtttgttttttttttttttacttttgtgtatgtaaaatggttgcaccgagtagtactatatgcttgctagcgtttatcgggttaataagtaaatggttttttaatgaaatttgcacattttgtatttgagcacttgaaatcttttttttttttgaaaatgcacattgtttttcttttcagggagaaatacatataccaatataaattcattttaggattgcgttttgtaagaacacctaataacaatgaacaacactcgcgagagcgaattgtaaggcatatatatgctaacctttaccatatgctcaagatatagtactgtgaattttgatgtattatctaattaaaaattacatttgtatgtgctatgaattacttatatacatttaaattcactacttaatcttaaaattatttttagtttatttttattatttttgggcacttttttgacaaaacatatgaagttaaatactacttaaatatgtttaactatttgccacccatacattaatgacatatgggccctcacgtgtctatgacatgtgggtctagtggcaacaattgattacaacatctaaaagtgaaaaaaaagtaagaagatgtaaggctgtgtttagatccaggggtgtaaagttttagcgtgtcacatcggatatacggacacatatttgaagtattaaacatagattaataataaaacaaattacagaatccgcctgtaaactgcaagacaaatttatgaagcctaattaatctgtcattagaaaatgtttactgtagcaccaaattgtcagatcatggagcaattaggcttaaaagatttgtctagcaatttacacacaatctatgtaattagttattttttcgtttatatttaatactccatgcatgagtccaaacagtcgatgtgactaggtgaaaaaatggagtgaacttattttgggacaaatggagtgaaaaaatgattttattccgggagggggtagtactcactatttttaagaggccctgtcaaatatagcattttcaatgaaatctaatataaattaaataaaattggttaaaacctataatgagaaataggctaattagctggtgtgcgcctatttctagtcgaatttgctatatatttgtcgacaaattttccaccaaaaatttgacagatgtaattatagtacaatcgtagtgtcattacactgtaacttgcatgtaattacactgtaactataatgtaacatgtatgtaactttcaaaaatctctccataacatttatttcggtaaaatggaggttgtgagaacaaattctttcacatatgtgtgtgatgtggttgtttttcttcctcaccagaacaaattttgtaatagatctaacgattcaaaattacgtgaaacttatatacaagttacactgtagttatatgcaagttacagtgtaattacactacgattgtactataattatatctgtcaaattttcggtggaaaatttgtcgacgaatgtataggtggtcccatttctagtctattctcactactctgttttctttcatcccacatgggcctggctagcccgttcaattaaatatggtgcctggcccatgatgttgccgagtcatgcaagcaaccgtgtgtatgcgtgaagctcgttcagggcttcgtcgaagcttcgtcgaatcagcgtgtgtgtacacgagtcaaaaaaggattgagcacctggaccaatttgcagctggcagaacaggcaacgtgaaaataatagatagatgggcttgtatgcagatcgaatgttcagagaatcatggtcataaatgtcagatgcaaaggatttgtttatgtgactagattcttaatcctaaacaaaacataacaacatgagaaaatgatgtagtatgttgaggaccatattttaaatgctgtgaaaggtgaaagtattatcatagcatactgtacttttaagtgtcatctatgctatttacaccgaagctaacttaatatggttcaaacattgatattaattgaaatagaagccaacagggggcacccaagtagcctagcgattacagtactcaaggaacatctctagatccttggttctactccccacaggagcgaattttaggcctagttaaaaaaagtcattcgctagctcctcataaatgcacgtgttaggaaatgatatatggagagcgagctctcgtgtagaggacaggaacctcaaagcaagcgttaaggaccaatccataagaggtgactcctctcgtgggttttctcggctggtttggttgaggcttcttcttcgtgaaaaaccgtgagggtggttattctcctactggtcgagtttttttttaataggggcacccaaaatttttaaattttgtttcaataatataaactctacaagctacatgactgcaagataatttgattttctataaaaagtgctcattctgaaatttcatacaggtaataatttcatacagctcatctaggatcgtgatgttgacaacctgtgcgactagccagaaatgataaagcaatgccagcatgcagcaatgcagcatatttcttaaggttacaaaaactttagctgcaaccattttctgacattgatatctgctagagattgatttataacagtggtttattgacatctacagtttaacttttatcttcactcatataattcaaagaaatatagatctgacattactcacttcttccaggacatgttggcttgcccacgcaaaaataggaagcgagttaataccaattaggagctgtttggttgcgtcgttttggcccgtatcagttcccaccatgaatagatcatgttacactcgtttgttacagatggaccgtaatcggatagcccgcaaatgaattccggcccaatacaaatctgattacgctccaagacgggcggaatgcgatatcgatacggagaggagagcgcgacctagctcctccaaatcgagcaccgctgccactactccctcgcagcgcacgcgttgccggcgccgccccctctccccacagactctgctgctccctcgtcttgtgcgctcctccaaccaccgcttggccaggctggcgcatcgatgctccccacctccaggagttccgcctccagagtccctcctcccccgtccaacgtgcactgccacctccccagagttccacctccttggcgattggatattgacgggaagaactccatggagactggatcttgacgggaagggcgaggacgtgcagcaggaggctagtcggagattctgctgctatcaactacatccgtcttttgtcgttgccgccgtggaatgaacaccttgccggtgagaaccctccccctactgaaaccacctttttttatgatgatatacttgtgatgctggtgagtggtgatcttgtgatagtcttctaaaaaatcatgtagtagtttatactagtgaatcacatgtgttcctgcctcatatatgtttgcttcataagttctgatgggttatgtagaatatattttcctcaattgcaagaaagttgaacatcagtacatggttttttttttagtgtagggaagttggaccaactcatattactatctagattttgagaattttgattttcattactgccaggtgatatattattttgcacaatatcagatcggggaaaaaagttttgcatattgcctgtttgacagaatatgttccagtaaaacagcacatacatgtaaatatgctccttgaatggatgcttgatatggtgttctggtgaattacttatgtttagcaacaaaaataatttgcaccgtcttttgtttgaatggtagcttgatgtattatgtgtgctagcaggatatattctgaacatagggttaatgcttttgttttatatatttgtagagtgctatggctcgccttcccttaagtaccaaaacgcggagaagaaatttagggcttagaaatatgatgattgctgttatacttatgtattattatgttgctgtactgttcttgatttcatataagagaaaatgttggaaaatagagaggaggatcagaattagagaacttaggagtgaaagaccattccagcttattcgtgagagtgatattgcttgtataagcgagctccgaatggataggaggacatttcacattctatgtgacatgcttagagacgttggaggtattgaggatacaagaaatatgtcgttggaggtatcagtagcttcattcttatatatactatctcaccatttaacgaatagaacaatagggaccttttattgccttatatactatttgtctgaaaccatgcaccagtataatgcatgtatgggtccagctgtccagctcaatgccataggaattaacctacgggagcataagtagtaatatcatattcactccaaactactcctagctggagtatgtgcctacgcctttcttgcttgcttgcacctataaaaaaggggttcatgaaaacagagcttttctacaaattccttgtgcagcccctttcctaaagggctatggttttttagtccagagattaaaaaatgctacctttttcttaatttggtatgatgctgagcattatatattctttcttgtaatgtttctttcactaatttctgaattttttttgttaccaaatgaggcaaagaaaaactgatgtgctggatgttaggcatttgatctacaagatgttcactatctatgtttgaaacccagaattccatatatgcacaagtcttggggattggagaccatatattttcactatatatttcctatgtgctaaagatgtttatttccaatacttcagcttttatttgcttgaaccatgatgatgtacatattctgtgatcaaagtgctaccctattcaacgtcctagaccttttgtttggttgtggaagacaaaatgtgtaatgaaaatcaaagtctttgcctggttaccattcactgacagattaaatactagagataagctagacagaagacactgtgcaaaagaggatgatgatttatcttgcgttctatgtaatggaggccacagagaaaccaggttacaccttttcttcacttgccctttcagcattgaatgttggcagcatttcttgggatttcgtgggatgctacactggagtttttctaaatgatagtgcttgcaagggttaactttggtaggaagggtttcttggaaatctgcttcattgctctgtggcatatctggaaaaaaggaatgggctgatttttcaaaatgttccaccatcttttcagtcctggagaagcctattcaagaatgagattcttctgcatatgtgcaaaatgaaggaccctatgaaacaaatagtttttgattggttacaaactgtataattttacttgtctttgtttcctctccctgtaaatttgtacttatattctaaataaatgaaaaacactactaggcaaagccctggtagtacttccagtaaaaaaaagtgttgtcctatttttgagacaaaagtactaccctagcttatttgttaactaatctggtagtttcactaatgtcaattgttcatccaatcctttattgattgaattttgaaggtgtgccattgattatattttgcaaaatattatctctcgtcttgaattcttgctgtcaaaatttgcatccaaatagaagtctccatattaagtattttcccgttgtgtatcaattttagaatttgaattctcagccgacacatgttttgcttgcacctgctagtctgttacctagctgcctaaccaaacagcgggaatgaattggtatccgttacaacaactatccaaacaaagcacgtaatcggtgtaatcggttaccggcagaagcattcccaattacgtttacgttaacgtgattgaacctaactccaccttaatgtcatagaggtagagcaatgataactatgggtggtcgacattacgttctctagtgtagcaaacttagaatttaagggtggttattggtaatgagtaaaatgattacgatggttggaacaacattgcaagggccacggagcttggaactccatggcgcagatgtggcatgcatggcaatggcagtgatattttctgttctgaggattttgatcaatatgtgtgggggaggtggctgcggtgatgtcaggtatggtggcaaggatgacaggagtaatgataaaatacagtccagagaagatgggaggcactggggaaaataatcctgctaatgtggacaacatggacataatcctactgataacatggacataatgacattgttggcttgcagaaaagtatgtgggtgaaagcagatgggttacgaaggtcagtggtgttgaattccatttagccagtatgcgctgatgaacattgcttcttgatgtcttcggtactggctgccaatctgcgtgatagatgtcgtcaccaggttcggtttcttgttcctgattctcatttactctcatgattatctaagaatataactaccatcagcaaaatctagttattgggtaggacatttagttgaattcacttgaggatcagtctgattttttgtttaaacaatctcaacatggttgttagactgagttgttttaatttcttggtttcactccaaatgcagagtcttttagtttcttccaattaaggtgatttaaatttcaggttatgattagtcctaaaatcgaattcaagaactttgaattaattataatccaaaactcagccaagcaggaaacatgtgattgtttcagctattcaatgaaagttcagcaaggaaatactagctttccatgcatgcaatgtttaatttccaccagagcagtatatatatgtattacgaagtccactaaaaagaagtatatatgaaaaacataaaatgagcaatgcatacacccaactaagaacaagtggtcatcacttagtctttccaaggaaaaaatatattcatgtgatgaccaattatgattaagtgaaagcaagcaagatttggttgttagcgacatgtgcaaaaaatgtgatattacctcattcatgatctgaaatggagctgaccaggacaaaaatgtgattttatattgatttaggcatgaccaatttacagataaagaatgatttaaaatttgttgagtacttacataagtttcgggatacgtgcaaaattctcaaagttcagggagtaagtaacagccccatggaaatttagtgagacataaattaaataaataaaagttcaattagaacagttttacaacagatgcaagcagccaaaatagtacctgagccttcatgccatcttcagcaagccatagaaagtcataaatccttggaagatgcctcttgaatgcatctgaatttgggtcttctatccaacagcaaatcatatttaatgcctaatattaaagcaaatcggtcaaagcatagtgctgaattgtgaattaataatgctaaatcaacaaagttagtaaaggatgataattaatttattagagctagaaactttctaggttctactacattcaacaagttttgcggagtattttaaacttgttataatcatcatgcttctgttattcttgcctatttattgtgtaaatgtccaatatttcactactctccacacgttgtaatgattatcagattatttataatatttgtccaatgagaaagtctaagattgtagtcacggttgcttttccgtcttctatgcctatatattattatattacggtacaaatgcatgaaaggtattgtgtgggttcaatacgtcatttattaggtcatcaaccttggtccaatttttccagccgttgctatatgtctatattttgggccctcttgtcaagtaggatggtttatgttttaaaagtttgatagaatctattcataaaagtcaactactatctgctctgtttttacttgtcattttagatagtgacatagtcttcgttgcatatgtttcatcactactttttctatataaaagctattaaattataactatttgaaagtgtttttcatgaaaaatatatgtatgattggagggtctagttgtagatgcaagatttcagaaacatcattatattacaggcagtaacttccccgaggaaatatgtatcaactcaacaactaaaaccaaatgttgtgaaacaaactgaaaatttactcacaagaatgcagctggaaagttcaccatatgctttttagtcgcacatgctaacatgtgggccccagctctgtaaattctcatttcattccagaaccctacccccctccccctccctcgtaatcaaacagagtctactataatacttcctgtattaattttagattctagaagaatcagtagaagaaatgtatgaaatttacttttaaactgtcgattaaatggactatcgggatgtgtcgaggtcatcgagttgtgcgaggttttcatttggtttccttgagatgcatcatggtagtatatgttatttttagcaggtgttaatgtgtcataatttcttattggggatgctcataaaaatttgaccatagggtgattttgttagaatttctattgaatctcattgaatctcagactcggtatttttatatgtgggtgtgtagctttcgaggtctaagtatagatgttatatcagaacctatagtaggccaccgcacttgtgagccaagtgactacataatcgaaacatagagagtaataccaaaacacttcctttgaagagacaaaaatagttctgatcaaattaccttgtttattgggcacaaacaaatgtatttggtattttcatcctcgtagtagatatgtttcataaggttgcgcagcgatatctccctcagcttattaaatggccagacattaaacattggatccacatacttgtttaaatatgtccacacaatatcttgtatccatgaacaaggatatcgaagatcttcctgtaccaacaaaagaaacatgttaatttcctggttatttaatatttctttatgtaatatagaaaatgtttggtgttttcttaggtcaaaaaagttgtatataattttgtttttgaccgttctgatactatgtcaccggctcactgcactatttatgccagagaaagcataaataaatgaaaccacttcataatttgctaggtaacatcacaacgtaaatataccacctcaagaaaattgggttaggaaatgccatgatatagaaatttgacttgcaagttaaatacaaaatgacctctgtgctctcctcttatgcttctctttatttctgttttatcatggtggccgtatggcctacctgtaatcatcagttcgtcctcctctactgctttgtcttctccaatgtcaagccatgaagatccttagctgatctcccccatcactaactaaccttctaagttccaagcactacatgttccaacatcctcctcaatgtactcttccattccccccaatcccccaccttcaccgatccaatcaacacatcgttttttgggctatagcaagtgttcaatggcaactccagcaatatcatcaaagcagaaaaccctacaaagattgtggctatgcatattcaaacaaaagaggtttcttttgtatttcttctgttcatctgtagtgccggaaccacagagtcgtgctatcggttctcatctactcttccttgcctccagacttcactgaccagatttgcggacgccaatcttgagatatcaaatggctcgcttagagctggcaaaccgcactgttttgcaactgtattcataagatgccttatttggaacattgtttttaacttgcgaacattttcttttgataccaggcaaatttgctgttcaactggaatagaaatatgtggcaagtatatagtacagtagtattgctaattaaatgaattaaatctcaatcttcagtgaaaaaattctctactcaaccaaaattctttataatgtactcattcaactatgaaggaagtaacaaaccttggcacagcaatctctagccttcttccagtcaatctcactgtatggtatgttgtacaactcctctcttatttccaatatagttggagtgattgggccgacaaactttttcccataaagatatgccatggacatgtaaatcatacggacaaagcaccaaaatcttgctgtggaaaaagaaggctcgcttcttaggatcaaattaaaaacgagaactttattactccctctgtatatgagtcatattgcaggctcttataccagggaaaacttgttttttaactaaaatatcaataactaatttagtactacttcttgttgcacgcatttaaaacctacaaaagtagagatactaagcgcaaaaaacatttcaaaaggtgaaaaatatgtgtgctttacattcttttacaaacacttgaataaatatggcttacattttttttatatggagggaatattgatctaatgctattctattttttttgacatcaagcaaaaccactcggcggaaacgaaaaagcaggacccttgggcagaagccttagccactcgagtgcgctgacgctccctacctcctctaccttgccgccgcttgagtgcgccgccggaaaacagcacgggtgcaaagatggcggcgtggggtgatagaggcgatggtgccagctgcgttgttctcctgatccaataatcgacttatcagattcgatgtctccagggactagctccggaaggatgggtatctgcgaaggttgatggcaactctgtggttgcggccgagtgaaaaaaggatcgtggcccggtgatcaaggtgcagccaaggaactggtggtggcggggatgtctgggtttagagcagatccggttccttgacgtgcaggtgcagtggtgtcacagtgaggctatgctactcatatgtcgtccctgcagcactggtgatcgccaccatcatccctcatgctgcagcatgccatgtggagccttactaaggggaggttcgctcgtggcaacaacggtggctggggtggctgaccattacaggaccttgctggaccgttgtctcaggcggtgagtatggcggtatgtccatccttattcgttgcaatagaagggagtagcagctttgagttatgctggcatcgaggctcggtgagctggccgctggccggtgacagtcgacgcctcattggtgtgccttatcggcagagcggttttcttttctagaatttgtcgacagccaccttcttcccacccctcgaataatgattgtctctccagcagctacttctcgcaacgatgttttcttcatcataagacagggacatctagatctgcttgtagaccaatgtaagcttggcttcaattcaaggtaccggttacatcaacatctctttcatctctagatcgaccctatggattttgggtgtgtgacttttggcttttcacaactttatctttgtatggtatcgtgtctacagaaggttgcaggaagtgatgttcgtggctgattgcaattgtgctaagtttggaaggtatggtggcactgtcttggaatgaggggagcaacaacactaggggcctcgtttaggtggtgcttgttgctaattgggttgaatccctaggtctggccttagctggttgtatctggcaatggtggttttgcatccttcttgatgacattatctagagttcatagagttttcataggcgaaaacctaaagtctggtcttacttgtttagagcataacaatggcagcacgtgcacgcgtcgtcctctttttggaggcattgttttatgggagcctttgtggtcgtccaagtgtttctttggtagagtacggagatgaagtttacttgtagttgtagacttatgcatcacaatttttgtagttgtgtcgccctttttcttttcttttgtaataatgataggctatcctagctttgcagaggccgagggtggtgttagaattactgtatcctcctgacgtaatacctaagatcatgtgaaggtaaatgctattattagaccatccaccatcatttaaaaaacattcatcttaatttttgccagtaaaatcaaaataaaaggaaataaaagaattgtgagaaattcaattggaactttagattaatgcaagaagctaatgaattatgtacctggatgtattggaagaaaatgcggcaccatccataattcaggaattattgctttgtttcctgaccaatcgtatacaccaatgacctttgattacattgaagattagcttgtattactaggcccgtatatttgttcatagatcttaaaaatgtttatttggtcattctgaatatttcaattaagtagtaaatatatgtttttaagcatatgctggaaatttaaaatagggtgatcattcactaattggaaccaaggtaacaattttgattcacctctatcaaagacagctaaaaataatattttttacattatttcattgcataccgagagccatatctttgcccattgaggtgccgccgttgcgcttccatgagataaaatccacatacgcccttgggctaatgcatcgttattatgtagggcctcaccaaggagctttaatgtagcatagttcaagcatgagccaaacatggtactctggccaagaacctgtgtcccccagccgccatcttcattctataaacatgtattatacatataaacaaaattcaatttacatatttaatttaaaattctatttttattgaaattaaattgttatcaaataataacatgcctgatgattgtaaatgtatcgacatatctctcgtttatgttccaatgacaagacgacatcgagcgttcccgtaacatgcatggagaatatctgaaaaattacatcaattcacaggatgtatgaataacattttgaggattataaataggacttaggtgccatccttattcaaaatccaacaatgttcttcatggattccaaagaaagcagccacctattcaaacccaggtcaatttctttgtccaggggtgttctagttgtccttcttatttctatctctgaaacagctgaaaataatgaaatattgcaaatattgcagatagtgttctgtggcaaagaatcaatttttttatccacgggcaaacctactttttagaagtcctccagcaaataccacattttagagtgttgtgtagcaatttttccttcaacgacagatcaatatatacctttattttcaactaagaagctagcccacgtattcgcgcgggcatgtgttatgggttgcgtttaaaaaacttacatagacaaaatatcaattggatgacaccttcaatgttttataagaactatttctccaaatgtttcttcatcaacattgcttaaataacttttccaaattatttgatagcttttaaaatatataatatttaataaatccctataaaataattatctatgatctcttcattgtggagttagatttagtttgtttaaaaaacgtgtctaacaaattatgtatatattaaaaggtgttttgtcttgtttaattaaatgtttaatggtttctttaaacaaatcctaaagaactatgaaatagtatgttttatttgtaccatgaagttagccctccgtttagttggtttagattgttgcaagttgttacatataaattaacaaagacatatcgtacacctcgcttcctttttatatacatgatttatactactttttaacaagaaagtacctagttaaaatgaatccaattaaaaaatgctttttaatagtgacaaatataacttttcaaccaactacatactactattactggggtttatatatgcaataatatgtggtaaaacttataatgctatggtatatgacggatgtaagtccattaatatctaaccatttaaaaactgttataaaaatagaacatgtaatggttggtccaattttagtgaaaagtaagaaccgatttattttcaaactcattacattttttttccaaatagttcaatttagttccgattgaaattttctattttctgttttattttataccagttaaaactatagacgttatggatctttaaattgttggtgtaattatgaatacaacaatagttagaatagaaatcagatgtgtagcttgaaaattatgcattttattttttttttattatttctcgctatataaaatgtggagtagagtggagagcttcaagtcgagaggcaagtggacacgtagtgttatgttctgcgcatgtgtgggggagcaaagcggaggatttaagtgaaaaaccaatgatcccatttttgtcctcggaatttataataacctcttttttaatttttatgttgtaacgcgtggtggcttaagattttactaaagtatttcaattggttaaaaataattgatccacctatttaagtggaaactaatagtcatatgtttttcttataatttctaagcttttatttttatttaagacgtaaaacatgatgtcttaagtgtgctagagaagatatacaatgactaaggtgatataatacttattttcattttttatagtgttttgttctttttgctatctggttaccatgtaatggattgacatctatgttcaaatgatgtatttttatttttataccgtaaaataggggtaatatggatattgatttatttattcaattataaataaaaaatcaaaaatactaaaatatatataactaaaaattataatcatttagctttataattatttattatttttattaattagttataaaatttaaaagatgaattaactgaatgcaagaggagtgaaatacagagttgaagggcagagagtatgcacatattataatattttttataggttatagtgttttagttgctattactttattaactaaaaatacaataaattctttattgatttattaaaatctaacctttttactcatcctttcgtataatatattcatagtagatatttaaaatttgaacagtataaatataataatgctattttgatttattatagtgttagaacgggggagtatttttctttaacattactcagagtttaggttcatttaactttaatcattatagatctaatttaattattatcaagttatatgcgatgataaaatatatatctttgtttttatataattttataattgtttgaatcacacgcaaaattcagaaaacatagcccaaagtgacatatttcattttaaagctgaattacagtggatataaaataatccaaacatataagtggatcaaatattagtatataatttagatgttatgttgcttaattgcttaacgcaattccttttgtttttctaactaataaacattaaaatagaagaaaaaataggtgaaaaagaaaggaaagaattgagggaatagggggacgtacgtaacgtacgtatatacttgcctacaggtctaggtgcgcccagtatttgggagatgatatttttagaagataaatctaatggttataaatagtgggtccgcgaaattaaataaaaatcaacggtaagatgttttgcctttttttagaaattttaagaatttttttatttttatgccacgtggcggcttagaaacgtttgtaaatgctatgtggtggtttaggagtgtttatagtaagtttaatggacttttagtatataatagatagatagataacagatagatagatagatgaatagaataaagtgcataccaggagtggcataatgaacaagattccactgtagtcaccaggccaatgcccatcatgtgcttgcaaagtcgaatattgattaagagctcgtcgcaatgaagacaatatagtttcttcggtaacattttgattatcttcaactatgacagccgaaagatctggttgtagatgccctaatttggcatactgcagagaagagataccagttaacaaaaaggatcaactgtctgaaaagacttattagttttgtaacaaattatgcttccacgacctcagtaattcctaggccctttatatagactgaagatttttttcttataaaaactcggaccttattgggccaaaactaagaggtcataagataagacactatcaatcccatgcatttgagtactctatcgatatttatatggactatctatatttatgtcgccgtatttttcatgaaaaaatagtcaacacactactagaaaacatcaaataggtgtcgacacttatnnnnnnnnnnnnnnnnnnnnnnnnnacctacatataggcactgagtccctattctgcagtagtgtatttacgatgtaaatatcaacaggtctgatacttgagtgcatgcaatgagaagaaaaaaatatcaacaaattaagttctgcagtagaccactaatccactgacctagggatgaaaacggagcagatacggacggataacgctcataccatattcgtttttatatttttttaccagatacgaaaatgaatacggatagctcgaatacagaaacaaatacggattatctcgattacgaataagaatcgaatatgatcggacacgaatacggaaacaattttttctcggaacacgaaaaccaactcagcttctaatagaaacaaatatcaacatatataattagctcattttatataaaatgaagtataatttataaatattttttacaatttaaataatattaatacggtaaatctaattggagaggcctctccagttagtcttaaccagagacacccacgtgctagtacttttaggagttttggttgctattagtatatccaatagtgcatatcttagttttcttcttatagaattttgtcttaaactagttatccaatctacaatctgattataccattacgttcgttgcaattaaatctttacaacaagatcttacatgattgtattacgataaaaaaatatttatatttataaattacttttattatatacgtaagttacttttatcatatatatataagttacttttagatttgactaaattacttctatacattcataatactctaagttgattatttttattattgtttttagttaattctatattttgtggactttataaatcttctatacactttacttgcgaatttactctacatagtttcttatttcagctcactcacaatttaattatttgggcccctaattatttctactacagagagtaaaattactccctccgtttcataacgtaagtcattctagcattgcccacattcatatagatgttaatgaatctagacatagaaaagttacattatgaaacggaggaagtacttctattgcataactaagttacttctgttgcatataattacttctactacagaaagttatttctattacatagctaagttacttctattgtatagctaagttacttctacaatttaaatacattacttttaaattaataaaatatttgaatatatccaatatggatcttgcattgtcacatattttatgtagagtataacgatgcaaatatatcttgaaaataatacatgatttaaaatatataagttattaaagagcttaaatctaaaattaatttatatatatgataaaactaacttacatatataatagaagtaacttacatataataaaatttacaacatacatatattttttatcagaatataatcatataagatcttgttgtaaagatttaattgcaacgaacacaacagtataatcagattataaatcggataagtaatttaagagaaacttctctaagaggaaaaaaaatacatagatattgagtgtactagtagcttttttttttttgaaagaagggtgtctctctttagcactatccagctagcactctcagtgtagttgtgtccattttaatagtatagactaatgttaagagataaactactattaaaatctataaaggtatattgaaggaaacctcgataccataaccatattcgtatccgtatccgaactatccgagaattatccagtccaagaggtatctgttttcgtttttgtccggagcggacggaaactatatggtccgttttcatccctacactgacctataacttgtagttacgcgtaatataattaattataatagcacgaatcctatgaccgatccaacggcacaaaaactgactgtaaccaaccagaaaatgtgtcaccaaaaatttagcaaaaccgtatttatatttaccacaaaaaattttataaaaaagaataccactaaaagcgctacaacggaacacctttaatttggagcccacacttctctgccggttgacaaaagtttactccgtatcgatcactgccggttcaatatgctacagtttagaccttggtttatgaagggataatttaaatacaacattattttctgcctgatggaaatccaaataaatcactatatttttttttactgggatctatgtttaccttctgaccaaccgatccgacactacctaaaaaagcatttttctatctggccaaaccctatttttccatgtggttgggacgcctgtatgccccaaaaggtctccaaaaattgcgatttttccatgcagttaccacatctgcatacgaaaatccgggtgctcatgtgtgccacgtgaaaaaataaaattccccaaagaaaaaaacacctcaaaattgaaaaacagaaaccctagctagcctggtgccggccactaccttcccgccgtggccactcctgaggtcgtgggtggtggatccgcccgcccctgcagctcgccgctaccgccaccgctccttcggtcaaagggcatggatctgctcgccgccattgctcccgttgttgggggagggggtacggtggatctgcccgctcccattgtcctgaggttacccatcaccgagcacccgagatagccgccgttgtcgctgcctaccaccaaggccatcaaggggctgagcccaaggaagccgaagccgcccgctgcctgccaccggccacacccactgcccaccggccgctagccactgagagagagggagaggaggtgagacagagaggagaggaggactgagaagataaggttggacttagaagaaaatgtaatgtgttgagaaggaaagtggaggcaagttaggcggatccataagagatccgtctacgaaaatatattattgcatgtggcacttaagaggtccgcctgtaaaaataggctaactttcgcatgcagctacttaagtggttcgtatgtgaaaactaatttttgcatctggacatcttaaggagccgtatgtgaaaatggaggtcgattttatagacgcggctacttatggtccatctgcatccaaattaacgaaggtctcgtccagaaaaattattttttaagtagtgcaagataatttttttattacacatttactgttcttgacatatatctgtctgcagaaaatgtttttattagaaacatacatattcagttagatatatcatttgtagtaatatctaggaatgtacaaatttcttaattgtactattaggggggaagaggagttccaaaacccggctcagatcggctagcttgaggccttgttaagtttgcgaaaaaaaaattttaggtgtcacatcatcggacatttgaccatatgtcggaagtggttttcggagacgaatgaaaaaactaatttcataactcggctggaaaccaagagacgaatctttggagtctaattaatccgtcactagcacatgtgggttactgtaacacttatggctaatcatagactaattaggctcaaaagattcgtctcgcgattttcatgcaaactgtgcaattaatttttcttgttatctatattcaatgctttatgtatgtttctagagattcgatgtgatgtttttgtaaaaaaaaattaggagctaaaccgggccttaacaagccaagacgagacagctattttgctcgttgagctacgagccgatcctgatcctgagccagttcacgagctacttgttaggctcgttatactcgttatttcagtttcatgtcagtttcgcatttgccactcccgcatcccaatcagatggcccagcccagtacagtaggccagtagaaagctccccatcgtcctcaataggtctgttgaaaaagctcgagacctattaggctactttaagagcatctccaatagtctctctatcggtctctccaagtcaaattttaaccatttaagtaaaaaaagagatccaacagactggccaaccgaatggccaagccatccagctgaccaaactcgctcgctggctggctagatttggctagtcaaaacgcctgccaacacatcgatcggtcggcgcggctggtgtactcctcgcgaggtcggagtgggcgccgtcgtcgtcgtcggggtcgtcatctaggtcgtcgtcggggtcgttgtcgaggtcgtcgggggcgccgtcgtcgtcatcagggtcatcgtcgaggtcatcttcgaggtcgttgtcggggtcatcctcgaggtcgttgccacgagccaccaccgccatcgcaatccccgccctgtgctccgccgcctcccgcctccccatgccgccgccgccatctccatccccgccccaagctccgtcgcctcccacctccccgcgccacctcccgcctccctccagcgtggtcgtcgcctcgaccggaaggaaggaatggggaaaaaggaaagagaaagaagaagggggagagggagagagaagaagaggggagagtggctgatatgtgggtccgattttattttggagagaattaatagagagtctgttggagtaaatatctagtttaactagccaaatcagatgaagagttggctatattagcgtttgaagagttcgatttagagaggctgttggagatgctctaacttggctcctattaggctaagcttgagctggatttgaacttcaaatgagccaagctcgagcttatcttctgactcactccatcaaaccacatggtcacacgtgtcttcatttgttgtttcacactagctagcctactgcaattaacaatccagcacaagcacaatatcgaataaatatttggtgttcttttcttattaagatataaaattttcatcgatttctgttagcacgctttttaatttactaaacggtatgtttcgtgcgaaaactttttatatacaagttattctaaaataccaaataaacccatttttcaaattttcaataattaaaaataaattaatcaagttaatagctttctcgttttacgtaccctttcttcatcttcattagatcccaactaaatgttttataagcaaatcttcattagcaaagtagactttgcccaatggcaatcactttttccctgaaggagtcaggagtgcatggcatgcatagttgacttgtagtaggaggagtacagtagcaaaccttgagaaaaactcaaagctcgaacgggctgagtcggagcccaacataaagctcaagatttgatgaggcccgagtcgagtccatacaaagctcgagcctggctgggcaggctcgatcaagttgataatcctactccctattccctaacagtacacaaccttagtcgcacgtacgcacgcaagaagctagggcccacgagacacgtcacgtcggtcgtgcgagtgggagaacgccacgtttcgcgccccagctctcctgtgccgccggccactactcccagagtctcgctgtcccctgatagactgccccgtcgcctcccagtcccatgcgcccctactcctcccgtaggggctcttctgcagggtcgcgccactgaccatgcaagtgaatatagtctcgtcacccgtataaaaaatatgtttgttagtttattttaaactcccttcatactcataaagaaagttgtttagcacaatgtttaaatcaaacattgggaataaatcataaataactcttaagttattgggtttgaaaatataaaaataatataaatagatttatcttgaaaaatacttttataaaagtatacatatatcacttttaaataaatatttttacagaaacatatatcacttttcaataaatatttttatagaaataacaagttaaagttgtgttttggagaccgtatcgctgtcgactttctttacgagtacggagggagtatatagcagtacaaaatttagaagaaaaagttaattagaaataggacaagtagacaaacaaagcccgcttgtctcgtcccgcttgcatccctacgcgccacttccatgcgccgcctcagcactgcaggctaacgctgccctttatgccctcaggcccttagcaccacactgcatggtttggaatgccggttggcatgcgtgaagtccaagaaccgcagcaaggggaagaactcgtcagcgacatctctaaggctttgtttggtaaatgagattggaaaataatatcccaccctccaaagagcaatattgcatcatatctattcattcctcacaccttatttaatcctacccattaatccatttccctttttcaatcccacctcccatatcccatttgccaaacacactctaaattctaagtgcttagtgctctctatatcctaagtggttgcactgactggatgagtggactataacatagtgctttctagattcttatgatgtttgatcctatctcattgctttattccttctaacatcattactagctactgcggcatgatgtattcttggtgtggatgtagtggatcatattaattaattaacaggattgcacaagggttcaaaggagtcaattcgatcgttaactagctaattaaataagctcaactagccagttcactgagctgagccaagttggcatttcacctcgttatatatactcttaatgagccgagccggctcgttataacgatttagaccgagccgagcttattcagacaagctatcctatctagtacaggaatgatttttctggatggcaggcattttaaattgtagacggatcgtaagtggtcgcgtctgtagaaatcgtgctccattatcccgtgcggctctctaaaatgaccgcaccgaaaaattaattttcacaaccgggcatatattatgatgtggaccttgttaatgacccgcacatgaaaataccacccacattttaatctcgacatctgcgccccacacccacactctccctctcagatcccgtctcctcccgtctcactctcgcacgactcctccctctccctatccctctcctcgtcccactccttcctctccctatccctctcctcgtcccactcctcccatctcccggcgatggcctcggctagggcggcggaggtagcggcatcggttagagcggccgaggcggcatcggccagtgtggcaagcgggaggccgaatccgtcgcctgctaccgcggggatgccggatccgtcgccggccactacggggactactgcagcgggcctcaggcaaggcggcgatgatgacggtggtgacggcaacgacgaagtctagattagggttccaggaggcttttgatttttttttcgattttttattttcccgtgcgggcggtttaagcgcccgcatgcgagattttcgtagacacctcgttctagacgggtggaagatctgcacacaaaaatcaattccaaccgcacggaaaaatcgttattgtactagtgccatccttatctatatcattaatattttatatcatgactgaattactttcataaataataagaaaattatagaaacattttaatagataattaccaagttgaatatgataagttgtcgtagcaatcaaacattcctgtttaatattttatattggtagtcttgacaatatataactcatggattcttcatccggtcagtcttttactggattccgtaatattagaattagatattaggtggtcatgcttaggataatagttgatatcaagatcagtcccataaaaaaaagaggttgatatcaagagattacaaagctcacacttacgactgtaccaccacagcacaccagtagtattaaggaagtaaaacggaccaaagcgttaaaaacaaaatttgttaattaataactaacgtgcctgcatccgcatgaggaggtcctgtgactccttcctctggaagcggtggcgggtgaagtcgcggcgcagcctcgccacctcggcgcgctcctccggcgtgccggcgtcgggatcgaactcccacactgccctgcctaggaagccgttgcccgtgtgcagcagcgggctgctgccgctgccgccgccgctctccgccgcgatcttcagccgccacatgcttgcctacttgcttttgctttattttaccagtggtactgcttggtgaacaaattaaggagcttgcacttgctagggtacgatgtctatcttatatagtagaagccgaacgagtgcaggccacaccatccacctaccttaccattttttttctcagtagggtagtgtcgtgggtgtttatgtgaacatgtacgatcatttattgtactctacatttgaaaactggaacggaatatatatcttgtgactggtaaagtcaccataagcgaggcctatgaacacaaacatacacacctaactatataagcaccgtactaactatataagtaccatacatctgaagattgagccatcatatcttgagagttatagtagatgccttgctaatagcggtacaccgattcactgaaaaaaaataaataaccttaaatacgagcatttgtgccaagtatagaatttgaatcagcatgaatagttttcaccagcagaaatctagctaaccagttaagccacactgatcacttcgcaacctttattttaaatagcacctatcttaattcattgcttcgatgaatagtacgatggtgtggtctctgaaacgtgctacccactaggcgtttgtatgtactattgatggtagatgataacaacaagccgaattgatgttgatttaaggaaataggataaacctggtctctacgtggttcgatgtagacgggcaactgatgaattgtagttgaaggctctcttcatgttctaccaaatttattgcgtttatattttgatttcgactaaggcctgtttagttcccaaaacaaaatttttcatgctgacacatcgaatatttggacacatacatggagtattaaatgtagaaaaaaaaccaattacacagactgcatgtaaattgtgagatgaatctttataaactaattgtgccatgattcgataatgtggtgctacagtaaatatttgctaatgacggattaattaggcttaataaatttgtctcgcagttttctggcggattctataatttgttttgttattggactacgtttaatactttaaatgtgtttccgtatatccgatgtgacaaccaaacccaaaacttttccccaactaaacgggcctgatctcacctaaaaattgttaccatgtcaaatcaaacgtctaaacacctacatgaagtattaaatataggctaaaaaataactaattatataaattacgactaatttgtgagacgaatcttttaagcctatttgctccatgatttgacaatgtgttatgtgctacagtgtatatttgctaatgacagattaattaggcttaataaatttgtctcttggtttactgatggattatgtaattaatttttttattagtgtccgaacactcccatgcgacaccctatataatactcgatttgacatgctaaaacttacacccctggatctaaacaccgcctatgtactgatgaattgtagttgaaggatctcttcatgttctaccaagtttgcattccaaggcatatgtctcacgtgtacaacaatactccccttctattccaaaggcatgcaattgcgtacttacacacatctatatggattgtctacagattaccataagtgcgaggaaagttaagagactcgggaatggcttctataatcaacgttggcaccgcgccttgccgtaggttatgtagttttatcgtcatgtttcaaatggttagatgcaactacaaaatatatgataatatggctttatataaacccaatgttattacaatgcaattcatgctttatttttcaaagtgttattatgtattgttataatatgtgaatattatattgatgtgcaatatgggtatcttgcaactagatagtttgcatctatatctacttctctcaggcttgctctgaaaatggtttcaagtaacgatacataattgttacatgctatttaatcacgtataataaaccaaaactaacattttaaacaataatttgagttgtatttagaaaaaaagttaagcattattttggaagagaaaaaacatgacgctctgtgtaaaataggaatgtgaatgtacgactaatatatgattaatttagatggataggtagctgcttgaactaacggttgttatctttatacaaatatgatctaatggcttaaaactatatatcgatgatgtggatttttacatgtcttgctttataagagtaaatgtattttagtgggtatcaactatacgggct

SEQ ID NO: 76842 - DNA, 607 bp, Oryza sativa
ttcggaagatccgctcttcgtggaagttgaagccggcgtttgggaaagcgagcaaggcaagtcacatcatccttgaacatattaaatcccagtttataaaattattttgatttaaattattgcattgtcgctttatttaaattcccgcgttatcactgttttatttagccatgcctatttacctttgttatgaccttattattattgttattgttattattaccttgttcaccctagattaaacaaaaccccaactagtggatactctacttacggtaccactagtatgattttaggtagatgcttcgctgtttaattaggtaacattaggtggttttacaactctagactttgggatattctcatcacctggacactttggaattgttggattattgtggaattggattcacaccgccccctctattcaaaacccccaaaatggttttaggctgggctcggggtgcatggtttggatagtagcacctcggccatataaggaccggtcttcgggcctctgttgcaaagcactaccgtactttcacatgtctagtgggtaaggcttagtttgtggctcattctggttataaacaaaagtacacggatg

SEQ ID NO: 76843 - DNA, 795 bp, Oryza sativa
acacaagatggctatgtactgtacaacttattggtaaattcgccataaaggcaacatcatctagagaaagtttgaggagctctttgttgtccaccaaatggaggagttgttctatgtttttttttctctagttgttcagaatgcaattgggaatgggtataatctgtgcaaccaatcatgcagaatgttatccttgagcttggtgttgtggcctgcaacctcctggtccatttccatagctggggttatggtagcctggtttgttgccagagcctgatggaccatttgatcttccaggatgtccgtagtgatggtgatggtgttcttgccctggatgcagaactggacgccaagggccagggggagcaaaattgctaggtggcctcacgtgtcctgaagttgcaggaagattggccattaaatcaaatgttgttcatcaggaaaagtaccatttttgtttccatggtttcacggggaatgaaaattacctggagtaaatggaggacaaggatgtggaggagcatgacgaggaaatgggccttgatttgcatggaacggaggacgccaaggatataagtcttgacctgcaaatggaggacaacgccgaggaaagaagccttgatttggtagtacaggtggaggatgccgaggaacgaagccttgaccagctaatgcaggaggaggacaccgaggagcaaggccttgatcttctagtacaggaggaggaagccgaggaacataaccttgatctgctagtacaggaggatgccgagctgctaaccgttgatccccttg

SEQ ID NO: 76844 - DNA, 1507 bp, Oryza sativa
ttgccgtcgtttcctcccgcgccggccgaaccccggtgagaactccctctctcttcctcccgcgcgcgccgccgctccccgcatgcgtgtcgccgcgatgcaccgtcgcccgcgtcgccggccgctgttgtcttctcgccggccgccgccgtcggaggccgcttgccgccgccgccctcgccataaccggccggccggcttgaagccgagccgagccaggccgctttcccccccccccttgtgacgctgcccggtgggtcccgcctgccagccgcccctctccctctctcctgtgcctctgtcccgtgggtcccgcatgtcggcgccgccccaccccttgctgacgtcagccctgggatgaattattgcgcaataaattgattaagggtttttcttttatagtaataaacacagtgaatcttctaaaattcataactaattcatccgagctccgattaatcccattcaagtctcagtaaattcataaaaatgtgtagaatccattaaaaatggttttgcttcctgtttcagtagtcttatagcatgttttgcttgtgtgctttgtttgtcgcgtagatttcgcccgtttcgtcgattcgtggtttcgcgaagacgttgctgtggttccatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccatatgccattgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatacgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactgattagtttaggtggtggtttgggcctgttgcaacgtggtgtaacgttggaca

SEQ ID NO: 76845 - DNA, 1299 bp, Oryza sativa
tttggtttggtgatctgaggatggacgccggcgatgaggaagaacatggttcgctcgtctgaacggtgggttatttacccaccttgcagattttaaaagtagtctgagccgatgcaaatttcctctggattcatcgttttccttgatgagttactggctttacagttttagaccttaaaaatcctttgttttcacttatgtttctgtccagtgaaatctctccgttgggatattcagttgcagtgatgagtatctcttttttcgagagcaggtctcgatctgcttgatgagtctgggaaataatcaccttatttcctcctgagcggttacctgagcaactcttagcaccatccaaactctttggagtttccccaacacatctgacttttcttggaatacaattttttttttttgctttcttagcttcttgtttgtctcactttgctgatttaatagattaacgtttgcatataatctcaattttcaggttcattttcaactgcaaattcagaatgtacttaaaaacatcattacgcaagagacacaaactctctagaatggcacacatatcattacatcaagtttagtagaaagctacatcatatgattgaggaccaacacttaacctgcgattgcaagttgccctcaaacaagatcagggcaacgcaagcaacgaaggagatggcaaaaaacacatcccccgacaagttacaatgttcagctacagcagcatccacagatgacacttatgacagatgcatcatctgcttggcacaagacaaccataaggtcgaagaaacttgcaagagcaatgaagaacggtgtgtatggaagagagctatgattgatatgttaggaggcttgatcattcgtcggtctctctggcaggtgattctcctgctccaagaaacggacgacgaggcaggtgatgttgtctgcgcttcccctctgtgaggcctcctggaggagcttctttgcagcctgctctgaatccagaattggcttcaccatggccacagcttcctgggatcacacgagaatacatgttattgcttcatttttttcacaagagaacacatgttattacttgcatttcatataggagattttgagaaattaaaaatacatttcagataggagatttggagattgaaaaaacatgtcattagtactttattactggcttcagacttcagagttcagaaacatgcatttcagagaggagatttggataaattaaaatgattcagagatcagaaacatgcatttcagaaagatatttggagaaattaaaatgat

SEQ ID NO: 76846 - DNA, 12385 bp, Oryza sativa
aagcagccgcccatggcgacacggccgtcgccgcggtcgcgagacagcgcgcggccgaaaagcacaagcgggaggcctccgtcgagcccgcgaagctccgacaccacccgccgctcctccttcaccgccgcctcgtcgtccgacaagccggtgccgtccttcctccgccccaccgtgagctcgtccctgcacagctcgtcttcgtcatcgccgtcgtcgtcgtcgttgttgtcgtcgtctccctcctccaagggcaccggcaccacgccgaggaggtccgcggacaaggccccgtctgcgtctgcagcttcgtcgcggccgatcacgcccaaggacaaggcccccgctgtagcgacgtcgcggccgatcacgcccaaagacaaggccaaggcggcggcggcgtcgacgtcgcgatggtccgcggtgtcgccgaggcagctgatgcagaaggcgtccaatgcctttacaagaggcagcagcagcaagtcgcgcgctgccaagaaagacaaggaggcggccaccccggcggcgacctcggccgccgccaaggacgcggccactccggcgtcgacctcggccgtccgcaagaaggccgccacaccggcgacctcggcggctggaaaggcggtggccggtgcttcgcccgggccgacgagagcccagcccacggaggagcaccaccagcaacccactgaagcgccgccggccgaaccgtcacctgccgccgccgcggtgcaagaagaggcggtgacttcgagagcccagctcacggaggagcaccaccagcaaccacctgaagcgcccgccgagccgtcacctgccgccgtcgccgtgcaagaagaagcagcggctgcggagaccgaagcagagcaagaaaaacaaccggatgagacgccgcaagaagtcgtcgcggcagtggaggagaaagttcaagacgagcaggttagcacggaagcagcggaggaagccatcgccgtcgaggaggatgccgccgccgtgaagaccgatgcgccggagccggaagagacgcagacgcaaaccggtgccattgcagagtcggaaacagagtttcagaggagttcagaggatgagccggcatccgacgccattgtcgaagaagcggcgatcgaatctgcaacgcagaatgagccagatgaaccagaatccaccacggttgaagagatggccgtcgaggaggagatcaagaccgatgagagccaacaagaagagacgccaaaaccagaagagagaatggagaactctgaaacaagcgtgatctctgaagatccaaaagaaatggatgcaatctctgaagaccaaaaggtggaagaacccgtggttgctgaagaacaagaggaactctccgaggttgtaaaaatggctgtcgagccgagcatctcgtcagagccagcaacgccgctggaggaagaagatcgcgacgacgtggagacggagcaagcgaactcgtcggagcccgcaacgacggtggaggaagaagaagatcgcgacgacgtggagacggagcaagcgagctcgtcagaccccgcaacgccgttgaacgaagaagctatcaacgaggagggcacgtcgacggagacggggaagacgaagaaggtggcgttcaaggggagcaaggtgaagacggcgatggagaggcggccggagggggagcagccgaggaagaaggacgtggcgcggagcaacgacgtgatcgaggagaccaagaggacgctgatgatgaagaggaagagcaaggtgaaggcgctggttggggcgttcgagacggtcatggacacccccagcccgggaaaatcgagctgattttgatttggatttttttttctttttttttggagggaaagcttcagcggtgatgcacgtattgagtggtttgaattgaactgcgaggtgtgctttgtggtgtgatgtttcggtttcttgttctctttgttgcattgatcgttgattgattcttctgataactgaaacaaatggaaatgttattgtcgatttgtttgtttgttgatcattcgatctagtgttgtttactaggcttagttgtatgtaactaaaaagggaaatagctgtgtgttcttgagagctgagactggtgtggttgtcaacttgtgctacattgctgagttttgagatttatgcttgtaaacaattattgatgacatgcaatccattttgtacgttttttacatgttcatggatatggatttctttatagtacatgccctcatttcatacatgaaatttgaatatttattgaaaataactaaagaaatgatgatatcatctaccctctctgctccaaaatataaacactagttgaaataccaaaaatataataacttccaatactattgatctcatcaatcacctttcatttaattctttttctgatcttacctctaaccattccgataacaaagtatttttcttgttaggtttactctcagttaatttttttttaataatggaatagaacatcatcctcaacaagctacaaccaattattacatccaaacactcaaagtgagtgtagtctctgttaaataacctagagattattatattttgaaatgaaaggaagtaccattgtatcgtactccctccgtcctacaatataagggattttgagtttttgcagcgtttgaccactcgtcatattcaaaaattttttgcaaatataaaaaacgaaaaagttgtgcttaaagtactgtggataataaaataagtcacaaataataatttaaaatttttttgaataagacaagtggtcaaacgttgcaagcaaaaacttaaaatcccttataatctgggacggagggagtaccaaatttcattttagtagtgtaccaatattacaggcaaaaatacaatgtcggagcctcggaggccactagggtttagataaaagaatatttaccaaaatgcattttatggccagtagggttgagatcatctcaccacaaaatttccgacatagtatacaggcataatctcaacttctcaagattacaggtacacatccgaatcacacaaacggaagaagcgtcatacagaggaggaggagatcgtcgtgccagtcttcagctgagctcgaggaagcgccgtgccatggggtgcttggcctcggacagctccgacggcgggagcacctcgacgacctcgccggcgacgaggaggcagaccaggtcggcgatccgctggatctgcttcacgctgtgcgacaccatcaccgtggtgagccccctcgtcttcttcagccgcacgatcgcctcctcgatgttctgcgtcgagatgggatccaacgcgctcgtcggctcatccagcagaagcacctgcacacacactccaacatcagaatccgatcctgaatccgaaacaccaagatgcgtcgcgttgcaatcagcgaaaaggctgaataatccaacatgcctccggatcgttggcgagggtgcgagccaatgcgacgcgctgcgcctggccgacggagagctcggaggcgggcttggagcagagagcagggtccaggtcggcgaggctcagtaggctctgcacctcggcgtccgtcagcttcttgccctgcagctgtggcccgtatcgcacgttgtcagccacggttcctggcacaagtgtcagaccacttcagtttttttgcatgagaaatatcaaatactcctgtcaaatctgtgtttggtgcattgagcttttgcatctggggggatatatacttgagccatgtgcctcaaatgagaaaaataggactcaatggggaaatggagtgtgccagagtagatcggatctgttgaatcaattttaacttggaataaaaaattaaaattatagctttggaaaacctggcatattaagggtgtgttcttaactacaatttttaagctgttccaatttttactctcttttttacgtgcacgtttcctaaactgcgaaacgatatgtttttttgtaaaaaaaaattctatggaaaggttgctttggaaaattgcgttaatttattattcaatttctttagttaatacttaattaattaggtgctaatgagtcattttgttgtgtgtgctatagaggaagtgtttccaaaatgcaccttcaaacacaaccttagggagcttcgggtagttgtagtttctcccacaataaaaatacttttcaaaatagtttttatcttcaaattaaaatgagttgtagttgtagaatgaaaaaataaactagagcagaagctaggtttttccaaatttctacatattctcaccagccgaatccttacctgttgcttcttagaatttaagctcccctaaacaatcccacggagtcttatgaaatttgactttttaaaacttctttttgtcatgaatcatatgaaatttgaccgttttttactttttttttctagataatatattgaacgccctctgttattttgcttagaataagtccccctgtcgcattgaaacgtcagccacgagcttggaagattctagttactgtaggttactcatcgccacgttggtagaggcgtaccaattgacatgcatgtcccactcaactgacgttagcaagcagtgacatcttctaagaaaaaaaatatttgaagcaagattccacttacgttggtagacaaattaagcatccattttatcaagtacattgcactagctttagaccttgtttaagcctctaataatcagttgacgagtagcgagtagataagaatttggaaaagttaagtttcacaacttctagtttctagtattttttaaaaatattttgtatctactacctccgtctcagaatgtaacaaactaagatggatttaatctcatactagaaatacgaatgttcagattcacagtcgtctcatcctaggttgaaatattctggcaaactgaggagtatcaattatcagaatttaggttagaatctgaactatttaagggagctataaagtctagaagaagttacaactagcaaaagctctcatgtatttggccttagcgtaaaaactctttcaactaaaagtacccgtcctctagtgtaaaagttcactgcaagttgaaaattgatgcggtttcttaggtagaaaaaaacttatcacccatttctaggaaacaagacgagggcaaaaaagtgctcaacttggttttatctgtttatcaaatgctataactcggctttcatttgttaggttttgactgcgacattggtacattttatcattatttcccccttattataacttattattgacacaactaggctaatcaatcgtaagagtggcgaatagttaattattcatatgaaaaatgccaaacctagttgtctgttgatcgtctaaaacttactcgttactgtttttttttttggacaggatcttggtaatctcaaatcaagttcttgtttatttttgaaggaaaagcatctttttgcagagaagaacatttaaatttggaaaaggtaccgcattcatggaatccatgtacagtttcttccaggatcggatcaccgtgcgtatgtgcagtgtgtgtggacagcggcgggcgtacgtacttaccgtcgaacatggcggggagctggaagagcatgccgaccttccggcggagcgcgaggacctcgatgccgcagatgtcgacgccgtcgaggagcacggcgcccggcgcgggctcccagaggcggttgagcgcgcggagcagcgtggacttgccgctgccgctggggccgatgacgccgacgaccaccccgcgcggcacgtccaggtcgacgccccgcaggatctcctcgcctctcgcctccgaccgccgcgtcagcccccgcacccgtatcttcggccccgccgccgccgccgccccttcttccccgacgccgtccacgtccagcaggtgctccctgacatcatgctcttcaaattcgatcgttgatcacacgcacatgtcgtcagcacgtacactggaacacgaagctgacgcacaagagacgacgaggtgtactcgctcacctgaagctgagcccatcggagagacagcggagaggtcgagaggaagacgaaggtgaggggggatcgaagtgggaatccgggcaatgcgcatcgtcttttttattggctttttgccaacttttcccggctccaactgaggtgggcggcttttggagcacgcgtgaacggtgccattcggtggcggccgctggttgcaagcaagggcagcgaagcttggactcgtgtcgtggtgaagggaaagtcccagacgacgcatggcttatcgccgtggtcggtttggacccttgtcgatctacacagtgatcaccaacaatagatgcaatacactgatacagtatcaagtactcgcagcaatgttgctgacagttgccgtggatctgtgtgggaaatacaagattcggttgctagctcttaccccagaaaacaccaggaccagataagcacatcggcaacttggtgttggtgatgaaaagtttggagaggttatatcgcgagcggtgtccgtggttatcaccggtacgacggaaacgtacgcaggattttccgcgtggaccgtgtgcgcggtcatggatagctacgccaccaggcgacgcccgcaccgagacgcacatgcaggttcctctcgtcgtgacaccaagcgtgtgggacgtccgctatctccatatgggcttctgtcaattcgtgtcccatgtaaggcccgcaaagagaactccaattgaacgtttctatgggctgtaccggacggggccttctgtccattccttctctttcacatatcttgacagatcaggccttcaggcccagttctatcccttctccatggcccaaaagctaactgctaatctgatgcccttgctggtcccctgtcattagctttggctccacataccacagcacacatgcgcaaccctagaaactggcagctttgtgttccggaaaaatacaaatggtttacgctggattgattatccaagtcactatctctaactaggaaaaaggaagcgggattatcattatccagatgctatcttgtcagcatcacaccgctatccaacatggcaccattattgaacggaatcagttgttagtaggttgagtcacgattggatggtcaatgccgtaattgctatagctagctagtcctactccagctcgctagttgagctggcgtctttcttggcactgcagtttgatgcaatgttgcacgatggctcaacagtgaaactaatcagcagccactagtatagttctctcccatctcatcaatcattgaaccgtgcaaacagtttcacagcacaacgttacatatagaaacagacggcttgcatgcatgatttcagtccatagctagcttagttatagctactacgagtagtagtactactattgctaccatccggtcctcctagcaagcttgatcggctgagaacatcgtcgtcggtggtcctccaagtctctatcagagaaacccttacaactatcacatcgccagattgacgacgggagacgtgcatgttcaccatcgggtagtagtagcagccgatcgttgaaaggaacagtgcacgtgatgtgatggtctctagctgaactctgaagattaggcagatatactgtagtacatagggtgtcagggaatgctttgcccgttttaaattcagatgaaaacggcaaatgtcagtaacaaccaatagtaagttgtttaaccacaaaggattatgaggaggagtgtccttgacagtggcaacgggtagtacgctgctttcatccgaggcagggtgaataaaaaagcgagagagaactcaagtgcagagaagaacacgatgtacaatcatccagtcggagagccattgattgttcgtcacgagaaacatgtcggctgtacaacaacctctgaggcagtgaacgcagcgttccctgtctaccaccccagaaaaaaaagagagagatactagtacttgaatgcttctgcttcgtgcacaccatacaaaaagtgcatcctctggcaccggataccgtatcgatccagtgatcatcactggatgtcacgaggagacgaactgtgccgaatcatgatcaatgtttttttcgtacgttaccaacacacttcatcaatttttcagatggagaacacgagtagcagtagtacgtgcaaaattctggttcacttccatgtgctcacgggccgtgatcacagggcgcggtgctgatgcgaatcagatcgctgctgccgtgttttgctcgcgctcgcatacgaggtacagcggccatcgcccgcctagtagtgacaaaaagagaaggcgactgccacgcccatacacctccgttgcagacgcaccgctgtgccgctgtgtgctcgcctgcccgagaaacgtacttaaaaaaacggcacgaaaaaccagccgagtacgatggaatcagggagcattcagccatgtcaggaaaccgatttcgtcacggccaaataaacgggatggatgaaaaaacactcgagtaaacacacgaagcgaaatgaacacgggtttacctacggcaccaatgataatgttggtagaaactttctttttacagtggagtgagctcgagtgatgagagagcaaacaagaagaaatggacgcgtggtaacctagccgttgaggcgtgggagtagtggtaggttggggagaagcatacgggccaggagagcacgaggccacgacggtgttgctttcaatgccgcaacatgacgggcaagtacgaggcaagtgtgcggccgccgattgctcctcccacatgtgccactgatagtactactgccactacgctagaatgcaaaacggaaccgagtctagcaacacgacgcaacaaaaaaaccaagaggatagtagatgagaaatgcgagatgggctttagctgctttactaactgagccattgcccgggagatgctttgcaacaggttacaccaaaaagttgcagcgcttttcctcttacacagacaagaattttacacgcatacgaccagctttttttttctttttctctcttgtgtagcatgggctggttgcctggttccctcgtcccccgacccggccgacgcgacgcgccaaaagcccttgtcagcgcacggcgccgcagaagatccacggcgcattgggctacgacgccttcgccggcgccatatgcgggccgtagccgatcgatccaggccgcccgaattcaggaagaaaccagcacctttgcctcgagatccccgcggaaagcaacataccatcaccaccaccatcttatctctctctagcggcgcggctcccgaggcgggcatggcatggactcatcttgcagtcttgtgccccagctgcgtgtaattaccatggtgcccatcacgtgagccacgggttcgggcatagggtgccgtggtttacgtggaagtggcgggggcagtatggggagagaaaaaattgggagcctttttccgggctgcgaagtgggccccgcggaacagcggcctaggtgctagggccgttaagggcgggcgggccccgggcccaccagctcgagcccggccaccgacgcgcgccggctcgtggctcgccgctggcgcggatgggagggagccggctcacgccggcgagctccgataggctcctcgcgctgattacgctcctgccgttgccggagtggacggcggcggagcaggagtaccggccggcctccgtcaccagcatctccgaccggacgaacatcagatcggatggtcgcacctcgctccaccgctgcttcgccgccggtgccgtctcgtcctcgcagccaccggcggtgctcaccaggatgcggtgcccgaaccgccggtcgtaggcttccgggtcaggctccgccaccgcggccgccggctccatcaacagcaccctgtccttgcgaaccttggcggcctcgaagcatcccaccaccgcaccgccgtcgcctccgacgagatcggccgaccggcgtgaggcagggccaaccctccctggcgcccgtaccgaccccgtcgagtgccggccggagaagaagcctctaaacgctggagacggagcaggagcagcaggagctaagctcgcctccttgtccttggccgtagcagccgccgccgccgccgccaccttcgtctccggcggatcagggggccccgtggtggacggctttggcggctccgggaggagcaggacgtcctcggggtcgacgcgggagcggcacagcgggcacgtcgagtgcgcgtccagccacgtatccacgcactcgacgtggaacccatggcggcatttcggcagcagccggagcgcctccgtcggctcgaaccggccgaggcacaccgcgcactcgagcccagccttctgcccacggagcgcgccgaaccggaacaccggcagcgactccaccacggcgcggtcgacgccggagttccgccgctcgcccgccccgcccccaccggacgacccgaacgcgccgccgctcccgtacgggcccgacgactccgcggcgttccgcttgcagtgcttcgcgtacagcagcagcaggaacgtgatggagaacacgctcgtcaggatgcccacgaccaccgcgacgcccggcctgaacggcgtggccgacgacggcggcggcgacggcagcggcgacacgatcgcgccgtcgtagtcggacagcagcagccgccgcgacggctccatcggcggcaagcttagcagcgacaagacgagggattttagatgtactccacctccactacacgagacaaccacgagtgtgatttgtaaccaagcggtagggggtaataatagcggtggagactagcgctctgcggtggtgaccggatcttccgggcggtggggcccagtggcagtggcagcgggagaagggtggggccactcgccgctgcgctgctccgccggtgaggataaccagttcgacgccgtgcgggttgtcgcggagtggcagtacactacgggtggcactgagccactgacagtttagttgtggggatgtgggcccatgtgtcagtagatgaatggagtattttttttcccttttttcccgaaagaaaagggcaaagggagcagcatgggctggggagcagagacccctgtttcgagctagtaatgcgcatttaagaacgttaggacgcgagattactgttttgtccgtcattaaatagcctactaatgctgacagctcaagggcaatatcgggaatttttcaaataaaaataaaattcgtgcgcgcgttgcgagggaatgaatgctcgtgggaggaggaggaaaaaaaaaaggatgagcgcacagacgcacacgcgaggtgattaccagttcagtcgctgacatggctgtcatgacacggcgtgggtcccacatggcagtgaggaattactgttccggatggggtaggtggcacgtcgatgctttgcgaggcagcacggaaagaggtgggggctctggactggatcatccaagttcgggacacgtgaggctctggctagtgatctcagcgaaatttgaatgtttgctcctgaaaatttttaattttccggaggttgcccgtgcggcattcaggctcatcagcaggcagcaggaccagtacttcattcgcgagttatttctgtggaattttatggcgtaaattaatccaagttcattatctacgtaagtacagtacactgctccagatcgagttcgattaatactacagcatccaccatatacttgcccgccccattcataatttcagaatctgaaactccgaaacgcacatcagcgaattgctcactgtgaaatgcttttactgttaccgcgtagtacagcttccatggccattcgtactgtacaggtgaacctgcgttaaaactgagagaggaaataagaagaacagtacgaatttatatgctactgctcgggacatcgcccacgttgcatctccgtggatctggacgcggcggcactgtgcaagtacactccaatgatagctgcgccatggcaacttgctcccggtgaagccatcgacgcatcaccatggcccatagaggctgcaaacctgtcgacctgccatgccaagccaaccgatacgacgacgttcgtatacatgtacgccccttgaaacttctacgcacgcccgcatgtacgtacgctcgcccctcgaatccccctgtacaattcaccggtgtcgccgtgcgcctgcgtcctagtagcaatgttgagcaatagttggcgtcgctgcagcgcaacaattttgctggcgattttcggcccatctcccgcgcggcgccggggatttttacgcttttttcagccggtcccccgcggcaacgcgcgacaggccgtgcgctgcaggcgacataaggctgtttgagccgcctgcg

SEQ ID NO: 76847 - DNA, 2365 bp, Oryza sativa
atctctgcagtggattgcgcaggtgttcatggcgtcacagtggtggatcgagcgagcggcttgtcgtctacgtctactccctccgtctcataaaatcaacctaacaccaccaaatataacacaacataatactataaatttagatttatattcatcgtactagaatatgtcatatatccgatcctactccgtacatgggagtacgatggcatgcacgagccgattgatcgtcgtaagcgcacgcacgcgtgacgactgacgcgtgcatgggaggaatatgacatgacacgatcaaaacgaggattgatttatcgtgttactccctctgtcccaaaaaaagtcaaaccctagatttccgtgccaacgttttactgtccgtcttatataattttttttataattagtatttttattattgttagataataaaaaatgattaatactttatgcgtgacttatctttttaattttttttatattttttttaaataagacagacggtcaaacgttggacacggaaatcagggtttgtttttttttgggacggagggagtacactgttagctctggcagccagttggggcgcctgaatgacggtactgttaagaatggaaggtatcacatcaatggagctgacaagagctagcgtgccattcatctgccgacgctgttcttgtacccaaaacggcactgtttaattcagccttttcgtcggcttgctccgattcagtagctcatacaataatgtagggatttccggtgtattgggaaacatccttcaatagttcaatttcactgttttaatccattttctaaaaaaaaagggttcaatttcacagcatgacgtcttctatatcgaaaatgttgttccgtatactctctgtgagtctgtgtgcaaggtacgggcaaaagccgcatgtctatgctccttataagcttattgtgttatttttccggcccaaagcatcgagcccaaaatagataacagggccatattctgggtattctgccggcccacatgaattcttcttattgaaaccaaaaggaataagttcactttaggtcccttaatttgtcgcccagttcgattttcgtcctcagtccacaaaaccggatacaacgcatcccccaacttaccaaaaccgtgcagacgagatccctcggcagtattgtgcccggttttggatgacgtggcgcctacgtagctggtttgactaagtctccgtcctacgtggcattggcgtggcgcttacgtggcaattgatcccaaaaataatagaaaactgtaggacccacgtgtcaattacacataaaataataaaaaaggtggggccatgttgcggcggtcgcctccagtagctggctgggcgcgaagcgagttgcggcggcgttcccaccgcagctcctcggccttccgcggctgctgcggcgtcggcgacaaggaggaggaggcaacccgtcagttagtagcacaccccgagagttcaatctaagcggccgtggcatggagaagggcacattgatgcagcacacattaccttggagtggcgatagggcacgccggaggaggaagcggggccggaggtggaggaggaggagacgtggagcgcgacgacgagcagcgttgcatcggcggtgatggtggcgcctatcgcggcgagcgagagcagccaccaccgcaccgccgcccaccgccccgctgcagcggcgcccctcacctttcgccgcagtggcaatggcgtcgcatccgccctgtcatggctaccacacgggaggtaggaaggtcgatccaggcacgggggtcgctccgtgtctcaccgatggggatcgatcctcgccggcctcgtcgtcacggctgtctacgccatctccaccgtgtgatctcgctccggcttgacgatgacgaccccggcaagcctatcactgtcacgcggtgccgcacagtagtaggaggacgatgcccacgaccagcttcgtctccaagtctgaattttctcctttccttttcttcaactgaagaaactgttgatgtttgattaatctgcagcttgaatggagaatgcatgcgtgcataggccgggtatttgtagccattgattcgggcaatttcgcttggaagcaaaggctccgaaagtgagaacattgagtgtttgacgaatcatgcgaggaggaatgggaagatgcggtgcatgaaaacccccttcttcgccaacggcgcctttggcggtgacgcggggtcgggctttcaggcggcggccatcgcggcgggtgcggacgggaaggtcgcggtcgacgggcggcggcgaggcgactgcttctgcgagcctaaaatctcccccccaaccacgccgctggtctcctccaa

SEQ ID NO: 76848 - DNA, 3317 bp, Oryza sativa
ccacccttttccaacctaaacctctcctcctcctccccctcctcgccgccgcctctcttcccatctcccctcacctactactacctctccatgtcgccggataactagcgtcccaaccagcctcgccggcgaggaggaaggtggtgtctcgcattcttcttcgggggatgggggtgggggaggaggagggacgcgggatggcgagcctgctggcggcgaggcgggcgctgcgggccggggtggagaggtcgcgggcgctcagccacgcgctggcgcgggcggggcccaggctcggggagatccgggcgaggctcccgccgatggaggcggccgtgcgcccgatccgcgccccgcgggacgcgctcgagggcgccggggagtgcgtcgaccgcgccgtggggcctgccgccgccgtgctcaaggtgttcgacgccgtgcacggcctcgagccgccgctcctagccgcctcagccgccgccgacgacctccccggatacctcgccgtgctgtcccgcctcgaggaggcgctccacttcctctccgacaactgcggcatcgcctcccagtggctcgctgacatcgtcgagtacctcggggaccgcagcctcgccgacccccgcttcgtctccgacctcgccgaggcgctctcccacctcaagaccccctccgcgaacctagacggcggcctcctcgccgctgcactggacattcttgaggccgagttccgtcgcctcctcaccgaacactcagctccgctcgccatgaaagaacccaacaacagctccgaccctggctccatcacgccgccgcggatccccgcctccgccgtgcacaagctgagcttgatccttgaccggctcgccgctaatgggcggctcggcacctgcacggctgcctacgccgatgctcgtggagacacggtgagcgccagccttcgagcgctcggccttgattacttgcacgacccagctgaggatgctcaggttctcaccccaaacgtcgagcattgggggcggcatctggagttcgccgtgcgccacctcctagaggcggagcggaagctctgcgtcgctgtgtttgaacggcggcctgaagccgcatcctcatgcttcgccgagattgcgtcgcgtgctggcatccttgattttctcaagtttggccgtgctatatgtgatgccaggaaggatcccatcaagctcttgcggttgctcgatgtgtttgattctttgagcaagctgagaatggacttcaaccggttgtttggtggaaaggcatgtgtcgagatccaaacccgaaccagggagcttgtcaagagggtggtggatggttccgtggagatatttgaggaattgctcgtgcaggtagagctgcagcgcaatatgccgcctccagctgatggcggagtgccacgcatagttagctttgttgccaagtactgcaatcagctccttggggacccgtatcgctctgtgctcacgcaggtgctcgtcatccatcgcagctggcgcaaggaaaccttcaatgacaagatgcttgttgatgcagtgcttaatattgtcaaggcccttgaggccaactttgaagcatggtcaaaagcgtatgaggatgtgacactgtcgtatctcttcatgatgaacacgcactggcacttcttcaagcacctgaaaggtaccaagatgggtgagatcttaggtgatgaatggctccgggagcatgaacagtacaaggattactactcagcagtgtttttgagggagagctggggaacacttgcaccgctgttgagcagggagggtataatcttgttctccaaaggccgggctacagcaagagatttagtgaagcagcgacttaaatcgttcaatgcaaactttgatgagatgtatcagaagcaatctgcgtggatcatatcagatagggatttgcaacagaagacctgccaccttgtggtgcaggctatagtgcctgtataccggagcttcatgcaaaactatgggccgcttgtcgatcagcaggatgccagtgcaaacaagtatgtgaagttcactgctgaaggtctagataagatgctcagcacactcttcttgcccaagccaaggagagctggaagcttccagatcagacactcaaatggcaagattacgagcgcaatgacagggttgtatcgaagctcttccacactgaagtagcttcagttgaagttcagggatattggatgtacaatttgtgcaataccattaaagatcccggttggccgggagacataattatggcccagtgacaagaacaaccggatcataacaagaactaagcttctccagtactgacaagtggcgaggagaacatgagtgactcgctttgcatatctgtgcagtctcctccacccaagttgtttctgtcgcctctgttattatctctagcagtatactcgattcattttaggaactttgtgtgggaaacagaagatgtgtaaccacttacctggtatgtgtaaaagattggttgtatttcaggggggtatttagttgttccacattctataagttttaattttatcaccatgcaatgaaatataaggaaagtacaatattacctctgttgatcaaaatgattgtggctaattgattactgattatatgaggcagtaataaacctctcaaatttctatttgtagacatgttcttgcatcttatatccataattttgtactgcagtaatgcagtttacctttaggattccccatgttcagctgtatacagaaagcttgtgtagtcctgtgaggcagtctctgtatatcgcagtgtgtgtaagttcacttctgtagttctggagatctgtatgttccagttattccccttgatacaggtcctggattactggctacagtacctcgatgaacagaaaggcaagaatgtttactagtaacaatttacctggtgggaagtccatgtcagatatgttcggaacttgaaagtctggaacggaaatattggcgtgagcaccttgttgagatgtcggaagcactggtaaactgagatatttttcaggagtttcctgcagctccatgcaaggcagcaggaagaacatgagggtgaacacccaaaacctggcattccaggttctgttgttctgcatgcggcagttccacaaagaatgttcaggtactgccggcttatcccagcagatatgccatcagattaccactggtttattctgatgcctcaacagaaagctcgctgaacctggtatagcctacctgtatgtaccacatatatccttgctaggagtacttggaaatattggcacaagtacaacgg

SEQ ID NO: 76849 - DNA, 574 bp, Oryza sativa
aaatccatttgcaaagagcatatgcaatgaaaaggattcagagggctcttaggtttagagggctcttaggtttccatttggcttgtcatacggtcaaggtcggctctgataccaacttgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaaatgcagcggaaaacaaaaggaactggagctaagccttgactaaactgcagcgggaacaccactccacaggcatcctcgacggcacggacgaagcctactcctcggggaaaccttcatctgacacatacccgtcctctggggttgggaaaaagtagagcaagactgagtactacccactgtactcagcaagtcataccggaataggggtatgatgcagggaattaacaaagaagagctagagtggttcatttgcataaatactggcatttataaacaggaattgaatgcgaaaacggttgtaataattaagcagtatt

SEQ ID NO: 76850 - DNA, 863 bp, Oryza sativa
agaataggcttcaccatggccacagcttcctgggatcacacgagaatacatgttattgcttcatttttttcacaagagaacacatgttattacttgcatttcatataggagattttgagaaattaaaaatacatttcagataggagatttggagattgaaaaaacatgtcattagtactttattactggcttcagacttcagagttcagaaacatgcatttcagagaggagatttggataaattaaaatgattcagagatcagaaacatgcatttcagaaagatatttggagaaattaaaatgattcagagttcagaaacatgcatttcagaaagagatttggagaaattaaaatgattcagagttcagaaacatgcatttcagagaggagatttggagaaattaaaattagtgtgtacctcgttggtcaccacgtcccagaggccatcactagcaaggatgaggaactcgagagagctgtcgaccacctcctcctgtacagatcaaataagcagataaatgtcgaatttcgatttgcaacagtacataacgtaatatggtcgtatcctgaaatcgttcatggcctctatgcatatactttctttatgagctgcatgaattatgaatttgagattggaagaaacttgaggaccttgatctctggatcagcaaccacatattgcttcaggagtttgtcaccaaatgctcgagagacagcaagaacaccacccacgcgccatgttcctacaaaatttccgccaacagaattttagcatttttatagattaaggacttggtgttcaatgtcgaaaaaaagggtaaatgtagcatcagcacaatgaatagatcaagagttgaaatac

SEQ ID NO: 76851 - DNA, 2245 bp, Oryza sativa
ttctccctcccctccccgaagtccatcccacctcccctctcctcccgggcgccgacaggtggggcccacctgtcggtcgtccctaacctcccgccgccgctccccaagccggcaaccgccgagccgccccgcgctccctgccgacccggaccacgttgcccactcccccgctcgccccacactccccgcgcccacgccccactcccgctcaccccgcgcccgcaagatggccgggattcaaatttgaatcccgcctctctctctcttctcctccacctcctccactactccggcgaaattgcgccgttcccggccacgactcgccgccccccctcctatttaagcacgcccgcaccttcctctctctttttcctttctcggccgagccctcccgagccctccatcactcccgcaccgctacacccgccgccgccgccttttccactcctccggtcgccgctcgccgccgctagagccgtcgccgcaccgcgccgtcgacgccgccgggttcgcaagcttgtgcgccaccccgtccgccgtttccccggtcaatcccgccgccggagcttgctcctcctcgcgcgccggtgagtacccccatggccgccgccttcgaccggcgaatccactcgccgttaaccacccctctccctctaatccctcccatcttgttccctagaggtcccggagatcgttcgcccgtcgccgtcgtcctcccgtcgctcgtcgtcgtcgttcgccgtcgtctccactcgcgccggccaacctcggtgaaaaactccccctcctccccctttccctctcttccgtgtgcgtcgccgtcctccgcgcgcgcatcgtcgtcttcggccgccgccgccgcttttcgcgccgtctgccgtcgccgtccgcgccgccggttgccgtcgccggcgaccgcgcgtgccgccgtcgctcgccatgcttggcctgccggctttgaggccgagccgagccaccagccgcgcccctcccgccttgtgccactgccagtggggcccacgtgccggcgcccctccctctctctcttgagccgccgctcggtggggcccgcttgccagccacccctctctctccttgagtcactgacccgcgggtcccgcatgtcggcgccgccccaccccttgctgacgtcagccctggggcaatattgcgcaataattaattaaggactttttctttattagtaaaaacacagtgaatcttctaaaattcataactaattcatccgagctccgattaagtccattcaagtctcagtaaattcataaaaatgtgtagaatccattaaaaatggctttgttatctgtttcagtagtcttatagcatgttttgcttgtgtgctttgtttgtcgcgtagatttcgcccgtttcgtcgattcgcggtttctcgaagacgttgctgtggcctcatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccattgataacttgggtattaaaatgactagatgttggtttaggagatgcttagccatgcttagttcaactagtgcacaaaaggggatcacattaaagcatagactttgattattggcaatagctttggattagtgccaccgcaatggtgttggttaattaaaatacacttcatggtgggctgtgggtgcatggttttgctagacgtgcccatggcgattaaggaccggttcgcgggatgccctggaagaatttatcgtacttaccacaagccagcgtgggcaacggctgggcttgagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatacgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttag

SEQ ID NO: 76852 - DNA, 771 bp, Oryza sativa
atgtttaatactgcttaattattacaaccgttttcgcattcaattcctgtttataaatgccagtatttatgcaaatgaaccactctagctcttctttgttaattccctgcatcatacccctattccggtatgacttgctgagtacagtgggtagtactcagtcttgctctactttttcccaaccccagaggacaggtatgtgtcagatgaaggtttccccgaggagtaggcttcgtccgtgccgtcgaggatgcctgtggagtggtgttcccgctgcagtttagtcaaggcttagctccagttccttttgttttccgctgcattttttgtaagacttttatgatgtttgtaagacgtggatctgaatgtcaacattgtcgtttgtgtaccccggctggtcctggacggggattttaatgcacattctgcttggaattctattcgggaatttctgggcgtgacagatcctcagcctccttcgcggtccgctcacggtcctgctgctcacgccgtagccattcttgttcttgtgcttgatgctcctcctccagtcggcgacgttcttcggtctcccgggcttggcgttgctcctccgtctcattattggccatgaaaaagccaaagtagagaggggtgtagttgtcatctaggctttccgtcgaagtcgtccaaatcgtcgaagtcgttgtagcgagaactaaattcgtcgtactccacaatgtcagtaggacgtgagtcgaccgtgggagaactgtttagtcattcagctga

SEQ ID NO: 76853 - DNA, 578 bp, Oryza sativa
agcgcccgatggatttttgaatgatttgtagtttctttaagatgtttctgtgatctgtgaataattttgtttctgaatatgtttcgatctgtatttgtgagggtttgggaatggcgcaatgactacgattgtgagttccggcttgattcgagccggctctttttttttttttgctcgtgcaaacctataggtgccggctctattttggtataggtgccggttgtttttattggtgccaaccaataggtgtcggttggaaacccggcacctatagtcggttcccaaccggcatctatcatggctcttgtactagtggtataggctaactgcagttaattactcggtggtttcgttatttgtcctaaccatggaccattgggtctccatcgccatgtcactgtctcatatctaattggcatcttatggatttatgatgctgagatatgtgaacttccgtgtaaactctcgatggatcgatgtgaaagcttcaaggttttgagcaatagattatctaagatataatggccgagctgattcattcagagtctcaaaattaaatgtttacttggcctattagg

SEQ ID NO: 76854 - DNA, 592 bp, Oryza sativa
cttctcattttgagtgattgtagatttcaaagactgcaacccccaaaacacagaacttgttctttagatctgagctagattacatggatgatttccttgacacctcagagagtttcttgttacttcctgttacttgcaaacaagattcaaatactccttcagaatgatttgtgtatcctcaattgaagttcacatttctttgctcaatgctaacaggtaaagtggttctgcaagcagcaatcctaacggcggttgctgtcatcggcctcaccattttcacattctgggcagcccacaggggccatgatttcaccttcatgtatcccttcctggccgccagccttctggtgcttctggcatacctcatcattcaggttatcttcttcttccctgctcaacctgctccgtttttcttttcttctcaagtgctgtctaactcattgtgcaattcaccgtgacccggcagatctgtttccctctggggagggctggcatgacgatctacggctgcctcgccaccgtgctgttttccgccttcatcgtcttcgacaccaatcagctgatcaagcgccacacctacaacgagtacgtc

SEQ ID NO: 76855 - DNA, 718 bp, Oryza sativa
  unsure (1)..(718): unsure at all n locations
agagagggggaagggggggaggggggcaaagcccacagggacccaaccggttgccgngggcagcattttttcttggttcaaacccccatcgntcgattgggtcttaaccgagcaagcgcaaccccctcccttactcgtttccacctctcttgccggaggccaagctagcacgagctcaaaccagcttgctgaccgccttcccctccctcgactaccctctatggcagcctagcgaggtagtagctcgcgccttgactaccttttacgctcctccgtccacctccctcgcatggaggccgggcgagcttgaacttggatgggctcgccgaccacctatccattccttttccgcctccgacttcctcagccacccctcagggcgacagcccgcaccttgaccgcctcatctgtccccgccttcgtgaatgcgctctccctacgtcttgcgcttcttcccgaacgcctccccatcaccagggtccaggagagaagaatgaagcacgcattgccacgtgggccccatgggtttttatttatttttgctaactaggatgccaccgtcagaaaaccaaccacctatagtgtcataggacctaatttagtccagtttctaaggtggggttaggatttagtattgtgtgtacggataatgatattaaacctgatggaaagatgaagaaccttaagtatacttaataccgatatcaacgatgagtcg

SEQ ID NO: 76856 - DNA, 598 bp, Oryza sativa
gcaccatcaacgcagtagcatctccaaccaatctagcagacaccgccaaggcaacggcttcagccgatccaacagactccgatacgacagcaggtcgttcagccgattcagcacctggggtcggccaatgcatcggctggatttgcagcacatggggggcaacctgtgcagcagtttgtgaatcaagttatcccagagcatttggttcatcatgcacaatcggatggcaccgtggtacctcagatggttcctgagcacttggtgcgcaacattcagccgaatctgcataactaccaagggggtaacttgagctatcagtatcagcctccatccccgcaagcccaatatcaaccagcgggatcggcccagcaacaattcgctcatcagtttggtcagttcgagcccatgcagcagcaaccacaaggagcagctcagcaacgaccatgggctgatgtcattgtgatgtaatgagggagcaatttgggctgagaccaaaagagactgggagtttgtacggcagccttatcccgagtggtttgaaagggttcctcttcctaatcggtttaaaatccctgatttctccaagttctcaggacaa

SEQ ID NO: 76857 - DNA, 4696 bp, Oryza sativa
  unsure (1)..(4696): unsure at all n locations
cgcggtacggatcatcatcctttttagggttccactatatatacctcttgtaagccgccgtgcagcgatgtaacctcaccttagatatagtgaagatattttaccggctgacgcccgtggttttttctctcctgttttggaagggttttccacgttaaatctcatgtcttttatgattgatctattgttttttatcgtttgttcacccatcgtttcctaacagtcgcccggcgcgacagttcttggtgcggcagaagcggtgtcgttcccggcgaagctcctgggccccggcggcggaggtgtcagcccgcggggatggttggcgctggcgcgcacgcgcgcacccgcgatcgccggcgggttcttggccaggggagctcccggtggcagaggcggcgtcgtcttccccgacggttcttggctcaaccgagctccgggcgtcgcacgtgtcgcccgcgggaaaggttggcgcgcgtggacccgcggtcgccggcgcaggaaccagccgagccgcgagaggaacccacgggcgtttcttgcttcttgccgcgtcgaggcagaaacagcggaggcgccgcggcgggttcctgtgttggcggcggagttcttggcgagttcttggtggaggaagaagatggaagcgcgagtttttggtggcaagaagagagcggaattgcgggagttactggcgagatggtggtggagggagaaaatgatttgacggcgagttcttggcggcgacgagggggcgtgatttggggaattcttggcgagaaggtggaggaagaagatgattatgacggcgatttcttggttgtttaagagggaatggggagagaggggagatggagaaggaaatgttgtggtatttatcggggaaagaatcgtctcgatccttccaccgaccatcccggaaggccatcgtcttctccggcgccgtcatgtgttcgatggcgagctctgcaaactcgaagcttctcgaagcgttcttgcggctggaacgcaatacttcttctccggtggctccgttttggtggcgagcgtggctcgcaccggcttggcgagagtatcgccgccggcgtgcacgagcgccatggcagctcacggcgccggtgacatcttagcagaagcagatgggctgtgggcgcacgtatgagacgtgggcctatcacttgcatttcaactttcaaggcccaaagagtgcggtgtttaatcccacctcgctaaccaaaccacagcagcaccgcttataaattgaaccgtgttttttgtttgcaagtgatatcaggcatttgagtattgaagtttcattggtctaaagacttatttttgttcagtctgtgttctctctctcccattctttttttattttttttctacaatgttttttttaagaattacacttactattgtttagtgtgtgttctctctctcacattcttttttattttttctacagttctctctctcccattcttttttattttttttctacaatgtttttttcagaattacacttattattgtttagtgtgtgttctctttctcacattattttttattttttacaatgttttttaattacacagtacaacgcagacactcataacgcacgcacgcaaaccctacccctatgagcatcttcaaagactggaccggcaaatccatcttggagattgacgaagtcatcacaggcgcttcgctgtcgacggatacgtcgcctaccactaaaagtataaagctgaatatgcaagatacactcccatagaaagtcgaacccatgactttttttttctacaatgtttttttttagaattacacttattattgtttagtgtgtgttctctctctcccattctttttatttttttctacaatgtttttttagaattacacagtacaacgtagacactcataatgcacgtatgcaaaccctacccttacgagcatcttcaaagactgggccggcaaatccatcttggagattgacgaagtaccacaggcgcttcgctgtctacggatacgtcgcctatcactgaaaataaaaagccattaaatcctgaaaaatacgctcccatggaaagtcgaacccaagacctaagatgctactgagactcttgtaaccattagccagcttgtttaatatagaccagtaaaattgtacacatcacttttctggtctacaatgttacattgatttatttgttattcatgcaggccaattaaaatttagatgtcaacctattaagaaaacaatatattataaagaaatgtacgtaattatcgaatgaatttcaatgataattattaatgagtaaagtgcatgtgcggttcttaaacttgtagcggtgtgtcatataggtccccaaactctcaaaatgcatatccaggtcccagaacttatcaaagtgtatcatgtaggtcccaaatcaacacatccccacttagattctacgtggcgctgatgtgacctgccacaccgacgtgacgtgtcctttttttcttttccttttcttttccattttcttctcaaggagaagaaaggaaaatacaatagaaggaaaaaagaatatttttaaatgggtcccatttgtcagtcaaaattacgccatgttatatctgtgtcacatgccacatcagcgccacgtaggatcctaaaaggactataagtgatttacaatataaatctcatactataacaaatgngnngccgcgatatgcattttgagatattaaggacctatatggcacacctctacaagtttaaggaccgcccgtgcactttactcattattaattctaggtatgaattaattatagactaccgactaaaatttatacgccaactgattaaaaaatagtactccctccattccaaaatactataaggcacaaccaccattattatcatcttgtagtttggatcatcctaataaagataatgcatgcatccaataggattagataacatgagtggagaatttaaaataataataatttaatagagaagatgtcatagttaattacatacttgcatgtatgccttatattatggaacatttaagaaaagtagttgtgacttgtattatgaaattatgaaatagagggagtacatttttactcgatcaacttcccgcagtattttatactgcaaaactctcttcgtcaacattattacagtgtgaatcaatacatcaagctacatatatctgggcctacgccgtagtaccgaaccttgtggtcctaatagcaaggctaatagtgcagctaacagcaagttccaaaattttatcatgtcaaatagagctaacttaaaaaccaactcatataataagctaactacaagttagctataagctaccttggttaaagcatacatacattaaatcattaaatacttatatggatacatcagagaggttctgtgtaggacccacataaacgcatttttatcgtctcttctggctgcacgcaggcgttacggtttggggagctgtgcaagcgccggcgtcaaaacaagcgcccgcttgtttctttttctttctctacaattttctttccttaatctcagattaagttgattaacaagttttggagcgggtttaatagcgctattgtacctgctctaagcctttctcgtattcatgtatttcttttccactcaattctctcaggtctagagtattttgaattttttttgaactcaatagagagttgcatttatatgtatatatttatatttttgaaattgaatatgcctttcaactcaatacaaagttatatttatattcatgatctttttttactttgtcaaatggtttactaaaatctttcaagtttagtgattttttctattgttttaacacaatagagagttatatttattttatctatatacctccaccctctttactttccctctaaactacccctaaactattggtgcagtccaaattactgtcatgaactacaattctaaacatttggcatccttaatttttcacactagacaaacaaccctcgtccattatagtttttgagtggttttggcatgagttagtacatgtagattttcaagatactccctccatcccattttaagcataaccggaagtttcggtgtccaactttaatcgttcatcttatttgaaatttttttataattaatatttttattgttatgagatgataaattatgaattgtactttatatgtgacttatgttttttaattttttttaaaaatttttcaaataagaaagacagttaaatttgtacacagaaaatcatggctgcatttaaaatggaacagagggtgtatatgataaaaaatgtttggaggtgggggggggggggcaacggcagcatcggccgatgtcatggaagataagttttgctctaaagctgatttggcggaggacgatggaaaaatccagaaccctcaatactccgtatatataaacatgaaaaattaaggtataaataaataagaacataattgcatatatatgcgtaaaaaatggatggaaaattaaggtggcataacatagttgcattaataaaaactgactagattaattatatacaatcaatctgttaatatcccattgatagtctaatttaactaaaaattcaccgacattgatcatactaatcaaccactctaatttatactccctccgttttttaatagatga

SEQ ID NO: 76858 - DNA, 4412 bp, Oryza sativa
actactcctattagtaaacatctaccactctaatttatactactactattagtaaacatctcctaagatagtaaggccagcaaggtcgtcatggccaccgcagcagccaccgtaccgatccccattgtcgcaccacgcgctccatgagaggtcggtggcggcggcggtggcggcagtggcgacggcgaagtgaacggcggcggggacgacggcttgggcgcctgtggcagcgaaggcgccgccgttggagattgcgccggcgtggccgccggagactctgctagcttccccgctgatggaggctgctgcggcgacgacggctcgtagggaggaagcaccagaccttgcgctgcaagatccaagaaattaaattaaacggcagagtcagtcagtgtcagtgacacgatccggcgacgcgccggcgccggcacgccggtcgccggcggcgaggtgaggtgtatgcttactgttgcagagctcgatgggcggcgtggcgaggccgcagctgacggggatctcgagggcgtgggtgacgttgacgtcgtagccggtggagcggccgtagacgccgtcggcgatgtagcagaggcagaacgggtcggcgtcgaacgccgcgctgtacgccgcgcagcacgccggcgacgcggccgccgcgccgccgaacatgaagtccctgcacgcgagcagcccgctcagggagtcgcggcagtactcgccgccggcggcggcatcgctggccgccgaggccggcgacgggagccacgccgacgacaccgccgcggtgaccacggcgagtacgaggaggagaggaagcttggaacgcgccatggtgggatatatactgggatcgatcgattgattaattggattggatttttgcatggtccgcgacgtgtatttatagcgccagagtttgagaaatttaagagaacgcgacattggatcgtgcatgagaggttttctcatctttttggaggaattttatccgaactcaaatactgatcgaagtccacgcggcacaaaaacgcatagcttaagcgctttggggagaatagctaatatggtccctaaagtttcgctcctgagttattttagtccttaatctttcatattgtccaaacaagtcctttaaatttgtcatgtgggctaatatagtccttggtcccaccaaaatcgctacatggacatgccatgtcacctttctatgtaaaatctttatgatttgtccaatttacccttatgcataggaaaataaaaaacaaaaggaaaaagttaaaaaaatatatggtatatgtaagagcaaaaatatacctcaaaagggtgaaaaaagaagtatttttttcctatggttatgtctaattcacccttatatttatttttctacgatatacgtaaggctaaattggataattcatcatagattttgcatgaatgatgacatggcatatccatatgatgattttggtggacccaaggactattctaggccttatgacaaaggttaaggatttctttgaaccatttaaaaggttagagactaaactgatcctacagagaaaatttagtgactaaagtagctattctcccaatgctttgaattgttatccagctaaagagtcttaatgggagaaagttacaagttgacacgttagaagataaccaggtcgtagaacgatgtaataattttgtcatccactcctgtatctgtacgagttttatttagtttctttttttaaaagaaaaaatattggtcccagaacttgtacttgattacacaagttttttctgtttccaaattatcctattgacaaaaacaagttaaaatactgcaacatttgggagaaaatttcattgaagagaataaacacgtggccaactaacttcattacacagttttggtgtaaccaaattgtcctattgacaaaacaaatgaaaatagtggaacatttgggagaaatttttagtgaagagaaaaaaaaagactggaatacgtggcgaacaaactttattacacaagtttttattatgtaaccaaattgtcctattgacaaaacaaatgaaaacattgctacatttgggagaatttcagtgaagcgaaaaagaaaaccggaacacgtggccaactaatttggtccgtgtctctaaaaatatatgaggctttgggcccagtaggcctataggagtacgcgccaaaaagaatttgcaaaccccaaatgcgccgagccgccgccgccgcggcggtggcgcccgccgacccgcagctgctggcggcggcgttcgagtcggccatcgcgtcgcgctcgccgcgcctcggccgggccgcgcacgcgcgagcgctgaggctgatcgccccggcactctcgcccttcatctgcgcgcacctcgtcaacctctactccaagctcgacctccccgcggcggcggcggcggctctcgcctccgacccacaccccaccgtggtttcgtacaccgctttcatatccggcgcggcgcagcacggccgccctctcccggcgctctccgcgttcgccggcatgctccgcctcggcctgcgccccaacgacttcaccttcccgtcggccttcaaggccgccgattccgcacctccgcgctccaccatcgggccccagatacactccctcgccatcaggtttggttacctccccgtcgaccccttcgtgtcctgcgcggcgctggacatgtacttcaagaccggacgcctcaagctggcccgccacctgtttggtgaaatgccgaacaggaacgtggttgcgtggaacgctgtcatgacgaatgctgtgctcgacgggaggcccctggagacaattgaggcttattttgggctccgggaggctggtgggcttccgaatgtggtctcggcctgtgcattcttcaacgcgtgtgctggggcgatgtacttgtcactcggggaacagttccatggcttcgttgtaaagtgtgggtttgagatggatgtctctgtgttgaattcaatggttgatttctatgggaagtgccgatgtgcagggaaggcaagggcggtatttgatggcatgggagttaggaatagcgtgtcctggtgttcaatggttgctgcatatgctcagaacggcgcagaagaggaggcttttgcagcatacctgggtgcaaggcgttctggggaagagccaacggatttcatggtttccagtgcgctcactacatgtgcagggctgctaggccttcaccttggacgcgctctgcatgcggttgctgtccgttcttgtattgatgcaaacatttttgttgcgagtgcattggttgacatgtatgggaagtgcggctgtgttgaagatgccgaacagattttttatgagacaccacagaggaatcttgtcacttggaatgcaatgatcggtggttatgctcacattggtgatgctcagaatgcacttctggtatttgatgatatgataaggagtggggagacagcacctaattacatcacccttgtcaatgtgatcacttcatgcagcagaggaggtttaacaaaggacggctatgaattgtttgagacaatgagggagaggttcgggatagagccacggactgagcattatgcttgtgtggttgacttgcttggtcgtgcaggaatggaagaacaggcttacgaggtcatacaggggatgcctatgagaccttccatttctgtatggggagctctacttggggcgtgcaaaatgcatgggaagacagaattgggaaggattgcagctgagaagttgtttgaacttgacccccaggactctggcaatcatgtactgctctcaaatatgtttgcttcagctggcaggtaaaattaccttattcactttgatgtttacgttaaagttccaggttccaggctatctcaggtccaaacacagatacacacacacaaacaaacaaaaagccactcccggtgatttctcagtaaatttcatactcctgatgtcatttgattgaacttagctctaggacatagcgaagtatattttgatgtctcttggcttcttctgaatgtggaatgtccctgagtttttaatgattataaataatctccatcattgatggacaagcggtaaactaatataaaaggctaagttgaagcactatattgcagaattgtaaggtacatttgtcagcatatctgccagaattcaatgcagattagatgagcatttgtatgccataatccatatacttccaatcagctgtgaaaatataatctcgaaagtgcttgttgagagcttgaagtagactaatgctgattcctgaaacttgttgctcataatttttgttatgagtgaagtgcaccagtggtccctaaacttgtgcaagtgtgtcacttaagtccctgaactctcaaattgcatttttaggtccctcaactt

SEQ ID NO: 76859 - DNA, 10141 bp, Oryza sativa
tgcataccacctggggtacctatcagaatcatgaagaacctgcgaatatgtgtggatagtcatcgcgcattctagttcatatctggtatcgttggtagagagataattgtgagggacaataataggtttcatcacttcaaacaataccaatgctcatgtggagattattggtgacttctatctatgtgcctattgatgaatattatctgcaaaaagaaaaaaaaaacacttcttcaaagccaaaaggaaaaggtatgcaatttttgttcctgtgcaatagttatatcagcatattttttcttatgtgatttctttagttgctgtattagttgaaacttgaaagtttgaaacttttgataagcttccaaatgagtataagtcttgttagtaatatgataactgtgttatctgatttctacagtagaaattagaagctaccaaatcacgcacccactcacagcacacacatgcatcttttactacaaactccagagaaactcagacatccaagaaaccaaggtccaacttgtccgttgaacacacatgcatgtgcatattctaaacaaatgagacacactatgtcatcctagggattgaattcagggtgggtcagaacaagctccctcataatggtaacagttacagaaatggctaaatgggaaatgagtgtgttggaaatcattatttcttttgtttagacacaaatatatttttttctgacagttgtttgtaaggatatctttcctaatgttttacacctttactttccttttatttattttggcttctgtctgtacaggatttggcattaaacatggaacatatgtcctggtttacctaattaccttgctccattactgaagaaggcatactgataaatcaaaagaagagaccagctggaacaaaatttggggttgatgagcagaagcatacactgcctgtttgatgtgccacccatgttagctcaggttgcacatagcctggatttaggggcatcaagggcagaatatgtactattcaagagaagctcagggatatcaatatatgattgctgggtgcaccgtgcacgtaggttgtgatgctggctcaaggatctaaattcctgctatccttttttgggggtgtgaataatatttcttattggtactatttcttggtagtagggacaattccactgtctcaaaatcgtggtaaatattaagcagtaaaacgattttaactttttctatatcttgattttcaggtcatgctagattgagcctattactgtttctaccctgaagcgctaatgtttgcaggcctgaagtgtctcgtattcagcttggaggtgttggtgaattacttaaagcgacgaatgcagaaatctgcacggaagcgatgcatcccatttttgccatttggttaagtaggttttggttattcttatacgttgagaggatacttatcatgggtttggtggattagacgtggtataatccagttctcattttggttttcctttttgtttgctagctgaccttaattacttggtgccatttcctgctttgatttttaggtgttactgtaaatgaagagatgatttattatatatactacagaatatagttcacgcgtattacaaagaaaaccggtgttttgtttctgttgggcactttagttagcaaaagagtaaaatagcctttccaactggggctcttcccatccatttgtttgtgatcataattttccgaaccatatgtttcattttttcttctaagcttatcttagttaaaacattcaacacactttcagtttcagttttcagtctttgagcaaggttgcttcagaattatcaggcatatacatggaaatgaaatgattccattctctgttcagtttattttccttgtaggcttagattgatcatacagcgagttaaatgaatataacttcaaacaaggctcgagtaaaaactacggaggaaaatgcagtcaatagtgacttgtgattgtgatctgcatcgaggattaaaaagatttgtctcgtaccacatgaagtccttcagtagatttgtatacttgttcaaaagattgtaagagcgatgcatcaacttgtttagttgcagaggtatatgatctgagcttgttcattcggattattcagatagaaagacgctgtactaacggaaatcttatacaggttgaattcgaatcttcataccccactggaccggggcccacacgtcagtgacccatctcaagactcaaattaaattggtcacgtctcgttcgtcctcatctcgctcgcgtctcgtcggcatgacgactccgccggcggcgaagcgccgccgccgctgctgttcgctgccgccggagctgaacgacgacgtcatcggcgagatcctcctccgcctcccacctggcgaccccgcgctgctcgtccgctgctccctcgtctgcaagccatggcggcggctcctctcctccgaccccgtcttcctccgccgccaccgcgagctacaccttcgccgccggacgcctcgccccctcctcggcttactctttaaccagctcggggaagaccccggcgtcgcctggttcggccccacctagttccatcgccgcctccccacccccaccattgggactggtacgcgctcgacgcccggcacgggctcgttctcttcagcaccatgctctcgcgcgacgcggcggagcacgagctcgtcgtctgggaccccatgacggggcgccggtggcggctcgacttcccgggctacctcgaggacttcaactggtccgcgtcggtgctctgcgccgccgacggctgcgaccaccgccactgccacggcgcccccttcctcgtcgcggtcgtgtccaccggccgctactgcaacacctccgcggccatctactcctcggagaccggcgcctggggcgacgcgatcgcgctcgagcgcgagcaccccgatcccgatgatgccgtcaaggtcgggaagcccggcgtccaagtggggaacgcgatctacttcccctgcgtccggagcgcccaaatcctcgagtgcgacatgagcggccacacgctggcgatgttcgactcgccggcggccggccggggatggccggacaacggcctcctcatgacggcggaaagcggcggcggcggcgggctggggttcgctttcgtgcggcggtccatgctccacctctggtcgagggagcccaccggcgacggcgccatggcatggtcgccgctccgaggcatcaacctggagccgctgctcaccgtgctgatccggagaccacctgagcaccactccgtcacgcctaatctggtcggcttcgccgacggcgtcggcgtcatcttcgccgagatcgatggcgacgtcttcaccattgaggtgagctctcgacgaggcaagaaggtgtacaggagggaagacatccacaccatcttcccttacacgagcttctacactcctcgcggtggtatcaactttgatccattgccatgaactcactcgcgctgctgctgctgctgttagctttgttgtggatttgacgttagtgatttctttcagtttggaagcccaggaacagtattgtttgctctggtttcagtggttagtttaagccataaaaagagttaagtagcgatggcctattttgtaacctctgtgtctagttgggcagttttaaccaggaaaagagttgactgctcatgatcacttcactatgtgattgtatcaactcatctacctatttctttttcgtttttcatttcctcgctgcctaaagcatactctcgaagatacaatacctctattttttttataatgctacgccgttaaatttttctttacaatagtttgatcattcgtcttatttaaatttgttttgtaaatataaaaaattgaagtcatacttaaaaaatatttgacgataaatcaagtcacaataaaataaataataattatataatttattaataatacaaatgatcaaacatatattaaattgatcaatcaattctaaggttgtgttcggcagccaactttcccaactcatctgtatcatttttcgcgtgcatgcttttaaattgctaaacggtatatttttctttttgcaaaaaacttctataggaaagttgcttaaaattatattaatctatttttttaaaaaatagctaatacttaattaatcatgtactaatgagtcactttgttttaagtgagcgagagattaggtaccaacctcacaattagcctaagtgggaatactaagagtgggtggactaggcaaaatccccccccccctttttccctaaccctcctagagtcgttggatcaaacattgtctgtcagattcaaccaaatacaaggctgggttcccaacccaagctgttcgcacggaaaatgaagtgatccattagcgcatgattaattaagtatttgctattttttttcaaaaatgaatcaatatgattttttaagcaacttttgtatataaactttttacaaaaaaaacacaccgtttagcaatttgaaaagcgtgcgcgcgaaaaacgagatatgtgctaaattggtttcctgattccacacttccccatcaatggtggaagcatccacatctacactctcagtcttagatcaaactatagaaataaatctgaataagcacatgtcggattcatagctaaagtttgatttattctttttatgaagagagtatatgtttgtgcgcagcaaggcacctctgggttaactcttaactgtacagccggccggcaccctgttacgctggccaacttactcctattctcttcctccactagccagctgctgcgaaatcatgcccaagggaagcaactccacccgaatgtgcctccccagtccccagtccccacacgcgcacagatcttggagtaaaatcaatgcccatcaaaatagactgattgaaatcacaaaaagtcagttgactgaaagtaaacaaacctgttttctttaacattgtgtcactaccactgtggttagctgctaccaaggtacattgaaataagtttcaccttggactaggtgttatattatatgattgaaggaaaatcttgtaaaatatgaggaaaagttataaaactttttgaatttagatcacatattcacatttgatgatgatttattcaaaattctacgaaatgccatggaaattctatattattgatgatgtatcctagattcctagtgctccgtattaagtgaaagttttttttgacggtttaaacagtaggagaggctcatactgtgctatattagaatatagaataaaaaaagagtatgtacaaaggatggatataaggggggagaggaaagaaaaaaggaaaacaaggaaaaaacaaagacaattagctaatgatgttaatccatgattgccagctgggtttgtctgatgcttttactctgtgcatatgccgagtaaagaaggatggatataaggggggagaggaaagaaaaaaggaaaacaaggaaaaaacaaagacaattagctaatgatgttaatccatgattgccagctgggtttgtctgatgcttttactctgtgcatatgccgagtaaaatcttctttgaagtccaatttccatttactgaagttgatgggcacattattgaaaatatgatcatttcttctattccagatattccaacatccaattcctaatacttccataaagaaaggttgtgggaaaagccttcttgcagtcatgatcatgttcatgaattctaatgtcagatcccaatttatcccaatacagttccaacattgttgggcaaaaggacaagagaagaacagatgaatgtagtcttctgtggttgtcaaattgcaaatgttacaagtgactcctccttgagtgttgaaatgttttctttgaagtaaatctttagtgtttaatatgtccatcagtagaagccatagaaataccttgatcttcattgtgcctttgcttttccatatgagagtgagtggtatgtctggttgaatatgagaaaagaagagatcatacatcttttggatttgtacaagtttgggttccacacatagttccattgatttgaatgatggcctcatactccactaaatcaaaagctttctcaaaatatattttcagaattacaatttccctgttactttgatggcactgatggatgtattcaaagctccatgctaggcaatcctggatggttctacctttaataaacacatattgattctcatgaataatatcaaggataactgattgcagtctgttggccataatcttggagacaaatttcagaacagagttttgcaaagcaataggcctgtaatcatttggactttcaggattgggtttctttggaactagggttatgaaagagttgttcaggttctgaattgagattcctccactgaaaaattgatctgccatagcatagaaatcctcagagatgatatgccagcatttcttgagaaacataccattgaaaccatcaggtcctagagctctatcacttggcatttgctttattatttggtccatttcatccttggaaggcatggaggataaaagatttaggttagagttatgctgtatcaaactgctcagatttagatcagactgtaagtgctcgggagtgcccattctgtctgtaaagagttgaataaaatttgggccttttcttcatgagatgatattattctgtcatccaactttcatgtgagatcttatttctgttgtgactgtctgttgctgcagcttggaagtattttgggttttcatctccaaatttaacccatcttattgtacatcttttcttccaaaactcattcttgtattttaagagctgaaggatatggtcctttaatatggttctgaaattccattcttgaatggctagatctctttgctcttcaattttgtccagaaaaagcaaaacctcattgcagtttgagacgagggtatgcatatttgagagtcttttcctcaaattttgagtcctttccttaaatttttcatctttccattcaacttgatagcttgatttgatcctctgacaggaatgttccagaactgtgaaacgacatccataaatcctggcatgtcaacccataagttttcaaacctaaataatcttgatttaggaactgaagtttcaatagaaatcagacagggagcatgatcagagatgtatttagatagagctgttaatgatgtgtggagaaatttcagattccaggctggagatgtaaagacccaatcaagttgctggagcagaggttggtcttgcatgttgctccatgtgaaagacatgcctctcagagagatttctaccaatccaatgttgcttatgatttcattgaaaatcacaatatcattcatatctccaccagagagatttctattttgcactgatctaatgaaattgaaatcacccatgaaaatccaattttgatcaatgtctatctcaatggtgttcatccatgaaacaaattcatctcttaattctccagcacaagggccattggccatagatgttagatagggaccaattttcatgtaaagaggagtttgacacaaactgcatagtgatgacatatggatggctttcaatcatggtaccagttgcaacactactgttccaaatgacaattaaaccccctgagtttccaaaagaaggttgaaaaacaaacttatcaaaccttctaggacaaaattttctaatataggagtggtcaaaatgctctcttttggtttcttgcagacagataattgagcatgaagattcaaaaattttgtcagataaagccagccactttcgctcagaattaatacctccgatgttccaacataagatattgcagcttctattattctgttgattcattattctggtttgtgagaaagataaaataggtcacagaataactgtgtaccccgagatgagagccaccagcagagacccgcaacattagatgaaaaaccaaagcatgacaaaatatgcagcataaccaaagtacttatccagcagattaacaagttccaggcataatccaagagaaaagtgtcacaaaagtgaaattctaccctattacataagtgggtagaggggctaagcatagcccaattattacaaagcttagagactttattcatttctttgatctgagaagcttcacttcggacacttcctcaggaagaagtccacatttttccaccccatctcgggagagcattcacatgattacaaagaggaggcaggagccgcaggatagccttgtttagttcccaatttttttttcccaaaaacgtcgcatcgaatctttggacatatacatggagcattaaatatagataaaatgaaaaattaattgtatagtttgcatggaaatcgcgagacgaatcttttgagccaaattagttcacgattagccataagtgctacagtaaccccacatgtgctaatgacggattaattaggcttaataaattcgtcttgtggtttccatgcgagttatgaaatcagttttttcactcgtgtccgaaaaccctttccgatatccggtcaaacgtccgatgtgacacccaaaaaatttgttttcgtgaactaaacaaggcctaagataaaaacacaaggacaactatgtttgcaacacatgcccaaattatttgagtggaacatcaatcagataatttagaaagccagcaacgttttgcctacagaacagaaccatcctaggacgctagatgctaattaaattgaccctgaaaatgacgaccaacatttaaagcagttaatcacatgtctgcaacataacgttagaaatgtaattaactcggcggctaatctgaccaattcagggttaatttcgatgataaaggaatacaaccagacgcaccagtaagcaggcatgtccccacgaacagaatgcatgacattccaagaggagtacctgatcgcctccctcgagctgagcctcctcttcttttcttggcttgtgtctgtctgaatagatccatgaggtgcaacatttgttgggcggcggggctcctcgtgtcgtggagtcggcggcgatgcgcagtgcacctaaagaggtgcgccgcccatacacagtcgcagcccactccttcaaagctgtcccagacgcagcgcaggcaccctccgaatccgcgtcctcgtcgccctggtgatctctctagcgtcgacgaggatgccggcggtggcggacccggctcttctcggtggcgtccaagatggccttgttcttgtcatcttggcagcacggggcatgggtcagacggtgcagacgcggggcgcgaacggtggacggcggagagcaggacgtgccgcgcgtggcgaaaaagggacggcggcgagcgcgcggatgaggcacgcctcctgtcgaacaggttgcgggcgcgcggcggcgagtatggctccccgcgggcggagcgtcacggcggaggcgttgcaggacggagtcaccgccggggcgacaagcgacggcggcggaggtcgtttcttgggcccggtggtgggaaagtgcccgacggcaaaagaagacggcgtcacggtgggaaccggcgatcggcgcggtggagggcgatttcttggagctcaagacccagaacacgaggttgttattataaccgccttctgcacggccgcctcgccgccggaaatccgtcctcattcggacgccagcttcggcgtctgggttcatccgcattgtttcacagccgctcggtcggtcgcacctggtgcgcgtgcggctcaaccgaagcaagccacagcaatggcgccgccgcggctgcgctccaagcttcgagcaggggcatgagcagccaagccaatctgagggcttttaataattatttcctttttctacgtaggttcgaatctccgttggtgcatatttttttttttagccgctcgaattttcttttctttttttactctcaaataattttctccagtgtttctatataataaaaacatacaattttttttatcattcctttcttttacgctctaatcaccaaaatatgaattagagataataattcataataggtctgctcttgtgtttataaccaggtctaactggcatagttggagctgggctaactcgag

SEQ ID NO: 76860 - DNA, 629 bp, Oryza sativa
gtgcgcggccgtcgctccggtcgtcgtcgctgctcgggaaggtcaccgtcgtggtcaccaagccgtcgccgatctcgtccacccctccgtcgtcgccgtaggttgccgtcgtcgtcaagccgaaggtcgccgccgcttcttcctcgacgccgtcgccgtccgttgatcttctgccgctgttttggtcaccggtgagttcgccacgtcgccctctacgtgttggtgtcctccattcgcggcgtcgcgtcgtcgttcgccggcgagcttgcgcgcccgagccgccgccggtgatgacgtcatcaccgatgtcatcggtgccgtccgtcgtagaccggtcgtagaccgttaaatcttggccgttcgttgtggataggatcgatctcggccgttcgtttccgtgagccgccgccgtgcacccggtccaccgcgaaccctaaccgctgacgcaataatttccttttccttttaaaaaataattcattattgcgtcatcattcaattaaaacccatataagtgttttaatccgatttaatctataaaaattcataactaattcatcttagctcggatttagttggttcaagtctctaattttttctaaaattgagatcggggatcctctagagtc

SEQ ID NO: 76861 - DNA, 702 bp, Oryza sativa
tattccctgatgtcatacctcaggtaaacctcaccattgttagcttgaataattgttagccgattcattacttgactaatctcttgtttttgttctacagacaatcgactcttcggctaattactcatagactttgggttgcaaaaagaaaactgctgtgaagaaaaaaccagcagcaacaattgtcaagcggctccaccagtaagatgtctttaattcttttacttaatcaatctcaaccggctctatatacacttgtctattctacagcctcttcctcctccttctcctcctgtacagcaaccgtcaagtgaccagactccatcggctgtggagagtcatcacatcgaggagtaagaacagccagctgctcctgctatcccaataagttattctttgtctcaataattagatcagctacattttacccagctcttactctttccgaaattgtctctgcaggttttagccgatcttttctcttttgacatcagagattatcttgataaggcagaagaagatacttctagcaaagctttagctcctctatctgacgatgtacagataacacttgaagatatctctcatcggctagctacaagcctcttctttagatagcttggtagttgactgcggatcaattaggacacggctgcatgaagttcaagctctgattcccgaagaattggccgatgtcctaac

SEQ ID NO: 76862 - DNA, 1317 bp, Oryza sativa
caaatagctttgagccactaaatggcttaaagctgtttactgcacccctaacccttatagtataattcccttgtactcccttgcattattctgcagttgcgggtgtgtcttgttaagtacggtggttgtactcagtcttgctcaatttttcccaaccccagaaaagagttccttgaaaataaaggctttggtgtctagctcgtgcctgccgtcaagcgcctgtggtcgtcgccctattcttccgctgtttcccgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacagaagtccaagaggatctgacctatgttgagaaaccaatccgtatcttggaaacaaatgagagaagaaccaggaatcgagttatctgtttttgtaaagtccagtggagtaatcactcggaagaagaatcaacttgggaacgagaagatgaattgaagtcagctcatccgcatctgttcgccagttcttccgaatctcgaggacgagattctgtttaaggggggtaggtttgtcacaccctgaaaatcataaatatataaattgttgtttaaatggaatttttagaatttattttaaaagcctagaagagaagatctagttttaattaataaattccaatataaaatggggccaaataaaattttattaaatactttgcttaattctataattcctagatttttctgggatttatttgacctaaggaagtatttttaataaatggaattgcatttaagaaataatttaaattgaaaaaggttttaaaagtcttcttttggctttgggccgaaagtcggcccaaaaccgctctctctctcctcggcccaagtcggcccagtccgcagccgcgcgcgccctcgctgtcgctgacaggtgggtcccgcttgtcaggttcgtcttccccgagccgccgtcgcccggccgaaaccctagcgcgccaccgccgccgttcctttccaaattcggccgctcctttccttctccggccgaatcaaaagaggggaaatgatcctcgggatctcctctaccttttcttctttggaagcttcggctagatcggttcggaaatcgatggattcgagttcgattcggatcggcctctttccttcaagccgcgagctttccttcgccgttgccgccgccgtgggccttcgccgccgcctccgagccccttt

SEQ ID NO: 76863 - DNA, 796 bp, Oryza sativa
cttcacttcttgtaccaagatgtggactatgagttaggcaccatcaaaggtctccttcctttctatgcctatctcaacaagctcttgcgcaaaactcttaatcctaaggaaggtgatgctagcaatgtccttgcctatacaagaaatttgctccacaagatgaaggcacacccacagctctttgatgcttttgacttcatctttgaaaaaatctggcttatctccatgatacctaagcgaggacatggctatgggccttacattatgaagatgattgagattgtgtccaagaagaagtttcacaaggaagtggctcacaccggttaccaagttcgtcccatcaaggctgtttccgtgccggctggtcgaaccactcgtgcttcttctcgtgctggtccctccgctactgtcacctcgtcggactccaactcttctttgcggttcttcaagtccatctttaacatgtgcaaaaccatctcagttcatcaagccaaggagcccaaagcaaggaaaaaggacactcggcggatcaaaaacctccttcacaacgcccatttgctgttgacggagcgtggggctcctcaccgggagaccgcccaggcccccctttgccggttcggccgggggcgctaagtgaggttcttcgccctcatctgaggaacgtcagcgagagaggaaatgcacaagacacgggcgacgtaaacaggttcgggccgctgagaagcgtaacaccctactcctgtgttctggtggatctgtgcgtgaaggaatacagagagccggagagcgagagaga

SEQ ID NO: 76864 - DNA, 1054 bp, Oryza sativa
tagatggtctcttctttcaatggtatttattttttattacgaattttagttatttataaattgtattactatttgaacccctatttttatttttctaatttcgaaatttattttactttttatttttcatttttattttaattaatctcatattatgttctatatggactattcttttcatattccttatttttaattttttgtttcagatgtttcaaaattatattcctattctaactctatttttaaaatttctaatttaggattttattttattttttataccgaattataattaatctcgtattggattgttatatgtacttttctaaaattgtattcctacttaaactcttctttttctttttctaatttcagattttatagtatttttatttcgaattttagttaatcttattgggttcttatatgtactcttctttcaatattgcttattgttaattccgaatttcagttatttttaaaatgtattcctacttggacccttcttttccttttctccgattaatgagggaatttttagcctccacaatgaacgtgttgcctcctttcaaagttatttcaataatataatatatgttcgaattgcatccctgaattattgggtgagtacgaataatccccctaaacttgaaaactagacatcgttcaccctgaacttttaataccagacgaattcccctccccaaagttccagcgccaccgtgttcgccgccctcaccgtcggctagggattcgattggagaattttcagaatatgccattcgatttgcaccactttcaatatttgtcactcaattcgcaatactttcagaacatgctaccgaggacatgaattgtttcattccatgccactgaggacgtgaattatttcattccatgccattccatcccttcgaagccggcggcattgcaagtccatgtcgcgtcgtccgtccacctcatcttgccaccgcaagcaagctcttcctcccccacaccaatggagctagcttctcatcgcacatgctaatgccattataggattcaatat

SEQ ID NO: 76865 - DNA, 14598 bp, Oryza sativa
tattgcggtgaaagataagcagttagtctgaaatctgtacagatctgtcagctgttaccgaagcaaaaggttcaatgtgaacttaaagatgcagtactgatccttttaagaggatttaacacagatttaacaggtacgtgccccttgtgattctttgttagttttcttgttataatgatgtttttatcctctgaattcaagcagggtgttctgtatgcgagctgtgatgggatggttctcttcagaagcattttattttaactaaattcagaagcatttcgatggcatgaggactgttcgattgacaatttgtatgtacatttccaccgtttacgcagcttaggaattggaccataattagttgtgtacctgcaagttttgtatacgaattatcctgaagggtgttcggtggattgaatattgcccttttggttgttttgcgcatcgtggatgcggctgctctacatttttcttataggaaatcagcttctgataaaagggattattatctgtgtgatctactgatcgatattttacccctctagctgagtttattaagccaattgattatcgagtgggatcctctcaacgacacatgagcatgagcatccggctgtttgttgattaaggccctcttttgtttatgtttaaacctaaataaatagatattttttcgtttgtattttttaaggtcataagtcactctatgttaagctaaaagctaggttacagtagcttttctggtctatgtgaagctaacagtctactacttaaggtttaaaaaacagcggcttaaacaataaaaatattcaaaagaaccaaagcgagagggcttaaatggttcagccgtactttaacggaaaattttttggaaagacaaaatggcaaagttgattgtcacccattattatccaatttcgacgtttggacaaatcctcaaattttaaatgataaaaagtactccctccgtattttaaacgacaccgttgacttttcgaccaatgtttgaccatttattttattcaaaacttttatgtaaatatgaaaatatttatgtcatgcttaaagaacatttgataacgaatcaggtcataataaaataaatgataattacataaattttttaaataagacgaatgattaaacgttgaacaaaacgtcaatggcgtcatacattaaaatatggaggtagtaatttagaaggtaagatattcctttacatgtgtggtagtttttatggcttggggactggggaccaagatctggtgtggttgctagtataactacaacttagcagttgcattagcaatgcatgatgagaaatctaggtttacacaaatgttctttaatacataatctagatcatcgaatcaaaatctggggttgcgaatctgccctagactgcttcgatccttattgcacagttgcagtaagcatataatctccatgcggggacaagaaagtcgattaaggtaatcaatgctagtctttgaggaaggcaacatagggtaattctagttgctaatagctgcgttcgcgacaatgatttgttggggtttacaccctctaccataatgacactaccattatagacattgatatgtgtaacactaagaaagcggaactcacatataagtgaccgtaatggtatagtgatattatggtagaggatcctcacccgatttgttgtcctctttatttccctttttttaagaaagatgacgtgtgtgacttgttagttgtaagatagattcacttgttttaggcgggattatttctcacactacagcaaaagagggggagcaaacacctgattttggtaaccttggtaaagactagaaatgtttctattttctctcaaaatgaaagatagcgaaagtggtgatttggcaaacccaattcaatggcacaagggctttcgccattgtgaaaaggtgagctctcagaagattttggggtgtaggtggatgcatataaatggatgaggttgtttattttgaagttattggctaccatctttgttgctgtagagactaggttttattctattgttaaaaaaaacttgattcaagtgtaatcaactaagagttgagaaggccaatacatatttattccttaccattgtcaatgtacatttactatgcaaaaaaccacatcactaacatttaaaacaagagaaattatatgtttcgttattgacaaactaccgattttaaaagttgccattagaaagctcgagctctagaaaaatatcatcgtacaagtgttttttttctcgttttgtcactgccattaggtttccatccataaacctccattaagtctttagaaaaccaatttgcccctagaatttgataaaaactgtatgaaaaaaatgtttgcacacttaatggagatctttttatgagcagaatggtccttttagaagaatgcaggtctatggatggaaacctagtggcgatgataaaaagggacagaaatgcttgtaccaaggtattttgtatttcgtagaactcacgttcgtcgatgccaatttataggacatgtcgcttgtcaatcgtaaaacgtagaatttctcttacaacaaacaatgcttacttttttcatcacaaatgtagttagtaataaaagttgtaagccttgttattccttgggtttatcccgagaaaactcacaaataaattactaagtctgagttgagctactagctatagtttttttttttggaaaaaaaaaagggttggcttactaactagtgtcaacatcattgagtcacggtgatgagaatgcaatatgttctgcaagctatgctaccttcatatagcatgcctctacccattacatgcctatgtcataattttgcacctatgaagggatgagctagatatacttaagttggcactacttcttaagataactccttatataccatccaaagctaccttatatcccaatagggcaaaaccaatggtagaatttgcttgcacggtaggcattgttaggtctatcaactaaggaaacatttcgcttattggaaggttggttgaagagtaaggacagaggagacaccactacaacataaaagctcatcgtggataggctatcaagaactatttgaaattcctcttatatgaatatagagatgcttggttaccatgtccatctacatttgttgataccaagctaaagattgtctttggtgagagtattcggtacttataaggttcatcatcactatatatagttaatgttaattctctcttctctcctgaagccacatcatcctagttatttgtagcctttggatcattcatctacgatgtaaattgtctatgttctctaggtatacacacatctaatttatttctagcatttttaatacaccatctcaattatttgtaccctttgatctcatatgaagatacattatcttaatatttttagcatgatatataatatataaatgatatttacttatatgatgtccaatcatttaaaataaagcaaatctaatttgcatctcatgtttacttatctcatacattttttccgcggcaacacgcatgggggttcccctctagtatacctaataaacacgaccattgtttttgtatatgcatacatgcatgcagatcacgcgaattataacgtagaggatgaagcaatgtgcttacatgcaataatggtgaaaaggtgtcactaatggaccaaaatgggaatgcatcctgctaagtgctagctaaataggcaatagctccgataacaaagttactgcaatgtacacatgcagtaggtagttttttttttcctggcctgtttaaattaaaagcctagctaattaaagccattttcctgtactttgtgccttagttttgctacgtataactacaaatataaacttgcctaactgatgcacagtaaaattagagaaccttgattgtgttttcttttaagataattgaagtgaacactcccgctctacgtataactacaaatataaacttgcctaattatctcttattacataattcactcaaaacaacggagattttaactgaaaaactctgatgtgtccttactcgaaaataatttcttggtaacagttgagatgatgtagacgaaggaaaataaaggatgttgtcaacacgatgaaaatattgaacatttataagtttgtgcatgtttgaaatatcaaacagtattagtgggaaaattaattatgcatatcatagacggtcagatatcgggaaactatccttcagacatactgtcgcagaaatttgtgaattctgaataaacagcactgacaaatttatctccaccggaaaccaaattaatcaggctttcatctgtgcgatgatcaaatttatcttgttcaattacgcttgaaaagagataaatagtattccggcagggggtgtagtgcatgtgcatatgtccaaccaaaacactggaactaacccaaatgaatagatgatgtcaaaggattatttcgatctctgttcttatttttagttaagtactgcattaattagaacaacttgctagctcctgcatgctttttttattaatctctgttgagttaatttctctcaggttagagtttagaaaggttagttctctgttatatatatgaagacgctacaaaactcctaaacaacacaaatgacagagatcggcagaagaagaaatatgtttagttgcagtcatcaaggcataccttcagctccgagttggggtttgcgacgtgctgctgctcctccttagctcgcccatatcgatcaatcactgacttcatgctgcacaaaacgaatggccggcacaactcttactaagattatttttgtaatctgaaagcacatgcatgcgtgtgctagcttttgagtgtaagagtacggcaaaaagggtaaattaacaattatatgaagtgagcagaaatcatacgtataagtgtacagttatcacacaattttattccaagagtgctagatcaattattgcttcactgcaaagcatagttgacatatttattccttcgaaaaatatgcatgacaaaatagtaaacacacaactgacatatggccatacatagggggaccctagctagaagaaggttaaaaacaaagatgaacaactagtagttaatctgagactaacaggaaattgaagaacctgacacatgcattagttcttaaacacttatggccgatgtatatgtatacatatgacagggaataataggtgcaaagatgcaaaaaaaaaatatatataaaattttcacgataaccttttgtactactgaagctgtcaaaggtaaaactcattcataagattctaatctttcatggagagaaaaaaaaaccgtagaaacggagaacaataataagaagaaagatgccaaccaaataaagtgtttacgcatggagagttgaagacgatcgaggaaaacatgctaataatcataagccaaagcaagaacggaatctatagaaaagctaataagctagggccggagggagaagccattgacctggtgctggcatactcgtagaggcggccggtgctggagaagatgacgaggccgacctcggcgtcgcacaggatggccagctccttggccttcttgaagatcccgttgcgccgcttcgagaacgtcacctgccggctcgtcgagttgtcgatccgccggatcactatcttgcccctccccatcgatcgatcgatcgatctcagctggattgtcgccgctcaggcgagagcacagatagaaatggacagaaagagagagagagagagagagaaagagaggaggagatctagctagcagggagctcttgaaggagaaagctcccaggtttcccagaagagggggttgaattattggagggggggggagaagagaggaagaggaggaatggaaatggaggggtcttttgttggtgcctttgcaagttggctttcctttaattgcttccttcctttatttagttaggaggggagagatatccccccattggctaggatcacaaggtgggttattttaactgtgaatgctaaataaatggctgcaattaagaggccagggcaaggccaggcacaggtagctagcttctagaaattgtgcagtgcctggaattggtcgcactactgaggaaagttaaaggggatgctaaggttgtgcatccatagttgtgctactaattaatccatgtttggtctcttaatattttttattcatgaagaactgatatatatactttctataaaatatatatgccattactcatctttatatttttctagcaatttttagaattttgtattaatttgcaccaacgttacttcaaagtttcaatcatttgccatgatttatatattagacatatatagagacatactgaaaaaaataatcacatgcctagttcattaatttcacattgaatttttttcctctacttttttttttgcatatatataatactgcatttgtcccaaaatataatgatgtcaaaagttgctatattttggaacaaatgtactatatacaaactgaatactctaatttaatttaatcttactcaaccataaaaattgccagctaaaattacctacaccactagaatgtcatcgattacgggtggtttaaatcttttactagcattagagaaggtttgattaaccgcctttggaaaagagtaagtgagataaagagggccatcactgcctcacaaaaccgtcttgaaaactgctgcagctatagtttgaaactaatagatcagaacaatgttctccatacggttctaattaagtcgagaacaattaaccatgataggtgtaacaagtgcgtcaaagagaaatggctaaccttttatagtggctatggattgagctcattcgatttccataacatagcaaggtttatcatctacctaccaaaatagtttcaactagaaaaagacttgtaggaggagaaaagaaaataatgtcatttcgagtaaagtgacccaattttaataaccctgatgataattaaagtgatccaaagatagatttcaatttgcagtgatgatagctgctgcctgagcaatctctactatggctggatgcatgctgtcatcatttttccatggacaatttaaaacataaagcctactactctctctgtattttaatgtataacgccgttgactctttgatcaacgtttgaccattcgtcttatttaatttttttgtgcaaatataaaaatatttatgtcatgtttaaagaacatttgatgataaatcaagtcataataaaataaatgataattacattttttttaataagacgaaaggtcaaacatttattaaaaagtcaaaggcgtcatacattaaaatacggaagaagtacaatgtaaaattctttacatgtactccatccgtacttgtaaaggaagtcgttttggacagcgacacggtctccaaaacacaactttgacttcttgtttctataaaaatatttattgaaagtgatatatatgtatacttttatgaaattattttttaagacaaatctattcatataatttttatatttttaaactcaacaacttgagagttatttctgatttatatttccaagacttgacttaaacattatcataaacgactttctttatgagtagtgaaggaatacatgcatgttcatccatgcacttttgtacatctaaatgtagaacttcatctccttaattagctggtgaggtcaggcatctctatcatagctaatgaggtggtcacacaaacctcggcatctctccctaattaagctccgtttcgtcttaaacaacgttggagtactagagtagtatagtagtactagagtacgccaagctgaaaattttaattaatcgatactaaaattgagacgtgcatctcgtaacaattgtcgcgctgatcacatgggagcctaatataatgcacgcccatgagagggccaccatggcccatccaatgagagctagctagctagctcttaattacttggtggtttagttgcttcgagtttcgctgaagaaaggcaacaacctgtgtcacggtgtgtggttaattagtgtagtttattgttctaaatcgagcaaaacgacagagtgcgtgaccaacgatcctcttaattccgacctcaagagattaattagtcctgtttaatttgccccataagctaaacgtaattagagcaggtacaatagcaggctataagccagctgcaaacatattttaagaagataaataaggagagagaagagcagcgggctacagatttgtaatcagctgtagcacggactctaagacgcggtgtgtgtatgataggtgggactagatatttatagtgtagtatgtaactattgtatgaatgagctattagattggctatatatgaattggagctagtagttggctatactattaaacttgctcttaagctatcaagctatacctcatgtgactagatagccaattgattggctgagacggctactaccctactactaataattaatgataggtgtatatatattagatgaatcaagtgtatatatatatatatacatatatatatatatatagatagaactatgtatagattaatttgtacagattgataagatctatggactgcatgtttcggagttcagctagctgtagagatcgtgcagggtttctgaatagggaaagatggaaattagtgacatcgatccgccattaagtggaggattaactatagcaagttgatgccttttgaattcttacgtacgtaccgcgcaccttcttacaagagaaccacactatactaacactcctttttggatcttctagctcgtagtcgtagacatatgcagcttttctagaatctacatctcactcaaacagtagaaaaataaattcgaaatcaaaatggaaatctagattttccatattctcactatggctgtgtttagatcctaagtttgatccaaacttcagtctttttccatcacatcaacctgtcatagacacataacttttcaatcaaatcatctctaatttcaaccaaaatctaaactttacgctgaactaaacacagcctataactgcacctcaaaatttcgagttccaccgaatagggcctaagtatatctcaaaataatagcaataatatgtcccacattaagtttctgaatttccttaatttctgtaagaatattccctgctaatcaggtcttctatgagcttttttaattattcttgaacttgttttattatcatggtcaacaacttacatgctaggatcctttttttatacatcatgctaggaacttgttcgtcatgtaatgccagttgctaaaagtcaagatataggtgataaaaccattatacacacgccctagctaggtattcctccggtcataatgttgtcttcaattatgtgtatatatatgtagctaatccgcgttaaccttaaccatatgtagttactactctatcgaaaatgtaggttttgggtatatatatatatatatatatatatatatatatatatatatatgaaaataaataatatagtcacatttatcataacgatatatatttttaataatactacacttataccactctctttttcatttatgcaagagaattagaatattagatcatcaaagtcattccatatgtatattggcttttagaaataaaatacataagcttttttatgagggtaggtaccactctcatctctaaactcgaaattaagctaccatgaggcagtgttaagaaaggatagatgctctctccctccgttccaaaatatcttattttaagagtaaattgcattggtggtacataaacttgttagttgggtgcaatttagtatataaacttgtaaaatgcttgtttcagtacacgaacttgtctagttcgtgcaaacgaggataaaaataacttggcaatgttaattttacgaagctgatgttgattaggatatgacgtgcatacgtgtagtaagtatacataagacatgcaatatttataaatttggtctctaattttatcttttatcatggaaaagatgaatttggtatatttctaacccttataccattgctcggttttttaatctttttctactatcgctatatcctactctattttttattgaagcttttttattgaagaggtgtatttctaatagcaaccttctcagatatatgtttacatagtatcctaaccagccctaaatcaataagattagccatgttttattgaagaggtatatgtctaatagcaaccttctctcagatatatgtttacatagtatcctaatcagcccctaaatcaataagattagctatgtagtgtctttttcaccttcctccgcacgcacagacaagttcatataccaaagcgagtattttacaagttcgtgtactagattgcacctacctgacaagttcgtgtaccgatgattcaatttactcttattttaatatgggatgtgatataatcgtagtgttaaaatgtgtcacatattttactaggttaatttattttgatatgacacgaggataatatttaattaaggtcttgtttagttctaaactttttcttcaaacttccaactttttcatcacatcaaaactttcctacatatacaaactttcaacttttccatcacatcgttccaatttcaaccaaacttccaattttaacgttaactaaacacaccctaaaacacaccctaagtactgtaaggaattgcattcaccgatgacaggaagtcttgtcgtaggagaagcactaggtccgtctttttgagtgaatatgcgtttctgagtttgagccagccaagaggttcatggtaccaatgctctattattgcacaagagtgcacgtgaacacgtcaccctgaacggcctgcgcagtgcgcacgagagccaatacatttggttttgcacctttgcttatcacgggttaatcacaaattatttgctccacacttttaacaatacaatttcttaaaaaaaaacgttttctagtgtattgattaaactacttattctaagttatttgttaaatttatttattaaaatatttaatttatacctttaataaatatataatgtgcatcaataatacaataaattattaataatttggttcaatcactgccatagatgagcaaatgtagcagttgctagctagctactagctagtagtagtaccacttatatatgttaggttcagctctatgctagttgcagattgcatatgagggccattcctttggatccatatgaagccgtatatgagttataattgcactttcgcgcgcgaaatgattgttcttcatgtatatttttttaaaaaaacgaatgttcttcctatctcagaaaagaaatctatctcctttcaaccgcatataaatagaaatagttggttgtaactaaacaccgcatctacaaaccttaatcttcactaaaccaggatgatctaaaaaacggtgggcgcgacgcataacattgcttataaagcaagcaagaataaaatgatcactctaacgtgtctaaataagtttcagaaccgtcggaccaatcacagccacatctgatgcgatatatagggcccaccttgttagaactcgacgtagatggaccccccgaataacctataatatatataaaatattgttatccgttgtcgtcttgcaacactaaccatataacacaaattgtttgttgtagttttaataacttgggaataaaatgttcagacttcaaaatggttttgaccaatttcctcctatctcaagacatcatttctaataaacttaattaggtgacaaaagaggacatagattagagagtaaataactttgagagatgtggatatatatgcatccctgcgtttgttggtagctcaaatcattcgccacaaaggatcgccgctagcgattcctcgggcaactgctcttgcactgtttcaggctttggtgcagagctcgaaattggccatgtctggccaatggccatacgccaaccgtaatgactgcagccgttgtcatgtgacggccatactgataaatgtcgccatagtacaggacttgcacgttgcagcgtagcaaacgagcataggatgcagccttcccgatgtggcaagcagcagatgcagctagcggcaagccggccggcgacctggcttttaatttccgggcactgttaacttttggccatgctaaagtctcgtggattccaagtgtcaatcatcgtctgcatggcagagggcaaaaaaagcaagatcttgtccaacaaaggtaaccatcggtggttatagctttgaccatgggtgcaaagcacaacgatgagtatcgttggttgaatggttgtccagcgtttggattccgttctcttggtaattggtctagtagagcctaagtaaacatactttagagaattttgtggattaaataagtattaataatttgttgtttttaatagtttgatctggcacaacttaaaataaatcaggtagatgaacaaagccgtgcaagctccgacaaattaaagtaacctagctagctagctagtaagcattgtatgagtttagtagataaaagataagctttggactcttaaccaccattcaacaacatgttaacccatgacatggcgttcaagagaagtttctcgaaatataactgctatgcatgtgcatccaatcaatgagataagagaggatagcataaatattaacacgaatcaggtcaatcacgtgtgggagattcgcattgtcgataacctttatctgtatgaccaattttcaggctataggtttcctacttttgtcgatattgggccactctttgttttattaaaatagatattttaatttgtacaaaaaccaatttttagcacgactatgaactgcatcattatttcggcttgaaatctactatgtaaacattataaactttcaaataaaactatatgcatagtttctatatatatggtgaattccccctttaaagaaatgatgaccagactgggtttatcatgaatgctacaaaggttttaggccatgtcaacttaataattgtcgtgtagtgcttgcaaattcaagtggtatattttttctaatctgcccatgaccgatgctgtgtgcctgtgtggtggactggtggatcatcaaaacacgcgcagagaactggttgcaatggttaagtttccgttaatttgttaccgcaatgacaattaacagcacaataacgtgcatgagtatagtattttctctaaaaaaagattatgtattaaaaccagaaatatggtgcccactagatgagtggaattaatatatcatattaagaaatgtagcaataaccatcattaggcacaggatgttcttatcataaaatatgcattttggtaggacctttgattagaaatttttctgtttataatatatttatttgcaaaactggttataataatatcgaatagattaatcaaagataggaataaaggaaacgccaaatagtcaacattaacaaaccacgaaagattatagcatactactctaaatgaaaaactttaaataccacatggaactgtgctcttaattaattgtgtctttggcaatatataacactaggaacttctgctatatgttggactctgtggttgtgcagaaataatgtggtttttgataaatcaccatctattacatatatgcaggtaatttttagggcaacatactggctccggctctggactcaactacaaaggtctaatgaagatggtgagttcataaaagttgcatgccagaaacttgagacgatggttatgcaactctttaccaattttggatggagattcacaaatagacttcaataaatgtgttctccttatcttagtttggtctctctttaaacattggtgattgttttcgatgtctttgatgttttgttgaactacactcttctagagtgttagattgtaataattggttgtagctctttgagcaaaggccggaatgttattccattatctaaaaaatataaactaggatacgggcgctcgcgcactagtgtacctggtgcgtattatgtagaatctgtttaatatgcagagcataatcttttttgtgttttcaatataagaaaacttactacatttgttaaataggataaatatattcttctatttaaaagtatgtttgataaatttacattcgtaaaataaaatgtgtatatgtgaagttttcatcctacttttgtccttcatatatctatacatttaattatgagtaaagttcatcaccggtccctaaacttgtaccgatgtatcatcctggtccctaaactcgcaaatcaaccgtttaggtcctcaaacttgttcgattgtgttatccaggtccctaaacttgcatatcactcgtttaggttctccaacttgttcagttgtgtcaccccggtccctaaacaggacggtctaaaaactttatatcaaaaaataattcataactttttcatgtgaactctaatgaagacaaactttatatcaaaattgtagccctcgacacgaccta

SEQ ID NO: 76866 - DNA, 769 bp, Oryza sativa
tcctgcggcccttaaagactaccgaggagtcatcccttctaaatacggtcacatcaacatcggtaaaaagacaattgtagcccatggaacataattgagaaatggacaagagattatagtttagagattttaccaagaggacgttagaaatggaaagatcattggagattgcaatcttacccaatcccattacttttccctttccatcgtacccgaagagtatgttctcttgcaaagtgccatttggatcaagggaagaaaacattgattcttctctgggcatgtgatttgtgcatccactatcaatcacccaacttcttccaccggagagatattcctacaagagatcaatctctagttttaggtacccacactttgttgggtcatcttatgtcagtgacaagtgccttacgaacccatagaactctcttgatggaaacatttttgcccctaggcccaacatatttagcacccacacgaccactagcattcttcctaagaacatatgatacatcaaaaggacaatgtgaagcatgaccattaggaaggatacttttggccttaacaaagatgctaagaccttggggcttcttgatcaacacactcttgtccacctttccttttggtggaggaacatacccaaggccttcatggttgaagttgtccctttgatagcctaggtatttctttagtaccttactacccatatggcacttaagcaagccattgtgaaggagtcccataagcttctcattttgcttttgcaaag

SEQ ID NO: 76867 - DNA, 2600 bp, Oryza sativa
agggaaaacgcaaggcgtccggcatggatgggtggttccggctacgtcggcgggagaagcgacaacgtcggcggcggcagcgaggcatcgggcgctcggaagccatgggggatgggagcgagcagggctagtgggtcaccaccggaggcatggctgtggattgggggagaggccgccggtgacggggaggtcaatggaggaggcggtggcatgagcaccgacgcccaactcctctccaccggccgccacagtcgccagagccatgcctccgtcgcgagagaggagaggggagagagagttgatgagaggggatggggattgaggaagaagggggttgagaatgacatgtggggcccgcgtgggccccaccattttttattaatttcagtgtgaaactgacatgtgggtcccccgaggtttattattatttttaattgaattgccaggtaaaggccacgcgggccccacatcagatcaagacctagtcaaattagtcatataggcgccacatcaggcaaaaccgccatctaaaccgccgagggacctaatctgaaccggttttaatagttgagggacctgtaatacctggttttgtggctgaaggacgaaaatcagattcgttgacaagttaagggaccgagatgaacttattcctattcatctagatagatagagaattttttgtatttttagatttttttttttaatatttacagaaatattatagcgccgaaaaaatttgcaaaactagaccctgccgcccttcgcaagggcggcaagccgacgtggcacacgccgcgctggacggcgcgggacggccgtcctcctgccctcttgccgccctggcaaagggcggcaggacccacttgccgcccttacagagggcggcaggcctggccgcctataaagcccagccggctcctttgaggagcccattccctcctaacctctccacatcaaaaaaaaaaaaggagaaggggaggagaagaaaagaagaggcgaagccctgccggtttcaaacttcgatttcaggtaatattcgtagattatatacgtgactaaatatatgatgttaactaggatatcacttgtatttttgtagaactttggttggataaatgcattgtatgaaatagagttttacctgtggtactatataaatatatattgttagatgtaggcagggtttcaaaaaccgccgggggctcggttaaacactgtagtcgtttattatgtaaaataacggcctagtaattaactttgcagatatgtccagtaaacttatatttcaactataccatggtcaaggaaacgtccgttatgggccaactggggtagatctgtcagaatttattgtaacagcaaggggaattgataggccagccgagaggagtgtaccttctattaaaaaatggttgatgcggggcttgggagttgatccacagactagtgacattacaatctactgttgtagtaagtcgggcaacagagggtttttattgggaactaatgccggttcaaaactctgggatgtggagatggtatgtggagaatgcattgcaacgtgggtggcctctagctatggttccgtatgttcatccgaaggatccaagtgtacagatgaacatggatgatggcgaggggccaagtgcagaagtgaatgagattgaagtggatcaggtcaacgcaccagaggaagatggagtagctccagtagtagctccagtaggcatgcaacctggtggagtggctgacgagggggagactgtgggtgccattgtggacgaaatggaaaaagaggatcgtgacaacgagcgtgtcgaggaagatgattcgtcagatgatgacgagaacaatattaatccagctgaatgggctagtgatgatttttctggtttggtcatctctgaaggggaaaatgtgagatgggagtacaaggaaaacgagattatcgagggagcgaggtatggtaatggagaagacatgaaggaggcggtgaagcattatgcagtgtcacttcatagggagttttgggttgccaagtctaaccggacacaatatgaagttaggtgtgttaatgaaaaagatgggtgtccgtggagagtgcacgcctataaggggaaatggaaggactactggacagtgtcggtcgttacgaaacatacttgttatctacctggtgttcaaaaataccacaggaacattacatgtgcatttgttgcatctgagatgtatgcgcatgtcgtggacaatctggcatatgaaccgaagtcaataatccgacatatcgaacagactttcaagtatacaattagctatgccaaggcgtggagggccaaacagaaaataatagagatgagatttggaacttatgaagcctcatatgacaatttgccacgtctgctatctgttatccaacaaagaaaccctgggacctcttgtgcactcaagacattcccctcaattgaacatcctggcaagactgtgctgcaaagagcgttcttagctctacatgcatgcaagatggcattcgtgcactgtcgtccagtactttgtattgatggcacatttttgaccgggaagtatcggggccagatact

SEQ ID NO: 76868 - DNA, 1524 bp, Oryza sativa
gtgctactaatgctcctgtaacaactaggctacaggccctttcacaggaatgaggttttggctttgctgattgtgtgcttgagaacaaattgagggtgtagctaatgggcgatcgatcgccatccccctatacgctctctccccccttcctccttcccttgttctcttcctagtacaccataaattttaaaaaaataaaaaaacaaagttgaaaaaaatatgtgtagaaatactatatataaaaaatatttgaatttaaattcaaatttgaaacgggtatgtaaactttttgacttataaattttgggtctataaactaatatttgaattcaaattcaaatttgaatcgggtatgtaaacttttgacttataaattttaggtctataaactaatattcaaattcaaattcaaatttgaatttgaatcgtagcgtctcattacctccttcaatcatggaacgattgtcctctccatccatgtcgcggcctcggtagaccgtctacacaccacattctcttttttccgagccttttcatttttctaaaaaccgttgtaacacacttgtactttgctaagtacaaacaaaacaaaagaccaatcctaagtgtcttgacactcttataataatctgagcgatccttgactctgcacagcagcatcctttgttcgttcaggtccagaaaagctggtacgctccacgaaatatttatccagaacatcagatggcaaagttcccatgagtctggaaagattagaacaaaaataaatataacaatatctctcaatgggtttgcatgttcaaacaggttttagctctgcattacttgtataaggcaccatgggccactctgatcttgctttttgttacatcaataggggccaaaagctgcaacgtaagatctcccattaatctgcataaaagggccatcagaatggtgggggctctttttgcgtttttggacagttgccctggggaaaggatagatttgttctagcaataaaatcatgtaattaccgtaaatattcagaaacagcatgagtgccactgtcactatttgagctatctgcctcctgtgtcaaggtttttacaaggtaagttcagtatccgtaatctaaaaaggagtagggagtagactgctatgccataatgcacagtttagaattaataaattttaagcttgaggattggttatcaaaacaaacatggatgccctttgccttggtaatgttaaactcgggggaatatgactagggaacttacatatcgaatttttggatcgagagatgatgccgaattagaggagaccaatggcatactccaattgtaccttctcttcaaagattctatgtgtgtctctacaaaacatataggcattattttgtgtgcttatgattggtatcatgctaaatgtgacctatgaaatctgtccaatactgacataaaaaatggtattctcagaaatagacttatcggttacctatattctggagctgctccaatgcagcaagaagattggtatcta

SEQ ID NO: 76869 - DNA, 1281 bp, Oryza sativa
ctaattatgctgccaaattgcggtaccacccatgggtgaaaagaacacggggattgcttctggaagcaagcatatcgcatccaacatttacagaggtcactgacctattggccccttcaatgctaatgatttccattaagcaattttccaaaatgacaatgcacctgacaagctacatcaaccacgatacatcattcgaagaaaccaaaccaataattcaaaagccaaactttcttgttcaagtgatagatgtgcaatgtcataattcctctgcataactaacatgacttgaggtctacatatttcatactacagcatcagaaatttgcaaaaataaacttggcaagtcccaacactccaaaatatgctctatctcagcacggtcaaagttggataattccataacctgaaataacataagcaaataatgaaatagttgtccaacgtagcatagcaattgttatgtaaaaagactaaatgatgacaattagtaaacagtactccctccatcccaccctctatcccatatataacacgcggtcaaagctggcacggtctccaaaactaatctttagcttataatttctcatatactataaggtttgtagcaacaaaattataaccatattaaagtaaatttaaatctcaatctaatgatataatttttaataaataaaattaatttcatattatactaagtgttggtcaaatgttttaaaagttgaatcttaatatgtgtgcgcgccatatattgtggtatggagggagtattttgatgtcattggctttagtgccctttacttagaggatgatcaatctgggatggagggagtactatttgtacattcttttaagaaacctgtagtttaacctacccatttttgaaaataaacatggcagcttcattattaatctactatattcaagacgcaaggtccggagcataaatgaactacttgttaaccacaacttcacttttttgcggccttcacaaaggagaggctaaacagcgaattgatcgtgaacttaaaagagatctaatcacattatagctccatcatggatactaatcagaacaaatgcatttttattgtctggcaatagagtagactagacactgtgaaatgaaccaaatactgataggcataatatcacacacaacattcattggctacttgttatgtttatcaatggcagggcatatgaaacaatttcatgcatggcatttgtattttttttcaatccacttctaggatgttgatgttcgctaaaaatatcagg

SEQ ID NO: 76870 - DNA, 730 bp, Oryza sativa
cccgggcagatctcatgctgaagttgactggcaggctaaagacccagcaatgcctccaatattcttctctcgagacgtcgaatgtttcattatatttatttgatgatataaattattcacttcatctatataatgggaggtcaagagagcctacgacaactctccgcaccgcacggtgcacgcgacacctagccacggcctgccggcgttgagcgacggctggctcctcgcagccaatagctcgctcctcgccttctctcctcctgcttggtgctaagctgacaatgcgatgctgtcactgtcgcagtccggccgtgctagccccaccaccgtctagtccggccggccggccatccccgtgcggccatgctgccgtgcggccaacagtccgcagcagtgcaacactgcagcagctagcagcctagcgcccgacaggccagccgccagggccaagcgcaagcaacacgtgcagacacgtgcaggacatcgtcatttgtggtggctagctgcctagcggctagcgcctaatcgatttcgtcctgctgctatggtctatggacatagaggaacagggataaggacatggtgtggtcacgcacatacatacatacatacatacatatatatatatatattaaagatatctatcgaccatgttttataaaatttttgggtgtatgatgaattatgtatggcgcaaaaaatattactttattttaaactggtttgg

SEQ ID NO: 76871 - DNA, 1534 bp, Oryza sativa
aatttttttaaaaaattgacatgataggttagtatttaatatatcacttcacaaacatacaaatccaaattcgacttctacaagttgtaacaaaaacaataaatttaactgtgaatatatgtatactagttagagtttgatttgttactttcgttacaacttgtagaagtcgaatttgaacttgcatgtttatggagtgatatattacatattaacctatcttatgaatttttttgaaattttttcataatcatttaggtggcatgcaagaaacaagtggacgtccacccgaaagattagaatccatcctcgacaagtcttgcaatcttggtaagaaactaaaatagaacacggactttggatttgttcatatgtaaacaatacaaatttttcgcaagaggacaaacacgggatggtattcaaccatgtaggaaccgttaaaccagaaaccagatttaattttacacaacttcccacgaattaatgcagcgccgccacacggtcaaggcagagaacacgtacagtatacgttgtcagttcacgaggacctccggcagcatggcgtccttggccgccggtggcggctgcacgaagcgcgccagtaccagtgccgcgcccagacggcgcccatggcctcgagcggcacccccttggtctccggcaggaacgcccacacgaaggcggtcatgacggcacccaggccgcgtagtagaggaacgtggcgtacttgaagctgcacagcatggcgaggaacgtctgcgtgagcacgaaggtggcgccgaggttgacggccacgctgatcccctgccccgccgaccggatctccaccgggaatatctcgccggggatcacccacgtcagcgggccccacgaccacccgaacgccgccgagaagacgcacgtcagcgccaacaccgccacggagtagcgcctcgccatcgccgactcgccgtcccgcccgatctgcgaccccatgatccacgccaccgcgacctggcaggcgatcatcacgaggccgccggtcaggaacagcacccggcggccgtaccggtccaccgtggcgatggagacgagggtggagccgaggttgacggcgccgaggatgacggcccccatcagcgacgcgttgctgccgaacccggccgtctggaagagcaccggcgagaagaaggcgatgacgatgacgccggtgagctgctggagcagcggcacggcgacggccatcaccaggtgggggcggtgctgcctccagaggatcctgcggtacgcgccctcctcgttggcgcgcgccgcctcgaccgcgcgcgccacgccctccagctcggcgtccacgtccgccttggcgccgcgcacgcgccggagcgcggcgcgcgcctgctccacccgcccgcgcacgaggaggctgctgggggtgtccgagatgagcagcgtgccgacgaggatgacggacgccggcgccgccgccaggccgagggagagacgccacccccaccgcgggatgcgcgccgcgccgtagtttgtcaggttggccgtc

SEQ ID NO: 76872 - DNA, 2375 bp, Oryza sativa
ccactcgcccgttataagatacttcctccataaaagaaaaattaagattagatgcaacgttttatctagatttattatactcagatatgtctgtcggtgacatggggccgggggtatcgtgactagaggcttgggtagccgcggtcacccacgtggcccgaccccctcgggggggtcgggcccgagggtgacgtggccacccctccctctgtctccccgaggggtcaggccgctcccgtttcggccccgagggctggagcgccccggccccctgtggttttggcgccacgtatgtgggttagatgagcacagcgggctcacctaaccgcatttatagcaggttggacgagcgcgccacgccgcatttaatgcggcgcagcgcacgcttatccggtccgtgaccggtcacggtgtgtaccggtcacagaccggtcagatcgcgggttaggtggcaacaggcggcctgtcacacgcctcgccccgtcccgtcggaatgatgagagctgcgaagggacgacgagtctcttcgctcgtacattcagcggttctgtcaagtccgcaacaccataccgtgcatccccgcacacgcggtgatctacgcgttcaggaggggcgtgcggcacaaccgcatgctcgagaagatcgcctccaaggagccccagaccacagcgcagctttttgagctcgcggaccgtgtggctcgcaaggaggaggcctggtcctggaactcctccggttctggtgtggcagctccggccgcccccgggtccgccgctcggtcagggcggcgggacaggaggaggaagaaggggtcggcccattccgacgacgaggggcatgtcctcgccgtcgagggcgcttcgcgggccacccgaaaggggaggcctgcgagcgacagaaagaaggaggccggcgctcccagcagggagcgcccgaccggcaagtggtgctccgtgcacaacacctccctctacgacctcgcggactgccgcgcggtcaaaagtttggctgagcggacgaggaagtgggaggaggagaggaggcaggagcgccgtgagggcaaggccccggcggccccagccggcaaccggcgaggtgaggccaagcagaaggcccccgccgaggacgtcgacgatggcgacgataacctggggttccaggagcctcaggccacggttgccaccgtcgatgggggagcgtgcgctcacgcttctcgccggagcctcaaggccatgaagcgagagcttctggccgcggcccctacccatgaggcgacgcggcgggcgcgatggtcggaggtggccctcaccttcgaccagacggaccacccgccgtgcgttgcccggggaggacagatcgcgatggtggtttcccccaccatttgcaatgtgaagttggggcgtgtcctcatagacgggggtgcagccctcaacatcctttctcccgcagcctttgacgccatcaaggccccagggatggtgctccgccgtcccagccgatcatcggtgtgacgccggggcacacttggccgctaggtcatatcgacctcccggtcaactttggtggttccgccaatttccgcacggagcgggtgaactttgatgtggcggacctcagtctgccctacaacgcggtcctggggaaacccgcgttggtgaagttcatggcggcaggccactacgcctatctccagatgaagatgtcggggccccggtggccccatcaccgtccatggcgacctcaaagtcgcgcttgcttgtatggagcagcgcgcggaccaccttgccgcggcgtccaagcccgcgggtggcgacgagagactcagcacctccatcccggccgccccaaggcagcagatggtcacgtgcgacgaggtcccggtcaaggaggttaccctgggggacggcccgtccaagaccacacgaatcggtggtcttctgaacgacaaatagaaagacgcgctcgtctccttcctgcgggcaaacgccgacgttttcgcctgaagaccggcggacatgcccgtggtccccagggaggtgattgagcaccgtctcaccgtgcggccgggcgcaaggccggtccggcagaaagtgcggcggcaggccccggaacgtcaagccttcatccgcgaggaggtggcgcgacttctggaggccggattcatccgtgaggtcatccatccgaagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagatt

SEQ ID NO: 76873 - DNA, 1543 bp, Oryza sativa
agcctaaaaagatttgataaaaaataatcaaaacgacttataatataaaacaaatgaagtatgtattaactattgtatcatcatccaacatgcatgacgcatgcggagaataaggcgcgaaggcaaaagcaacttaactcgagacggaaacatgggagctactcccactctcccgtcccggtcccaaccaattgaaggtatcagtagagtggagagatggagatgcttgcaatctttatctgaggcgtgagagcgattggttgacacaaaaccagccgctcaccctagctaactccaagggacagagaacaaattgaagcaagacgcaacaactaccttccagtctacattgccagctaccccgtttggtcgacagcaacttatccttctttcatgtcttttgaagtaattattccagacaagctgacataggcctactagcttgtgaatttgtttccattttgaagcaaacacaatgtctctatatttcttgaggattagaaactttgtatagttggggtgacagtaagtatggtttgagaaaaataactctgttgcgaccaaaccaatcaattctacgacacataaaaaatgccatggcaacgtatgattatgaaactacaagaacagagtgtcatgctccttgaatttctataggaattaaaaaacaataaaatcttgaaactaccattttagatgatacatagaaataggtaagaactttgtggcatgggaagagacaaacatgcggtaaaacctaatgatagttttcctccaaaattcctgtgaaatgaacaattctataggatttttaaaagaaagtgacaaagctagccattcctttgttccaggtgaactttagtgattgtttgtccgtttctcctccatatctctacaaacgtaaaggtggaatcctcttcaatcatccccatgtaaaaaaaccaaccaacctaaaaaaaccatcgtcccaaaaactaattttacacgaaaattgacccatctcaaaggactggatagaaaaaaagaaaattaaacctagtgaaacctattctcgtccgtcttccttctaaattctactagcaatgcacggagatggcactcgtactactttgaaattaaacttgatataaaaagctcaaaaaggaaataaaaggactacatcatgcaagtacacaggacatttcatcacttctgtacatcctcgattgtgcaatcaactatatatctcctgcatagtcgtttatgcttttaaaaatagagaaattttatagtactttgagaaagtattttaagttatctaaattttacactaaaattttagtaacttaagatacttatagtatatgaaggtaccaaattttatataaaacaatatagtactacattccagtatcttttcaatgatggtataacatttcccttaaaaatgcgaccatttctttccttcaaaatgtttcggtgcacgcccggtagtggtggaccggttcatgcatgtattgcgtgaatttgggatcggtttgatcgatctgctgcccggacaaga

SEQ ID NO: 76874 - DNA, 749 bp, Oryza sativa
cctgcagccctctatgcacaatgtggtcgccttaattacaagtttaaaattgcaaaatccaaattagcctaggaatcagacaaggagtagaagtcgtatctcaagctgcagcttccacccaacactttgcctccctccttggcgcaacccctcgccagcagttgatcaatggcggattccaggcacatcttgcagtcgccgccggagaggtccttggtgcactgtgccatcccgtgcagcctctgcgcaccgccgaccgccacggcctccccggcggcgaacagcagcggcgacaggtaggccgtgctgtcagccgcttcatcagccgggacacctccctgtcgaggtcggccgacctgtccgcgccccgcaggacgcgggccggcgggacgacggcgcggtgctcggcgtcgacctcgccgaagaatggctcgccggagtagcggagcatgcacgcgtcgagccagactacggcatacttgttggacgggcacacgcgccgcgccagcgcacccgccgcccggatgcactcggcgcacgttgcccttgcgacgtctccgcggcagagcgccaggccgtgcacgcgctgatcctccccatcgccgccgaccccgaccgtggcgatgtgaacacgatggccggggccttggcctccaggagcgagacgaaggcgccccaggttaccgcgtacgatctgtcggcggctaatctgtccgtggcggagcacgacgcgacaggctccaccacgg

SEQ ID NO: 76875 - DNA, 785 bp, Oryza sativa
  unsure (1)..(785): unsure at all n locations
cggtggannagtgactgcttcatttcctgcggcccctacgtgngataagatcgctctagattgagtcgaggggctaatttgtcccgtattgaaccaactttggttcttcggtttgggggggggtaattcggccaaccgcaatagttcaggggggtaattcgtacttttttccggtggccctcccttctcctcctcctcctcccgatttgtggcggaggtagcaccaaaggctggcccaaagcacgaggtggtggccggtactaggaaaaaaatggaggtggaaaaggaggctcccccctctctcctggtggccctcctctctgttcacctcctcccttctcctcctccagatctggcgacgacggtggcggtggagaaggccggctcggagggcaaggtggaggccgttggctgggtangaggtggaggtgaangccgtcgcactccttccctcaccgagctctttcctggcctcgccatgcgcctcgccgtcagctgccggatccggcaatgacngcttcttagggctctttttgttatttcacttaatactataggtgttggtcatagggtaagaacctgacacctattgccggtttctaactggcacctatgggggttcatgtatactagcgatcattatcatagaatcattgaagggtgatttaaattgatgaaattctgtgatttngttgcaagcctgaaacagctcaataaaactctgtttctacccaatagtatattttatcaacgccacacagtttgaatgcaacctagtttttaat

SEQ ID NO: 76876 - DNA, 786 bp, Oryza sativa
  unsure (1)..(786): unsure at all n locations
tgcgggganagtgactgcttctatctgcgccccgaactctaacaccgagctcactctcatctctccacagtcgcatcgcctcgcctcatcctccagtcctgtgccgagagaaccgagggagagagctcttgctgctctcctcgccttcgatctcaccaccagccgtgacaaagacgatgctcgtcgtcgccgacgagtcttcgccaaccctatctcttccacgttccatactctcctcaccatgcccaagattctccttttgatttcatcctctttcgtacagcgaatcaacgggaacgccactgtgtcatcgccggccttggggcgtgctctgcgcgacgccgttgtgacctcgtcgctgttcccgtcgttctggaccaaatcaagcagagccatcgcgccatcaactcctccatgagatcctcttaaaaacccctcaagaaccgagaagaatggagcaccatggacggagatcggcctccatcgtcttcaacttcggccactgtcgccatgaccaaattctccttcgctggtgagcccctcatcgattctttgcacatgcaccatctatgggacctaatcaacctcttggacatgcatgcatgtgtttgtatcataatttggcttatagttagttcatttgtgcaggccaaattattttggaatagatggtgaaattatcttatgatttgcttgaaatcaattcagtttacatgtgtaggaatttgtgatgcaatagatggttccatgtaaatgggagggtggctttatcatttgatcatgtga

SEQ ID NO: 76877 - DNA, 11074 bp, Oryza sativa
ttggcccgtgcctggcccgtgagtgcggcacgtgggctggcatggtacggcccggtgcgtcggtcgggccgtgccggcccgacaagcctcggcccaggcacggccgggcctgggccgtgccgtgccaggcggcccacatggccatctatagcagtggcaagtgcggccggtgatggacatcgcagtcgctgtctcctccctctccggcgctctttcacccacgacgtccttgtctccctccacctcacgccgtcggcggcctcctgcgaggtagcgacacgagctcgcgaggagataaggcggcggcgagaccagcgaaggcggctcgcggtggcggctggcacgagctttgcgcggagcagataagacggcgacgaggtcagcgaaggcggttcacggcggtggaaggcacgagcttcacccggcgagcaaatccggcggcggcaaggtggggacgatgacatcgggcgagccggcggcctccagattccggcggcggtggaggtagcagcaagcgacagagagggcaagccgacggcctccagattccggctgcggcggcggtggttgcaaccacgtggagcgggtcctcccggagcgacgacgggggccggagtagggaagcccgaagcctgcgaggcaatgaggtggcaacgatgatgaacgacgagaggttgaagacgggggcatttttgtccaatatgggtaaaatatgtatactagcggcatgtttcaaactatataaaagttgtaaaggcattgttataaatacataaattgtaatggtatatttcaaatccacacaaattgtaatggcatatttcaaatccgttaaatttataatggcatgtatctaattaaccctacaaatttataccacgtattgattcttgtcccttttccagaatcagttgtagtggatagcaatttaacttgacaaaaattctttagagcgtttgaataattaccaccagaagaaaattgttgagaagtagtaataggcaataacaactgattttgaagttcatgtcctaacctgctcaaaccatatactccgtaccaaaacatattctcattgcatctactagtattccagtcatcacgtgatacaggcaaccaaacgattccattttgcaccggctcatctaagcccaaggaaacgctttggatggatgacacgtggactccctggggatccgacggtatacgatgtccttccgagcggctcggctcacacagctataaaataagaccgagaaagcgactcgcacacgcaatccatcacgcccgccaccgccatggctgtcttcctcctcaagtccaaggcaatacccacctccgtcatagccttcgccggcgatgtcccgctcctcgccggcggcgtagttcaggacaacggcatctcgccgcgtacgccgatgagtatattccgtacaagcccaggcgagaagatgctggagatggtggcctcgttcccgtcgccggagggattctgcagcatcgactgagcgaagccatctgcgtccaacgacttctcgtgccaggctggtctcattgcgggcggcctcgagaacggcatggtcgccatgtggaacccggacctgaagctccggtgagtcccgcgccgccccaagcctctgttctccttctcgccgcgccgccgcgggcacgccgcgtcgcatctcagtttcgttctcgccgcgcacggcgcctcctcgtttcgtcttcgttctcgccgcgcgcgccttcgtctcgtttctgctctcgccgcgccgccgcgggcacgccgcgtcgcatctcagcttcgttctcgccgctcacgcgcctcctcgtttcgtcttcgttctcgcgcggcgcgcgcgcatgcctttggcgcgttctcgccgcgcatgcgccaaggtttcgttctctcccgctctcgccgcgcgcacgctgttctgttctcgcggccgcggcgggcacgcgtccagctcgttctcgccgccgccgccgcgcgctcgcttttcggctcgttctcgctgcgaacacacctcctcgtttcgttctcgttctcgtcgcgcgcgcgcgcgcgcgcttgccttaatttgctcgttctcgccgcgcacgcgcctaagtttccttctcgttctcgccggcgcccgcttcggcttgtttatcgccgtgcgccgcgtcgttttgcttctgttctacctcccgtttgcactaattttggttcgattttcgcaggaaactaccttcttatctacctgacgaggagatcctcaagccccacccagatggcgttcaaacttggattcgcaaggacttcgaggtcatcgaggactacctcgaccaagttcaagttgatggaaactccagggctctacatctccaagtgtcccccacttatcaggaaatgtctggaaatttgatggtggaataccaagacgacattatgtgtcgcaccagcagctctggcgttgttgctttgtttgccaaacatactggaaaggtacgagttccactcctattcgaattggtttgtgttacattcttcctgtgcctttcatgtctgaagcgcagatcgatcgatttggggatttaatttccccagctagctcgtggtttcgggttgatcgaaatgagcgtagtgatgtttgtctgatcggctggctagtggttaattttgctgtggggggtttgggaggggatcgatcgatctggtgtgctttgggttctagtacagaaagtggagatatggaactggttctcggatggtgcattcatcgtttctcggcggcatgcacgtttcaggcgtaggcttttttactctgctactgctctgcgtttttcctgtttgattcaactttcaaccatgcttgaactgaactgaactgaactaagaggttggggatttggctgaacttgtcacacaagaaatcccttgcaaaagaggggcaagaagatgttggctgttatcgtcagtttcctgcattattttgtgtttgatccagtagttcaagacaagttggtttgtagtagtgtctgtccgagtgatgtcatgttttttttcctaccttttgctgctctagctcatttcagtaatgagatgggagagctcttgctctctttctcaaaaaaataaaaaaaaatgcttgaactgaacaaacagcaaattgtgtgatcacagatttcagatgtgcctgccttttttttcctttttgattgaaatttcaaccatgcctgaactgaacaaactgcaaatagtgtgatcaaagatttcagatgtgctctgctttttcctttttgattgaaaatttaaccatgcctgaaccgaacaaactgcaaactgtgtgatcaaatatttgagcagtgttgttttgttttgtacaggttagaggcctgtcgttcaaccccaatgcaccgaatctgctggcttcgggtgctgctgatgggcggattatgctgtatgaccttgcccatcctttggctgagacaatccctgttcaggtaaatgtcattgaccctccgatatacagttgtgtgttgtttctttttttctaattaagatgtagaatatacctcaattttcattagcacgcttttcaaactgctatatgatatttcctctatcccataaaaaaaaccaacatccagccacgtccagattcatagccacaagttagttagggagtacgtttcgtgcgaaaacgttctacataaaagttccttaatatcaaatacatctatttttaagttcgagtaaattgcatcaacgataaaaaaaaacttggtaggtgggtacaacatactacatgtaaacatccgagtataacaatttgacaagtgagtgtgttttagtacaaaaaattgatagtttagtactttggtgcaacaatttagctaagtatgtgttgttttggttaacgagtgctaagtgacctttttttttcacgatatcaatatgccatcagatatcaatacttggtttgcttgctctaacttcatcttcactagaaaaaaaacacacctatttacaatatatagcctatttaggaggagtagatggtaacatgtttattgtttgctcttttttttttgtcagttatgtgattctcctgatgaagaaatatcttgcctctgctggaactcctataaagttcatgtcatagcatctacaaccacttgtggaagaatatgtaagttcttcttacatgactaaattttctttttgtatttttttagaaatttaatcattattttattttttatattaaaatgcaggtttccatgataccagagcaaaaaccatcattggatggtaactacctttttttttaatatttcacctttctctaattgtgttgctcactaatgaatgtattgagatttttacagtaccactcttgattgcaaaactaagagcggatcaactgtgatcttttgtcctgatcctgattcagaaaagttgctggttgcacgggaagattcaccgtctgtaaaggtaattttctgtttttttccgttgcatatgaatatgcttggaaagacaggaacatcaacttgttaactaaacttgagcaagtataattaatttaactggataatttaatctgtttcagattttgaacatgggaaacacggatcataatcctgctggtgaaatccccttcagtaactcagaaggtagtccgtgttactcggttttatttatgctgtaccatcatgttacaatctttgctggtagtctcttaatttgactcgctagtgtatgtagtagtggattgtaacatcatgttactatatgtgctaggtatcgttgctatgtcttggtgcccacacaatcccaacttactgcttgcgtgtaccaagaacaacaagattttggtctggaacaagaaaactaacaaggttctcccgaatccattatctttaggagtacctacttagtgttgcaaacacaactgttggattgcacgattaatagtcagtccgtttacaggtaattagcgaggcaaccgctgcaagatgtctttatgctcaatggagtagaacaacgccaggccaattagcagtcatccaagaaggcaagctgaggctttgtaaggtgacccccttacttatatttgtcactaaacatggcacactttatatggaagaatgcatgttatatgttataaaaataatatatgtatatatttagataatataaaaatgatgtgtagatggtgatttgacattgcttgcatgttaacttctaaaaatacaacaaaattacaaatgatatgtcatatttgcatgagatgtaaaatattcgagataataattgctagtggatgatgatgtggcacacttacatgttgaactttacgagttagtgggtacaaatatatagaaaaaatatatagatttgtcatcacaatggtagtcattaacacttctccttttcttcgatgcagttggatggagctgatgtagctgagtgaaggctaataggagtgttactgctagttctagatggcgactagattggatatatagttggatggagctggtgtattttcttcgatgcagttggatgaagctgatgtagctgagtgaaggctgagaggactgttgctagttctagatggcgactagattggatagttggatggagctggtgcagctgactagctgagtgaaggtgtttctccagttttaaatgacgactagattggatagagaagttagtgtagctgagtgaaggccacgtgtagctttagataaccacacttgaatcaactatagatggccatctgggccgcctggcacggcacggcccaagcccggccgtgcctgggccgaggcttgtcgggccggcacggctcgaccgacgcaccgggccgtgccgtgccagcccacgggcggcatacacggcccaggcacggcccaataccactcgggccgtgccgggccggccagaaggtatgatgggctattgtgctgcctcacagaaaaagtctatatttggtccctcaactctgtggctgtgtttaaatggctggaaataagtctatttttggttcctcaactttgtgggctgtgtttaaatggctggatagtaagtctattttgtatacctattgtcttgggccatgccttatacgattatataagtctatttttcgtccctgtatttttttatttgatcgggccgtgccgggccggcccaccgtgccgagggtgcagcccaggcacggcccggctgtcgggccgggccggcacgggcacgaccctagtcgggccgggctgtgcttgggccgggccaaaattgcgggcttcgtgccgggccgtgggcctcgggccatatggccatctatagaatcaactattctttgatccgctaaaaatagaaggaataggttcactttgtaaccctcaaaagtgatcgaaatttaatccgtgaccctaaaccacaaaaccggatatctcgatcccaaactcttaaaaccggtgcaatttaactcccttgacggttttggaggacggtttcgctgacatggcgtctacgtggcatcatagtcatcaaataaattaaaaaaataaagtggggcccacctgttagtgattcccctcctatattctctctttcttcgttggcagcggcggcggccggtggcatcggggtgcagcggaacaagtcgcggcggccggggttgcggcctctctctccgacgacctagagcccgccaccgcccgcacccgcacccgcatccgatccatcctcgcgatgaggcgctgatgagtagctgttgaagaggagctcggccggtgccctgcaaccaatccaatccacgagtatcagcaacaacatgggagatccatcaccaagaggaacaaatacaagagcaagaagctatagacagcgtacgtgcgtgaatgggtcgacgggcatggcgatcgtgtctattgcttttcgcattgcccacccgcatcgcacttgcgcagcagcagttggagctgagcaagatgagcaggagtagagaggcgacagagaagcggaggcgagtgtccatggatgatcgcagcgactactccaacgttgcgctcgtggatccggcctctccggctcagcaacgacggggacacgcaaacgaggttgagcttgaggagaatcgtcggtcatcatccgactccctattcccgcctctgcgttggtccctccatcctcattgcgcgccgccgctacgaatcagtggagcagaggaggatgagagcgggggcgagatggcgtcggcaccggtctcgtcgaccccgtctccgccgcttccttcgccgcccagcgcaggtgcagctccagccctcgcctgccctcccacctgtcgcctcagctccggcctcgtcgcttgccatcgctcgctctcgccgcctgctcgctctcgtcgaccccgtctaccttgttgtcaactacgagtcagcacttcagaccgccaagtcgaccacagttaaataggctacctcaaatattgtactggtgtgattatggtgaataagagtaacgaccggctttggccaacagaaataggattattacttgacaattcaggggctcggacctgtataaaaatcctcgtccccatctcttttattacaatctcacatatatcctagtactaatgatccctattctatgcaaataccggaatcacgacatcaaacgtcgacaagcggtcaatcttattatttttgtttcaaattatataaatcaaattttaactcgcatgtttgaaaaagaaatatcatatattgatctatcttgataatgttttttataactttttgaatgacatgtataaaataaggggatgtcccatcgactcgagggacaaaattccacttcccaaactctaacatatatagtaaatacaggacagtttgaaatcccatcgaaattaaagaagcccctaattcgaagcggattattcgctcacaccatgtcaaactcgacatacaaatttgatcggcactaggtgacatatgaatcagtattttaacgtacaccatgtatatatgtagcaaccggggcaaacctaagccgaacgatcgcctagctcgcgccgcgatgaacgacgacgtggtgagcgagatcctcctgcggttgccggcgaagccgtcctccgctcccgcgccgtctgccggacctggcgccgcatcaccaccgcccactacttcatcaccgcctactcccgccgccgcccgcttcagctcctcggccacacggaccccagcgatcactttacctccgtctacaccttgacctccctcccagccacggctgttccacgcatcgacgacggcggcgacatcgccggctgccggcgtttgcttcaacgcggcagattctgcttgagcctggtgactacctgcgacggcctcctgatgttcagaagagtgcagaaggggggcatgctcatctgcaacccggcgacgcggcagctcgtcaatccggtgagccctgagccgtcgtcgcggccaaaggataacgagctgcggacactgggcttctacttccaccggccgtccggcgagtaccgcgtgctgtgccaccgcccactcctagataataccacctacatcctctccaccggcgccgccgagccacggcagctcggcggcggccctgactaccaccgctgcaccatgttcgtcggcgagaccatcggcgacaccgtgtactggtgccgcccccgttacctgcagaacggcaagccacagatatcgtcgttcgacacggtgtcggaggcgttccgcctgctgccgccgcctccggtgagcctcgccgaggacgaactggtcgacatgatcgacatgcacggcacgccggccgtgtggacgatgaccgagctgcacctcgacgtctgggccttggacgaggatgagaggtgggtgcggcggctgcgggtggagatgcctccgccgcccgcgccactcgcctactggagcaagggcagctggaagaacgccgtcgcgacgttcgagtccggcggcggcggcgtgcagatggtggtggtgacctgggcttggaagttgctgtacgacgacaccaacaaggacaggagggtggtgggtcgcaccgtcgcactattgttccgagacactgtggacatttcgggcacaccaattgttggtttcatgcctaccgggagagcctcgtcagggtggaatcttgcacgccggacctcccgccggacggcgagccctatctacagttctgttgagtacaaacacgtcgttactagctactgatactatgatcagtacttcctagtctaactattcctctgttttatatagagaggtattaagttatttttgactttttttcctagttattaaaactttttaaatttgactaagtttatagaaaaataccacaatatctcaaacataaaattaacaaacatattatcaaaatatattcaatattatatttatcatcaattcattatactacttaaaaaaattgtagtgatggtggtgggtcctaaacgatcgaaggtttgaagtccatccatggatccttccacacaattaatggtttagagtcctttggatagcgctccatcgcattattccgcgtgtgttcgttgttgttcctccgcccacttctcttgttctctccaaaacaacttctctcacttacttcctactcaacacccccagcgctccaagctgccgcaagtctatcgctcccttctcgttcctcgtccacgctgccacccccgccgccaagccccctaacgaaggttgtcgccgccatcgatccgattctgccccttccaacccacgtcatgcaagtagttgtactaacaaatgctagtatcaaactagggaacctacaccgccgagcgattttaaggtttttctcccgtcggcacagagccacggaagaggtcggtcgctgccacgaggtgctacatcggattcaagtcacgccgccactcactttgagtactaacaacaggtgtgacccccaatcgcccgtccttataaggatccatcgacgttcgagtcccaagttctgacggtagttatggtcgtgtcatctttgatttgtgagaaatccaccgcacctattgattcatcccaaaggaggaaaaaaaaattccaagctagtaagaatgagagctggatgattttgtaaaattaacactatgtgtgaaaggggacatagctgatgtggcattttcttctaggttggtcaatggtgtggcaaaaaattcttttgaaccacagttgcattcacctagtcaagatattggaatgttacgttcaatttttgagcttttacttttacatctaattgtacgcacctattaagttttttcccttatcacttttaagtttgcaatttaccttgccactagttatgcttaattataattataagagaaataataaatttaacaatttttctatatatttgtcaataaattttatcctaaaaatttaacagatgtaattacagtataatcgtagtgtaattacattgtaacttacatgtaattacactgtaactataatgtaacttgtatgtaatttttaaaaatctctccgtaacatgttatttcggtaaaatggaggtcgtgggaacaaatcatttcacatgtgtgtgctgtgatttttttcctcaccagaacaaatattgtaatagatctaacgattcaaaattatgtgaaacttacatacaagttacattgtagttacatgcaagttaccgtataattacactacgattgtactataattacatctgtcaaatttttaggagaaaaattgtcgataaatgtataggtggtccctaaatttaatgcatcgacaattttattgttactgttcacgtaatttcttttgcgccccttcgtttttttgtttttacaaacaagttcctggtgcttcgcctcgcgctattttcgggccgtttctcgggtgcggcccagcccacgacaccgaaccgcaatcccctccttcgtttcgccgcggcggctcggaccacaccactgctccccgccgccgccggctgctgttacgaccgacgaccccgctcgcgccg

SEQ ID NO: 76878 - DNA, 12141 bp, Oryza sativa
ctcctccgtcaaaaaaagttataaaccttaacacatccggtaccgtgaatctgaactatcctaattccgtccaatacacagtctcatctttacgattatgtttatacttattagctaaaatttattttttcaaccttaaatttatagctgattttgaaggtttttatcaaaatttatttttcagcatttatttttatatcactaaaaacacacacacacatatatatatattatttataaattattttttgtttataaatagtataccgtatggcttattccacaaataaccgagtaaacaattgggctgacagaacagcaagtacggtttctaccatgatggcagccaccatggtagaaggagtaaaacgcaaaaggtaatactagcagcaacagcacgtccattctgtcggaggggtacagccagcggaagaaccctatctgcgtcactgacaggtgggccccggtggcacgtatgccccacctgtcagtggcgcgaccgcagacgctgctcgccctgtagccggccgttagttacagctagtagccgtgacctgcctgggattctctgcggctgctactgtgcaactgctggtgggcggggcacgcatctcgaggcactcgagaagaagcatgtgaagatgcgatgggaaatgaatgatgaagttggattggatggtcaatgaggggcaagaaatgcaggatacaggtagcagatggcagctgcagcacgaggctggcagcagtagtactaggagttaacacgcaaaaggcaaggaagcaagcaatgcctctgcggctcagaacgtggcgctccagtagcgccactgtttcgtgcattggcatgcccctaattgtcaccattttgttttaatcctaattggcttcgcatttaggggaatgtttggttggtcatcattaagtttagttagtttgagatatggcggcacatatgtggcttagaaatagttggccacggtccataaatatggcatgcttagctccaaatttaagagtatgatactctctcagttccgaaaaaacaaatttagaattggatgtgacatattctagtacaacgattatggacagaagtatgtccagattcgtagtactatgatggttttttatgggacggagggagtatgtgggttctaaggctaaaaaagtgtggtatgacacaattatgatagtgaaacaaacacatacttaagaaattgtggcataactaaagtgtgacaaggcaaagtatgacaaccaaataattaattttgaacataccagttccttcaatccttaacatagtagcaacctaaaatccgatagaatattttatagtacctataatgaatttgaagtctggatgacatttttttagattcgttgtactataatgacatattcggtttcatgttgatataaatattggacgaaagaagtcctagttcttaccactgtcatattgtcacaatgagcaaaatttgctactccgagttgctgtcaaattttgaacagtagtactgtcttggcagaacttctcaccaggttgggattcgtttgtaagacatgtttaacatcagtaggagtagataccaccggtatgattaagtgtattaactacatgcatgacagtcaattaatcgcgccgtctcttatgattctaagttgctggctcaagttaagtctcgtcaacattcttttcagaaacgaaaacagactactgcctatactacttgttaattactccagctgcactgcgttcttgaccttctcaaatcagacgatcgaacaaattgccaatttgtcagcagttaattataaatagtcaagaattgcacaacaggctcatcagctaggccattcacttataatgcaatgcaagaaccgtacgtacaaaactaccactagtacagaaccagtgcctaattaatctgctgccagttaagaccaaaatctggagtggtttaaacggattgattaatcaaagtagatgatggatttttgcattagttggtcaatcaaagcccatcatttggggcttcttcatattcatatcattttaaaccatatcactgtttgctaaaactgatatatttagtttgttaccaaaatattggtcatgattggagaatttgacaacactatatttagccaatcttattaaaacttgttaatgttatcaattaatcaaaattttggtaatacaaaacgttgaaaatggctgtaaagtgaacaagctcttggtgtttgattagctagcaacctcgtcattaatctgtgttgacttgctccgtgttcgtgtccggtgcgtgaggtgagctggaccggaccaaatccggcggccggccggtgagccgccgtacgacggatggaacgcagctaattaagctagcttagctcaatcatcgcttgattaaacttcaagacagctaaggtttgtggctacctagccgtgttgacattaataatactctgctggtatttttgtaagcaatctaatctggtactccaattgagatcgatctgcgacgctaatgatcttctcgctgttcacaccgttttgggcctggtcgatttgaatataatttgtagaaaaaataataataataacagttgggctaatgattatctgtagttagggcatggattatggatgcatggaaggtgaacctaacgtctggttagctttcagacaacaccgtttcctcttaacctcacagtacagttttgttcgtgtaccactattattgcccattgaggcagacaggcagagcttttgccctcctttcaaaaaagaaaaacaattattgctcatttttcattgcacgaaaaacattcagcataaaagaaaaatcatgtcatccctatctcttgtttccttcctgggtgttgcacaagtgcacaacaaagttgtcagtacaatgcaacaggatagaggcagctgtttttataaatgaaatgaagtaaaataaaaatattctactccatccagtaaaaaatattttaaaaatcgactgaatttttttcccctaaatgtcaaatactccactatctactatagggaattttatgtggaaaaattctctccccccaccccacacacacacaaaaaaaaaagaaaaagaaaaaaaacacaaagagcttcagaacatcctctcagcccaacccatctccaagcccaactcaacacaccctacacgcaccccataatatgggccttacaatctcaattcggcccataccaaaatatccgcaccacgccacgccacgacaccgaaaccgacttccacaccacgcgggccccacatgtcacccccacgccaaataacgcacgcgtcccacgagccaaaccccaacccaaaccaaaaaacagaacacaaccacacgccacgaaacgaacaacaaaaaaaagaaagaaaaagaaaaaaaaaggagaaaaaaaaaacacaaccgcgtcgccctcctccgcctcccaacccccctcctcgccgcggcggccaagtcgccgcccgccgccgccatcagagtccacgcccaagtcgtcgcctccatccacctccacctcctcgcggtttccatcccgcgaagccttggcaacgaaggattcgtgctccgatttggagaattgggggggggggggggagggatttgatcttgtggtggtttgggtgatcggtggcgatgggggagggcgcggcggggtcgtggtacgtcacgagggatgaggtcgagaggggttcgccgtcgaggagggacggcgtcggcgccgccaaggaggccgagctccgggcgacctactgctccttcatccgcgacgtcggcctcaggctgcagctgtaagatcgatcttctttcttcctttccatctggttgtcgaattcgatccattctcgcacgcggcgtgcgcgttaaatctgttgagagtgatttatatgttgttggttggttgctgttgatgggggcgcgttggatttgggtttttttcctgatgaaagatgctaatttaattttattttttgcaggcctcaggtgacaatcgcgacggcaaccttgctctgccatcgcttttatctccgacagtctcacgccaagaacgagtggcaggtaaaaaaaaaatgcagttcttcagatacggatgcgcacatttgtttgcccactagttgtggcactatccaatgttgaaaatcttcctctgaggttatagtgacactgataattaaagctaatctgccattgccaacagcgagtgaccaaacgcttttgcatcagcaaaaatcagtggtgccatttcatccgttaaccaactgtttcgtgttttctgcaatcgatgttctgtgcctgtagcacactgagatgcaatggccgatccaggatcaaaatcccaaccctgcggagaatgtatcaaaagattatatatttcagtttcaatgcaaatatgagaaattatggggttagttgaccccgcaggtcataacgtggctctgccactgctcctatccacaaaaatataactatgtataaaacaatctatatttgccaccataaaaactcttgggctagaaagctctacgcactccattgagggtaaaggtgttaacacttactttttttaaccatgtcgtataactaacttcatttcttacttgtgtagatgttttcggaagttaaaacttcctatttttatccgttggatcctaacattacctgactatgtaccatcctctggggttagtcgagggtagtgtagtcacgtgggttgttaagaaaattacaccggcatggatatatggatacatacaagctggtttgatgtaaatgtgtataatcatttggagcactgttgattggatcattccttatgtggtgtactggtcgttggagtgataaaaacttcccatgaggggtcttttatgaaatataagcgttgaaaattttcacttcgacttgaagttcgcccatttaagtaatgaatctggaagtgaggtatagctttaagcaattttactcggagcaccaaaaattgcaattttgggcaagacacgtgattcttgggagcgactttatcaaacttgaaggcaatgctttctattagtactatttaccagtaagtaataacaacttgtctttattgctatttgccttttccaatataggtgcttatttatttctagccatgggaaatttaatcctagatttgggcccatggtactaactaacacaaatgcgcaagtttatttaacaatttttactattgaacatgtaaatcatagttactatctgttattccagaccgttgcaactgtctgcgtatttcttgcttcgaagattgaagacacaccttgcccattacaacgtgtcatcattgtggcatatgaaaccatgtaccggaaagactgtaacgctgctcacagaatctaccagaaggtgcttaaaactttccattttttctattagtatactcttgctatataaccggcttctttgtcataacttttcttactaaaagcaggaagttcttgagaagcagaaagagctcattttggtaggggagacgctgttgctttcaacaattaggtttgatttcaacatacagcatccttacgagccactaaagctcgctctcaagaagctgggcattttccagatggaagtgaaacaagttgcggtgaatctaataaatgatgcgtaagttctttgcgtcaccttgttatttgtttattcttgaaattgcaactctgttgtttctgagttggtactgctgtcctgtttatgcaggattcggactactttggttgtgcagtttaaacctcactacatagcagcagggtccctctaccttgctgctaagtttaataattttagacttccttctgatggaaaagtatggtggcatgagtttgatgttgctccaaagcagttacaaggtacaatccttataatatggattcatgaagttttagccttttttccagggttaaatcggaccattgccatttgttttcaattagtgccatcgattttccatcgtgctgatgatttattccacctgcagctgttatccaacaaatgacagagctatttatgggaagaaacccatgctccatgggtcctgccatcaggccaccgccaactccaagtctgatggagagacagcaggtgatcaggccaccaccaactccaactctgatggagagacagccgataatcaggccactgccaactccaactctgatggagaatcagcacataacacactctttgggcgctgttatgaggcatacgcactcttcaataagaagtctaagcaataactttgatagagaggcttctaggtctttgcctttgaacattccagctaatcgcaaatcaactgtttgcccagcaaggaatgaaggcaatcagtcactgcgaatgcatatgggtcatagcaatggcagtgatgcaaggtttgagaaacaatattcccggggagctctgaaagcagatcatgtttaccatgttgtcagcggacagaaggatcttcatgtgacaggaatcagggacttggttaggcagaagagaacattccatgaagttggagagcatccagctcctattgataaatctgacactaagtcctggatcaggaagcgacatggaagaaatgtgatagtttttgacactaagtcatcatcttggaagaaacagaagctgtgattttagagaagttagtcatatctatttgtaaagacccattgtctcgatctatagtttcccaccaaaacaaaggtttcttagaatgatgagatgaagtatcatcatgaaagatgatatggatcgagtaacttaatctgctggcgtacagcaattgctcataatttgccttgggaagacaacaaagtgattcagattcatatttcaatgataatgtatgccatttttccctgtatatatatatgaatagagatcaaaagcgctaactgtgagtagaatcagccatgtggcgcaaagttttgtaatctgatttcatgtgtgatagcatttgtttttcttctaatgtagcctaggaaacattttcctttcttgtagtgggcctaggaaacaatcttgtataatcatatatacctttgttagcgtttatataatgaaattttgttttcattggtttctgattgtcggctcaagtttgaaagctgacctgcgtatattctgcaattctgcagttttgacgttgttaagagtaaatcgcggcggcggcaggaggtggagtcgcgcgctcgtagaggagaggaggtgaggattgattcgatgggttgtttttgacgtgattatgggtgacagtgtaaaatatgcggccgtatgcgtgtctcatgcatcaacccttgatgtcatggatgggtttagggctgacttgagattcagcccctttgaacatgctcatagaaatgctataagtacttttattttactagcaaatatgcttagcgttgcactgggtgaatatcacaaatatagatggttaagattgcttgtgtacttataacacgtgcacaaaaatattaaatttgtacataccttgcaaatatctccaaattttatacatatgaactgttgtgtaaatcatacgaattccatattatcgtgttgatctgtagcattattgatgagcccatctatggtaataattttgaaggttgtagctcaacgaatttgcattggctatgtatcttagtgttgatatgtcactactataaaaacacatacacagatcggtactataggtgccgatctgtatatatacatatactataagtgttggttttctaaaaatagtatcagagctgaccctcgcggttgctcatacggattagtatgcgggcacttggcatagcatatagcacgtcattggacgtacggacgtgtgctaagagggtggggcatatggcgcatggcgcatgtgggctctgtgtaaggcatatggcatgacactgggtgggcatatgaatgggccagttgcggcggtagcggcggcggtggccttcttcgtcatgtccagaactctcttccacatcggcggcggcgtgcgctggggcggcggtcggagcagccgccggcggtagcggggagcagtggtgtggtccgcgctgccgcggcgaaacgaaggagggggtgattgcggttcggtgtcgtgggctgggccgcacccgagaaacggcccgaaaaatagcgcgaggcgaagcactagcactagggacttgtttgtaaaaacaaaaaagtcaaaaataacttatataattactctataaaacacagaggactaggaagtactactaatcatagtatcactagctagcaacgacgtgtttgtactcaacagaattgtagatagggctcgccgtccggcgggaggtccggcgtgcaagattccaccctgacgaggctctcccggtaggcacgaaaccaacaattggtgtgccagaaatgtccacagtgtctcggaacaatagtgcgacccaccaccctcctgtccttgctggtgtcgtcgtacagcaacttccaagcccaggtcaccaccaccatctgcacgccgccgtcgccggactcgaacgtggccacggcgttcttcctgctgcccttgctccagtaggcgagtggcgcgggcggcggaggcatccccacccgcagccgccgcacccacctctcctcctcctccaaggcccagacgtcgaggtgcagctcggtcatcgtccacacggccggcgtgccgcgcatgtcgatcatggcgaccagttcgtccttggcgaggctcaccggaggcggcggcagcaggcggaacgcctccgacaccgtgtcgaacgacgatatctgtggcttgccgttgtgcaggtaacgggggcggcaccagtatacggtgtcgccgatggtctcgccgacgaccatggtgcagcggtggtagtcagggccgccgccgagccgccgtggctcggcggcgccggtggagaggatgtaggtggcatctacatctaggagtgggcggtggcacagcacgcggtactcgccggacggccggtggaagtagaagcccagtgcccgcagctcgttatcatttggccgcgacgacggctcagggctcaccggcggcagattgacgagctgccgcgtcgccgggttgcagatgagcatgctccccttctgcactcttctgaacagcaagaagccgtcgcaggtagcctccaggcccaagcagaatctgtcgcggtggagcaaacgccggcagccggcgatgtcgccgccgtcgtcgatgcgtggaacggccgtggctgggagggaggtcaaggtgttgaagggggtaaagtaataactggggtccgtgttgccgaggagctgaagcgggcggcggcgggagtaggcggtggtgatgcggcgccaggtccggcagacggcgcgggagcggaggacggccttcgccggtaaccgcaggaggatctcgctcaccacgtcgtcgttcatcgcggcgcgagctaggcgatcgatggccttaggtttgccaacttggcgtgcccggttgctacacacacacacacacacacacatatacatacatatatatatatatatatatatatatatatatatatacacacacacgtcatgtacgttaaaatacagattcatatcacctagtgctttatttcttagagtttgtctcaaaaatatgcacaaagaatgtagatcgagttataataggattagatgacaccgtacctcacatgttgctgtgagatactcatgtatacattgtagctgctagatttcaatattggactagaaaagatgtccgtgcgttgcgatgggaaaaactaatgttacgatgattatagttattttatagtttcatagaaattatatatattggatactcctggacataaataataaattaaatctatgtctaattctatatcatgacaaagaaataattacatttcgttgactccatctagctagaaataatttattataaagaatgaaaaactatatcaaatttcagcaatttttaatgcctcaaaaagtgcttaaactaagtttgttaattgaaaaatagtttaaatcagatgaaagaaataaaacacaattaggcccacaattagaaggacgttgtgtccaccttttaagtgcactgggcccatgtgacaggccacggacaaagtcggcataagtgcgctgagagtcattgaattcgatcgaatggctaggatcaccgtgatttagataaaacattgtttgttgaaaccctaaccctagattcattcctcttctctcccactgtgagcggtggcgccctcccttagcacgggtggtggcggcggcgtccttcccttccgcgaacgacggtggcggcgccctccctccgcatgggcagtaatggcggctccctcccccaccgtgagcgaaggcgtccttctgcggcttcaacgggcggatccggtggcaactgcgatgtcgacggcttgtcgcgggtggatccaacgacggcggtgtcggcaccgatccggcggtcacaactcaaagtctgttatgctctaccttagtggctgttttgccaatcttgctgagcatgctttgcagtacaagtgaacatctccagaagatagcttctttatatctgttcatccaagaaaatgaatcacaaattcataatcataatatgaacaggggagattacattaagataatgcagtactaacatattagcattttacttgcaaatcgacttaggttttcagtggtactagaatcctagaggcatgcgacgatttggagtgactagcggtgataaaattattggccaggaatcaaccagaaagctcataaaccctactacctaataatttcataggacagtaaaacacatgagtagctcaccatcgcagagggagagaggcgcgggcggctcctcgccggggcggcggcgacgacggggaggacgagcgcgatatacaagttgaaaaaaaaaacaaattaaactagaaatagttatggtacattcgcggctatatttgttattttgttataacttgtataagttgaatttaaacttgcatgtttatggagtgatatattttatattagtttatgttgcaaattttgtgataactatttagatgacatgcacgaaacgagatgatatccctcgagatcacattcttcaagtcaggccgagctttaataaatgaactccagcccacaaaaatgaaacgagcccaggcaataaaataaaagaagcccaacccactgtacataattaaagaagcccaggctacgtaatcaattgcgacacgtatacgtatacgtacgtggatgtgtgcagcatattgcgaccgcaacctaaatgttgttggacaatagtacaagttttgtatgtgtaggtctcaattaataaaattgaaacaatctttgtgaataagtagtatgcaattctatcttttgagacattgaatctgtaatcattcaagctgtaccctaaaacttccttgaacctgtttctagaactcgtagttgaaaattgttttgcctcttacaaatttgggttaattagataacatgacattataaatatgccgatttcgaaatatgccattagtattcgtgtatttggatccatactattataattttgcacatattcgagatatgccattgagatgcatttacaataattttttgaccaaattgcccttctttccttattcttcctctttcttccctctcctctattccaggagaccggcgatggcagtggcaatagatggccataaggcccgaggcccgaaggcccggctaatggcatggctttttggcccggcccaagcacggcccggccgtacctgggcctcccctccgacacgctgggctggcccggtcgggttggcccggcacggtcgggtcggcctagcacgatgggccggcagaccaggcccggcacacaaagtatagggactaaaaatagacatataaatgtcattgtccaaagaatagggatcttaaatagacttatttagctatttatatatcacagcccaaagaagagggaggtaaaatatacttttttagctaatatgtcacagcccaataggagggaggaaaattagacttattctg

SEQ ID NO: 76879 - DNA, 4377 bp, Oryza sativa
atattgcagaacagcgtctaactcattgtaatcaaaatcctacagagaaatgtagttacaggcattatttatagccaaacaaaatccaaattgttttataggcacaagcaagaacactaacctcaacaattgtatctgtaccgtactccttcctccatttaagcatgtcagtccacatttgctttgctttctcaatgtcaaatctccttgcttttagaaatctacacaaatcaattagtcaagtcatcagcatgtttgcagttgggttaaaaaaatgatggtaagtaatagggtatatatacctcagcatcatatgatagtcatcatgccttgcaggcaacaactcatccaaaatcagtgcttgtctaaatgcttcaactgcttgcagctcctctagatcacgcacatcttcaatagacacggagaggacccgactgccgctcctcctcttcttctttttcaaggaatgcctaattttggttgatgcatctatagcttttttcttcagagaacccattcttgttctcttgtcatcttcagaattttcaacgtctgacttgtgatctctcttgtcatcattacttgaagacccttcaaaacctggatcattggaaattttagaatgcagataaagggtgatatttctaaacattctaaacaaaagaactgctcatgccccaccacatccaaaaaagaaagaaaaggaaaaaaatctcggtaatcgtgcaaatttacaacaattagctacttgtacataaataaataaataaactttgacaaccgctcaacttatttaagatataaaattaagtttgtctaaactcttcatgctagcaagaagacaaggtgatgtcaatttttcagcaatctaagcattggaatagctttgttcacaacaatgaatccaccaaactagcttagttacacaactagataattcaatactaacaaccttatgtatccaaatggttacagctggaaattttgtcaacttttgtcaacaaatgttatgtaacttttgtcaacaactatacccaaacaatacaagtttctacctaaaaaggatttattcaattcttttttataagatgatgaacatcaaaatcctacccaacatgatatatgtgttcttaattgtgacttttagtgtacgctgcgttgaaatttctggccatctagtcaaccagattcagaattcatgaatttaagattgtgcggagcttgaggttattgaactggtcaatgcagtgttctatgcggaaatcgacatgaaaccttctccttgtatcaaaaacattttctcccttcaatcaagttgaagcctatatagtaagttagtttcctgtcacagaaaaatccagcaccaaaccgaaagtcccccgtgaattttatgcttcacaagtcaaagcatccaacctagcctggccactcacattctgggagctacgcgtccatcaaaaccagagaacatggaaccttcaacaagaccagaacagcacaatattgaaccggtcaaactcgaaccacacatagactggacgcaaaccgtcctacgactcgatggatactaagccctaacttattccaaaccagaacacacggaagcgagagaactcgcagcgagcttgattcgcctaaatcctaaatctaatctagtctctgtgattaatccgggttctaacgcggcgccagtgcaggccaatcctcacggcgagacatcccaatgcagccaatccaatccaatctcataaccccccagcaatcaaatctcccaggaaaaaaaaatcgagcaaaaaaaaccccaaaaaacagaacggagagaaaaatcaaaatccccaactcacatggccgcgcgaggcgatcgagatgccccgacatggacgtcgtcggacgaacaagcacagcctcctcctcctcctcctcctcctctcccaaacctccggatcctgcaacgcaacccgcattccccgtcagaaaccctagccccctccaccccacaaaaaaacaaaaaactcaccaccgcggctacctcgagcaccgcggagatctcgccccccgatgatgtacccacctcggtcggtcgtcgtcgtcggcgccggcgaagcggcggcgcgggaatcgaatccgaggcgaggcggtcggggaggggaattttttggggagaggcgtcgcggaggaggaagaagagagagagggagagggaggcgggtgggtggtgggggaaaggagtggggaggtaaagtagtggaggtaactttaaagtaatggaaaagatgggaggaaggaggcgacgtcgacgaggtggaagaaggaaggaggagcagccgatgccgattcctccgggaattcggtgcgcgcttcgcttcggcttgtgtggtttcggattcgcttccgtttcagcccctcgggtttctgggaatttgcgttcgcgtcctccctgggttggctgatatttgtggcgatggaggcgttgggtacggtgggggtttagctaaccgtcttggagtaaaaacccgttctatatctgtttacccaaaactaaaaaaaaaagcaaggattttcggtaacctttgccgttttgggagtaaaacccattctttgttggtttgttgaaagcctgataagaccatgaaaaatatgtatgaaaagattaccagtttgggagtaaaaatcgctctacctgagaaccaaacaaaaccgaacaaaaatattcaaggacttctgatgaactccgtataaaaatcagctaaaacatgttacaaaccagctgccgacggttttgtgaaacaaagtggtttttcgtgataactatcaacgttaaccatgtatacattgatgtttatgtggcaagttatgaatatcatataattgagttcatgcaatatcaatagagtcatgggttgtttgggttggaataaatttgggatagtagtggttattatattagtattatagcattagataaatattcttgctatatgctgcttatgtttgtgataaatgcattgaatgacgacaagcaaatatattagagcttaggacaaagaacatggcgtgtgaaaaagagcgtgaatctttgaagtttttggcataaagtgatactcttctactttgatattgcactaggatttgtcgagcaataaccaacatgagattctcattcttaggcctagttcttttcagaatataaccgctagattatcatgggcataaaccttgtaattttttaaaataaaactatgtagggatatttttcttaaaatttttgaatagatctactttttttcaagtttttaatctttaatacaatcatgtcttaattaagtgccttctccatgaagctaagtgactaatcgtccgaaaagctaaaacggtccttagtgacggccgggttgctttagggtgaaaaaagaggctttattagatgtagttgtataagtttctttttgtaaaaggatgtttttagataaaaatttaagtacatgattttgttgaaagcaaattgcagaatgcgtattgctttattggatgcaacactaatattcttctaatctactttactctctcccataattttattactcgtattttgttcaagaatgagattgagacagtgaggaatcgtagatgatcattggaaacaagatggataatacttaactgcaaagtgagagagatgaaagaggatagatgagcgaaaacctttttaattatgccgtgtgattttatacatctttacatgccagataaagtaagaaggcagtgtctttttcttttctatataatataacgcaatgcccttttctttctccagaaaacaatgtcttttttagacaaatgacgacgtaacaccactctattgcatgccattgttgtttaaaaaacaacacaggtacgcgtttagtatgtgattagcttttctcacatactactagctctttctcagatgtatccacccagccttcgaagaaagatgcatctatataaccatgaacataataagaaaaagggaaaatagataatttataaaaggaataagaccatcgttgcgttcaagtaatttcacactctcataagggtctagatgtaaacaaaatccacccagacttcgcagcgaaaaaaaaatatccccccatattggactccggagttttgacccggccaaattttaggtgggaattggagcggatacagagaaaaaagaaaaaccaaaaaattcagcaacggtgcggagaggtaggtaggccccacctggctgttgccgcacgtggcgcgcccgcggggagcgccaaccatgggacccactctccaggccccggcccgcccgcgcctaggactagttacattttttcatgtacccctcatagttatcattat

SEQ ID NO: 76880 - DNA, 6296 bp, Oryza sativa
tcgtctttattctcatcctcgcgtcgtcgcccgctccgcccaccgctcacctactctgccggccggccggccgctccccgcgccgtcgccgctcctccagctggccactccgcgcccgcatcgtgccctctccggcgatctgcttggaggggaggggagagaggctgagaggggatagagaaaagtggggaagaaaactaggtttcgttgacatggggcccacatgggtcccataccgactcagcagccacataggataaaactgagatcaaaaccgccgaaggacctattgtgactggttttgtgtagttgagggaccccgcatatctggttttgtggttggaggacgattttgtatcccgataataagttgagggaccttcggtgtactttttccttccatagatgcactctgctagccaaatgtttgagccttttcttgttttttcttaatccggtgcaactgtataatacacgcaaacaatcaatggcagtcgagtgccgaattggatagattcgtaagagctttaagaataaagtggctatgataacagtacgaaaagctctgaaaaagatttggatggatctccacaaccctatcaatttgagatagatccataatccgtttctgggactccacctagatccatggtaggcagttaaaggacctagcaccgctattgtacgtaatctcccggagaaaaaaataggaccctaaagtagaacatcgagatcgaagagcacgtagatccaagaccttaacctcccaaacggtggtgacatgaccatagagctcatcgactagcttgttactatttggagcacagtgcaagaaatacaactcactgatgaccaagcagatgaaattacatgaaagctcaaaaaaccataaagagtacatgttgggatttgcctacagagcgtaggttccttggttcaactaactacgaaataatcttttggaaaaccttagacccaaagaaatacaaactctttgcatagcattttgtgataaatatagtgtggacaacacatagagtggcaactcgaggttggccaaactactgtttttatcctccatgctagcacaccatcactagtacagatccttctatctgtgacgggctctaatatgcttagaaatagcgggccgtcataaggaagtcatctcaattgggccgaaaagtgcccgattgagatatggtcgcacagacatattagatgggcataaaacttaagctcgtcacggatgacacctatcagtgacgggccgtagtgtaagcccgattgagataacattccatatctcaaacgggcctaaagttgtggcccgtcacaaatgaccatcatctgtgatgggcaccaactttaggtccgattgagataacattccatatctcaaacgagcctcaagttctggcccgtcacagatgaccatcatccgtgacgtgcaccaacttgaggcccgtttaagataacaactaggcccgtcaaagatgactcatcagtgatgggctatatacttaatctctatcgggcattaactaaagctcgtcaccgatgactatttttccatttttcatatgaaatgtttatatttgtaagttgactatagcaaaataattgtcacgccccaaactagccccgaacgggactagcccgtgacgctccaaattaacctgttaatcgataccagtcccaggaaacagtgctggtatcataggaagacagaatatcacagccacaaaggtctctttattacagagtaggagtacagccatgttgggctgcggacaggtcccgagctcacaactgcattacaaaagagaaaacggaagccaagacttgggccaaacatcacaggcgcgacttgggaactaggccgaaaccctaaaactcatcgtagccgacttgctcctggaagaactcctcgtcagcgggatcctcatcatcttcttcagcgactggggggggaattatttatatagaacaagggtgagtacgggagtactcagcaagccatgggaattaagtgtttaatgcaggcttcaaaggaaaggctgttgtttttgcaattgattttatttaaactcctttttgaacaactaagtgtgtgcttctcaaacgacacggatgggacagtgcgtctcgtccggtcggagtatgtgcaatgtatcaatctttgaattgattcaaggttggcacctggccaacaaccttaaaacggccacccgggcctggctgatcccatcagccgcagatttaccaaacatcgaacccattccacaacagcaaattcacaaagcagtagttaaacaaaactacgctaggaatcacctcacatccgcccatgaccgtgggtacggctgtttgaacagtttaataacctctgcagagggggtacactttacccacacgacgttactagccttggtcacccagcccgtgcaaaacagccatgtttggtgactttggggctttcacgacaaggcatttcgaaagccgacacagggttaccatatgccaacgagacgggtcccagaccaacaacaggttaggtcccagaccatactgtgccaggaagcccgggggttctccccgacaccaccccgttgaatccacatgtctctttgcatcaaggctccccttattagcaatttactcagccaggggtgtcccatttcacccatgtggtcgcacatgtcttatgttcggatgaaattccaaggaaacggtccttaagtgcaagagcgggaaaccgtactcccggtacgtccctcggcctgcgattttggaaattcatttagttcgcaagcaccgacccaggtgtcgggttttccaagtcttttgtaaaacccaaattttacccatcgttggatgttttatatttgaggggaggtgttccgatgcgcgtgcccgaaggcccgtacatcgaagcaccacagtcgacgagggaaggttaagtgttcaataattcaaggagggtaattgcagcaattaggattgggggccgacgggctatctcgcaagctgcggccgaattactcgtgttaatcctattcatgcaatatttgtggaaaagaaataattagatttaaattataggtgcaagatgatcaaaggtgacttgccttgctcgagatcttgagcttgatcctcgtaatcctcgcactgcgggtcttcgggctctgaaactacaggcgaaacgggacaactcaacaaacggcgaaaataagctttattattgacctctaggcgtgccattagatagatcttgagatttgaggaattttggaagttggacagagtcaaacggacttacggttgggaagatattgaatttctaagattattggatttttggtctaaaggaaaaggatctatttaaatcgttttgaaaaagaaaagaaagagggaggggaattagacttcgcgggcggcttgagcgcggcccgagaggtgttggcgcggcccggccttgccattgggccggccggcctgagggacggcccaagggggctcgcggggaggggaggagagagggagccggtgggccgggtccaccttgcgtggtcccgggtgggacccgcttgtcggtggctcggctcaccgtgagcgaggtgccttggtttaataggaggcgatgtcggtttgggaactgacctagggtggtcaagggagcgagctagcactcggcggtcgcggccaaatcggcgacagggggggtgacgccggcgatgggaggaaaaagaagaaaggaagagggaaagggggcttgcctccttgcttctttgggaaaagaaggagggagagagagcgacccggcagagggaggaggggctctgcctccgtcccttggaagctagcgcgcggtggtggcgaggccaggttgatgacgacggcgatgacggcggaccggtttggagcggaacggcgacacgggcggcagacgcagggcaggcgcggcaggtgctgacgacggcggcgactggccggtcggccaccacggtgtgcgcgcgcgggaagcaacgggcggcgcggcgatttgggcggcgtcggcgggaagcggtagcgagggcggagggcactcggctcgcgcggctcacgcgcacgcgcgcgcggcgcatgggcagagcgagggatagaaagaaggagagagagagagggggagggagagagagagatgggccgagagggattcggcccatcgaacctaagggaggcaaaatagacttttgcggaggaattgaatttggaaggaaaattgagattagggtttggatttgacgatggatcggggattcgagatccggaatggcacggagactgactgcaagcgaaaaaacaattttcgcaattagggtttttagaatttaaattttcccgctaggcgccacgacggaacgggcgctacaataattaagtgtagtataataattcattttatgagtcaaaataattttatgggtagtaaatgatttcaaatggaaaaaatatcaacaacaaagttgtataacttatcaagatgtacaaattttagtttggtcatttttcaatataatatttttttgaacagtttgaatttgaatttaaaaatatgacaactttaaacaacattttcaaatactaaatgatttcaattgaaaaagtcattaccaacaaggttgaataactcatcaagatctaaaactttttttttgttatttcttcatccgacgaaatgttagtaatattattcacaaattttacatatatgtgttatagtttatagaacatgataagagatatgtcaattttatgaacaatgttactatcattttgtcgtatgaagaaatgaccaaaataaatgttttagatcttgatgagttattcaactttgttgttgatgactttttcagttgatgagttattccgtcacggtacgatccttttgcttaagtgcccggaactcacgcttcttcaaagcaacaacacctgcaggtatgtgtgtcttcttgaatgcttccgtgaactccgcctaagtgattggttgtccttctgctctgttcatccggaaatgatcccaccattctgatgcaggtccttgcaactgatgtgaagcgaaaacaactttctcctgatccgtgcactggagcaattccaacttcttctcaacagcgtgcaaccaatcacctgcttccactgggttggtagtgctagaaaaggtaggtggcctcacacgaagaaaatcagttaacttgttctgcggcgatggagcattgttgttcccttggttgagctggttctgcatctgctgtatcatcatgttcattaactgagtctgttgagccagaacttgagcaagagttgggttcccttcattgttattgtttccacttccattagcacgagtgttcaccatctgttgcagattagagaagataggaggagaggggttacactaaagacaagaccttaaccaggttaacactgatctgatgtgtgtagaccaatatattgttcaagttgattaagcaagcaacctagtatagttacacactcatcactgaactactccaatgatggaaatgcaaccatacctacacacaagcaaacaacaaacgttctatcctactaactattcttcaaagtcactttggtggtttaggttctaaggtaggatccaaacttcattccatcttgaccacttggcacttcagatcgaccatcaccttcttatttatcgatccacttgacttaacctccataagttgaccacatcagcattttctagtttcaacaactagtttcagaactactcaagttgaaagagagaggggagtagacaatgaaacaatttgcaaagaattctagataaggaagaaaggagaaattttcacaaatcatgttttcggaaaattagtccttaaggtttgaccatttggcttatcctacagtcaagatggctctgataccaacttgtcacgcccggaaattcactagtaatttccgaacttatttgtgcataaaatcctcgtccaggaatcagccgaggtacacaaactgacaatttaatatacagattcatcaaattaactaaaacgataaatacttacttaagaggcactaagtcctcaccaagaagaaaactgcagcggaaaataaaatctagcgaagctccagctccactcccacaggcagctcaactggggtataagccaaacgtcttttccttcgcaacttgtcttcaactgaggttgattgattattgcaaggtgagcatatgacatactcagcaagccacacagcaaatatgc

SEQ ID NO: 76881 - DNA, 806 bp, Oryza sativa
gacaagcacacccatgttgcacaggcccaaccattttgaccaaccataccgggtagaacagatctaactccaacccaggagctaagcaaattattaccagttataacatctataattatggtgagaggtgtgagactaatcacgaaaaacattgctcaactcgcccataaccgcgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcacccccttataaaacaaggcatggactccccagcgacccccatgggcttatctccgccacttctcagtctggtgccccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataagtgatagtgaaacattagttatcccaaatgtgtgctaatgtttctaagcatggctaagcaatcatatctaatatctagttgaaccaatatatataaagctcaactagtcccattataatcaccccaggtatcaaggaataaagtaatcaa

SEQ ID NO: 76882 - DNA, 5668 bp, Oryza sativa
taaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcataattttagatgaattatgagacttgaacggcctcattctgacttcaaatgaatttattaagaattttacaagattaaatctatttaaagcccatttaaaaagaattaaataaatttaattcaatttatggacaattttaatatgtagatctttattttacacaacttttgcaacttgaaccacattaaactgagttaagatgaattagatatgaatttttaaagattaaatcggattaaaacctttaaactgattttaattgaattatgacgcaataatgaattatttttgaaaaggaaaagaaggattattgcgtcagcggctagggtttcggtggaccgggcgcacgggcgacggttcacgcgaacggacggccgagatcgaaccaatccaaaacggacggccgagatcgatcgggtccacggcggctcacggcggacgactccgatgacgtcagcgatgacgtcaccaccggcggcggtggctcggcggctcgggctcgcatgctcgccggcgaacgacggcgcggcgacgcgaacggagagcaccaggacgtagagcgcgacgcggcgaactcaccggtgaccaaagaagcggcggagaagcaacggacggcgacggcgacgaggaggaagcggcggaaaccttcgggttgacgacggcgatgaagctccggcggtctccggcgacggcgaaagggcggacgaggacggcgacgaccttgcgaacccgacggcggtcttcccgagcgacggcgacggctgaaacgacggcggcgcacggctggagcggcggcggcgacggcgaagctagggcacacggcgctagagctcttccgacgacgagaggcgaaggcgagggtggcgacgggtagaggagagctcgggggtccttaaataggtgcaaggaggcggcggcgaaggcccacggcggcggagacggcgaaggaaagctcggcttggagagaggaaaaccgatccgattcgaactcgaatccatcgatttccaaaccgatttaggcgaagcttccaaagaagaaaaggtagaggagatcccgaggatcattttccctcaaacgattcggccggataaggaaagacgcggccgaatttggaaggagacggcggcggcttgcgctagggtttcgggcggcggcggcgacgcgaggaagacggatccgacaagcggggcccacctgacagcggctgagagagagaggagagcggcggctcggcggactgggccagctgggccgagggaaagagagaagagaggttttgggccggctttcggcccaaagccaaaagaagactttttaaaacctttttcaattaaattatttcttaaatgcaattccatttattaaaaatacttccttagctcaaataaatcccagaaaaatctaggaattatagaattaagcaaagtatttaatgaaattttatctggcccctttttatattgagatttagcaaattaaaattagatcttctcttttaggcttttaaaaatcatttctaataattccttttaaacaacaatttataagttaaggatttttaaacaagaaaagctcttaataattatacttagatcattaatgatcaaataattactgaactgttctttgtattattaagagttgagctctgaaaaatccgagaaaatttcagagagttgacttaaccatggagaatttaataaaaattaaatccatccatgctttatatttaggaaattttatttcccacattttacttcacttgtaaattaaagaacatttaacaaaaattctattattaatttattaaataatttataaatcctgaaacaaaaaatcaggatgtgacagtgaccgaccgggaagtttgtatttcccgcgtgggtgcacacgagtgagggctagccaaaaaataaaatttatttatttatggattatactcatctgtgatgggggggacgggcattaacttaggctatagttaatgccccacccgagtgggggctagccaaaaaataaaatttatttatttttagattatactcatctgtgacgggcattaacttaggctatagttaatgcccgtcacagatgacaggcataaaagtttgaatttcccgcgtgggagcaatttcgggatgggtgaccgaccgggaagtttgaatttcccgcgtgggtgcacacgagtgagggctagccaaaaaataaaatttatttatttttggattatactcatctgtgacgggcattaacttaggctatagttaatgcctgtcacagatgactcatctgtgacgggctatagtttgactggtcgtctgggtcaaaactatcggtgacgggctttacttagagcccgattgagatagattcatccgtgaccgccgtttgcccgattgagataactcttcacattagtgacttctagcctgtgacggacgccatgcccgattgagatggggcttaccgcccaattgagatgagggtatccgttctagtgcataaaaacaacttaccaccatcttgtggaatgcatatacataaggagaatatggagcacactatcaacctagatagctcaggaacttaggttgcgctcttttttgatggttctttctggctaaattagttgtacgtaaaacaagaaacatgattaattgagtgttaattatttaaagagtaaagtgcataggcggtccttaaacttgtagggttgtgttatctatgtcacccaaactctcaaaatatagatataggtcccaaaactggttaaagtgtatcatttaagtcccaaatcgacacaacccctctagaatcctttgtggcgctgatgtggcatgccacatggacgtgacttgtccttttcctttttttcttcttttctttttttgttttcttctcatttttttcctttcatctgctcgggtcacatagaaaggagaagaaaggaaaaaagagaagaaggagaagaaaaggagaaaaaggaaaatttttaaatggatccatttgtcaatcaaaatgatgttacgttatatacgtgtggcatgccacatcaatgccacgtaggatccttaaagggttgtggcgatttgggacctagatgacacgctatgataagttatgggacttgaatatgtatttttaaagtttagggacttagatgatacactcctatgagtttaaggaccgtctatatactttactcttatttaaaaaagaagaatggatctgtttgatttttaaagaaccttttctatggaaaattttcacacataacatattgttttgtagtttgaaaaatgtgttaacagaaaataggaagtagctatgctcaattagctatttagaacacacccttagatcggataggtagcctgtgtctacgtaggtacatgcttgatggacagtgctagcaaccgccataggtctatcaaagaaaggagcatgctcgctcattctcctgacgacatggaaggtgtgtggaaggaaaggaaccaaagagttttccagcataaagagctccacatatgtttgccagcataaagaactacgtgtaactcattatctactctggtagcaaaaatcaaaggaggaagccaacacatgggctttagcatgagcgaaacgcctcacagagcttatcctttagttttaagttttttaagttctcgtttttacctctagaaactttttactctgtttcaattaatgaaattggcatagctggttcattaaaaaaaagaaaaattctgaattaccccctgaactataaggatagcacgaattacacccataaaccgcaaaatcagacatccttcactctcaacttttcataccggacgaattaacccccctaactctctatgaagcggttttatcctacatagcgtacacgtggcagtccaattagcataaaaaattaaaagatgatggggccagcatgtcagttcttttttttattttttttaaaataattgtttgaatccacaaaacagaactgacatatacgtcccactgatttcaatttttttgtgctgactggattgcaatgcaagcaccatataggaccaaaaccgctctagatcgagtccgagggttgggggggggggttaattcgttcagtatgaaaagtagagagtgaaggatgttttattttgtgggtgagggcctaattcgtattgttctttgtagtataggaatgtaattcggattttttttccctataaaaaatatataaggcatttaaggcatacaggatgggctgtataaattgagccagttggtttctgtttcaaaaggaatttaaattttgggccgttgggccttcggctcagcaagtcctatttgaccgcccggcgttcgtctctgtccccttccttctcagtttctcctgtcatcccgccggggtcagatacgacaagataaccaataaaccagagtacaaatcttaataagttctccaactatggtctctgattttcgtacgcttacttttccaggctaaataatggacacggccacacggcaccagtttgaacgtcgtaccatccctgtgcacaataatgtattactaacaagcaccacccgatacggaaatctggtggagcggacagccggacacattagcattagaatcggtggctaccggctgcctgatgacctgattcgttcggaccgatcttgctcaagtttggctaccttaccaaaactttgttccccttcccatagtttcgattctacattcgtcatggtctccaacaagtatgtgtgctgcatagcagaagatcatttgcttccgggttacgtgcctgtttgttttgggtattactaattaaggtcgtcacgtaccgatattctagagggaaaggaatgattggcggcattggcactcctagtacacgccagcttaattaggattgtcatttgtcaatccgatggaagagcatgcatcagtatcgcgtgatgtgaaatgcagctgttctccgtggtgaaatgcattgagtgaaagtttccagaaaagatcctctgttccgtccttttttttttaataatgaaatagtcatcccggcctttgctcaaagagagctacagcccatctattatataattaaaggaatagaaaaaggagcctccacgttcgctctcatggcctagaaattctcacattaatcggagaaaaagaaaaagcagagtccatatagaaatacaatttagaaatagctgaaattcggaattaaaaaataaggaatattagaagaggggactagagtccatatagaaatacaatttacaaatagctgaaattcggaattaaaaaataaggaatattagaagaggagactagagtccatatagaaatacaattagaaaatacctgaaattcggaattaaaaataagaaatattagaagaggagactagagtccatatagaaatacaatt

SEQ ID NO: 76883 - DNA, 722 bp, Oryza sativa
ttatttaattctttttaaatgggctttaaatagatttaatcttgtaaaattcttaataaattcatttgaagtcagaatgaggccgttcaagtctcataattcatctaaaattatgatctacatgtttgtttactttttatgtattgtttatttggtttttattagtctttttcctcgttttgcgtgatagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtgaaattaacctattctttgttatggcccttttgttcttgattactttattccttgataccttgggtgattataattggactagttgagctttatatatattggttcaactagatattagatatgattgcttagccatgcttagaaacattagcacacatttgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactgttgtgaaacatta

SEQ ID NO: 76884 - DNA, 1692 bp, Oryza sativa
cacctctccaatcctacatgccaaatcatcaggttaaaccctatcgtccattcgcaaattaggtatatctccaccacatgatttctccacgtcaccacgtgaagactactctctaagcgtgaggactacgcatctccgcgcaacacgctactctccacctccacgcgactcactactatagatggccaaaaggcccacccggcccggcccggcccaggcacggcccaccagccatcgggccggcacggcccaatcggcacttcgtgccggaccgtgccagcccatgggctgcgcctcctgcccaggcacggcccacaagtagtcgggccatgccgggctggccgaaggtacgggtggcccatcgtgtcttttttttaaataagtctattttccctccctcttctttgggttgtgacctatatatagctaaaataagtctattgtccctccctctctttgggatgtgacctatatatagctaaaatagtctattttacgtccctatgctttcgaccgtggcatataatatgtttatttttactccctattgcttatgtatcgggcctagcctacggcccatcgtgccgtgccgtgccgagccggcccaacgtgccggtggaggggcctaggcacgacacgattgtcgggccgggccagcacgagctcgacccccgtcgggccaggccgtgcttgggccgagccaaaatactgtgtcgtgggccgggccgtcgggcctcgggccttttcgccatgtatgctcgctactcctcctcgctcctccccgcatgtattggcaccgcgccgcaccgccgcatcctcgccggagccgacttctccagccgctgccggatcctacttcttccccatctgccgctcctcagcggccggagccgaggacaaccccttccgccgccaccgccgccaccgcgcactccaccgctggccaccgaggtcgtccccagccggtcttccccatcgactgcggctggagccgaggtcgtccccatccgccgccgccgccacattccaccgctgcccccgccgaagacggagccatggtcttccccaacgccatgctcgctcttctggtcttccaacactgttgagctcccgtcaacaccaccactgcgtccaccgcgctcgctcttcccttgccaccaccgacgccggcgctggtccggtcttgcgaggggaatccatggaactcggccacatacccacatcgtggcctccactacaccactatcacggtgctcgctggccgctctaccgccgagcccttcgctgtgaagcagatctggccagttccaccaagaggccgttatctgccccacggccgaggccgttgccccaggcccatccatgtctgcctgacgaccatctccatcatcagcactccatggaatgtatgaatgtatctatgtgagcttgtgcgtgctgtaaatcttaattttaatttaggttaaaatatatttgttctatcaggcaagagtgaagctgggttcaatcttgaacatctggaagtttgatttagagaatgccatgtaatgtgacatcgaggaaagagtgaagcaatttagcttaggtaaattaggtcatccagtgcataagagatttacacagctaagtagtacagtagtggtagcttgacatgcatgaatgcttggtccattgattgaattcacagctaag

SEQ ID NO: 76885 - DNA, 2372 bp, Oryza sativa
aaaaaacacaaacagaaaaaaataacaggccagcaacaatcgtaagtgacaattctaaaacgaacatacacgtgtgaaaacatttatcttcttttttttctttcttttctaggtggtatataagggtagaatggtcatttcattcataccgctgcatgtgaggatgacttggcatgctcacgtggcacttttttggatccaagaactatattaacccaaataattaatttggaggacttgtttggacgatttgaaacttcaagaactaaactgagcctaaagagaaacttcagggaccatattagctattcaccctaaagtaaataacaagattaagtctaacaaatagacgaacataccggcaagatcgtctgggcagagcaggccgagcagatcgcggaaccagttcatctccatgtcgaggtgcacggtgtcgcgcacgtgcacgcctctctcccagaagaagtccgggctgagcgccgtggcgccgcccaccgcgaagttggccccgctggcgaagtcccccgtggtccgcccgccccagtacggccgcaggaacggcagccccagcgcgtcagctgaggccggcgccacgcgcgcgatttccaaatctcaagtgattagtactatgttgggttaagcaaatacaggtggaggggctggattggttgcgagtagcgtaccgatgaagtcgatgatgaggcggccgttggaggcccggccggtggcgcggtggaagaaggtctcgccgtagggtggccacagcggtggccggcgggactcgttgccgtagaggaaagggccgttgcccgtgtcagctagcgagttccccgaagctgaacacgcgcgggtagcacggcgccgccagtgcctgtgacgccgacagcagcacagccacggccgccagcacaaccgccgcaggcgagaggagtcgtcctcgtcctcttctcccggaggtggaggaagccattcttcctgtctgctcgagtcgagattctcgcattctcgagtgagtcgagtcgataattaatgcgaagcgtcagttaagcacttaagcggctagggaaggtgttgcgtcgttgtgttactagaggcctttttttttctcttttttgatactccatccgtagaatataagaaactttagaattggacacaattattaaaaaaataggtagaagtgagtggtgaaagattgtgattggataagtagtggaggtatatgggaaaagtgaatggtggaggattatgatcggttgggaaaagaatattggtagagaagttgttatattttggaacaaatcctgagggctaaaacttattatattttgggacggagggagtaaatgataacttgccgagattgtgaacagttgctgtccatttccagtggacaagtggtccgttgcgtcgctgtgtagtacactgtttttaaaaacatactttgactaatattttattgcattctatggtcctaataaatataaaattagcatcacattgtgaacagttgctgtccatatccactggacaagtggacacgggacaatgaacggtgagaggctcacacaccctttgaagttttccttttttctttttccgaagaaacccacactttgaatttttgaactacacgtggaatttaacatttttgcacacaaaagatttggtcagttcttaaagtaaagatttgggtattatgcggcactctatttaccggtggcaatcagccggttaccactttcgatatcgcttccacacaagtaaccggttgatgcctaaatttgtgtatgcgagtagtgagcaatttcttgttttcaaagatgctgtcacaacatgattggtgttttttcaattgatgaaataaatcctgatctttgcttaaaaaactacagctacttattacttggttcgctcaacataaagcaaactaaaaatccaacaaccaaggatactaagagcatcccaacagctcctctatctggtcctccatccctaatttggcgcataggagcgaaaaaaaccacttctagtggatgcgccatccagtcatccaaaactagcgcatgcgctaaaacgggagagagaaagggtaaatatagcatatctctctcctcacgttatatcacaacaaccgcgctccccacccccatccggagttccgcgacctctcctccgccgcgacctcccctccatcatcatcgtcgctagcccgttttttattttttttacaacggatggttgagagggagggtgtagccatggagtgagggtggagagggagaagcatgccagatctggaaggagagaggggagagcggtgaggcagccgacggggagataggagcggcggtgccgtcctcgatccgcag

SEQ ID NO: 76886 - DNA, 5606 bp, Oryza sativa
gttgcagcctatttgctatatttcccacgccttgtgcctctaaaacgtcctcatgctcactaaaatgttgttgcgacatgtgatatattagtacaagtaactatgtaactatttgtaactattactgaaatatcattttattttacttactataggaacccttgcagttcttcacaattattgagcacgtaccaacacagggaattatattgatcttgtgttaggattacgtcatccttgtgaccaaaagcacagaatctagataaaaatattgagtagcgatcagcgaattgcctctctccatcatagtttctctcttccctattgaaccttgtctcaattccattgagatacatagagcaaaatgttgagcactccttcataatataggcttccgcgattgaaccctctggatgtgccctattgctcaccatgcctttcaaagtaccaaggaacctacataccaataatatacacttactacagtacaacgacaaaattatagaacaaagagaaggatcctaatcaacacatacctttcaataaaaaacatccatctatactgtacaggtccaccaagtcttgcttgttgtggtaaatggactgctaagtgtaccacaatatcaaaaaatgcaggtggaaaaatcatttccaattttcacaacacaaatattatttgttcttctaacttttccagcacatcaagcttcaatgacttagagcatagttgacgaaaaaagctacctaactgtaatagtgcatcacaaatgtcattctgcaaataccctcgaattccaattggaagtattcgctgcaaaagcagatggaagtcatgtgtcttcaacccagttattttcccctctttatagcttagaccttttgatatatttgcaccaaaaccatcaggaaagcggacagattctataaattgaaaaaaatcttgtctctcctcttgggatagtgtataacaagcaggaggctttatgacattgctgcccctttgttgcaagtgtagctctttccggatgtttatgtcttgcaagtccatgcgagccttaagtgtgtctttagtcttaccatttatgttcaaaagagttccaagcacgctctcacaaatatttttctcaatatgcatgacatctaggttgtgtggcaacttgagttccttccagtacggcaactcatacaaaatgctgatcttagtaaaattctttcctgggatgtccctttctgaggtctttcttttcttatttccatcatgctttccatacttgaagccttgtagatgatctaatttttgtagcattgcaaaattttcatctcctgatagctgtcttggcctcaatgatgtttcattcttgccattaaagttcttacttcttcgccatctatactgaataggcaagtatcttctatgacccaaaaaaccaatcttgcttcttagcgaacacgaatcagtccaatctaaacatatcgggcaagccttatagcccattgccacatacccagatagtgaatctaatgcacgaaggtcactaatagtgcctagcactactgctcgtagattgaaagtatctcctacaaaggcatcatatgtactgactccagtgttaaagagtagattcaattcttcaatcaagggcctcatgtacacatcaatatcccttccaggtgctttcttccctggaatcagcaagggcattaatatgaagggttccttcatgcacttccatggtggcaggttgtatacaactaatataataggccacacactataagagctactcaaagttccaaatgggttgaacccatctgtagcaagtccaaagcgcaaatggcgaggatcgtgcgcaagccattggtattttccatccaaatccttccaagcttcgccatcagctggatgtctcaagacattttcctcaattacacgcttatcacgatgatatcttaagtctgaggctatgtccttgttcataaatagtctctgtaacctagggatcaaaggaaaatatcgcaaaactttgtgaggtacacgtttctttcccttgtgaattttccatcttgattcattacaaacagggcacttatcatagtcttcaagttccttccagaacaatacacaatcattgatgcatgcatgtatgctttcatagcccagccctagatctcttaacatcttttttgcttcataatatgaggctggaagtgtgtcacctgttggcaaagcttctttcaataatttgagtagcatctcaaatgatttgttagtccaatggtttaaatcttttaagtggactaacttcaacaagaaggataacagtgaatgacctctgcatcctgggtacaactctctttgtgcatttcttagcaagttatcaaaacggactgcctcttgattagattagaggacattatctccattattaccactttggttctcctgctctgcaaccccaattgtggccctatggatatcacctaatagatcttgaatagtatcaaatccatcaaactcatccccattatcttcatcctctaaaagttcatcgtcctgatcataattgttggccacttctccatggaatacccattttgtatatgataattgtataccatacaacaccaaatgtgttcgagcatcattggcacccatctgacttatattcaaacacctttcgcatgggaaaaatataaaactgttctctccattgtgttcacaagcaaattcaataaatgcgtttaccccagcaatatactccctagagaacctatcgggcaatctcatccaactcttgtccatattctaatcctctgcataaatgcaagtttccttagaattaatcaccaatgtggtaatgcaagtattacagattatttaatctaaaactatttaatctcctcacaaatggcaataaaacttctaaagccatggcactcacaaaccaacatgctaacccaatgtcatggaaatcaattcatttctaaaaccctaaaattcgaaatactgtgtgctaatcaaattagtgcagtcaaccagatttgtaagtcacactcatgttatactcatgttatagcagatcaaatctcacacaaaaaccattgaataatagtgcatacaaacattcatttgggttatagatcaggttcaaggcacatccagttaaacaaattgtttgtgtgcaaacatagaatatcaggagaatttaaccacttaccttgaatcaaagtggagactcctcctgctgcctgcaatgaatcaactgcttgccccgacgacgttgtagctaaaccaccagcgatccctcgggcgctgccatcgcagagaccaccgattcctgggcgctagcacaggggccgcgaaggactcctccaccgagcgccggcggcggcggcggcgtcgtcgccgcaaaactccgtcgacggtgccgccgccggccgcagatctcgcctcgccgccgccgccgccgccgcaggagacctttcccttgcctctcgatttgtttctggatggggatcgggaggaagtgtgttttgcactccagtactccacatattcaaatatcaggtacatgccttggttgctatatgttgtcacgtgactagtgaccaagtactggccagtaacttggtaactgtagaggtaattggtattgtttaactcaagtaacgtgctgacagctacagaaaccaaggtattagcatgttggttactattgattaatatctaggcaccaaacttcttggtaactaaatatacggtagctaattgtatgttttcttgtagtgagaacggtgtctactcaaccaaattagcatacattacaattcattggggcagcgggctcgatcttcaaccagacaatctcaaaatgttgggtgccactaagtgcgcgcaagttcttttcttggctcataatccaaaacagagtctggataatagacaggctccaaaagagagacaggacaaaccaacacaattgcccaatgtgccgagcttctacagaatcggtcctacacctcctagccaactgcagactgtcgagaaggatatggacaaaacttcaaagatggataaatatcgacctccaaataaatgagtgggcaaactgcgccaatgtagaagaatggtggtacaaactgtcacgtataccccatgtgccgagaaagacactaaaattggtgatcatccttgtggcctcgaagctttggtgcgagcgaaataccaggatctttatacacatagctaccacaatggctacaattatcaccaagatcaaagagaatgcgcgagcgtggatcaaggcgggaggcacatgaatcatagagatcatcccctcgaagaatagccctattctagttcttttgcgggtctattgtttgtgatagaccctgtatatatttccgtgctgtgaatttactcctctataatctattactagtacaaaagtgagaaaagcttttgcctttttcaaaaagaaaaaaacagatattagttcttatgatttgtgaacaatatgtacaaatgcagtaagaacagggacggtaaataatctttgcatttatgagtatattgggctattatcattattcggaaacaaaattgaatcactttaaaacgttccatatttaacgtgctacttctatccttggaagggcttgaaatatgaattgctgccgttaccttaccaggagatttaatttggtgccacaatcgggttccgacgccaccaggccgatcttggaaagcattgacacattttgatccgcgttcgatcacacggaggtttataaaagggggtctgcatatgcaagcaatgcagaacgatcgcgacaagtatatatctctctctagcaatcatctcgatctgtacattcttggcgatggagagcttgatcaggcgccatggggggcgccgtgccgtttccccgtcatcgtcggcggcggcggcatcgttcatcctcctcctctgcgccgtcgtccttctcaacactcacgtggcgctgtgcggctgctacaagcgcatcttcagcttcggtgactccatcatcgacaccggcaacttcgtgtaccttaccggcaacggcccgtcccagttcaaggagctcccctatggcatgacctacttcaaccgcccctccggccgcatctgcgacggccgcgtcctcgtcgacttctacggtgagttgcatctgcagatgtagcatgtatataattttatatacacgtgccatttcttgatttcgcgcgtggcaatctatatttgctcgtgtgtgtgtttcagcgcaagcgctcaacctgtcgctgctaccaccgagcataccggaggaggggtcagggcagttcgagaacggcgccaacttcgccgtgctggcgtcgacggcgctggggccggactacttcaagaccaagtacaacttcagcctgcccgtgccttactgcctcgacaaccagctcgcctcgttcaagaaagtgctcggtcggatagctcctggagtcggtaaacaatcaatcacgcgaacacgttgttaatttgatcgattaacgtgcatgcgtgcagtgcatggaagagcgtgttcagatcatgtcggatatatatataaat

SEQ ID NO: 76887 - DNA, 3257 bp, Oryza sativa
atgcagtgggtgaacaaacctttagtcaccaaggtaattaatgttctaggtggcaggatgtatgtacttaccaaggagggttggacacaacatacttttagttgccaattacttggtggcaaattataaatagtcaccaagcaaccttggttattagatatttttagttaccaagtaccacttggttctaaaaaatatatagttaccaacattttcttggtgactattgcttttacatattgttaccaactatggttggtaagtaattatattatgtttagcaaccgaggagatcacacgttggttacaaaatacatttagcaaccgggttgtagccaccaagatgcgaccaaggttcattggtagcgaaaactcaatagcaaccagcttgtagcttattgtcaccaaccaccttggtaactaatggtctgtttccttgtagtgtctgagtcaatttctaggtgatgtcatccgtttgatcattgaggagttctatgcgttagactaattaaatctctgtattgaaggacaaaaatcgtatttatttttataacgtgtctcaaatatatatacattgttgcatgtatataaatatattagcttgatgctaatgacatgtacatattttcataaaaaactaaaagtactaacaactacatgcacacttagttctagtttacaaaatgtcaaaagaaaaagggaaaattgcaaaagcaccttaaatgccaatctgagttggagattccccctataagatgatttgttacaaataccccctctcctaattcacctttgtatgaaattccccgaataacccgttacttgcctattcttgttccaacaaaccacacatgtgctcatgtgaattctagcaagagaggagctgtggtggtcagtcatgtccgtcagactctatatgatatgactgtgacgttcctagtgatggtactgagcatgtcattggacaatggcgatcacaaatctgttgaatagtctcacattggttgtggaagggcaaatgacctaagatataagtgggggagcccctcacctcaatggctagcttttggggtgggaaaggccccttacgatcctatataattggtattagagcctggctagtttaacatctctggcccgatggacagtgtgtgaaggcctgatagaccatgggtgcctatggggcccgtatacctgagggaccgtggtgaaacggtgaaggggcggtgaagggttgagggacaccaatgtgtgaagggggaaattgttgaatagtcccacattagttgtggaagggcaaaggacctaagatataagtgggggaacccctcacctcaatggctagcttttggggaggaaaggccctttacgatcctacaaaatcttcgctcttggatatcttggtcactagaggatgagctgtcgcgcttacttcctgaggtttggtggaggttggtttttatgtagtagatttaagatgagaatgttgagctcggtgcaacactctgtcgttgagaacgaagatgtgtgcttggtgagacaccctaccactgagaaagaatatgtgttttgggacatgtacatgaggatatacgcttagttgtataacacatgtagaaagagaaaaaaaacacgtgagcaatgacaactggggtgaggtgggggggatatcaaacctaggtgaattagaagggggtatttgcaacaaaccgtcttatagggaagaatctcaaactcagattggcatttgaggtatcttttgcgattttctctaagaaaaacatgaaaatagatatgaaaattgatgcttatgcaccaaaattgtgatgaagcaacactcagaatatagaactaccattaattattgcaattatactttcttattttagccagtagtggagtggaatacattgagctatatcacaagcttttaaagtcaaattttggtaaggttatttagtggattcagttaagaaaagatgtcgatcaaccaatggaagtttatctagaaatgaccgagttcaaagaggaatcgtgaagaccacggcatagcagtttaattctatatattaactcgacaagattttgtaattttccttttatctttaggaaacttgtatcgagtccgatcaggactagtatcaatccgtgggtataaaaatgtacacccggggcccttgtaatctatctctcgatcaatacaacttttggcgcatcaccaccctctttttcgaggttttatggccagaggaacttggcacctggtgcagggctgcatcacttcgatctcccgcgaaagggtaagtcctaagttctaccaaccctggcagtggcaattgtatcggctatattggcattgttcaaggctacatcgtttcgatctcttggattgttatggttcagttggtatacttgcctacctgatatttcaattctatctttaattgcaaaattgtatttatagacaaattagtttagctgggactgtctcgattaggtctgatattatgtcttcgtcgatatatctctacaatcacaatgttgttttaaatagatttgttatatccatcatgttagcatagtctatgggcttatctagcttattgatcagatgcaatctagaactatctcggttaggtccgatctttgcattgttttatcggagtgctagcagataagttatctttgcatcagactttcagccgatgtatgcattaaccatcgagtctacatttaatattatgtatcaatatcagccgattggtttattgggcatctacttcatcatattatcaacggctgattgaattgtcagttcaagttcttccattgtctttatccaagtgtcagaatctacatcggatatataaccaattgttcaaaaccctatcgacatcggttagtaccgctaaatcggcttattggctgatcaactctttgatcatcaatttatccatcttgtcagttgcaggatcaaactgactagcacgcctcgaatctcataaatatttaggacctgcactatagctaagcagatctcctaagcctttgtgttttttcacgtcaacacaagcatactagattgacatcttcttgcaatggaaacaagcgaggggctcctaattcgcaatgtgcccccttgttctttctctccaccaacacccccgcttgcttcccccgtcccctttcttccccatccctatgttctttctctccaccaacaccagacaccaatagagagcgagcgagcaatggca

SEQ ID NO: 76888 - DNA, 2715 bp, Oryza sativa
ccatttgaaaacgaagctttctctctcctaaagcaagcaccaattagggggggaggttttcaactcgaaatttttacttgaactctatacgaaaggtgaagaactctctatcttgcttcatttggctccatttttggtatatttcggttgggggaaagtggagtttttttaatattttgacaaggtttggtccaactattttttgcaaaatctagcttcaaaatatatgttttgatgggcaaattttgcatgtaatcaattgtacatactagttacatgtattgttgtattttttttgggagacaaatgcatttaaacttttgtatgaaatacctgcggtctatttttttatctgtaacttttttgcctttatataattagatggatcggtcgtcatggatgtatgagatgcggagaacgcagccgatatttattaaggaagcatctaaatttattgatcaggctaaggagcatgctttgagggagaatatgacaaagatcttttgtccgtgccgtcattgcaagaatcagaaattgttggtagatcctggtgaaatattgggtcacataatggagtacggattcaccgccaactacaaggtttggacctatcacggggaattcgccaatccggaagatgacgatgaagagttaagtttcgagatgaatgaggcagagaattttataatcgaagacatgtcgcgtgaaagaatgattgtcgatgtttccaccgatagtgatgatttcgatggtggttttgatttagaggatatgctacgccatgttgaaccagaggtgctagcgggcaggtcacgaggattggagaattggcaagcattagagaaggcatcgaaggatcttctttacgatgaaacgaagggatatgataaggatttcacagtcttgcgttcagtgcttgaacttctgagattgaaggctaaacatggatggtcggacacaagttttaatgatctgatgagtttgttgcgtgtgttgcttcctaagcctaactttgtaccatcgaacacgtatcaagcgaagaaactcatatgtcctttatctcttggtgtagaaaagattcatgcttgtaagaatcactgcatattataccgtaaagaatatgcggaattggaatgttgcccaacgtgtggcacaagtcggtataaaacgggaaatgggcccgtagattcagagtgtaccgatccagattctgataagggtaagcgcgggaagattccttcaatggtgatgtggtacctaccaattaaggaccgcctgaagcgtctgtactcaaacccgactgatgctgagttgatgagatggcatcaagagagccggaaaatagatggtatgattcgacatcccgccgacgctcgccagtggaagacatttgatgcaaaacacccagaatttgctaaggatcctaggaatgtaaggtttgcgttgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcaatcatattcgttaccatcaatgacctacctgcaaacttttcattatctggccagattaaagggaagactggatgtctaatatgtctggagaaaacttcatacaaatacctgacgtcgtctttgaagacagtgtacatgcgacatcgacggttcctaccacaaagacataggtaccgtaagatggctagattgttcgataatacagtggagaatgacactgccccagtagcaagaggtggtacatacgtgtatgagataacaaagaagattaaggttgtatatggaaagggaaagaagaagacagtaaagaggaagaaagctgatggtgagaacggtactgcgtcgcctttcaagaagcactcaattttctttaaatacttagattactggaaggacctagagattcgacatgcaattgatgttatgcacctcgagaagaacgtgtttgatagcaccgttggcacattgctggacatcccgagtaaaacgaaggatggattgaagtcacgtaacgaccttgtagatttgtccatacggcatgaccttcacccagtactgctgccaaatgggaagaccgagattcctcctgcttgttactcgttgacacttgatgagaaaaaagccttctgtaaatgtttacaaggggttagagtgcctactggtttcgcatcgaacatcaggaagctagtatcaataaaggatttgtccatttcgggatacaatgcgcatgactgtcataggttgctaacagtgttcctaccaattgctataagggcagtcaaaccagtccatacaaaggtggttataacaaagttgtgctactttttcaatcgaatttcgcaaaaagtatttgatcctttggaattaggcccgcttcagacatttgccgtcgagactgtatgccagcttgagatgtatttcccaccatcatttttagatatgatggagcatttgatccgtcacatcgtccctcaaaatattgaacttggtgcatgatacttacat

SEQ ID NO: 76889 - DNA, 6940 bp, Oryza sativa
  unsure (1)..(6940): unsure at all n locations
atatactccaaactagcatggtggctcgcgcagattacgcggctagtaccattatattttctcttatataatagcatatatattttctcactatattattaaaatatattacaatgacaatataattttaaattttacaataactttacgaaactactcatgcgtaatatttatattgtattttatatacgtgttagttattaattatttttaatatcaaactttagttatttgtaaattatatatattcctatatggactctggacttgtcttttaatatatttttttaattctgaacttttattatttttaattgtatttctatgtggattctaaattcatctttcaaaattctttaatttttaatttcaaatttcagttacttctaaattgtattcctatattgactttaaactcttcttcccatgtttttcttaatttctaattttagttatttgtaaattgtatttttatacggactctacacactacttttcattttattatgtttattctaaattttagttagttttaaattcctatatggactctatactctacttctaatattccttatttttaattcctaatttctattttttttttcttaattgtatttctatatggactctatactctacttctaatattccttattttttaattccaagtttctattattttctaattgtatttccgtatggactctatactctacttctaatattccttatttttaattccaaatttcagttatttcctaattgtatttttatatggattctagtctactcttctaatattccttatttttttaattccgaatttcaactatttctaaattgtatttctatatggactctagtctcctcttctattattccttattttttaattccgaatttcagctatttctaaattgtatttctatataaattcatctttcagtattctttaattttaatttcaaatttcagttacttctaaattgtattcctatattaatttaaactcttcttcccatatttttcttaattttgaattttagttatttagaaattgtatttttatacggactctaaactctacttttaattttattatgtttattctgaattttagttagttttaaattcctatatggactctattctctacttctaacattccttattttttaattctgaattttttttcttaattgtatttctatatggactctatactctacttctaatattccttatttttaattccgaatttctattatttcctaattgtatttctatatgtactctatactctacttctaatattccttttttttattccgaatttcagttattttctaattgtatttctatatggactctagtctcctcttctaatattctttattttttaatttcgaatttcaactatttctaaattgtatttctaatatggactctgattttccatatggactctatactctacttctaatattccttatttttaattctgaatttctattatttcctaattgtatttctatatggactctatactctacttctaatattccttatttttaattcagaatttcagttattttctaattgtatttctatatgtactctagtctcctcttctaatattccttattttttaattccgaatttcaactatttctaaattgtatttctatatggactttgtttttttctttttctccgattaatgcgagaatttctaagccatgagagcgaacgtggaggctcctttttctaatcctttaataatataataggtagatagataatagatagatagatagatagatagatagatagatattgttaatgattgtggtatctctagacacgcacctttctagacaataaagccccaccaactaatagcaaactgctatgactagtgcttagaaaatgagaactgccacgatctcgttccaaacgtcattgtcgaagcctcaaaggttggtggtgcaaggcgaaagccgaaagccgaaagccgaaaggtgttggttgattcaaacataccgtccatgtcgccggcgcagagcatgtcgagcagatcgcggaaccaccccatctccatctcgaggtgcacgacaccgtcgtccgtgggcacccctctctcccggaagaagtccgggccgagcgccgtggcgccgcccaccgcgaagttggccccgctggcgaagtcctccgcggtctgccctccccagtacggccgcaggaacggcagccccattgcttcagctgcggcgcggcgtacccacacgcgcgcgcgcgaattacacgtctcatattagcaaacggatcgagcgatcaatcgatgcagacgaggcctgcaggatggatggatgatgaggcgtaccgatgaagtcgatgatgaggcggccgtcggagcaccggccggtggcgcggtggaagaaggtctcgccgtagggtggccacagctgcgaggtcgttgccggagaggaaagcgacgttgcccgtgtccgccagcgagtccccgaagctgaacacgcgcaggtagcacggcgccgccagcgcctgtgccgccgccgccgccgccgacagcacaactgccaccgccagcactaccgccggcggcgagaggaggcctgctcctcctccggaagtggaggagaccattcttcctacactttcgtttgcttctgctcgacgtcgggcccgaaggcgaagcggccactgggattggctctgcggtgttttttcgcgttggcccaaaaaaggcaaatactccaagaaacgtaagcgtggctcgttaatgttaagtgggctcgagtgacgaatgcccacaggtcagtagggcctctggtcgctgttagcctattacacatgagacggtgacaggtacgctccatcctccactaaatgcactgtgaaatgcgttagtataattcttaagcgatcataacaagtacacattgatccctatatatatcactcatcgctaaaataataattacccgtaaatgcaaatgctcatgtcaagtataggatttgaatcaaggggacttcgttctaccacgagaaagctaaccagttgagttgcgtttacaagtacgtttatttcgtaagtcgtaaggtaacacttttagatacacagattgttgtatatcattactttggaccaaaagatttgatacatccatatattgattttttttcggcgatgtatatttaaccaagcgtaagtgaaaatatttttccccgtcgttcgcattctgccatggtgaaacaacttatcgaacgataatgaggcttgcagcaacaaatcacaaaatggttcaggtgataagactcgaggagatagaaatgggaaaataagtgtagtccaacgacaatgacaatattttttttacttcctctataaaatatactcaaccttgtatgaaataggataatctagtacaattatccatatattcgttgtactagattattttattccttactagcttacgttttttgtgacggagggagtattaagtaaataatcgcttctcttaagagtgttaggtgcaaggagagtaggtagtgaattaatgatgttgcaacataattgacctgattgatatatactgggagttgtgctttttatattatctaatatttgaagtgttttcgntatttcgatttctttaaacaatatcccgcacatgtttgacactgacagtttttttatttaagctatatggcacttctgatgattgtggatacaaataagagtcatggaactcactaaaaattagataaagcgatcggattgcatgatctttatacaatatcgctcataagaaatgcctctacgagaagcgacatcacggccacatcagccacgcagccaaggtgaccaaagaatgtagttgtctccctgtaacccctaaccctttcactatacacagaagaaaaacaatggagctaaattataataatactacacataccctataagaaataataaatcttaaaaatttacgaagaatcaaacgatccacaaataaaaccttgtggtcgtgactaaaaacagagaaggaataacaagagccagccaatcacttgggcaacagccattctgtgtagaacagttctgcagttctgtaatgaggcaaaaataccacaatcgttacatcttttaatcacacgtattgtctatataataaaaaaaatatagttacagaattacaaatcgtagaggaccttgtattcaacagaagaactgagctcagtaatttgcgggcacgaattagtggtggtagcaaatgaaggttgtgtatatgaacctcgtagcagtccaattgcaatggccttgtatgcagcttctgatggatggaagccatcccatgacccaaacttttgtgggtcatcgcaaaccttgtattcaccatatccacatcttgcagttccagatacaccatacggtcctcctccaccacaacaagctgtcaaaggatctttgattcctgaaccgaggttagggaaatgttaaacaagctatactcagaagaaaaaaatgatctttttcttgataatatgcgctttcctccatattaaggcttctagacagtttttctagtgtaaccgactagttagttcagtcttaaactcggtacaagtgatgtcatgttaatttgtaatacacataatgtatctataccatggtaagaatgcaataatttgtaatacacataatatatctataccatgataagaatgcagatatctgaacagaggtctggcgtgggggtgcattacgtgacatgatgaaaataaacttctgaaccttacaaacatatgaaggatacagacagatttgcttcgtttgagaagcactaaggtaatcaaatttaagagaacacatatagagtatttttcttgtaacctaaaaactaaaattagtagtgttaagctttcgaaaagaaatcatagtagaaacagtaatgaattaactgaactcaccaaattgttcaggggaaaggaaaacttccatggcagctccatagtaatcagcatagatgatggccacatcaggatgaagcttgcgtaacttttccaattcatctataagaagtttgttgtggtattgcgagaactcgttcatccacctgaggcaacctgtctctggctcataatcttccttcttaccactcttgaatatcatgaggtaatttggaacacatccaatggggaggttaccaggaacaaccagcgtcttggctccaagcccaatcaattcctgcaaactcaacgctgttgcattacaagccatgtaattttgtattgcttcttgatacagggtctcaaggtacacagaaaagatgtaacataggcacgttactcacggtgattgtagaagaaattttggcaatgacactcggagtgaagctgcgaatctttgtaatggacaccccgctgagaagaggtaggttgtaatcattgcccccaatttctccgaccaggaaaagagattgattcatcatgcctgtgcaacctgtgcaataactagtgtttagaatcagtatgtaaatatgatattatagctgaaaatggaattttaagcatatcacaattgcttatttattatatcatagttaaacatttaaaggatcacaggaagcttactacttgtcatttctactaaaaaccagatttgtagcagcatgatcttccccttggcgtattaattgatttctgatttatgttgtatgccatcaattcaagggcaaagttcatatgtagcagtgacatggtgtccatttataaaatattttttataatttttaatttcaactaatgatgatgtattctttggaaaacaatgtgttatggattcgcggtgtgattttatatatatatatatatatatatatatatatatatatatatatatataaactgcagaaagttttaggactccttttacaatatttcctttttatagaaaatacagtatcagttatggacttaaggtgtttgacaatgacggttatggattttgaaatggaccatctgcctagcagcaatcaacaaaagctgtcaatcttcaagccacaaataaaccccactatttctggtaatgatgaattgcttttcttattttccttgtgctgttattttctttggatgcacatttttttgtgtctaaaccaagtaaccacaggtgacatataatatgtgaaaatgacattagtagtgtatcgtggaaaatacttcgatgcagttatattctttagaaaccatgtcaacgtcctaaagcacaagtaaaaactaaaaaggaatcaaggaatatatattgtataccattgcaccaattctgaaatggcatagaaggtactaggataagttccacaccataaggaaaatgctatagcatacttttcctttttttttttctcttcaactttctagccaactcccaccttccatgtcttctgagagccacaaaaggttgagacagtgccttagtacctgtcagtctgcgtgcttatactctactaatcagtttgtggcatgtttgggatttgcttctccaatctccatgtgtcacattcagaccattctatttatcaccagatgcgcatcatcatcaagacattaacccccaccaaactactagtctactgctacgatttcatatcgctagttgaaaatgtcatcgtcaaaggtgggtagagagagaggagggattatatcaacataccggccaggtcgccggggcagagcagtttcagcagatcacgaaaccacttcatctccatgtcgaggtgcacgatgtcagccatgggcaccccctcttgcccggaagaaagccgggctgagcgccgtggcgccgcccaccgcgaagttggccccgcatgcgaagtcccccgcggtccgcccgctcaagtacgggcgtacgaac

SEQ ID NO: 76890 - DNA, 3534 bp, Oryza sativa
gttcgatcggtcgaccaatcgatgcaggggaggagggggcttaaaatcgccgcgagcagagtaccgatgaaatcgacgacgaggcggccgtcggagaatcttccggtggcgcggtggaagaaggtctcgccgtagggcgggcggagcgccggctcgcgggagtcgttgccgtagatgaaggcgaagttgcccgtgtccgtcagcgagtccccaaagctgaacagccgcgggtagcacggctcctccgtcgccgcctctgccgccgacaggagcaccgccaccgccacaactaccgccgccggcggcggcgagaggaggagtcctcctcccttcctcccggaggtggaggaggaatccattcctctcctctgctcgagatgaacggagaaaaggagagaaagtcgtcgcggcgatgctttgcgttggtccaagtctaacgtggcttttataaacgctgcggtagtcactgacatgtggggtcgcggtgacagaggcccacgggtcagtggggccagtggtcgctctcacgtgtgacaagtgtgctttctaaccttcgagaatgatgagatgtgctcagttaagaggccctctttgaagtacacgtcgaatccattattttttgcacacaaacatatgttctttttagtattacttccgtcccaaaataaatgcattcgtggatatccgtgccccacgtttgaccgtccatcttatttgaaaaatttaaaaatatttagtcacacataaagtaatattcatgttttatcatctaatagcaataaaaatattaatcataaaaaaattttaaataagacgaatggtcaaacgttgaacgtgaatagtacaaaactatatttattttaggacgaaggaagtattaattaaggcaaaggttttggatactctacgtctacgtgacctggtgaaaccggtaaaacgcaacaaggacgtacgaaaattacgtattccgaatggtgaggcacttccgtatgatgaaaaccgtgtgtgagtgaaaatatgttttcgtcatctcgcttctcccatgggcaaacggcccaaagaacaataatacgaagctcagcacgcagaacggctcggaggggcaatccttataaaccaaaattaaaatcttacaactttaatctagcgttgtttctttgaatctttggttttctcatcgtagtttattttacaacattattttaaaaagttcaaaatttgaaatatactcctaacttttaagaataacaaacttagagcatgtcaatggattgtctatactacttctaatataaatattttgcaggttttttcaaaaaaattaacctcccacaatagccctaaacaagctgaaaacatcatccccatcaccataaatgtctctccataagtcgagggagggcctcaccccggatagccatcaccgaccgattcacacgcttaggagtcaaccgtgggagtacaagaaaataggtctagttttgtctgaagtttttttatgtagacacatttttattttgagaagttaaattgggctatctcttagagggaaaggatatttttatcccttaaattccattagagattaaaaaaagatttaaggagattgaattttggcaaaaatgttagtcatgctctttagcataataactcactaggttaaattacttgtaataaaacctattcacatgggttcaaaccgtacacttgacatcacacggatgcttgtatttaggtttattattctttatgtgacatggtgctcgtatttaggttatgatgactttgtcaatccacattcatatataatatgtggactgcttctaagtttaataaattcctggttctcaaaaaaaaatccacattcataatgtgacaaaagtgggggaacacatgttagaagaaacgacaagtatagttcaacgagaaatgtgtttttttatatgagtaatagtttgtcatatactcctatatatgtaagaaaagtataaaatgttgtaaagttgatgttgcaatgatttgacttaattgattgatataatttgctcgtgactgtactatttatccaacacttccaaaattttgaagtgttctaatctttttcatttcttaaaacaacattctcgtgcattctttgagaggatattatttatgggctatgccacttgtcaggattttgtggatacaaacaagagcagtcatactcacccaaaaaggagaaagcaaatttgcatgaccatggtttaattttttcaatctcatatatacacaagaaatatcggcttctcataaaatctctaaagcgttaccacgcagtgcggtgatatcatactaccaacgtctaaacgtgcactcaaatgtacacaaaaatatgaaaaagatttaaggcgtacggagctcaacgatatgtacactactcctaagtactaacacagcaggactagcaggatccttgccaagcaatgtgttcttggaggtagagagttcacgaaagtatatatatgcggtgttgaggcacaaggtaacaagttagcaagtactagcaacaactatggtgttattttgtgtactaatctcctctttgtcttactcgctccgtcccactaaataaaacacttaaatttatcagtctccaaaactaatttttcatatatattttttgtcaaaaaaatttactatgtttataagaataaaatcataatcatatgaaagtaaatttaaatatcaatctagtaatattatttttaacaaataaaattttatttataataaaatagttactgatcaaatatttaaaaagttgaatctttaaaatatgtgtgtgccttattcttcagtgggacgaagggagtattagttttggtcggcagatcgccaccatgagacggaaaaaaagatctgtaccaacaaaaaaatcaactcaaaattatgtatacacggtaaaaaaggacaaattcaaggaccaaacagtacacaaataatacgtcccatcattattggtagttacagaatgcactgtttttcatactcatatccccatgtataaaacattttttttgttatttttgcatataaattatcatgttgcacatcttgatttttttttctttacacattagacacacatgcacatatcatcacatacgcaagaccgcaagaccgcaattacacacccacaaatgcatccactgacacacttttgaaaagaaaaaagaaatagtaacttgttcctgatcttagtatattcttgtagagtgatgcatttttagtgtactttggtgtaccagacatccagcttctaaatttagtttcaggagtttattttgtgagagaggtttacctagctccgctctcagtttaattagatggagctgaaactgtttggctgagttccagcttacgagagatggaggtggagctgaagctatgccaaacaggctagtagtacataaagattctcttctccatcgcaccaaacattgtgaaagagaaaagagcaccattttgagattcgtttatgcactattactattt

SEQ ID NO: 76891 - DNA, 5666 bp, Oryza sativa
tgtcgccgctttggccgcgaccgccgagcgctagccctctcctttgaccgccttaggtcggttcccaaaccgacattgcccccctataaacccaagcttccccctttcctttcctctcccattcgcctccacgccattgccgccgcctcccgtgctctgttcgccgtcgccgttcgtcgttgcgcgtgtcgaaggagccggcacgagcaaggacgcggaaggggacttcgggcgcgccctctccttcctcttccccggcccgagaccggagagattactcccgcgccgtcggcctctcgtcacagcgcccacccgcacggtagtgcatctctccgttcttcctcctcgccccatctcctccccccttagacttgggtagtagcacgagtagactccccgtagctagccggcgccgccccgaccggtgccgtcgctcgccgcgtgctcgccgccatcgccgctcgagctccgtagcacccgcacgtcgccagcctcgctcggcgtagctccgcccaatccgacgctagcatcggattcccatagccgcgtggatgctctcaccgccgggaatcggtccctcatgacctcgtcgacgtttccctcttccctccccgccggttgtcgccgccgcgattcgccgccgtcgaactccctctggcgaatccgagccgttggctcgtctcccctcatcacgaacaaccgcccggtgtgctagcttttgcccgtatcgccgtggttcgctccgccgctcgccgccgccgcccgccgtccattcgcggccgggtcgtcgtctacctcccgccggcccgcatggcagccacgtaggcgccacgtcggcgcccgctcagcctagaccgggtcgagccgaccccagccagtccctccccgtgcgcgcgttccaccgcgagccgtgaggctgcgcgtgggcccgccgcatccgcgtccaccgcgaaccgcgcgcgcacctcgtccctcccccgcccgcgcgcatgagccgcgtactccctccgcacggtgagccgagctgctgacaagcgggtcccacccgggaccgcgcatggtgagcccggtccaccggctctctctctcctccctccagcgcgcgcgcgtcttgggccgccttgggccaccttcttgggccggccggcccgttaagctcggccgagccgccctttctctcgggccgcgccctagccgcccgagggaagtctatattccctccctctccctttttcttttcttttcttttccaaaaaggatttaattaaatccttttcctttagaccaaaaatccaataatcttagaaattcaatatcttcccaaccataaatccgtttgactccgttcaacttccaaaattcctcaaatctcgagatctatctaatggcacgcttagaggtcattaatagggctttattttcaccgtttgttgagttgtcccgttttgcgtgtagtttcggagtccgaagacccgcagtgcgaggatttcgaggatcaagctccagatctcgagcaaggcaagccacctttgaacatcttgagcctatatttgaaatctaattatattgcttgcaaaatattatgcattgataggattgcacttaatctgttgttccgtctgcaaggcagattggcagacctacctaacttgttgcatttgatccttccattgttaattgctataccatgtccccttgtaaccatccagttgcgcctcgatattcgtgcaccctgtgctagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccgggaaacgtaccgggtgtacggtttcccgctctcgcacttaaagaccgattccttggaatttcatccaaacataagtcaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcatgtgggtaaagtgtaccccctctgcagaggttaacaaactgttcgaacagccgtgcccacggtcatgggcggatgtgaggtgattcctagcgtagtttagtttgactactgcttgtgaaattgctgtgtgaaaagggggttcggtgtttgaaaaatctgcagctgatgggatcagctaggcccggatggccgtttgaaaagttgttggcccgggtggccgtttgaaaagttgttggcccgggtggccgttgaaaaagctgttggccgggtgccaaccttgtttaaattctaaagactgatacattgcacatactccgaccagacgagacgcactgtctcatccgtgtcgtttgagaagcactcacttagttgtttcagaaaagagttcaaataaaattaattgcaaaaacaccagcctttccttgaagcctgcattaaacacttacttcccatggcttgctgagtactcccgtactcacccttgctctatataaataatcccccccagttgctgaagaagatgaagcgaatcctggtgatgaggagttcttccaagagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatattctatctccctgtgataccagcactgtttcctgggactggtatcgattaacaggttaatttggagcgtcacgggctagttccggtcgggactagtttggggcgtgacatggcgtggggcgcaaggcgacgtgacgggcgagcggcgacggcgcggcagcggggcagggttaggctaggggacctcgtcgaacacctggcggccgatgaatagtgccgttttccatttacccgatttaagcctatttatttatttaaaattgattctataaaccttaatttttgtaccaatgaagttcactcaatatttgtgttattccaaccaatgggtccacccttgattaattttacccatattttatttttatataatttccttgaatttaattagagttaattcttattccgacacttttcaatttaattgatacaaatatagtcgtaataatattttactcatttctatactcactaaatattattttaaattgtactttaattatttacttagtcaatttactttttagggtttattcctaactaattatccattattcgcgatttataaactctgaaatcaaaattcaataaaataatcgaacaaaattggcatgatgcaactttatttaaaaagtttttgaagatccgtatttttagagtttagattttgtcgtcgaatttttagggtgttacacgataccagcaaatgtcgatagggttttgagcaatcagctatatgtccaatgtagattctgacacttgagtaaataataatataaagataatcatgacacttgagtaaataatgatataaagataatcagctgatgataatgtaatagaacaataatataatccaatagaaaccaatcagtcaataatgatatgatagaataattgcttgatacgaaggttaaattcacaagattaaataatcaatgaaacctttgttgtaatcggctaaaaccaacttgtatgtaatccttgtaagccgatgcaacgtctaaataacttatcggctaaaaccccgatgaaacccttaatggcaatcaaaggcaggttagttttatgattataagcacagcttagtaggtcaaacccattgatgcaacactaaatatgaaaagaagcataaagtctaaacaatcaagcctttgtctgattttcagggtggtagataccttagctaatctagatcgatgaagcaatttaactgataccaacaaaaccctagaaatggtatggcctagacaacgactttgattaactgagatatatgataaatatgtattacaacgacaagattagagtgtcgagaccctagcctcgccgatacaaatagccataacaagccttacccctcatcggtgatcgaagctgaagcagcccaactcgaaacaagagctcgtcgagaaagatgaaaaataaaaagggtggcgatgcgccgaagttgtattgatcgagagataatttatagggaccttgggtgtacatatttatacctataggctgttaacagtcctgatcgaacactaaacacactttcctaaaaataaaaggaaaatgacaagtcctgatcaaacactaaacacactttcctaaagataaaagggaagttattaaatcttgcctaattaatagatagaattaaactgtcatgccatggtcttcactattcctccttgaacttggtttcttttgcataggttcccatcagctgatcgacttctttccttaactgaatccactaaagaatcttactaaattttggcgttaacaaatggccgcttcgtcctctcgccagccaatctacttgtagaagcagtatcaccgttggatctacttgggtggcggaattggcggctgatctgctggcggcccgacggccttcagcgacagcgaccccggcggccctcggcgatgaagaccacaacgacaacccgacggccctcagcgacgatgatcacgacgcgcagcgccgccgcttccccttcttccctccacatagctctgtgggccatgcggcagatgcttgcaggcaaggctctcgtagcaaaagtaagacatgagaagcaaactaaaactatgggccccacctactttttcttccacgacagctagtgttctacatggctagatgagtccacactccatgcaggagcactgtgaatggcctaacttgggtcatgcggactttagttttgtgggcccacccaaaaacgtggcaccaaatcgaatctctcctactcgtatacatggagggcgcgggccaaataacagcacaccgcgctgtgaattagagcaagtttaatagtatcgtccgttgatgggttgcaaatttgtatacgtcagtgatagatggtaccaacagatgttacatacctatgatttgtatgacgtggatgcttgtattgccagcttataggcctctattatacctgctcaagagtcaatagtgttggcccaaacactcacttgcacacacacctctctctttctcacttgatgaaagacacacacaaagaagatgcactgaagagacactagaaaatttttgtcactgcacaccagcgaaccaccacacatgcacttatatttcacccttggcaccccaatcaaatgctgatcacattggttaaatctatactaatataaaaaggagaagttagcagggtaccgagctcgaattcgcc

SEQ ID NO: 76892 - DNA, 5177 bp, Oryza sativa
ttatcaggggagccttgatgccgagagacatgtggattccccggggtggtgtaggggaggacccctgggcttcctggcacagtatggtctgggacctaacctgttgttggtctgggacccctctagtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgtagaggttaacaaactgttcgaacagccgtgcccacggtcatgggcggatgtgaggtgattcctagcgtagttttgtttgactactgcttgtgaaattgctgttgtggaaaggggttcgatgtttgaaaaatctgcagctgatgggatcagcaggcccgggtggccgtttgaaagttgttggcccgggtggccgtttgaaagctattggccgggtgccaaccttgaatcaattcaaaaagactgatacattgcacatactccgaccggacgagacgcactgtctcatccgtgtcgtttgagaagcactcacttaattgtttacagaaaagagttcaaataaaatcacttgcaaaaaaaaacaacagcccttttctttgaagcctgcgttaaacacttatttcccatggcttgctgagtacttccgtactcacccttgctctatataaataatctccccagttgctgaagaagatgaagcggatcctgctgatgaggagttcttccaggagcaagccggctacgatgagttttagggtttcggcctagttcccaagtcgcgcctgtgttgtttggtccaagtcctggcttccgcttcccttttgtaatgcagttgtgagctcgggatctgtccgcagcccaacatggctgtacctctactctataataaagagacctctgttgctgtgataatctgtcttcctgtgataccagcactgtttcctgggactggtatcgattaacaggttaatttggagcgtcacgggctagttccgatcggtactagttcggggcgtgacacacgtgtacttcaaaattcaaagcgcgtgtttcttcgaaaaaaagaaaacttcaaagagtgtgtgtctcagggtttacgattccgacaggcccttccgtttcgggtactggcggaatttggaatttcgcgaaatccggtggaaaaccagtaaattccgaacaaatttcataaaccaaaatttgaatacaaaatccctaagttgccaacaagttctcgaaaaccggtcggttttagcgaaattccgatcgaaatcatcgaaattttgatcagtaatttgtaatagaggtaatttgctgaaattcttttttttcatgatgtaagttttagtagatacacacaatacatcatttttttgaaaatttatatcctaataagttctatggatatcataatatttgtaagattttattttattttttctttttttatcaatttaaatttaaatctgaataaaatttctcaaaatttactttcgagtctgatcggaacgtcgaaattttacgaaatccgaccggaatcatgagccctggtgtctctctcagcttgtccagatacttccccgcttgtccagtggaggatggagggtagctgtgcctgtgacaactgacaactgacaaccaacaaccacaggccccagtgccccactgctccttgtactcggccccagttgacagtgccgcagtgacaagccaaacagcgacgaaaaaacaactccccgagccgcttgaccgacgcttcgcctttatttgctgctccatctcgaattctggactggagcagagagaaagaatggcttcctctacctccgggagaagaagagagctgcggcggtggtgctggcggccgtggctgtgctgctctccgcgtcacaggcactggcggggccgtgctatccgcgcgtgttcagcttcggggactcgcttacagacaccggcaacatcgctttcctctacggcaacgactcccgcggcccacgctgtggccaccctacggcgagaccttcttccaccgcgccaccggccgcgcctccaacggccgcctcatcatcgacttcattggtacgctactcgcaaccaatccagcccctcctccctgtatttgcttgatccaacacaggagtactactaattacttgagatttggaaatcgcgcgcgttgcgctggccgcagctgacgcgctggggctgccattcgtgcggccgtactggagcgggcggaccgcgggggacttcgcccacggggccaacttcgcggtgggcggcgccacggcgctcagcccggatttctaccgggagagaggcgtgcacgtgcgcgacaccgtgcacctcgacatggagatgaactggttccgcgatctgctcggcctgctctgcccagacgatcttgccggtatatatgttcgtctattgaactctttctccttccacgcaccttgccacctctgacgatgacgctccaaagtaacagtttggtaggaggtgagggtagctagcagtcgcggtctcccgtatccaaatcttctgttgtactatagtggcatcgattctatacacggtagtaattccagtgaggctgtgagggtaaacggtgaccttacttactgtagcagctgttactgcagaagaagatcgcgatgttttgctttcgatccaacggttaatggaatgatggatgcctctaatgcaaacacactacactttgtaggttatccgcattttatcctccactgccgatgatccgtttccagcagccgccagtaggtgaggctttaatgccatgaaggtggtgggagagaccagagactatattttggacttttttttttgtttaggccttgtttagttcctaaattttttttctcaaaaacatcacatcaaatatttgtacacatacatggtgtattaaatatagataaaaataaaaaactaattgcacagtttgcatggaaatcacgagatgaatcttttaagactaattagtccatgattagccataagtgctatagtacccacatgtgctaatgacggattaattgggcttaataaatttgtctcgcggtttccaggcgagttatgaaattagttttttcatttgtgtccgaaaaccccttccgatatccgttcaaacgtccgatgtgacacccaaaaattttcttttcgcgaactaaagcaggtgttaggggttggatggtggtgatattgggcacacttccaagcttaagatttcgctcagaggtaagtttgagctaactactgctataagcccatataaaaataatgttgaagtaaatatatttgcagatattagttataaggttgtctatacttctcttcttctctctatctatccattgctaatgctgggtggatcttgctctatttatgcccatcgccaccggatcctgctgcacgtcactaattctatgcacctattactgactagatcccaccgtccatcaccaacactatggcaacacactctagctaggaagcagatagcggccagaggggtgtgcattctgatggtacgccgcctattgtccgctctagcccagtcgtgtggttgctggttgtgcgcctctcccatcacacctccatccgggaagcatagtaaaaaaaaaacccagaccggtgatcaacccagtgacctcgtcggttcactggttcaccggtcggaccgccgggtcagccggttcaggtgctgaaccggatgtatatagttactatatctttttattagacaagatgagctagctagtaaaatggtaaggctgacaagttctcaacccacatgtcatgggttcaagtcacttcccagtttcccacatatgttttattttgcataaaatgtaaatgggccatagagtaagatgatgggccttacaaggccagctgaactgacaatgaaccactagttcttactagcccggttcaccggttttcaccaaaacctgcccggttcacagggttcttaccggtcaaatgcatgagcggtctttctactagaccaaaccggtgagaggcatggttccggttttttatactaagccgagaagtgaatgccactatactggattggttattctattcgtaaaaataggaaagagataggttggcgaacgcatgggcaaaggaggcttgtgcaccccttacggctgcatgacacatttaaccactggctagtgcatcggtttgatagattgtgatgacttactgttaatggtacggtggtcttgggctcatgtgtgcttgagcaaacaaattcactaatccaaggcaagcgcggagcagccccatggcgtcatgtgtgtgtacgctgcggccaactagtcccaggcaagcaacacggcaaaaagcatataacattaaagataaagttgcatcaaaatatttttcatgataatatattgatacagtccctacatttctttacttgttagggtatttacattgtatcagcatgttgtatcactatctcttatcatacgaaacattaaatatatatatagttgcatcaaaatattttccatgaaaatataataatgtcattttaacatatcaaatcttaatatgtttatatatattagtgacttaagatttgatggtttgtactgcactcattctaggacataatctatttgagaatgaagagaatttcataaatcctaatagaacaattcatggcactagatcatccagtgagagttgtggttaaaccatcatctactattagttcaaaagttcggcatcagtgccgtggatggtagaaacattgtacctcactttttttagtttaccttccttaactttccatgttcattttctgtttaagaagtgggaatattggattgtctggaataaagtcggaaagataaactcttatgtgttgtggttacttagtcaaatgtggttacttagtttatggcacaacaataaattgtgcttccaaagaggagaactgcaccaacaaaaatatggaaagcaattcatcattaccaagaaatagtggaatttatttatggattgaagattggtggcttctggttgtactaaggaatactgtccattccaacatccggggggatattcgatgagaacccgtgagaaaactggatgt

SEQ ID NO: 76893 - DNA, 867 bp, Oryza sativa
cttcagagttaagcgtgcttggcctggagcaatttgggatgggtgaccgaccgggaagaattcccgggtgcacacgagtgaggacaaagtgtgcagaaataacatgtgttggtctgtgagggcagtctatgacctatgaaagctgccagatgtaagtgggcccggcctgggggaggcgggacgttacaccatcgctgccgccctgtcaccacccgtcccgtcgcgcgcgcgtcccatcgcccgccgctgcgccgcgcaccgtcgccgtcgcgccgcgcgcgtcccgtcgccacgcgcgtcttatcgccgcctcgcgccccgcgctgccgcgccgccgtcgcctcaccccccttcaccggcccctctctctcctctctcacaccctataaaacccccagcccttctcttctcccccacacccattcccctccatcacctccctttttaccccgccgtagtgccgccgcaccgccgccttcgtgctgccgcgccgccattcccgtgccgccgcgccgccgttcccgtgcccccgcaccgccgttctcgtgcgccgtgccgccactcccgcgccgccgtgcgccaccatcgctgccgccgtcgtcgccgctgccgccgccggtgagccgccctccgttcccctcgcgtccaccgccgccaccgctcgggtgggagagagagccgagagagagagggagaggaaaagagaggccggcagagagagagaaaaagaaagagaggaaaataaaaagaaaaaaaaagaaaagaaaaagaaagggagaaaaagaaaaaggaaataaataggaaattagagggagattagggaagtttagaaaatttaaaataattggaattttataggttaattat

SEQ ID NO: 76894 - DNA, 5290 bp, Oryza sativa
gcacatctgtggctctcgccatcattgtgaactgaggtaagttgcgttaaaccctaaccctagcaatgtcacctcaccctctctgcggagatagtagcccatggccaagtcctttcgtacatgaagccactaaggagctgcatcattggcactcttgtcggcgaagtccgcagtcacacggagagcacgagaggaggataggaaggggatgagtctcgggaggagggatggaggcgaggaatcgcggagagatgggggtgacgagtcgtgggatagaggcgagaaaatcctaagcaaagggtaggactgccatttcactccacctgcagtattgggctacgaggccacgacgtgggctgagtagcatccatgtggttctccagattttatggatccagtttgaggccacattgcactgtggatcatgtgtcctttgaagttcctcagcctatttggtagccctagaaatagcaaattcaaggatgtattgctaatccctaaaacctctcctttcacgcaccttgccacctttgatcatgacgctatgaagtaacagtttgtaggaggtgagggtagctagcagtcgcagtctcccggatccaaatttctgttgtacagcggcatcgattctacacggtagtaattccagtgagagcaagtttaatagtaggctatgaaccaactataaacttacttggatgagagagaattttaaaaatgaagaggtttgactcacatgaaagagctagctattcacatacttcacaattgatacattaaatgcacaggtgagagccaaagaataaaaccaaatagagataaccttatagctcatctgctatacatgttaactctaatatgagctataagcttatagttggctctactattaaacttgcactgaggctgtgagagtaaacagtgaccttactgtagcggttgttactgcataagacgatcccagggttttgattttgattcaacagttaatgcaaacacactacacactgtagcttatctgcattctgtcctcgagagtggattttaaactctcgaggggacatcccctcgttgtttgtatgtcacttatatagtcatgaaaaaaattgagaagatgtattaacatgtgatatatcactccacaaacatacaagttaaaattcaacttctacatatcacaacaaaaatacaaatttgactatgaatatacgttagctagctgtagtttatttttttggttgcgagatgtagaagttgattgaacttgtatgtttgtggagtgatatatcacatattaatacatctttttaatgtttttcataaccatttaagtgacatacaaataacgaggggacatcccctcgggagtttagaatagtttcccttttatcctccactgccgacgatccgtttccagcagccgccaataggtgaggttttaatgccatgaaggtgggagagaccacagactattttggccttttgtttggtttaggggttggatggtgatgatattgggcacacttccaaatttaagatttcgctcagaggagtttgagctaactactactagctataaacccatataataataatgttgaagttaacatgtttacatagattagttataaggttgtctccacttctcttctctctctctctccctctttctctcatttatatatttaatgcatttatgcgtgttttgtttgagttggttttcggatctagtttagagaagaggacttacctaagcacctacccgagggtagtttagactggagcgagattgtccaggccataaagtagagataaaaggattaccataggctcattcatcgaaaattatatatacaggaaaacaaaaacgaatttctacttgaagcatgtgtaaagctatttcttgcattagagctaatccttattatttttctttgtctctttcctctatatatatgcttatagctgactatagtctcctattaaatttgctcttagtaactttcttcatcagtatattatcttaaaatgctttttctaaacgtttttttaactttgtaaacatttaactcatttgtatgtgtccttgaataatggtgataaattttaaataaatgtcataaacactaaattgtccatcaaatttataacatttaacttcatatgggcaattgagcacttattcaattctatctatccatggcccatgctgggtggatcttgctttcagcatcagtacgcacgtctttagcatggagcccatgctggcctgtggtaagtacgattatatcttccagggattcccgagaaccggtccttaattgtcatgggcacgacttccaaaatcatgcatgtatccacaacccaccattaaagcatattttagtttaattaaaccataaccatggtggtacatcataatataattaaggactaaattataatgaatcccattgtgagctaattgatctaagcatggctaagcatccctaaaccaatcatccagtcaattataacccaagttatcaatggcataaggtattcaacaggctgagcatgataggcatccatcccacatgacattctaaaacaatgcaatttaatggaaagcaggggattttataaaacaagttcaacatgattaatgttgtatgtatgacttgccttgctcttgagctgacggaacctcgcaaccactacgaaataaactggatcaccagaactgatggaatctaaatgacaaacaaagcacacaagaaatacaagcactaaggctactgaaacagcaaaagaaaccaattttagtggattctatacattttaacaaattcactgcaacttgaataggttaaaacggagctcggattatttagttatgaattttacaatatgagctacgttattactaataaccgaaaaaacttaatcatttgttacatattattgcccgtatataaaatagatcaatggaaatatatctccggtaagcaagcctcacgaattaacaactgaacgagccaatacttcgtgacacgggaccatccaaacggtcaaccgatccggcgaacggaaccggcggcaagtggctgcggctcgcggcagcagcgcagcagcggcggcagtagccggcaagcggtagcggcggggacggctagggcggcggcgctggtggcggctagggcttaggaaaataaaattgaataggagaataggggggtgttacaacttatataggggagtgaaaatagagagaggtggggccggctaggaggcggcaacagggggagaggggggaaaccgactcgggcaaggggaggggcgcgcgtggccgagagggagaggaggggcacggccgagagggagagggggaggaaaaataggaatatgattaggacaatgactttcccaaataggaaaagaaatccggtgccgttttaggaaaagaacggaaacagaaccgcgaacggattcggactcggctcgttatgcaaaactaaaccgtggacgaagaggggagtgaatcaggcacaattcatgaccaaatgcgggagagaaaatttattattaattcaaatcctgtcaattgaaattaacaacattaattccagtgctctgaatattccgctttaaatcctgttaatgattttagagcaaagagaattcgaaaaaaattctgcctgacattttcgattattgaatacattgttaattaagattttctcctggttagccaaagtaatttctatagacaatttattggtgaattagaaactacggaaaagggaaaacgctaggtgtgacatctaggcacctatcattgactagatcccactgcccgtcaccaacactgtggaagaacactctagctaggaagcagatgttagctttggcccaagaaaatcacaaactcacgtaagcaacaaactcacgggagaacacacacgagcagcaaattgggtggacacacacacaacagattccgtcggcgacacacgcctttgctgacttctctgatattgctgatctactaaaactaactgatgattacacggcttatataacctcccgtacatgcacatagctaacagcccggccgggtcgcacgcacgactacaagccactcactcatacaacgatctgcgcatcttacgccaagattcgctcctccgagctgaccgcgagccacgccacaacgtgctccactaatcctgcatgctcctaactaacttgccgctaatcttgttattcacctaacctgtttagttgctagttgtgctgcaacacacgcagctgccactcactagcactgactgattctacatgcaaatatggactaaccactacctacgtgatgcacacatacacatcacttacaagatacatgaacatatcacgttcctctctacatgcaactaatgcaaaacccaaagacatatgcaagtcatgattagttccaacagcagatagcagccagaggggtgcgcattctggctgcataccacccattgttctagatccgtcgtgtggttgccggctgtgcgcggtacgcctctcccatcacaactccatctgggaaatgaatgccagatgggagaggctggcgaacggaataggggcagaggaggcttgtgcagcccctacggctgcatgacacatttaacccttggctagcgcaacggtgcatcgctcgatagattgtgatgcgtcatgggtgtgtacgttgtggccacctagtccaaggcaagcaacgcgacagaaagcatacaaaacattaaataaatagtcgcatcaaaatattttccatgataatatattgatatactccatccatttctttacttgttagggtattgacatggtatcagcatgttgtatcactatctctgatcatatgaaacattaaatatatagttgcatcaaaatattttccatgacaatataataatgtcattttcacatatcaaattttaatatgtttatatatattaatgagctaagatttgtaggtttgactacacgcattctatcctaatagaacaattcatggcactaggtcattcagtgagggttgtgtggatatggatagtagcaacattctatctcacttttttagtttaccttccttaactttccatgttcattgtctgtttgagaaatgggaatattggattgtctagaataaagtcggagatctaaactcttatgaattgtggttacttagtttatggcacaacaataaattgtgcttccaaagaggagaactgcaccaacaaaaatatggaaagcaatt

SEQ ID NO: 76895 - DNA, 584 bp, Oryza sativa
cgccgagttccacaaccgggttctcaccgcgcggctcgacgacctccgccggctgcacccggacgtcaccatcgtgtacgccgactggtacggcgccatgacgagcatcttccaggccccaggaaaactaggtgagtgcgtacgtacgcgtcagctctctctctctctctctctccttattttggcattgtgtcgtgtcttgtcttgtgtgctgcaacggcgacgttgcacccgtcggcgttcctcctctctgttggtttgtgtggtgatatatgcatacacgtgacaaacgagcgaggcgagtactgcacaaagcttagcagttatgtatggcccgataagcagcatccaccgctgccatgcaggggccctcctaattcatacttgcgctaaggttcacgtacgaacagaggggtagagccgtagaggtcaagcgaacatggaattcagcggtgtccggttcggacgcgtctggctcatacgcaattatgcatccaaattccaaggtaagctgtaggcacttgggctgaaacacttatttcggtccctattgggctgggaagattttaataggaataagtcca

SEQ ID NO: 76896 - DNA, 3894 bp, Oryza sativa
tcttggtgggtggtgcagaacaaaggtatggtgaaaggcacggatggtcggtggcatttggccgaccatgaggatgatgactgatgcacccaggcatctcctcttgatgcctgattcaaccgacagctcaaaactaagactctgaaaacaggggatactttcatgtgttcgttattgctcgacaatgaagtaatgcatatgtttggaatcattttgtttttaacatttttcagttcattgtgttttacttaatgttatctgtaataagttatcaaaattgcccgctgaaaaatgaattatcagaattgttaagttgtgacgtttctgacaagcaaagcaagtgaaggcagtcttggtatatcattgtgaagatgtagttggaaaatagcacctgaggttggatagaatcagatgcactgagtaatttgctttaaaatgtgttgactccataattgtgcttgatgatcttctcgaacatttcagggggaaggaaccagatttgagttattcgtctacgagtactttatgttcaaatcattgtagaagcacatctctcctgcagttcttaaatctaacgaatcttaagaggctactaaatacactttccatatgcaacttatatttaaatggttctttttcatattagcgcagaaaagggcacatccatctcttaaaatagatgaaaagcatgccaaaaaattaatcgcaaattatgagccaccaaacccactgactcaatgacccaataaagtgcccggtccagttggcaccgtcccaatcactccctttctccatatctgagatctcattctcatcctggcagtcgggaactcgggatcgatggtcaatggatcaccggcgatctacacctctcctcgccagcggctgccgccggttcgttcactttgacgggccaccaccaagtcgcctcctcagattgtaggcggcgccaaggaaggttccaaatcaaaggtgataacctttttcttgtttcttcctgtgttgggtaattcggtttaggtacaataatctgccatttttttatttgttatttacaagactagtatgcttcatctgcatgatatatccaaaaccagtgcttttaatcatatttatttgtaaattaaaaaaggcaaggaaaatgaatcgcatgaaacaaaagaataattgccataggtaacctaccagaaataatatcatccccctctgaaaaatgtaagcattatcttgcataatgctcctagttttagccttatctgaagaataatggaccatgaatacatgttaaatcgattccagctgccagcataatcacatttatattctgccaacttttttcaggccaatatacgcataagcctaaaaaaacagttgtacacaaacattttttctctaggtcccacgaaaaatttcatagatgtttcagagcaactgatacaaatatctagcatcttggggaactacctccattccaaaatataatcatttctatgttttttttctaaatgtgcgtattgaaaaatgcataaaaatgattactatatttgagaatgcaccatgtcaacttaactttgtcggaacaaaattctaacagtttgacaggatagcaccaagagcagagctctcagatcgatcagaaaggtaccctggcgacgatgttctcctgcgacatggcgagccggtggagggagctgcacggcagcggccactgggacggcctgctcgacccgctggacgtcgacctccgccgctgcctcatcacctacggcgagatgatcatggccacgtacgaggcgttcatcggcgagcaccgttccccgaacgccggcatgtgcaggtaccgccacgccgacctgttccggcgcgtcgacgtgtcccatccgggctggtacgcggccacccggtacatctacgccacagccaacgccgacgtgcacggcaaggtgctgctccgtccgctgtgccgggagggacgcgccacggagtgcaactggatggggtacgtcgccgtggccacggacgagggcgccgccgcgctcgggcggcgcgacatcgtggtggcgtggcgcggcacgcagcgcgcgctggagtgggtggccgacctcaagctcgcgcccgcatcggcggccgggatcctcggcccggagggcgccgacgggaccgacccgtcggtgcaccgcggctacctgtcgctgtacacctcgaaggaccaatgctcggagctgaacaagcagagcgccaggatgcaggtgtgcgcgccccgccctgctccctccttgacactcttgtggttgtacggtaccagtactacttcctccgtttcacgatgtaagtcattttatcattttgcatattcataataatgttaatgattctagataaatatatatgtctcgattcattgacatcaatatgaatgtgggaaatactaaaatgacttacattgtgaaacggagggagtagtattttgcatgtagttgacttagtagaactataatcttcgacagttgacagttttccctagtaaattatgttggcatatctgattagtacacagccaccttacgtgaagacaattagtatatgctggtagaaatatcatccaaactaaattcatttagtactggttgacactcggagtgctgccatattttccacggacgtggaagggtgcagagcccatcatcactcttagatgtacttttaaggcactcacaccaaaataacgttacatgtatactccatccgttcaaaaaaaaaacctaaatttattaatgatagaatatcacctgatacaacgaatttgggttgtattagataatatctcatctaagttaggtttctttttacttaaggagtagacactaataggaaagtgagaaaagaaaacggtcctttcgctgcttttcatgttcattccatcctactccctccgtcctataatataagagattttgggtggatgtgatacatcctagtagaatctggacagaccgtgacacatccacccatcacagtttacaactttaggttacatatttaggtttctttgtttcagaaaaggttaatttgagtcaggccctcgtttgaagcaagcagagtttttttttttttttttttttttgaactccagagtccagaaggttttcattcatgtttaggtcatagagtggattgccgttaaacatcatttttcgaaattaagagaagagaaagattgcaacacatcttcataacccttgtcacaaggcaaatacagtgtcagttaaggagggcacatgtattgaaaaggagattagtgaagggacagactgaagttgaaaggtggtgctggcttgctgcaacgtggaagtggaaggccagcgacaggtgtcgagagaggctgcactgcagtcagagttgttggaagaaaagaacgttcatttacattgatggtttcttgaacagctgggcgagtttcttttgacatcacatggaccatcattttgtcattttaaacgattttttcattgctaaatccaacttagaataaaaagttgggatttgatcctatgcgacaaactttgaaaaaagtaagttaccgtgcgagtaggcacttacaaaattcgggtttgcttccccagcaggatatactctatgccaaaaaaatatatatatttttcaaggtttgaatttagcaaaatttgttcaaattcagtcaaactatattcctttttttttcctgttggccttcaaattcagtcaaattttgaaccctgcaggtattgacagagatagcgaggctgatggacaaatacaaggacgaggagaccagcatcaccgtcatcggccacagcctgggcgccaccctggccaccctgaacgccgccgacatcgccgccaactcgtacaaca

SEQ ID NO: 76897 - DNA, 2270 bp, Oryza sativa
atatgaaacatatcactccacaaatatacacgttaaaattcaacttatacaaattgtaccaaatataactgtgaatgtacattaactatttttaattgaatttggtcttgcatgtttgtgaaatgatatatttcatgtcaatcgatgttgatatttttttatgtctatataggtaacatgcaaaaaacgaggggatgtccctaaaggaataaaaattcatctccaatcgattgtacatatgttcatgcccaaagttcattttttttcaactaaattttgagcttagcgaattgagtgttactctatggagtttttcactaattagttagttagtgaacatatatttgtcaacaaatattcgtaagtttataatttgttgacaacaacttcttaatacgaaatgtagcacttgctcaactctaggtacctgtgcaactcgtacagtacgtagtattaggcctatccacctatggaaaccttactaattcagctgttgatcggattcaaccgtgcaaacagaaaagaaagcgaactatggctaagctccaggagatctgtgctctcaagcacagaatctaaatatacgtttcactgaaaacgacacccgcacatgccgttccacccagggagatgaacaaaatgacaatttggaacacctgccaatttcgttagcacaatagaacccgataaatgcttggctaccagggccactcttttcgttaccatttgcatggcctgataaccagaaacaaaatagaaagggctaggaaaaaagagagaatccaaatgcaatgaaccccaaaaggacaagaaatctgtatcatactatctggctgggctgctgctcaacgctgtccttctcagtcgcacatacgaacaacacaggggtctattcatgcaagcgcaacggcattgaactactgtgacttcaggttaagctcatggcttgttcgtgttgaaaggagtcggttaaaaggagccaaggatgtgtctggtactgcatgcgcggcgtacaggaagttgagaataaagcggaaggtgtgtttattcagttagttcagcgtttgccctgtatttatgttggcatgccacggctaggtgctgtctacttccgtgttgattgtgtccttggcaccttgcaattccatccccctgtcacgctacaaaacctcaataatggcgtgtggagctctcttcaacaagaaataccggttgctgctgttgctgccctgcactcccatgttcttttcatttccctccctactgtctctggttctctgctcctccacttcagagcagcacaccggctgctagctagccaaagccactggatcgaacagtcaacagtgtgctagctgctgcctccttggtggtgtgtgtacttctcccatgtcgctcatgcgaggcggtttcggtttctccccggcggttgcggcgctgtactgcgctgctctcgtgggggccggcggcctcgggagccggccggtgctcggctgctactcgcgcatcttcagcttcggcgactcgctgacggacaccggcaactacgtccgactgacggccggcaggaagcccagcagcccctacggcgcgccgccgtacgggaggaccttcttcggccgccccaccggccgggccagcgacggccgcctcgtcattgacttcatcggtgagcgaaccgagctgccctccgtctggtttcagcatgcattcccctgctccgacgtgtcgatctgtccgtgttcccaccatctctgcgttgcttttgcattgtgcagcgtacatccctctgttttcctgccaactactacgtactgtgcgtctgtgcattgtgcaacctgcatgcatgctctgtttggaggatttttttttggaggggcctcaaacacgtactcggtggcctcttgttcagttgtccgtcaataacatccaaacttattattgtcctgaaagacgggtaacatgcgaggcgagtggtgtgagcattagaacgccgacaatagctcattctccctcctgtcaaaaaaaaaacataagagtatcattttttatataggtaggttatatgtatgaaaattatatatgtaaatttgactcaaaaggtcctttcataatactattatactacctccgtctcaaaagactttattacttgctaaaataaaatctttttgagtggaggcagtaatttttatctgctatggtcaaacttgaaagtttatgttaagagatttgctccggtccaacaaaaagtatctcgaggtaccggt

SEQ ID NO: 76898 - DNA, 4430 bp, Oryza sativa
ccttgaggtattttttgttggaccgaaacaaatctcttatgttaaataccatgcttatatataaaaaaatggacaagtttggtgactagtgaggaaatatttttgctgcaataatcgtcatttactaacattttatactttgcttttcgtttacaagctcaagctcttagtcactgatgattgcactggaattcatgccggtgtacgctaacttaatttgtcctggccccaagcagctgtagtattagtgacaagtatgtactacagtgttttgcactttaattaggtctagcggcgaccatggtccaccaaaactccaaaactgtgcgtgcatgtttagcagagtagatgctgattaatttgtgtacaattaatttagaagtagccccttcaccaaaaagtgacagtagttagccaagtaccaggtgctgatctcgccgaattcatgtcaagatcagccactgcacgaagatgtcagctttgactcatcgcacggtgctgcttttcaagttgcaacttgcagatgccccgtcgcttgccaagacattctttcttccctaaagggcaccacaaattaaaccggaatcgcttattaatttcgatcatgtagtgaaatattttgagctgtttcttgagccttgttaactttgcttcggtaatttgtttattatgcgttctgtccaaacttctctagatacgggagtatgtactactccctccgtcttaaaatataatcatttttaatatagtgacaagtcaaacattttaaattttaactattaataacaaaaaaaaagatcaatcatataaaattgatgttactagatttagtattaaacaaactattataatatgtaacactttttatttaaaatatcttacttttatatatattattgatcaaaatagcatctcagagaccatagtacggttcaaaaatgtttatattttgggacggatggagtacgtactactggccgtcagttaaaaaaaaaaaactactgtggtagcagtgctaatgtaagtccttgctgttcgttgcagcgcaagagttcgggctggccaacgtgacggccattcaggtgggtgccgggccggccgacttcccgcacggcgccaacttcgccatcatctcctccacagcgaacaacgcctccttcttcgcccgcaagggcctggacatcacccccttctccctcgacacccagatgttctggttccgcacccacctgcagcagctcacgcagcagctgaacggtgagtacgccatgcatggccggccttctccatcagctacgcgcgtcgttgacacgccagctgatgcattacatgttactggttgattcgtaggcggcggtggcggcggcggcagcatcctgagcgacgcgctggtgtcgctgggcgagatcggcgggaacgactacaacttcgcgttcaacaagggggtgccgcgcgagacggtgcgcgcgttcgtgccggcggtggtggacaagctggcggcggccgtggaggagctgatcgggatgggggcgagggcgttcgtggtgcccgggaacctgccgttcgggtgcgcgccgctgtacctcaaccggttcaggggcgccgccgccagcgagtacgacgcccggacggggtgcctggcctggttcaacaagttcgccgagttccacaaccgggttctcaccgcgcggctcgacgacctccgccggctgcacccggacgtcaccatcgtgtacgccgactggtacggcgccatgacgagcatcttccaggccccaggaaaactaggtgagtgcgtacgtacgcgtcagctctctctctctctctctctccttattttggcattgtgtcgtgtcttgtcttgtgtgctgcaacggcgacgttgcacccgtcggcgttcctcctctctgttggtttgtgtggtgatatatgcatacacgtgacaaacgagcgaggcgagtactgcacaaagcttagcagttatgtatggcccgataagcagcatccaccgctgccatgcaggggccctcctaattcatacttgcgctaaggttcacgtacgaacagaggggtagagccgtagaggtcaagcgaacatggaattcagcggtgtccggttcggacgcgtctggctcatacgcaattatgcatccaaattccaaggtaagctgtaggcacttgggctgaaacacttatttcggtccctattgggctgggaagattttaataggaataagtccattttgactcccttaaaaatgacccgaatctaattcgtgaccctcaaccgtaaaaccaggtaagatgacttctgaactattcaaaccagtgcaatttgactccctaagcaattttagagggcggttttgctgatgtggcgctgacatggtgctgttgacctggtctttgtccacgtggcgcttatgtggcattagaattaaaaaaaatatttataggacccatctatcattcataaaaaaatattgtgggggcccacatgtcatcatctatctttctcttcttccttctccctgagatttctctgccttctctctctccccatttctcttcactttctctcgacgcagtgggcggataggggcaccgtcacgccggggagggcgagggcttcatggatccccgtggcggcggcggcgggggcgtgggacatcgatgtcgatggtggaggcatcgagcgggttgagcggtggctccggcggcgtgcggcgaccccgttggcgttggagagcgagggggtgtcagaggtgtctcgcgacgcggtcggcgtggggaggggcgccggcgcgtcgatctgtctggagccggtcggcggtggggcgtcatggacccccgtggcggcgacggcgagcgtgggacgtcgacggtggaggcatcgagcaggttgagcggtggctccggcggcgtgcggcgaccccgttggcgctggaggaggggcgccggcatgtcgatctgtctggagctggtcgcttggaggggcgtcggcggcgtgcaccgccaaggtcgagggcggcggcgtcatggaccccggcgacagcggcgtcatggcctctcctgtcctcacgcctcttcttcctcctccttccttctctcattctttccccctctcctttctaccactgtggcgacggcggcggtagcagcgagaggctgttgggaggaagaatggaggggggggcgtatgggccgctcgactacctcacgatggaggccgctcccgtggaagccactcgacgctgctgcgatggaagccgccgctcgactgcgctgccgccctattgtcgcttgcccgccgcctccggtccagctcctgccccctgcaaaccagcaaaggggagagaaagagaaagaaagaggatgacatgttagtgggtcccacaatatgtgtgaatggcaaattgggcccacatgttttttttaattctaatgccacgtatgcgccacgtgggacgaagaacagatcaatatcgccatgtcagcaaaaccaccctccaaaaccgctgagagagttaaattacactggttttaatagttcgaggagtcatcttatacggttttgtggttgagggtcagattatattcgggtcatatttaagggagtcaaagtggacttattccattttaatactaggccatagctcatggtcagtcacaggcctgaaaaatgagtttcataactaggctgggcctgtttccaggcctaacagtatacccatttgaagcccagctcatctattcctcggtgttattctttctgatcttccttaaccaatacacacacatcgacacgctgtgttatatgcaggattcacaaacgcgctggggtcttgctgcgggaaccagagcgtgccgtgcggcaaggcagggtgcaccgtgtgcgaggacccatcgacgtacgtctcgtgggacgggacgcacccaacggaggcggtgtacaagctaatcgccgacggggtgctccacggcccgcacgcctcccctgtccctctcgccaagacctgcccgcccacctgaccaaaccgctcctcctccaccggtagaaagaagatcgatccatccattctttgtgctatggttttattacttgctcatggaaacattgtagtacattgtgtaggtgaagttcaattacaggattcgtgtagagaaagagctagtacaaagtttgcatgctatgatccatgattcaatggacgaattgcaaattgcatgcgtttggagaaacacttttttactgatccctgaagaagtgtatggctccttttaagttattcttcccaaacagacatgatttagcgtgagacgtcgttgctacaggctacggctcgttgaggagttccgtttctccttgtgatcacagtgttttcgtgagcgattttccgctccttaatccatgtatgtacataccatca

SEQ ID NO: 76899 - DNA, 2339 bp, Oryza sativa
  unsure (1)..(2339): unsure at all n locations
aagtataagcaaataagcaataccctgatccatagcataagctatctggtatacatccttttctttccttcacttcaaatgaaacaactcctatccttcaagcgtaactatcgatctactatactctactttagatacttaaatatactaaggtataacttggacaaaaattgacaacgtttgcttcagaagataagacaataaatattggctttttcgttgatatactaatggttaaatcaagaatgacatgaattacctgatatcttgcactctgcttattgtactgagattctggatcggcactcgtgtacacagacagccaccccccatgcacacaagggtcatcagcactgcctggccgtactatttctgaagcaggtaccaaggaaatatcaaggtcatccatccattctaccatccgtattgttccacgccatgccaccaccacatcccgtctcccaagcacttctttaccttcatctgtggccaccgcaacaaaccccatccaatttgactgcttgctccatgcagccttcgaccatgactttatcatgaatgcatcaggcaaactgacagtacacattgcatatatgaactttgtaatgacanncagatttgggtttgatacatccaccctgctgagnaagtccttncnactnaaaagtcaagacctccgccaaaagggggggcgcccggggggttttaaacccccccttttggaattccttctctnntntgtttaaccccgtctagtcnncccagatgatctaagcaccgccnnnatgttantncgnagatcaacgtcaagatgatgaagtnnccccttccagtaactnacaccattgagctctctccatcttctggcatatttccaagctcttagaagctcatctttcgggggggtttgaaaatttaaatttggnggtttggttcctgttgatgcttggtacttacaagccacaaaagcttgcaacttcatattccactgggcgtctgggtatatatgtgtgtgtgtgtgtgtgtgtgtgtgtatgattctaggttgctatcctctccatcaaatctgcagttccataagcatgtagaagatgagctccctgtcattctcttccctaccaatcaaccgcccaacttggcaaccatccatcctggatttcaaagcatgaagaaacttgcacggatcaaataatccgcctagagaagaggtgaacaactccatcatattcataaagaaatgcctcctgacactacccagcacaccaaatctttgtgtgcctctgaagagagggggtggggttcaccagttgcaaccagaaatgagcagcatcttctgtaaaagatttttctccaataaatggcagaagtttatacgcgtactgtttggtatttgaagtattctccaataaaagcatccattagtaccatgtttactaaccaaagcatttcatattaaaacctttagttccaatgattactaaccatatgtataatcgtaatcttgactatatccttaatagaataatatagaccatgaccatacagccaaaagttctgtttgtgaagagccatctacagagttatgatgtatgtaaccacatttttcactgttattggcaacatcatccaggaaaggcacatttgtaaaggagtattttgcaacactcatcaccagaattaggcaaggaaaaccaatatgagcttagcagccactccattgcacctttctgaatatgggtctagctgcctagctggtcaaggtcctacgtgcaacaaggtaaagccacaaataaagctcagatctctacctatcacttccaaagtacaatattttaatacatttagcagctacctttaagtcttggcctaacaaatttcaacagatgtaccagtgcctgaaaaataaagctaatgctactttcagttcacattgcattgtttagctaatatccaaacagggccacaataatttttcattttgatctaaactgagttttgctgttctatttaagatatagaagtttatctttctcaaagtagatgacttagtaccaaagaaataatacaattataattgataatactatagaatgacagacattataaaagaaaagttatgacttagtaccaaagaaataatacaattataattgataatactatagaatgacagacattataaaagaaaagtttatatgattatagtgtaacggactgaactgtaccatgctgatgtattatggtgactctcaaactggtgtatggaaacttgtatgtagcttctcctgatacatcaatcattcttctatgcacaacgaagcatcagaacagtctcaact

SEQ ID NO: 76900 - DNA, 2560 bp, Oryza sativa
acgtggaatttaacatttttgcacacaaaagatttggtcagttcttaaagtaaagatttgaatgtgatatgcagcactctatttaccgggggccatctgccggttacctcttccgattatcgcttccacacaagtatagtaaccggccgatgcctaaatttgtgtatgcgagtagtgagcaatttcttgttttcaaaaatgctgtcacaacatgattggtgttttttcaattgatgaaataaattctgatctttgcttaaaaaaactacatctacttattacttggttcactcaacataaagcaaactaaaaatcctacaactgatctaagacagtactaattatagccactcacgctgaaggagaaaaaaatgttctgttataaaatctctattcgaaattaacaaatactagccgacaacccgtgcaaattgttactaattttgtaagtataacgtttttctttgtattctaattttaattcacaccaaagccttattataattttttggagttttttattaatttaatttagaaattatgaattactaagtatcaagagagagtcttaattatattgtttttcaccatttaataattttgaaatcgacaacaaatcaatagtgagaatagtgagttgtgttctaaatgtaccattagaaatgcaaaatagtgtagcctatgacaataactagagaacacacgaaccaaaacccagaagtatgcatgaaacattcccgagaaaggcaaaaggaaggaagaggcgacatcacggcggcaacagccatctagacaaggtgaacaaagaactaatttacatatcttctagtaaccactaagccttgtgctacaatatataagttagaacattacgccacatacttataagaaacaaagaaaaaagaaatctcaaaagtttaggaagacgaaaaagaactataaataaaacctcatgacaaaaaaaaaagaggggataaaaatgagtcgacctgcaggcatgcaagttagtaacagttgggatgtaaaacagtactgtgggtctataatgagacaacaataccacaatattcctttacatattttaatcacatattgggtataataataacaaaatataattacagaattacaagtcgtacatggccttgtgttcaacagaggaaccaaggccaattatctgcggacaagaattagtgatgcttacaattggaggttgagtgtatgaaccctgtagcaggccaattgcaatgcccttgtatgcagcttctgatgggatggaagccatcccacgatgcatattttgctgggtcatcacacactttgtattcgccatatccacagcgtacagatgcagatacaccataaggtcctcttccaccacagcaagcgaccaaaggatcctcaattcctgaaccgcagtttattaggaagtgttaaacaagctaccgacaagaaaagttgttctttatcaatatagaaagtagtgcaggagtgcattccataacatgatgaaaataaaatagccaacctggtaaatatatggagtgagagaaacccaatttagatgttgtgattgtggtacaagcatatttacaaaaagatttcatttgttcgagattgccatagaagtcaaatttaagaggccaacagaaagttttttttttcttgtagttacctacaaactataattaatagtataaagcttacaaacagtaatgaaatagcttcactgaccaaatcgttcaggggaaaggaaaacttccatggcagctccatagtaatcggcatagatgatggtcacatcaagatgaagcttgcgcaagttttccaattcatctacaagaagtttgttgtggtattgcgagaactcattcatccacctaaggcaacctatctttggctcataatcttccttcttatcactctcaaattgcatgaggtacattggaatacatccaattgggatgttaccgggaacaactagtgtcttggccccaagtccaatcaattcctacgaactcagctttgtttcattacaagctttgtaatattgtattgttttgtgaaacaggaactgaaggtatataaaatgatgcaacataggcatattactcacggtgattatggaagaaattttggcaatgacactaggagtgaagttgcgaatcttttcaatggacatgccgctcataagaggaaggttgtaatcattgcctccgatttctccaaccaagaaaagagattgattcatcatgcccttgcaacctgtgcgataaacatcgtttagaatccgtatgtatggataataatagttgaaagggacctttaactatcaaaattgttgctttatatggtagagaaactatcttcacctactacttccagcatgtccgtttattatcctattataaactagacagattttgttcatttgtagcaacacaatcatgaatcattgacctgacatatttgttttttttttcaattttgttctatgcaaccaacctaagggtaaaacaattgatcacgtggaaatatataatgttaccaaatatttggc

SEQ ID NO: 76901 - DNA, 3278 bp, Oryza sativa
cacaatcatgaatcattgacctgacatatttgttttttttttcaattttgttctatgcaaccaactcaagggtaaaacaattgatcacgtggaaatcatataatgtttaccaaatatttggcagtggcatggtgtgtattatcatatactagtatactcaaaatattgttaatgattgtggtatatctccaggcacgcacctttctagacaataaagccccacctactaaatagcaaccgctacgatttgtgcttagaaaaggagaactgccacgatctctcgttcaaaacgtcattgtcaaaggtgggtgcaaggcgagaggtgttttttgattcaaacataccgtccatgtcgccgccggtgcagagcatgccgagcagatcacggaaccactccatctccatgtcgaggtgcacggtgtcgtcgtccatgggcacccctctctcccggaagaagtccgggctgagcgccgtggcgccgcccaccgcgaagttggccccgctggcgaagttccccgcggtctgcccgccccagtacggccgcacgaacggcagccccatcgcttcagctgcggcgcggcgcgacgaggcgtacccatgcacaccacgcgcgcgcgaattattccacatctcatattagcaatggatcgagcgatcaatcgatatgcagacgaggcctggatggatgacgaggcgtaccgatgaagtcgatgatgaggcggccgttggaggagcggccggtggcgcggtggaagaaggtctcgccgtagggtggccacagcgagggccggcgggagtcgttgccgtagaggaaagcgatgttgccggtgtctgtaagcgagtccccgaagcagaacacgcgcgggtagcacggcgccgccagcgcccgtgacgccgccgccgacagcacaaccgccacggccagcacaaccgccggcggcgagagtcctccggaagtagaggagaccatccttcctacactttcgtttccttctgctcgaggtggtcgtcgggcacgaaggcgaacccgccactgggattggctctgcggtggtttttcgcgttggcctaacgttttatactcaaaaaatgcgagatatttaaccatttgccacatttagatgtagcaattaattttttaccactggacccatatgtaatagatatatttagactcacatgtcattgagatagggatgacaaatagttatttgccaaatctaaaagtggcaaatagttaaaagcccaaaaaaaatgcaaatactctaataaacgtggctcgttaatgttagtgggctcgaatgacgagtgcccacaggtcagtggacctctggtcgctgttagcctgttacacatgaatgaacggtgacaggtgtatgctccatcctccactaaatgcactgtgaaacgcagtataaattaacgtagacggtagacgttcacgatacttacacactcgtccctctaaacatatacatcattctccattgagataataattagtcgtaaatacaagcacctatatcaaaaatagggtttaaactcgagtgaatttatttcatccactgctgaagaaaccatctttattgggttgagcaaaaaccacaatagttaaagatgatttttttatcccggtttcaaattttatcggccctaggtgatgtttagtccctgttggtattagcaaccgggaccattttctgtccgaggctgtcagaggaccaggcatttttagtttcggttggtcacacggtcacaccaaccgggaataaaaattgactaaaaatcaatatacagtatataatccctatgacttatcccccgaactcctcatcttcctattcctctctcttatccctatcctctctttcctattcctcctcttatccttatcctctccttcgtattcccaattgagcgtgagagtgagcgagctgaggtcggcggacagcacgagagcgagcgggtggagggcggtggccggccggcgtggcagcaggcgggcgtggagggcggagtgacgggcggacgcggcagctgcgggtgcggcggcgggcgggcgcggcaggcgggcagcgcctctgagattgttttttttttttgagaatttgtgattcggatctaagatgtatttgatttgtgtgtgacgtgaatatatgatgtatttgtgatgaattttttagaacttgtgatgtaattttttttaagaatttgtgatgtatttggagatgatcgatttgaggatttggaaaatatccttttgctctgtgatgtgatgattgatttgggatttcacgatttggggatggagtgaaatcaatattcaatgttaaaaacaatgaaaaataataataaaaaaagcaaccagacctaggacctagcctggctccacttttagtcccagttaataacacaaaccgggactaaaaatagatttttactcccgattcatggtaccagttgtatagccgggagtatagggggttcccaaccaagactaaaacccctttctccatcagtgatgataagaaacctaaccagttgagttaagctcacttcgcaaggtagcacaccatttgtaaacagattattgtcgatcattattttggacccaatgatttgatacttccgtatactgaatttttttttccggcgatgtatactgaaccatgcataagtgaaaataattttgcccgtcgttcctgtttctggctttctgccacggtgaaacagctcattgaacgatatataatgaggcttgcagcaacaaatcacaaaatgattccggcgatgaagactcgaggagatataaacgggaaataagtgtagttcaacgacaatgacagtatttttgtactacgtaaattttcgtttctcttagaatgttaggtgcaaggagagtaggtactgaattaatgatgttgcaacaaattaaattgacctgattgatatatactggtggttgtgctatttattatctaatatttgcggagccattgtttatttgtggaataagcgaaatggcatatttgcaaacgaaaagtaatttgttaataaaacttttatatatgtattcttagcgatctaaaatcaaaggctgaaaaataaacttcgataaaaaaacctcaaaatcagctccaaatttaaaattgaaaattcaaaatttggctggcacaagcataagcgaaaatatgagtcccttgaagtgttttcgatatttaaattttcttaaacaatatcccgtaaatgtttgacactgacactggtggagaaaccat

SEQ ID NO: 76902 - DNA, 28643 bp, Oryza sativa
aagcttattagccatggcttcatcaccaagtctgccattggtgacgtgtgccctgctgctgctgctggccggggcatgccaagctcacccttactggccactggagttggcgtactaccgcgacaagtgcccccaggccgaggccgtcgtcaaggccgtcgtcggggaggccgtccgccagaaccccggcaatggcgccgccgtcatccgcatgctcttccacgactgctttgtcgaggtgcgtacgttagcttcttcctcttctccggcgagatcgattgatcgacttgagctatgtgtacttagatgtgcatggtgttttgttgttagggttgtgatgcttcgatcctcctggacccgacgccgttcaacccgacgccagagaagctgagcgcgccgaacaacccgtccatgcggggcttcgacctcatcgacgcgatcaagcacgccgtggaggcggcgtgcccgggcgtcgtctcgtgcgccgacatcatcgccttcgcggcgcgcgacgccacctacttcctcagcggcgggaaggtctacttcgacatgccgtcgggccgccgcgacgggaccttctccaacgactccggcccgatcgacttcctcccgccgccgacgtccaacctcagcgacctcgtctccagcttcgccgtcaagggcctctccgtggaggacatggtggtgctctcgggcgcccacaccgtcggccgctcccactgctccttcttcgtccccgaccgcctcaacgcctccgtcttctccgacatcgacggcggcttcgcctggttcctcaggtcgcagtgcccgctcgacgcgacgcccggcggcaacgatcccacggtgatgctggacttcgtgacgcccaacacgctggacaaccagtactacaagaacgtgctcgaccacaaggtgctcttcacctctgacgcggcgctcctgacgtcgccggagacggcgaagatggtggtggacaacgccgtcatccccgggtggtgggaggacaggttcaaggcggccatggtgaagttggcgagcatccaggtgaagaccgggtaccaggggcagatcaggaagaactgcagggtcatcaactactgattaatctacaagtttagctgcgtgattcaattacctggtgaagtacgtgctcaacgatgacgacgtacacggtttgatagtttcacaccctccttgatcaagtcgcaagcgtacgtgttgatgatgttatgattggatgtgacttttgcttcacatttatgttctccctcttttgttaccattccttaattcctcatttgtgaaccccaaggtttacatgctatggatttctttgttttgacctaattgtgtaataaggtcatatgtacttggaataattgtaagttaagttttttgcaacaagtgcccgctatatattgatgtttatctgaaatttgaaaagagaaaaatctaggatggctcgagatacccatggatgtaatgatatagatgtgtgagtgcatgactttcatttattctcttattcaaactagatgggtggcccgcacaattgcgcggctagcacccaaacaaaatcatatatctttcagtatgattttacttaaaatttattaaatagctatacccgtattcctaattatgtagttttaaaagtcacactagctgctaccccttacttctatcatatccttctttatttgcttgcttgggggtccccttaaattttccccaactatttctattcattcttcttgaaacgtttcaaaattggatcttatagtttttgaagttcattatctcgttgggtttcgtttttatatatctggaagtcccgtcaaacgctgccattatactcctctacggtccgtccactgtcttttctcttttgtcattgggattttacaaatcgaatataattatcgtttgagttcatttttcactttctataagtcccgccaaaccgtcagcggcttttccattgtactttatgactcgtccgctgtctaccttctttattgtcatttgtcattgagattttaaaatcgaacatgattatcattgggttttttttttttactttttagaagttccgaacctttaaaaattggaccttgtagtttttagaatttattatcttattggcttttatttcttataatttttagaagtcacgtcaaacaatgccactatactcctctacgacccatccgccgtctactctttattgccattgggattctaaaaatcaaatataactatcattggaattcattttttattttctagaagtcccgccaaccgtcagcagctctgcaactatactcctatacaccccacccgctgcttctcctttttattgtcattgagattttaaaaatcaaatatgattatcaataaggtttattttttttactttctagaagtcccggcaaccgccttgcccgtttgcttcacggcttgcctgtcgtccctccttttaatcatcattaggattctatctgttgttttactaatagtttttatatgtcgtatcaaccgccaccactctactcttttataggcttgttatttaatttatctcatcgtgtgttttagatagtctttttttttcaatagtctttatttttatcaccaattttagttgtttataaattgtattcctaattgaaatcttttttctttttctaatttcagaatttaattttttaaacttttatttaataccgtatagtattcttttaatatttttattttttatttttgaattttggtcgtttcaaaattgtatttctacttgaactctcttttagtttttctaatttttgatattttttatttttttattctgaattttaattaatttcgtattggattgttatatggattcttcattcaatattgcttatttttaattccgaatttcagttaattttaaattgtattcctacttgaactcttttttttctttttgctaatttcggattttatttttatttttattccgaatagtaactaatctcgtattgggttcttatatggactcttctctcaatattcctttttctaattccgaatttcagttatttttaaattatattcctactaggactctctcgttttattttctaattttggattttattttatttttattttgaattttgattaatctcgtattgggttcttatatggacacttctttcaatattgcttatttttaattccgaatttcagctatttttaattgtatttctacttcgactctctttttctttttctccgattaatgtggaaatttctagccctcacagcgaacgtggcgacttctttcaaagctgttttaataatataatagatagatagattattataacacacaattcatatagttgtatgttaggggaaagccgatcatgcatacacactctttttatgtatatcaactaaatactcataaaaaatagtaaaatagatcaatatatcatatatcgcttcacaaacatgcttgtttaaatttgacctacacaacaaacagaaacaaacataacaaaaaatgatgataattaagaaattgtgtactatttacggttgagatttgttatttttgtttctacttatatgtgtcgaattttaacttgaatatttgtagatagtgaaatatcatattttgatctattttaccatttttcaacaaaattttgatggctttgcagttggcatctatgaaatgggtatatgtcatcatatccttttaaaagaaaaacagcttactagaactaccatatatagggtcaattggctggctacttaccgtcaacccaagtactccctctgtattttttactgtattttttaaatgtgttactgtttacttttaagcatacgaccattcatcttattaatttactatgtaaataaagatgaatggttattatttcttctattattatttaacttttttgtgatatgttcatctagtaaaggtactttaagtatggcatatagttttgtatatttacattgagtaaaagaatggtacggtcaaatatatatatatatatatattaaaagtcaatgatattctatatttgaaaacaaagggagtagttatttcattttgcgactatcttaaaaattatcgagagtttttttggttgtaaaactttaaaatataactatagtataactacattacaactcatatatataactacaatataactagatgcatatataatttatatgtaactagaataaaacatgtatggcgcgattgcagtgcactccctccacaaactgaaggccgcgaggtcaaatcccaacaattgtgcttaccaatttattttttctcatccttgctagcacgaatcttagagcaaatatgacggtctaaaagtcgaaagtttccctaaaaatccgtcgaaagtaatctagcaattccgtttcattttcacttccttgaggaaatatctataccgcttgaaggaaagcaagtttaatttgttagcactaattaaagcagtaataccttaagcctcttcaagaactaaagaacacttcaaattattttttagcacagtattattgtagccatagggagtacgtacaagcatatctaacaaacttacggtgtcggtgaaattaagtttgacgctgtaaacccaaaaactccactaagctttactaatttgttgattaccttatataaacaaatgctcgagcactataaaaaattgatttttcatggcatcaccctattatttttattgatggactaatgaaataaatgcttgtaaaaatgtattggcggattctgggtcacaagccgtcagcgaaaaactcacttaggaggtcccactaaaaaaaatagctctatttttttgggcgaacctcatgagagcccaacgaaaattggtttttattggcagtatctaagagcaccactcgcgaaatcttttctgcggtattcaaaagtcccaccgccaaccaaaccctcgctcccttggctccctcgatcacctcatctacctccttccatgcccctctgcctctctcactcccttcatctgacacttcctccatcgtcaccgagatgcgttgcactactgtcgcgaaccgctaccgcatcagccaacgaggaggccaaggccgctagatttggtgaccccgacctcctcgctggtgaatccagttggcccgagcggatgacgcccgagaggatgacaaggagttacatgacgacacagggaaggttactgttggtgtgattcatgaccgccagatctagcggcggcaataacaagggttgcttttcgacgacaccagctgtcctcagcgatggctctgcgaccccgactcttggttgtgatggtaactaggtttgtggctctgagatggtggtggcgatgacaaccaacgctcggtgatggcatctacgacgtcgatcttgagcaaacgtccatatctaggcggaggttgacaagggacgacgacaacacgagctccttcttgttaggattcgcggcctcatcaatggtgttgtgggccagcggctcgatcgtcatggatagggtgaaccccaaggagaccgagatgcagcatggcgatgactactccctcttgatctacacgtggaagtcataatgacagtgaccttgttccgcttggtaacattattcaacattgtacttgtgcaatttgagcctcgagggatcaaattgatcttggattacagtagtagcaaaatgccaagtgaagtccctgcggcaacgcatctccgggtaccgccgcgggttgcacatgacgtactaaaagtgtgacggtgcgatttgatgtcaagacacctttccacgttaccaacaaaacaactactcaaagcggatagcaataggaaataattttaaattagttaacatactctatgtattaatggatgtaatgggagaggttaatgctgccaagtggcagctagcttgtttcgttggttgagttggaggtatttggctaccgggcacgaatagctagtttgataacaaaagaattgctctagcattactagtttgagcctttaatttgatgcatccctctaatgaaaagtcgttttcaagatttctgttgctgcttaattaattagatatatagttgcttatacttttgtcctgtggccagtcctaacggtgcttacattttcgtctaaagttgttcatattactatattttgtgcaccgtcgtcctgtcgtccatgatggtggcatgtgccaatttgccaaactgcagctagtgagagccgtgtttcttttttgcattgtgaactgttagtttgagtcttctatccttgttgcagaacatgagccaattgtatcatatccttatcttcccactatatatataggtgtttataatgtagttgtactactacgcgattggaaagaagcattgtagatattctagtcccatcatattgtgggcacccttactccttcctgagccactgatgtagctttttgttttttcctttggcactctatgtgtatttctcaatcttatccttgaaatctcccttatacttctacaatgacatttgatagattttattatgaaaaaaaatacctttcccttcccgtcgttaacatacggtgttggaagtcctaaacttaaaaactatgtattaattagtggtgaggttttctcctatcttaggatagttgtatttgtatacctcctcatacagaagatacctctaaataaagggagttaccaaaactaatctaatccgattagaataatattgaaaactcatcttttatatatgatcttaactttcccctttttgtgggggagtaggtatatcccttctggggcagatataaacacctcctaacttaactaacactgtgaggtatgtatagctatatactccctccatttcaaaatgtttgacatcgttgactttttagtacgtatttgatcattcatcttattcaaaaaatttaagtaattatttattcttttcatatcatttgattcacaaattttttatgtacacatatagttttacatatttcacaaatttttttaataagacgaacggtcaaatatgtgctaaaaagccaacggtgtcaaatattttgaaacgaagggagtatcttaagtactaaaaaatctctctattgccaattgtgaatttatcttctaatgatgtcaagcggtttagtttaattttccacctttcaaatgtaggaattatatatagttttctaagaataggaggaaacctcacaaatgataggatgggtgattttatttgactagagtacaatgagcttttaggtgatatatctctatctgtatatataccaatttttatccagcatttgtcaattatgcatttaacgtggcaagggtaactatatttatggcgtcatatttttcacaaaaaatagtgggcatgtatttatattgtaagttcctaaattacatatgtaattttagcgtatttacaatgtaagtccaaaatttacatatgtaagtctcaaaattacatatgtaagtcccaaatttacatatgtaatcagtatgtaattatagtgtaagtacaatataattagtatgaataatttatccaccagtgatatagtttaatctctaagtgaaagcaaatactataacaaatcttgaagataatcgactgcaaaatattagcaaaacatggatggtcgtatgagatgtgactataaaactaacaaatttgtggcgacacaaatatagcaattctgaattaaaatgcaggcttgaacgaagcttccgccatgcacagattctcgatatgctgccaaaaaaatgttgacttacatataaaaataaagtagcaacaccattgtactccctcctttatactccctccgtttcgttttatttgataccgttgactttttagcacatgtttgaccactcgtcttattaaaaaaatttaaataattattaattcttttcctatcatttgattcattgttaaatatacttttatgcatacgtatagctttacatatttcacaaaagtttttgaataaagcgaacagtcaaatatgagctaaaaagtcaacggtgtcaaataaaacgaaacggagggagtatatatatgatgttaaaaaaaagagggagtatatattggtggactggatgatgaagctatttcaatcaatctaatacaatgaactttttagtttgatatgcgcaccagctagttggtagatttttcctttttttagcagttgcttgaacaagagctagtgctgttattaatcagtaataaaacctgctgtatttgttaattactaagagctagtcaaggttttcactccttctacatattctgaaaagaatttgttaatttctgcccacttgccgagagaacttttcatcacgtaaccctgacctatcataattaatccagctgcaactagggatgaaaacggatcggaaacggacggaaactagttttatcatactcgttttcatattttttttggaatcagaatcggaatcgaaaactcggatacggaaatgaaatcgaatattatcgaatacagatacggagcgaatacgagacggaacaaatgcggtagcgaatatttaccggcatataaaaaacccctcaaattgagtttcttgataaatgaagagatatcgcttattattttagttcaacatctctaacatttatatcgtcaattttgtagacggtcccacaactgtatgtgaaaatcgattttcatggctgttcctctaagagatccatatgcaaatatgattatcattttctattcccaagaccgtttattagatgtataacttacttaccagtgtataaattggagatgttatttattttacttcacgtcttcgaaacttgtaatatttgtattatactttaaatacttttaaatacaaatgttataaactacaaagtggtagatcccattgtgctctacaattttgatatggaacacatctccatcagatgtcgtttgaattgtagatctgagattttgtaaaaattaatatggtatattataatgaatatttagacccttaaatgacctcaaataataaaatagtcaataataaagttatagatctcatcgagctctacaatgttgatataaagtttgtcttcatctgattccatatgaaaaagttatacatatatacgtatatacatgttctttctaaaatttgctcaatgtgtacggatatccggaaaaaaatccggatagtttccgaccgttttccgattccgacggatagtactcttaatgtattcgttttcgtttccgagaaaaaacatccgaattcgtttccgaatctgaaaatttccggataattccgaccgaaactatctgaatccgaaaaatggtccggacggacggaacctatccgaaccaggttcatccctagctgcaacgcataatcaactgcttaagagacattgtctgacactagctagtacctgccgtgcataagtatacgcgcatatgctttatttcaataatgcttgctgagtactccctccgttttttcttcggggactatactttttatatggcgttattaaatttggtatttgtccatttgatatacaacgatgttgatatttagatatgatagtttgttatttgtcttattcaaataaaggattaagtccgatttacccctcaactaacgtgatacaaggatttaccccttgaactgtaatatcaaacatttgatgctcctaaaataattgattaagtttgtgaattatttttatttactgaagtaagtatataattaattatatattagtgaaagataaattcactacttcaattgtcaacccgttgtgcgatgattttgtcaaccccatgcaattatatcatagaggatttaactagaatattatgtgttagcttgtccttgattgctatctatcttatattcgaaggaagttatcgatctttttgtttgacctcgtcgttcaataaatatattggtttttaatagagatgttaatttgatccgttgtgcaaaatgcatggatgtgcaactagctagaggtaaaaaaaatatcagtgaaaaggaggaggaagaagaactacggtgacccatccggttattgctctgtacaagctagctactttttataaccatactctatacaatcttgtgtatggagctagctaaatactagataatttaaggccatttgtaggttgattgatccgccacgcaagctttgctacctaaccatttcaatgaaatagtaataattaaactcacatcttaactgcagagcacaaaaggtgtttgggagagacttagtttgacttgcattccctgactagctagctagctcgctcgctctggaaagcatgcttatgtccatcactacgctttttgtccagttaattgcccgttataagctcggattagaggaacgattccgaatagcacgtggtttagcgagccaaccaacgtcgcgggtcaaaccgcagagttgtacacacttgtgctgcaacaaacaaacgtacgcgcatattgcgcggtctcctgccaccaccttaccctttgccaacatgcatccgctccaagattaaaaaagcttgcgatccagaagctatctatcaaccgaacgctcccctgatctcatcttacctggaggctggagctcatcttcacctataaatactcgtgcacatcagcatcacttcatcacctcaaccatcgcaatccatcaagcaaatctcactagctagctagctatctcagctcactctctcagtagccactgatcagaagaagagcaagagaagccaattaagctagctagctaagctggttaattgccatgggtagtggtaataagctcgctgccaccgtggtcgtcgtcaccttcgcggtgctcatggcggcggtgacgacgacgtgccaagcagcttacgggccacccaaccctgcttcgtgcgggctcaaggtcggttactactacgccaagtgcccgcatgccgaggaaatcgtcaagaacgtcgtcggcgccgccatcctccacaaccccggcgtcggcgctggcctcatccgcatgctcttccatgactgcttcgttgaggtacattcctatatatatatatatatatatatatatatatatatatatatatatatatatatgcatgtgtactatacttgttttattttatattataatttatagaaaaattcgacaatttgtaaagcacgaaagtactaaccatcgaatatattttaataatgtatttgttttatattaaaaatagtactacatttttctataaatttgataaacttttaagaatatttaatttataaaatcaaaacgaattataatagtatgaaacgggcggagtggtatacaattaaggcttcgacatttcgaactgaaattttcgaaatttcggtcatttcgtaccctctgatatgatattattttgcatgaaatttttatttatttttattttttcttgaattctgataatatttgtttaaatttgactacattttgtttcgaattttggaccgaaaacgggattgaacccacatataattacgagtttctcagctttgtggccgtggatgcatgacacgtttacaccgccaatgccgaaaatgtgcagggatgtgatgcgtccgtgctgctcgacccgacgccggcgaacccgcagccggagaagctcagcccgcccaacatgcccagcctccgcggttacgaggtgatcgacgccgccaaggcggccgtcgaggcggcctgcccgggcgtcgtctcctgcgccgacatcgtcgccttcgccgcgcgcgacgccttcttcttcctcagcaacagcagggtcgcgttccagatgcccgcggggcgcctcgacgggcgctactccaacgcgtcgcgcgccctcgacttcctcccgccgcccaagttcaacctcggccagctcgtcgccaacttcgccaccaaggggctcggcatggaggacatggtggtgctctccggcgcccacaccgtcggcgactcccactgctcgtccttcgtccccgaccgcctcgccgtcccctccgacatggagcccccgctcgccgccatgctgaggacgcagtgcccggcgaagccgagctcaggcaacgaccccacggtggtgcaggacgtcgtgacgcccaacaagctggacaaccagtactacaagaacgtgctcgcgcacagggtgctcttcacctccgacgcgtcgctcctggcgtcgccggcgacggcgaagatggtggtggacaatgccaacatccccgggtggtgggaggataggttcacgaaggccatggtgaagatggccagcatcgaggtgaagaccggcggcaatggcgagatcaggaggaactgccgggctgtcaatcactagctcatacaaatttacgagcatgcatgtttaattaatttattcatgcatatctatgttctatcgttaactgctgcatcttgtctgtttattctttcttttccactgatttcatttcaagtcaaatgaggcttatgtaccattatattgtatcatgtttgaatataataaaataactttcttacggacactacggagataccacaaggatcacacttgttattaatgttaggagaaattctgactgatatgtaaacttttccattaattgttaaagggacagcattagctttgacaacaaattaaactaactaataaaatgggagcacttatatttatggtgccacattttattttttaaaaaaataatcaaatcgtttttacactttaaattacctacactcacgttataataacaatataaagttaaaaacttacactgtaatttataatatatatacattagagtttttctaatatacaatgtataattaagagaattcatgattaggattaaaagtgatttattatatatttggaagagaagatacaagagatataagcatagttacatatcggagagagcgcaatcacatagagaaaaagtgactgaaattatgtgaaaatgtggcatcatagttttaacaaacccgattaaaaagtttagggatgaaagatagtgtgttttcccaatatttcccaattcccatccacatatttaatctaagtaaggccatagaaggcactgaaatatttcattatacatcaatataaacaatagagtaaattctctttatactcttgaaaactcatccaatccctttcaacctcctgaaatttaaatcccttttgtacctttgaaatttcaatttgatcctttccatgcccctgccggtacattttccttcatttcacttttaagtttggttgaaaatatcttttatacccttgatgatttagatttgaatataagcttgaaaaacgattgaaaattttgtttgagtgcacaatatgtgcattttatgaaactaatgacactaaataattagtgcaaaaaaatttgacataaattttgaaagtaaaacaaatttaataaattaaaacttttatttgaaatttcaataggacaatggattttttttatcaagagcattcataaaaatatatggtgagcattggtagtcctatctttgtatgaatgctcctaaataaaataaatacatatttttttatttcattatctaaaaataattttgtcataaataatatatcgcacaacaaactcataactattatagtctcatgtgtcaatcttttacattttcaataatgtaattcataaatttgtatgttcatccaaagggtaacatggtcatttttatagacattagacggtcaactgacgagaggggtatggaagggatcaaaatcaaattttaagggcatataaggaagtaagtaaaattcagtggcataaaagggattagctaaaattgcagggatatacaggggattttctctaaacaataagggcaatgtatttccctttcaatttatcagactaattgcaggtttgtagtttgtacagtctattatatgtacaatctactatctttgttcttaaatagatggcatatcccagattgtatgccatcaaacatcaaaattttaagtttttttatgaaataaaaatattataaatcaatacatgaaaataatactagtaggtttataatataaagcactttcatacagctgccttcaataaatattataaacatattagttattaaaaatattgataagatgtgtgtattaaagattgtcacgaataatttaaatgtcaagtacaaaatgagaatgaggtattggctagtttattgtgggataagagtcaaactttggaccataccaactcgatcaccaagtcaacaaataatcaattagaatgttagaagattgttttgaggaaatcaataatagtctataactaacatattcgagacttcaattttcaactcatgcttataatgctattttttttgactgaaagtactgccagggctttgcccagcagtttaaattttataaatcataaatatgtacaaagttacaaaggacaaacaaaacagctaaactataaagtttgtatccaatcaaaaagaaattgcttgagtgggtctttcattctgcacatatgcagaagaacttctttgacaaatatagatttccatgattgaggcgatggcttcacattctgaaaaattagcccatttctttgcttccaaagatgccatgctgccatgaaaaatacctcaaggaaacccttttgagcaaatctgattctcgccaaaacaatcatctgaaaaaattccagattacaattctaggaaatgcctagctactgccaacaagccacactgaaagggcatgtaaaaaagagatgaagcctagtctctctttgatgtgtattacacaaggcacatgtgagatcgtcatcctcttttgcacaatgtctcatgtcaagcatatcccttgtgttaagtctatcacaaaacaaaagccatgcaaacacctttatcttcatgacacatttggttttccacagccaaatcatgggtctaggaggatgcaacgaggagtaattaagcttataaaatattttcgctgtgtacatatctgttccccaaataaagctccaaacatcacctcttccaggctgaagttgcagataattcaatttataatgctaatttgtcaatcccttgcacatactccgaaattatagtttgctaaatatccggcattgacttgtcattatcagccgttataacctaaaactatatcgcagggagttcgatttattttattcttgaacatgctaattgttagaactaatcatgcgtagtttttcagtagaagtcaagttacacgctaagtcatacatacaagaataaatggaaataggggtaaaacaaaataacttcaagcaaattgtacggtaagccagctagttcctcccaccgaggaacttgtggttttgggaggactcagctttgactttgacccattcatgtgtagactaagaaattaaactaaaatgctacttcttccatcctagaataagtttattttttgttgctcccatctgtcctaaaataagtttattttttaataattgttgcatctgagtttttgaaagttggggataaatgcattcgaagtagataaagtgaggaataaacacatcaggatttgataaagtgggggtattttaatctttttttattgggatgtgtgagatggtgaaaattaaatttattctgggatggagggagtcctcaatatatgaggataggggaattttaattttgattcctcgaggaaatgtgattagccatgatcccgatcttctgaaagatattgataaaccgattgtggtggacttgacgttgataatctaaaggctcctagtataagcgaatactaagaatacaaacaaggaagtaggagaagaaatctaaaaatactacaaacaatccaaaataacagcaaaattacaagtggcggaataatctaaacaaaagccaactctatatgatgatggctatgtgtgtgtgtgtgaactaagccatggggagtgtgctctttacactcacacactccctatggtttagctcatgacacaaatgcaatctccaagacccaaaattaactaggactcgatgaagtatatgggcatatggcttgttttgactattccaaacatcttagcacaaaatctgacatgagacaaaaaaccatatgaaggagggcttcttaagctttccaataagtacttatgggtttccaaggaatctcctgtatcatcagagtcagaaggaccaaacccacgaataggaatttgcttgcacgtgatggttcgtggctcctcttctacatttggccgttttatcttctccattgtcttctcctttgttactaaggacaatcaaatcatcaaaagtaataaatagtatgtcattcttagaaacatttgtatcaaagcatagaaacccattcaccttatggctaaattgaagtgcatgggcacgacttactggactttgcattgttggttcatcttgttgaacttgttgaggagattgtatgtgaatttccacaagagcgatgtcattatcattacatctatttgcataaaccatatatagttaagtagttatgaaaaattctcaaattataaataacattcatgtacatatacaactccacaaaaatttcaaggttaaatacaaaacacacataaaggggggaaaaggataaatccaagcatataaatagtaccgatttcttagtgtgtagttcgattttaaacattaagtgataaaggtttgccaaatgttttttatacaaaaaaaactataaccaattacatgcatttgagatataaattatcaagagggaacattattcacttgaggtatcaaagtccattctgatgtggataggcatgattttagttagtagattcaaacatacaaagccaattatgtttttttttaaatagacactccattgtcgtagtttaggggacatggctgttaagaataaaataattaagctcatcctatatctataccttatataagattacaacccactaaatcctaaagcttaacatgcaaacataccacgtcatcatccactagcaattaatacatcttaacatgcaaacattctaatatacaatttattacattcaagagcgcaacatgcaagcatatcaaatcatcctcatcatatttcaacatgtccatccaatcctatatttcctcctcttcattcagttaatttgatttggatttatgttttattaaataaaggaactcaaattgaatagttcttgattcattggttcgcccatcgtaatatgtgctctaatgtctgttggttttttttttaccgtgttacaaatgttttctatattagttcccctattggactatgtgattattatcccttacattacttctactaatcttagaaagttggaccccaaaaagcatttttctacctctagttttttattatataaatacatcctaattcatgctgcactaacataaaaaccaattattctaatacaccgtatgccttagttgtttaattcaatcttcaaaatcttgtagcaacgcgcggggtatcaactagtataaataaagtctatccccaccacctatagttaaagttatttttcactcaccttgttgtgccacatcacctaaatttgagttagccatctgatttagcctatgtgctctagataatattgattaagcaatcaaacagcccatgacccatcccaactttcctcctcctagtactgaatcgtcactccatcgtctcacataataaccatcacaattgatagggaatctgaggcaacgcatgttaatcagttttagctttcgatcttcatcaaaacattctggtaagcctgctaataaggtaaccaaacatttcttttattacaaatccttataaaatatcagacatggtgagataccaatcataccattcatcattaaatcatggtaaccaagtgttgttttcttcacttgataatcataacaactcaatgcaagcataattgatttagaatttaagaagatctgaaacttttacacattaaaggcaaattttgataaacatgatatgctactcaagtgaggcaccatgtcaagaatgatgtatcactgccagtctgccacactcacaattataaaaaactatgattaagcttaaggctttacatcctctttcactatatgatatggaatataagggcatcatatctgcgatgagtttattaccttcaaagtgaaccatgtaattgtactacttagtaataataaacctattttagtaatgagttccattctgacaaccatttcgtagcattttgattcttttagttggcacatctgagcctgcagaatgaatgaagtacaaaaagtacacatttaggaataaactggattactttgataagttggcaacttgggagtagtattacttgtacttttctctgtacagttttttctctgatggaaatagatgggagtacacaatttcttatggctattgtacttctcacctcaggataaaaaaaaacccttatatttctggacaaattaaggagacataatcccctatatttctggacggagggagtatctaatactacctccgttttaggttataagactttctagcattgtcaacattcatatagatgttaatgaatctaggcacacatatatgtatagattcattaacatatatatgaatataggtaatgctataaagtcttataatatgaaacggaggaagtacttaattaatcatgtgctaatgagtcgctccattttatgtgcttagggattagttcccaaccatgggtgccgagcaaagcctaagtgtcatttctaaaagacggttgtgtgtgaataatattcattgcaaggaatggattttactaactttagatgcctcctttaccactatatgcatgatggattcatctggactttttaaggggataaagttaaataaactatatgatattatatatgactagcattttacccgtgcgttgcaacaggaagaaattcatcttctctcgtgtaatcgggattctatgataatgccacgctgctaaattccataccgagtcgaggtctaagatgattcaacagaagtagattggattgggcataaggctgacatggcatttgatgacttcatccatctcatgcgcaactcgtcgctaggtggggctcgattcgataggtaacaaacctaattactattaactgcaagcatatgcatatattttgaatcaagcaatgatatatcttgtgtgagtagtttgggcaaagtcaggggggtcttgtatagaactgttagtctgctcagcttaattggaaacagaagattgcgatgccgtttcgatccggataggaaaagacatagaaacacagctgcggtgggcttgcacgaagcaaaacgtgcggcatgtgttggactggtgctaagagatgaggtatccataatataacgtccgaaattaaacaagtgactttcagtttcactaactcacaagcattacgaagatatacaccaaagcttttagaacaatgggtatggtgtatgagtatatataataaaaccatctgtgagcatgaaagaattacttagtttattactgaatcaaacagttggtgtcgtagtgaaagggagggagcagtctgcagcatggccaccactgaagaccacctgcggcaaacattgaggcctacatcagcggctttggcaatggtgtcattgaatcatgggccagcttgggcattgcgacggtaattttcctagacattcgtgggtatcagcggcgaggcctgagatgctggcatcgacaaaacacgacaacaatacgacgtggtggaaacaggtgaaggctaggagcgagtgatgatgtggtcttcgacgacggttggtggcggcccggaggagatcggtagtggccactaattgggaaggggagggagcacgggaagaaaggtgggaggtggaagagattaggagagggagtgcgtgcatgaatcaggggatgtgatcaagggaccgtgattaggggatccagatcgctctctcttaaaagggtgacctcgatacaaactcggtgacgacagacgaaaaatcatacggaagccttacgtatgttttaagtaggtatagatgtcatgtatcctatagatacagatctactactacgatatgtatttaatattttaatatgtgaccaaatgttatatttttgggacatgttttgatatatccaactgatatgcaactgatctatgcaatcatttaaagtatgatataatgatatatattaccgatatacaatatgtgcatatatcaatacaattaataacttatatgatctatacaagcatttaatatatgagatactactgtatcttacagatatgcaatatatgcatatatcaatgcaattaataacttataagatctatgcaagcatttaatgtatgagatactacttctccctccgtcccaaattagatggcatgtatttttcccctgttgtctcaaaacataaggcacattttcaattgttgcagcttctacccggtaatgccctctcatttacatgcatatgtgaataaatgctgatagagggcgagctgtgcatgcagccggaacgtgggcccgcaccgtgtggccgtttggattgacttatcagcttcgtaacagagcgcttcaatctctatacgagatttgcatgcttagttagttgatttgaatgcccgttcacatggatcctgctaaataggggtaaaaatagataaaactaaactgcatgcaaagtctttggtcttagcaaaataaatttcacaccctctaatttgggacggagggactactagcaaagatggatctgataccaacatgctttacatgatcatgaaagttgaaaggctgcaactttggtactccctctgtcccagattggagggcgagtattttttttccccgttgtctcaaaacataaggcgcattttcaaattttacaccttctacccgataatgccctttcatttacatgcatatgtgattaaatgccgctagagggcgagctggtgcatgtagccggaacgtgggccacaccgtgctgccgtttggattgacttatcaacagagtgcttcaatctatacaagatttgcatgcttggttagttgacttgattgcccgttcgaatggatcctattaaatagaggtaaaaatggataaaaccaaagcatgcaaagtccttggtcttagcaaaataaatttcacgccctctaatttgggacgaagggagtatatcttatagatatagtatatatcaatacaattaataacttctatgcaagcatttaatgtatgagatagtgttatatcttacaggtatgcaatatatgtatatatcaatgcaattaataatttctacacaagaatttaatgtataagatattgttatatcttacagatatacaatataatgtatgagatgcaatatcttacagatatgcaatatatgtatatatcgacgtaattaataacttctacgcaagcatttaatgtataagatattgttatatcttacaaatatgcaatataatgtatgagatgttatatcttacagatatgcaatatatgtatatatcgacgcaattaataacttctacgcaagcatctaatgtataagatactgttatatctaataaatatgcaatataatgtatgagatattattatatgttacatatatgcaatatatgtgtatatatcaatgcaattaatgacctatagatagtagcattcaatttccactatagacctcccctatttaaaacccaagcatcctaatcaaaccactcaccaccactatcaacacaactcttgcatcaccatctgagagaaaccagggagatacacacaagcaatagccatggcgagacaacaactcctaggtttgttcttggtcctcgccattatggtggcggtcgtgtggggcgaccctagcggcggctgcgaccaagaccggcaggacatgatccgggagtgcaagaagtacgaggggtggccggcggagcccaaaatcgagccgtcagaggcgtgctgcgccgtgtggcaaagggccaacatcccctgcctgtgcgccggcgtcaccaaggagaaggagaaggtgtggtgcatggagaaggtcgtctatgtcgccaagttctgcaagaagccgttccagcctggctaccagtgcggaagtaagtgaaacagatctgtagattttatcctattatttctacttgtatatatgtacatgtattggactatatgcctgatattgcttttgtatggttttgcaggctacactgttccatcgagcctagggcaataaatagtacgttgttactgatttttatttttccttgtgacagaagaagtacttctgggattagttttcatgtctcgtgacatgcacaatgtataacttctgtgatttgtgtggactgcaaaattgggaaaaactgagaattaataaaaacagaaacttcttctaattatattatctagttcgtgtatttactttcacttgtaaagtatagtagcaggccccggtccagtaatttatccaccatgcgattttgctgccagcatattctactgatgattaactaaaccatcttaagaataatcgaagtcagttattcgagaggcattgtttggctttaatccatcgctattagagagacatatggttcaatcatatgaatatatgcagcggtgtacatatatatatctttacttatacaactactagccattagccacaataggctacgtactcagcacttggtaccacgcctaaatcaaccaaatgagcaggcctcaattaaaccaacgttaagcaacacatcccaattccccgaaaacctgggtcgagcaaacattgtcaggccgcgccatctggtggtcaacaaactaaccaacacacacataaacaccggtgatcaattctcggtacaatgacaccaaagatatattatctaaaaaaaaatgacaccaaagatatatattacatccttcgtcttatattataagtcgtttgaattttttcttagtcaaatttctttaagtgcaatcgagtatataaaagattatactaatattttcaatacaaaataaacatattatcaaaaaatattttcaatgttaaatgtaatgaagctaatattgtgttgtagatgttgctactttttttataaacttaatcaaacataaagaactttgactaagaaaaaagtcaaacgccttataatataaaacggagggagtacaattaatcattactcatattaacaacatttagctataaccaaattactcatcacatacacgatcttatggatctctgtggtgagaacggacaacatgggaggggagagggatgatgatatataagtgatcgaccaaggtattgttgtgtatgctatgtatgtactatttccagaatacatctggatgttgacgtcattaaaatgaaatgtgatactgtcatagaaaatttgtttaataaaatggtcacagatggagatttcaagtgaaaccgcgtttatattataacaaaataacgttaaaagttttttttaagctcatgcagaacatctcattccatatgtatgtttactgaataagtacttctacggtggtctatactgatataattctacaaccggtattataattagtataaataatctaagtcattgatttatgagtttactaccaacagtaaaaaggtaatctacttctattacatgaggtggtagtttaaatagatataattcatttgataagaaaatatgagagttctagattaattctactatagtagggaccactgtcttaccatttccctaaattgcctatgatatgcctttgatggttgggcaaaccattttgttgttgtgactactgtgatgaactatatcatcccacacaaacatcattgatggttttctgaaagctagcctcatcattgtagcgcaacctttgagtgaggatataagagtaactatatggtggaaacactaacttagatgaaaaccggtgtaaactccaaacgaaaaatcatctaaattcactaaaagatgcctaaaggtagacaagaatatattacacgacaaatgtaaatatcttatccaaactcgctttcgtctgtgagatataaaaataaaaaaaatttgaaaaacgaagttaaatttggacatggattttttacatggttgtgtaacattaacttacctacatgtataatttattttgtgaatttagacgaaatttccattagggcttacacaaatgttcagcaaagttgagttttcactatatatttacccactgtatacctctgtcatgaaagcatgtgatttacaacaaaaggttattcaacacttttaaaatattttgattgcggtttcttttaaaaatttgaaaagaggagagatacagattgagacgcaaatcatatatttataaatttatcttaaaaaattatctgaaaataatatgttacaatgttcacggtccaataagaatttcttttttatgcatagaagtatacgcgtgtttatataagtgtttgcatatgtactatgttttaataataataataataataataataataataataatataaaatgttttcgtaagcttgaaagaaggcatttgggtgttatgcatgccggccggcccgtacgtacctgcacaatatattatgccaactactcacatcaagggtcaaagtggtgagttgtattcaaacaagcggtaatcccacgcgcattgttcgctcccctgcctgcctcccaacatgcgctccaaaaccttaaacaaattcgcactccagaagataaccagcgcgcgctgatctcgtcgtcttccttgcattggcgccgctcaactcatctccaactataaatacgcacacacaataacaccatctcacccatcggtcgagtctctcgcagctttaatctccttcaaagccaattcaattaatcagctcgatcatatcacattactgagagagggtgcaagctagctagcaacaagctgccatggctaataagctcgctgctctgctcgtctccttcgcgatgctcatggcggcggccgccggcttctacaccccgccaagcccttccacgtgcggactcaaggtcggttactaccacgacaagtgcccgcacgccgaggccatcgtcaggggcgccgtcggcgccgccatcctccgcgaccccggcgtcggcgccggcctcatccgcatgctcttccacgactgcttcgtcgaggtaaaatcatactccatccgtttttaaatatttgacgcaattgattttttaacacatatttgatcattcgtctcattaaaaacttttgtgaaatatataaaactatatatatatatatatatatatgtatatttaacaatgaatcaaattacaggaaatgaattaataattacttaaattttttaaataagataaacagttaaacatatttaaaaaatttaacggcgttaaatatttagaaactagaaagggagggagtatatataatggtgtcacgttaagtatgccaagtgtggccagtcacatgtcggaatgttactgtcatggctgcattgacacggtcttatgacttgagttgacgacatgaacgcgtgcagggatgtgatgcgtccgtgctgctcgacccgacgccggccaacccgcagccggagaagctcgccccgcccaacaaccccagcctccgcggcttcgaggtcatcgacgccgccaaaaccgccgtcgaggcggcatgcccgggcgtcgtctcctgcgccgacatcgtcgccttcgccgcgcgcgacgcctccttcttcctcagcaacagcagggtgtcgttcgacatgccgtcgggccgcctcgacgggcgctactccaacgcgtcgcgcaccctcgacttcctcccgccgcccaagttcaacctcggtcagctcgtcgccaacttcgccgccaaggggctcagcgtcgaggacatggtggtgctcgccggctcccacaccgtcggccgctcgcactgctcgtccttcgtccccgaccgcctcgccgtgccctacgacatcgacccgtcgttcgccgccacgctgaggggtcaatgcccggcgagcccgagctcaggcaacgatcccacggtggtgcaggacgttctagacgccgaacaagctggacaaccagtactacaagaacgtgctcgctcacaagggtctcttctcctccgacgtgtcgctcttatcgtcgccggccacgatgaacatggtggtgatcaacgccaacatccccgggtggtggcaggacaggttccataaggcaatggtgaagttgtccgccgtccaggtaaagaccgccggcaatggcgaggtcaggaggaactgccgggttgtgaattactagttgagagcctcagacaatcatgagcgtccaaagcgttcaccattccaagcctatctttgctctctgttaacagctgatatgctgatgcatcttgtttgtttcattccttcattattattgattttcatgtattgagtctgttgtatgagtgtagtgtgtttcaacatgaaagttaataaagtaaccatttgggaagttacatttacaactccatgtttgcttgcaggagggtgagattactgaaatttcagaatttttgaaccgaaattgcaatctctggtctcaatttccttattattatttaattaacccctctagtatttagagaggatttatttcacacctattatggtatataattattttccctcaatcccctctgatgactctcttttgggaattaatcaaagaatgtctgggttgaacttgcacaaccaggtacgcagactggggaacctgagctaaaagatgagccttggaatccttaggacccaatagcagtgaaaggaaggaatcaaggtacaccaacagtagcaaagttcccaaccacaccaacgagctgccaatagaagtgctttctgatacttagttattttgatcggcaatttcattgcgctatcttgacccaaaattaaatctttttactgtgggtactgggtagatgaactattgtataataggtggtagagtggagatattagctgtgttttggttgcaacaaaattgtgaagaatgttcagtattatgtttttattcctgttttagcaactttggctcatctaataaggtagtaaattaagtgataaaattatgccaacttccagagagctattaatatgtcctagtatttttttttatatttttccttgagctttttagtgctaagcatagttgtatgaattcacaaattcaattttatgaatgaaatcatgcatgtatgcaagaaaatccaaatacaagccaaaaacaattctagcatagaatatcaaacacctagtacttctcactacatcatttgtataactttccattacgtcattcatataactttattcctagtttatcatacgaaaattgaatttaatgtgtatttgaaatttacttaataacctgatctatttgtctaaaaaattttattataggatcatgtggctagtttacgtagtctataaagtttcgacatatttataagggacaattgatcatttgaccctattctaaagcttaactatcaattcaacctactattttaagtttgcttgtttgaccttgtgttgatgcgaattgaatttaatgtgtatttgaaatttacttaataaccttatctatttgtctaaaaaattttattataggatcatgtggctagtttacgtagtctataaagtttcgacatatttataagggacaattgatcatttgaccctattctaaagcttaactatcaattcaacctactattttaagtttgcttgtttgaccttgtgttgatgcgaaaaacaaacactggcctgagagatctgcttaactccagtgcaggtctaaaggttggtgagatgtaggcgtgccagtcagtttgatcctacaactgacaagatatgtaaacagtagatcaaacagccgatcggctgacaagccgatgtagtagttccagccgatgccaatgccagccgatagcaatagggttttgagctatcggctatatgtccaatgtatataatgatatgaaggcaatcggctgatgataatataatatagcaatataatccagtataaaccaattggctaacaatatgatagaataagcactgatccgaaggttaaagcatacatcggctgaaggtccgatgtcataaaatccaaacgattagataaatcaatgaaacctttgtcgtaatcggctaaatccaatacgtatgcaatccttgtaagccgatgcaacgtccagataactcatcggctgaaacctcgatgaagcttattggcaatcaagaagcaggctagagattatggttctaagcacgacttagtagatcaaacttaactgatgcaacactaagtatg

SEQ ID NO: 76903 - DNA, 2830 bp, Oryza sativa
tctagcaattcaattagcatactgaaaatgatataggctataaccttcctcgcacaaatcaagtggtttttaggaaagaaccatggtctttacattagataaaaatcaggacatcgacgatatattttttactgtagtaacaaactgatataccatacagtaccttctgtacaaggattttaacacatacaattccatctttaactgtcattgtggaaacttgaaaagaaactaattagatggcctagtttaactcctggggatgttctaaggtgattcagcattacttgtgtgaacattttaagatctatctcatgtgttgcttgtgctcctgtactgatgttaggaacacgttggatgcttcaattgctccctcttcttcaattaccccaactaccgcaacttatttcccatctgggctcttggagagtattgtaatcgtcttcgctcagagaggcgtgcatgagaacatggcaggaaactcttatacatgctgcagatatattgatcgccctgtacaaatattactcggctatacctaaaaaaacaagcaaaatcttctagctccgttgcatatctcggatgtaattgcttgcgatccaatttgatgttgtatatatatattgtcaagactggttatcgtaaattcataacccattggcttttgaggcttaaaaaaaattcaatatatatgatgggttcttatttactattccctccgttttatatcgagtctttgctctgatatcggggttgtcgaaaatgagcttttgtgctcgcttcatgtggttaggtggttggtatctttgacaaattcaatgagaaagatgagttagatgtgattctattgcttcgaaaatgtgtttattgacatgtttatcaacaaatacgctaattcctactgtacaacactgaaactggaaaaaaagcacgttaataatgctaattggagagaaatgtcagaattaggaggaagtatttgcaacaatagtcgtatatgaggaatctcaaactcaaggtgatatctggtgtgttttttgcaattttctcgtgttaaaaagagggttattcatgcagcaatgatggcttgcacaaagtatcaactgaatcttgggcaatcacgtggccttgtctcagcaaagaatgtgaaataccacaaagttatgtcactactattaaactgtcattagtagcaaaatttacatgagtcatatgtgaatatcgcaaaatttgtcaaatctatcaaacgaagcaattaatagccactactatttgtgatcatctttgtgactcccgtgcgaatgcgacagctactctgcttcttcgttaggaaaaacaaaaataaaggcagataaactacgcaaccattgatttgttgtgctcagttggcaaagttgatggtacaattatgacgtttggtggaatttgcttctgaaatttaaatttagacattgcgtgtttcattattttctcacggaatttaatttccggttacacaatcacatgatacaagtagttccttctcttctctttaaaataaaaaaataaaaaaaaccacgtccgtccgattgcgatccggcggttggcatcagctctcgttgactctcaccttgcggccgcagcaaccgccgcccttcgccggccgcgtcgccggcgccggcgacgacgcggtggtgccgtcggtggtggtgcggtcgaggaactcgcggttctccttccagacctcgccgtcgtcgtacacctccttcttccagatgggcacggacgctttgacctcgtcgatgacgtagcggcacgcctccatcgcgtcggcgcggtgcaccgcggacgccgccacgaacacgctcgcctcgccggcggggaccgtcccgaggcggtgcgccacggcgagccgccgcagcgagtgggcggcgcgggcctcccggaggatggccgcgagccggcgccgcgccatggccccgtacgcctcgtaccggagctccaccacccgcctcccctcgaagctgtcgcgggtggtgccctcgaacgtggcgatggcgcccgccgccaggtcgcggacgtggtccacgtaccgtgcgatgtcgagccggcctgacccctcgtcgaggatctccacgaggtcctcctcctcggttgccgctgccgccacggggagctcgtcgctagccatggggtggggttgagatcgaagtcgtcgcgttcgtgggagagagagagagagagagagataaggtttcgtggggacgggagcgcgcccgcgcgactgcgcgaggggaggcggcggccggcggcgcgcgctcgtcgacggttggggacgggaccgagcccgcgcgacggcgcaaggggaggcggcggccggcggcgcgcgcgttggactctggagcggcggcggcggcgcggtggaggtggagattggagaaatgtggggaaggggagggttgacgttgactagggttagaagctatacatatctggttattgggcttcaattttatagccaaaacgactaataaagtctataattggtccctagctacaatgcatgcgggtcaccgcgagggatagggacttagggtgggagtggagcggcctccctgccggccatccccgatagtgatgtgttttggaccattagatttttcttagatggtagatattaaccatcttcatcccctaatacgtgaattcaccatggggattgatgatcggtcccatcgccatctataaaattttgagctatgaagtaatcgagcgagcatgcgctagataaatccaatctgcttcggaatcttcaggtttcacaatatttgcagcatttaaattgaaattg

SEQ ID NO: 76904 - DNA, 6902 bp, Oryza sativa
tgagttctgtaggctagctgaagataggaagatttaagacacgtgcaactatttctcattttgatactatcgatcccatcattccgcttatcctgatgtttatttctactgtttgttagcaaacaaaaattaatttatagttcaaactcctaagcgatataaaagaaaatgttgcaaaataaatcatgaaaaaaaaccttaaaatcaagttcaaaactaaaatttaaaaaaattaaattttagtttgtaaacataagtatataagtataagtataagtgaaacgatgaggaactacgacttcaagtcttcaacgtacagatctgaccaaagctataaatcgttcaaacactttatgttaagcaacattattcatgagccctagcccctatttttcacttgcactttgtaaatacgcatagaagcaataaagattaatctactttcaagagtcttcgatttgtgttttgctcgggtgcggcggttagagtggcgtctactgctcattcagaccgactgcagcagcaacaggtgacggctgcgcaacgggcgatcagcccggaggtatctgtccagtcagacctacgcatcaactccggtcagaccgatctccatcgattcgatggtaacttttaattctgataaaagatttagattttggtaatccaaccatttaccctctctgattagtttagttcttttttgaattcagattagcttagttgttgttgttcgagcataaatgctgaacactaaggctgtatttgagggagaggagattgagaagattgggaagatacgtaaaacgaggtgagccattagcgcatgattaattaagtattaactattttaaacttcaaaaatggattaatatgattttttaaagcaacttttctatagaattttttttcaaaaaacgcaccgtttagtagtttgaaaagcgtgcgcgcggaaaacgagtcagaatctcccctttctcctgtgaacgaacacagcctaattcaactatgaatagcaaattgaatcaactaaaaaattcagtcatgctgactgcgctgctttcaattgatttgcatttttatatactgttgtactgattgatttgggccatttggcactcaatttcgaagggcacactcttgagaggtactgttatattatattaattcattatattcatggtatgtgaaacgaaagcggctgaagatactagagagtaagctagttgtggcacagtaaccatctcgtacttaaaaatgaatgtgtgttgggccagcaatatggtgctagctgatgacggtcgtttcctgtgttatttacaggaccattgaaagcacatctcggtgcaagtattgcccttatccctacgtttaattggtggcatcaagtaaagcgaccgccgtgattaggactaagttttgtgtccaagtttaattggtgggatgaggataaaatgaggtaagtcatttagaggactattcatccttaattatatatttatttcaaattagggttttggtttcgcaatcccttatgaagcgtgcaaccaaacatggtataattactggggtgtgcacactactgtagataaggtaaaatatatttttttacgggcgggtggagcaaccacctagcctagcatatatgtaaaaaaaaagattttcataatcggacatcgtaatcgtacgtgaaaattgatttttcatacatggacaagtttaatatgcccgttaataaaaattggttttcgtagacgagcgaattaagacgcatgattacaatagacttttggcaaaaaaaaataaaaaatttccctaaatccaagattaccaaaattcaaaaaccctagctcccggtgaagtcggcggctgatcaggtagcccctcccgaggccaccgtcaccaaatatgcgagggagggaaagaggcaagagaggaaaggctgtaccgttggatccacgatgcatagttcatagcgatcttcgaatttttttttctcttaaactgcttatcggatataagatccgatcacaccgttatattcattataattaaatctttagagcaacatgtcacattattttgataaaataaagatatattccctccgtcccacaaaaaactaacctaatactggatatgacacatcctagtccaatgaatctggacatatccctgtccagttcattgtactataatgtgtcacatccagtcctatatttacttttattgggatggagggagtatgttttaaccattaaaatttaatgtcttaaatgcgatagcaacatgttcatcatgtgtttcataaatttttaaatgtttcaacggctaactttttttttcatcatatacaacttagtttattattagtggtcgactgcaacatgtgacaacctgatcttttttaaaaaaatggacacctgatttatactagcttaaaaaaatttatcttttgtcaaatcaacatattgcttgttgttttttatgaaaaatgagatgatctatcatttacttctggattggtattttaccaaatttctctagagagcagcataaatttctttttttatatcctccatgtagtgtatcttatatctttgggaattggtttgtgggtattaataaattataaaaccaaatatcttatccttgttaaagcatattctatatgttaggctctacggcttagcagaaatgatatggttttggataaatcactattcaaatcttatgtacaggtacttttcaaaacaaggtattgactccgattttgggcacaactataaaggtgtgatgagaacaataaacttatgaacgctgcatgtcgaaccttaagtcaacggttatataatttttcgccaactttggatagagatttacaaataagcttcaataaatgtagagttttatctagtgttatttggatgtgcttttatggatttgttggtgtgtgctcagaattgagtggatctatgcaataatgggccatagctcgttgagtaaatgacataattttcttccgttattaaaaaaaaaatcaacgtatggcttaagaaaatacaactctttcttggtagaaatccggctacagatgatggggttatgtattagtactccatagaaagaatatccatgaaaaggacaaccgcgtacatcatcagcttatcccaagcggcaccatttggctccaagccctttaaaaagccagcagccatgccaatactatcggtaggcctggtccaggaggcaaagagcaaaccaaacacacgcgcgtgtgcatgctctatagtctatagctaagttagctacaccttcttctccatctccggcgagtacccgttgattggctggcagctgctggtggtggtcgcggccatatacatatagctaaagctgctagctaccatgtggaggctgaaggtggccgagggcggcggcgcgttgctgcggtcgacgaatggcttcctcgggcgggcggtgtgggagctcgaccccgaccacggcacgccggaggaccgcgccgacgtcgagagggtgcgccgtgagttcaccgatgaccgcctccgccgccgcgagtcggcggatctcctcatgcgcatgcaggttcatatatgttacttaaccgctcaatcatcggctaactgacgatcgaccggttatactcttttcctttttttaatatatgatgcagttaggttttatacgtatgtttaactatccatagagaataactatatattttttctaaactgttttatcaataaataataatttatcttttatatctatatataaaatattttcgaataagatgaatgtttatttaataagttactaattaattaattgcaattaacaccaatacgaagtcgtgacagtgttggctttcatctgatatgattttcttggtttcatttcatacgatgttacattcatttcgattttgttgcagtttgcaaaacagaaaaagcttcaacgtcgtcgtgatagtattccaccggccgtcaagcttggagagaaggaacaggtgactgaagaaatcgccatggcttcgttgaggcgagctctcgacgagttctcctctttgcaagcagacgatggacactggcctggcgacttcagtggtgttatgttcatcatgcctggcttggtaattaatattcaattgtatttgtctgattgtctctagctaaattaattcatattttcgagggttttagtgatctaattgctgtccaaaataaatgcagatatttgctttatatgtcactggatcactggacactacgatatcaccagagcatcggcaggagatatgtcgatatatctacaaccatcaggcaaagaaacaaacaaaaaaaaactatatacgggctgaccctaaaataataagccaatatggtttaagattttattaagtatagaagaacatctattactctactgtccacaagtactgctaccactataaaaacaaaaatgtggtggtttgcataaattaaagcacagttcagatatataagcatatttttgtaagtaacaattaaatgttactagtatgaagaaacaaacattaagaaaattttacaaactacataaattttaatcaaattattgtaaaactatagagttaagatgacgtatcatagaactacatattgaccatcaaatttatcatgaagctatagatttaaagtgaaatatcataaaactttagatttcaataacgttgtcatcacaagagtattgattttaatcccttaaacctacagttttgtgataattttattattaaatctatgtttttatgatacttaatcttaaaccaatagtcacatgataaatttaatgctaaaaatatttgtagtttgtaatacaccgttttaaatctatagttttgtgaaagtttgatcaaagtatctgcttttactagaaaacattggatattctatattttgtgacatcaatatctacatgtgtgtgtagaacgaggatggtggatagggcacgttcttgagctcgagcaccatgtttggcacatgttcaaactatatcaccctaaggcttctcggcgaagttctaaccaatgagcaattggctagaggacgtatctggatcatatcgcatggtggcgctacccttgttccacagtggggaaagatatggctctcggtctgtctactatataatcccatgaaaatgcactatataataaatcttgctaaagaattacttttattggggcagtttaatgtcaaaatgctaagctatatagtagtataaatttgagcaatataatggttaactaaatgatatataggtatatttagcatttacaaattaatcgtataaagatttatatttttaagtactttcacgcaattggttttatagtcattcataatacagccgatgataactaacaatgttattcatcaagatcgacctttccaaattaaaacatgcagctcttataaaaatcaaacagagtttaacatatattctgaagtatatataattagtgcatgctgctaactaaatacacgtagcttgttgattcgtttccgtcaacttaatttgaattcgctacagatgcttggagtgtacgagtgggcaggaaacaaccccatcttccctgagctatggctagccccacagttccttccctttcatccaggtaaatattaataggacactgtgttgtgtatgtatatatcctcctacatcaaatagtagcaatataaaacaatttagtggcagtgctcagagtttatattttatcaaaacttcattaatttattacgcatgtgtaggtagacttttaacaggattttagtgagaccatgaatgtgccactagtttccgtctcttaaaacatatgttagagagcgtatttcacgtttttgtgagcgtggtgttacgtatgtagtgatatgtatgtgtatgtttaaaagaaaattcattaaatttatttttaagaataaattttaatttgggtgcaggcaaattttggtgcctgacccgcatggtatacctgcccatggcctacctgtacggcaagaagttcgtgggccccaccacaccgaccatcctggcactgcgagaggagatatacccggtccactacctcaccatcgattgggcccaggcccgcagcgcctgcgccaaggtagagagagagagagatactattttaggctgggccgaatttgttgggcctctaattgggcctaacgtaattgtgcttctttttgggggaggcgtggcccgtcgtgaggcggcgattctcgccgccggtggcggcggcggcggcggcagtggcgactcgccctccttccggcggcgccgttcctcctccatcccccctgtctctctctctcctctaactgttcgtcatgctctggattttggtggtggcaggaggatctggtctgcccgaggacgcggctgcagaacgcggtgtggagttggctgtacaagtgggtggagccggtgatgagcagctgggcgatgaacaagctgagggggagagctttggatgcactcatggagcacatccattacgaggacgagaacacgcagtacctctgcatttgctctgtcaacaaggtagcttcaattttttttcccctttgtgatagtcatcgtcaattacagatgtttgatgttaagtgttaaatttgattcttactttgctcttcatttctagtaagagaaatgggggccatgggccctagttcaaaaaaaaaaagtgttaaatttgattccggggaggctaggatatgtcagatttgagctaggcatcagaattcaaacggtttgtgtgaagcggtatttgtcttcttattacttgttactttaaacaatattcaggctctaaacatggtctgctgctgggcgga

SEQ ID NO: 76905 - DNA, 1024 bp, Oryza sativa
atgagagccaaagcccaatatcgggccgttcactctgggccaacggcccatgcccgacggccgacgtgtctcgccgtccgtcggccacgcggtcggccgccgagacgcttccaggatactacacgtctctgcacacgcgtcagcaagctcctgtgcttgcaccgtctacttatctcaattctcaagctctcagctatggagtaaactatacttgcatcttgggtatttttttcagagcaaatcgagatcgatccgacagaagcgagcgatcatggggcacggcaaggaggtgaagacgaggccggatcccaaggtggagatccaggttaggtttgctgcttaatttaattaatttctccccatttgatcgcattttgtatttcttttttacagtttagttcagatcagtgttagcttagcttgcggagtggattaatggcgatcgatgtggtgggatgggatgcaggagaagggcgagatcttcttcttctatcgtcccaaggtcggcaaggacgaggcgcgcggccccgacgacgtgcagcggatgtacatcgtcctccgccccgaggccaccggcgacggcggcgaccgcgccgtcgaggacaagcaggcgccggactccggcaaggagggccacaagaatcagcagccgcagaacagcgacggcgatggcggcggcgaaggcggacacggcaaggaggtcgtctcggtgacagagagttgcagatttttcagagattttcaggttaaatttgatggatgccggtgttgttgcattgcaggaggtgaacgtcgaggagcaggcgctgctccggctgatcgtgatggggaagaagagcctgccggacccggcggcgaagcgcggccgcccgtactggggttacgtcgagctcgtcaccaccgacgtcgaacacatcaaagacgcgctcaaggaaggtacaaaacgcattcaaattttaatttcgttgttccaaatcgaaatgtgaacttcttatgtatgaatttgttgcgatcgattttgcag

SEQ ID NO: 76906 - DNA, 11103 bp, Oryza sativa
atgtcataaaatccaaacgattagataaatcaatgaaacctttgtcgtaatcggctaaatccaatacgtatgcaatccttgtaagccgatgcaacgtccagataactcatcggctgaaacctcgatgaagcttattggcaatcaagaagcaggctagagattatggttctaagcacgacttagtagatcaaacttaactgatgcaacactaagtatgaaaagaagcataatatctagacaatcaagccgttgactgagttttcagggtggtagatgtctaagctaatctaatctagcaacacgatttagccgataccggcggaaaccctaaaacaagaaatagccgatagaactaaattgatatgctaagactagattaacagagacatatgataaataggtaggcaaatatacagtccaaaccagagcaatccaagaggtcgaatgtcctgatgcagccttgaacgacgccaacgtaaacgatacaattgtctgggccggcggaacgtaggacttatcccttcaccggagatcgaaagccgacgcagccccgcgtcaggtgccaaattctgccggatgataaataaaaacctcagtaaagagggtggcgatgcaccgagagtagttgtattgatcgatatattgatagattacaatgaccccgggtgtacatatttatacccatagggagatactagtccttatcggacaagaaagaaactaaagataaaaggaaaagataaagtccttattataggacactaaacacactttcctaaagataaaaggaaactaacaaactattcctaattaataggtaacttgccatgctgcattctctttgaactcggtctcttctggataagcttcccttagtagatcaaattccttaaccgaatatagtaagaatccgacaactgacgacttgataactctcatcggctaatctcaggacttcgaagccgatgctgactctaagccgatgattactccgggcttaccaaatttcactgttaaatgaaaaaaaaaatatgtatttacaagcccaaataactaaaatgtccatataacgacatttgccccttgtaaagaggtaaaattttctagtttaatttaaatttgaccatatcctcctttccaaaatatagttacttctaacattaaaattctgtgtcacaatgtgcaatttctcctcctactctcttatttcaatcaatcacaactatctactatttaattttttaacatacttcctcatctgaaccaatcataactatcccacacttaatttccccctctacataacctccgtaaaaaatccataagttattttaggacgaatgaagtatttgacaaagtcatttgtgatggtattttgttcacgagagtaggtgcttatgggacttccatttatttcttattcagtgctgattttttcataccaacattcacagaattaatgaaacattctcaaaatgtattttaacaattttaataatctatgtttccataatataatttctcagtacgttaaaggtaaagatcccatttcagggtgtgttcttgtggcaaaaccatatttttgcaatgtgttcaagcaaggcctcaatttttaatgtgatccttgtagttttacctttgaactacccaatcgaattttcctagctcagctatatattgtggcctttgtggagaaaggtcaagcttcagagtttggacttaccaaatcagcaacgtacgtaccaaccgatttatagcttgttaattgcgttgaggaagccagtataatagtcactgacactttgacaacttcaattcaactcgatttcttttctattttctgatttttcaacgacaacgactccccctactttgcaatgatatatagcgtagttgattgaggggagttaaggtagactattcggcattgacttgtccttgatcggtagctagaatataattgggattagatatcggcgctttcacttatatgtatgtgcagatatttgatcaaaaccaaccccattgacaatgcatacgcaaaatgcagcatgctccaaaacttgtcatgtcaacgccgtcgactaagctagaagaaacttttatcaaggtatataaatgtgtatgacagcacacataatatcgagccgatccatattattggacagaaactgtccactagacctaaacaatcatggtaatgctttgtccatgctaattgctgtgcactagctgtgcgttggctttttttatgttaattattttcgtttgaaaaggctagttgcttgacttgctcgtacatatttttttcgtatataaatgtcaagttacattttacttagaaaataatttggattagatggaactagggttaaaccaagtttaagaaaattgtagagtaagcggtcggttgtatagtgcactaattaagtagctgtgagaatgagatcaactcagaatttcatggaaaatttttctacatcttgctaaatggcataggcccaaataccactctcttggatagttggattttctttcccattaactcgcactaagactcttccatataccactattcacacttttatcattccatgtggcatcacttttgcaatccaacccctccccccccaaaaaaaacaaaaattgatgtagaggatgaggcaaaaagaccaaaatatccttgagaccaattgtaattaaggtgcatggtggcgtctatgttgtttcctccctggcgatggcatcgttgccaccttctttgagccagtgcccagcagggaacaccaccgacttcaactacaatccctatttgacacacgccatcatggcttgaggcccacgtccacgggcgtaaatcattgatattattcagctaccactcaagcggaactcgctgactcgcgaaagtgtgaaatcattgtcatgattaatatttgtgatgagcaattggctttacaaaatgatttaatcaacgaattggtttgaaaagatgtgtggatgttggtgtgagtgcgtgtgactaatgtgggtcaggttgtaatatctgtgcccaggaacggttgttttgtctgattgtgtgcaggtgacttgaggtcagccttggtcaatggtgaggaccgggactatgctcatggagaagcagaagtctagtacggtcaggataccatgtgagaaggtaactagagttcggattcttggaggtcaacttcagtcaacggtggggatcgggactaaactcagggaggagttgagatccagacggtcaaggataccgggtgacgaagttggatacgagatggcatacggtggatggacatcgtgtgggagagatcttcgcaacgggtttcacgaggtgtgcgtgcaacgtcggtgttcgcagaagaaaattgtggagtattatatggttgctacagtacttgaggtactgtagcggtgttactgtattgtgcatatatgtgtacactgtggcgtgtatgcgtgtatgtggatgcatgtacacgtgcatgtggctgcatgcatgtgtgttgatctgataggttggctcgaggctgtggcaagccgagtcggctcaggagaacaggaggacgtgtcgctgctgtgacggcgaggagagtccgacttgtctgtggccggtgtggctgcaggttttgggaaattgtaaaaggtatggaaattgtgtattgagtcctagtggaactagaagttctactcctactttaagtaggaggttttttggtataaatagagagggagcgtgaggcttcccggtatcgctttgagagcaattgagttgatagtttagttagggtttcgagtttaatcgagatttttgtaaggagtgctgttgttgcactttgtaaacacatagagaagcaataaagttgtcatttactttgagagttcttcgatttgtgtttcttcgggttcaggcggcaggaaggcggtctaatcggcggcgtgcgagcggttcgaccggcggcaacaggactacgtcgagatttccatcgatttgagggtaacttttatttccgctaaaagtttttgggtttttggttttccttaccattcacccccctctggtaggcttagtttcttgtgttcgatcctacagaaagttactgcttcattccccttctccatctccatatttgagcagaagtgaggggagaagtctccaacaattattagcccttagagagccgctactcctacttcagctctctgactcggctcagccaacctcgctaccaccggtggtgaagtggaggtcttccatgtcaacccgccatggcatcaccaaggttgtgcctatcaacgaggaggcacatgcatcatcggtatcccttgtgcttgggcagaggtgcttcgtcgacaatgacttatttgagcactctgtgatgatgcgatgtgatccactttctctcgaaggagcaatcgatccagaccaagggtttcctgcactgctcacccgtggcagtgggcacccatatattcgtcctccaccacattctttcgctcctacctcccccatcctgatttcttctcctgtgcatactctgacatcgagaggatgtggcagtgacgccaccatgtaccatacagctagacccaagggcatttagctcgatctttttgcctcatcctccatgtagaacaggggaagaattgtaaaagtaatgccacgtagatgattaaagggtaaatattctccatacagaagagttttagtggggaccaggtgtcaaaggaaacgaaagtccaagaaagtggtggtaattttttttcgagaaaaagtggtagtatttgggtacataacatttcagaagatggtaaataggaaattgtcccgaatttcatagagcacaatctctaccaaacccattataataatccaacatctcttcagaataattgaagtgtcaagcttgcaggtcacaataaatatgcgtttgagagacttaattggtttgactttcgtccctagacagcttaagaaaaataatccgtgttgatgcttcaaccatatgcaggtcgcatttgtgtttacgtacaacaaggtgccgctcgctccacacttacaacacacacggttccgagctgtccatgatcaagcacggtacccgtcaatttagcattccatttcattcagcacaaaacaacactttcactttgcagaaaccatctttgtcggtccaccaaaaatagtcccgatggcaataaaaaccgggactaaaaatattcccggttcaaaaggttagagctacttttttatctttagtcccggtaactaaagattatttttagtcccggttaaaaaaacggcaggcggtgtcaaacccctcctttatctttagtcccggttggtaacatctatttatagtccgggttattaaacaaccgggaaaagagattggcatgcgcggagaggacgaggcgtgcgcgcaagatcaaggaggaggacacgcatggatcagttaataagttatatctccttctactcccttacctttatctcctcttcctctcctctcctcactcaccacatctcttcctcttcctcctctggatccgccccctcccctctcctccccacttctcaggcggcctcgggcggcggcggcctcgcgcggcggatccaggaggggaggcggccgggcggcggcagtggcctcgcgcggagggccccgcccgacggaggcaggcggtggagaccagtgcggctgcacatattttttttttcttttttccttctctgtgttgaatgtgtgattcgatctgtgttgagaatgaactatgttgttgtgaatgattttgagaatgaactatgttgttgtgaatgatttgggatgaactatgttgttgtgaatgatttcagacgatgggcgtgagctatataaaatagaaaaaaaaacttagtcccgattggtgttaccaaagatatcgatctttagtcccagattcgtagtcccggttagaaaatcaggactaaagagggttatcaaccaggagtacaaaccatttctacaccagtgtttataaattttcaaactttcaaaaccttcatatcaaacctatatttaaaatggtaaaatctgatatatcatctctcaaaaacgatcacgctcgcgttcgccaaaaaaaaacgatcacgctcacgaaaacaatcaacttggcaaattcaccttaacgaaatccttgtaaaaaaatattaataatgatgtcggtccaaccggagtgttttcgtaagcctgaaaggaagcatttgaatagtttccatgcatgtatcgcctacctgcccatttaatttgatcatttttgccaacgaacacatcacaggtcaaactgctgcgttgtagtacgctatctaacaaacagaaatccaacgcgcattccgcgttcgcctgcctcccaacatgcatgcattgctctccaaactaaacaaacttgcaatccagaagccaattaaccttctccatctataaatacgcgtacacaagaacaccacttcatcacctcctcacaaagctagctagctccattgttcgatctcatctcccttagctagctactcgatcttaacagtgagcttccattactgagaagctttgtgcattcttagctactaccatggctaggctggctgctctgctcgtctccttagcgatgctcatggcggcggtgacggcagcccgggtagaaagagcgggcgccggcttctacacaccgccaagcccttccacctgcggcctcaagatcggctactaccacgacaagtgcccgcacgccgaggccatcgtcaagggcgtcgtcgccgccgccctccaccgcgaccccggcgtcggcgccggcctcatccgcatgctcttccacgactgcttcgtcgaggtacgtacgtacgtacattcatgtgtacgatatgattgctcgtttctgatcatctttgtggccgcgtgcatgacacttgacacgtctacatcgccattgccgacatgtgggtgcagggatgtgatgcctccgtgctgctcgacccgacgccggccaacccgcagccggagaagctcgccccgccaaacaaccccagcctccgcggcttcgaggtcatcgacgccgccaaggacgccgtcgaggcggcgtgcccgggcgtcgtctcctgcgccgacatcgtcgccttcgccgcgcgcgacgcctccttcttcctcagcgacagcagggtgtccttcgacattccgtcgggacgcctcgacgggcgctactccaacgcgtcgcgcgccctcgacttcctcccgccgccgaccttcaacctcggtcagctcgtcgccaacttcgccgccaaggggctcagcgtcgaggacatggtggtgctctccggcgcccacaccatcggcctctcacactgctcgtccttcgtctccgaccgcctcgccgtcgcctccgacatcgacccgtcgttcgccgctgtcctacgagcccaatgcccggcgagcccgagctcgagcaacgacccgacggtggtgcaggacgtggtgacgcccaacaagctggacaaccagtactacaagaacgtgctcgcgcacagggcgctcttcacctccgacgcgtcgctcctggcgtcgccggcgacggcaaagatggtggtggacaacgccaacatccccgggtggtgggaggacaggttcaagacggccatggtgaagatggccgccgtcgaggtgaagaccggcagcaacggcgaaatcaggagacactgccgggctgtcaattaaccaagttatcaacgttttcatgcttttatatctatatatatgctccttatcagttacatcttgttgttggattccttatacattgatttcgtgtcaaatgtcaaatgtgactttgcgagacgcctgtactatgattgtatcatgtttagttaaaaaaataataatgtttaccaagcaattacatatattgattacttcaaaaaaataacacatatattaatatttctgctctagagtgtcaatttcaacaactatatactccctacatgtatgacatcgttgactttttttatcaatgtttgaccatacgtcttatttaaattttttgtgtaaatataaaaatatttatgtcatggttgaaaaacatttgatgataaattaagtcataataaaataaataataattacataaagtttttgaataagacgaacgttagtcaaaaaaaaatcaacgatgttatacattataatacggagggagcacttctgctagatcaactagattggatgccctcaacattggagcagaatgttctgacgacagcactagattgcagaggaacaatatactacctccgtcccaaaataagtgcagccgtagatatccgtgtccaacgtttgaccgttcgtcttatttgaaaaatttgtgaaaaaaataaaaaaaaaattagtcacacataaagtactattcatgttttatcatctaataacaataaaaatactaatcataaaaaattttcaaataagacgaacgatcaaacgttgaacgtgaatagtgcaaaactgcacttatacactaataaccctactaaaccctgataacaaatataaacctttgtgcaaaagggtagatcaaattcccttaaggggatgtcccttgtttcttccatgccattcaaataattatttttttaagaagaaattgacaacatagatcaatgttgttctaaatttcctcaacaaacgatgttgttctaaatacaaggtgaaatacaatgttgttttttttttatttttttagtttttatttgcgagtttaaacttcggtatctgtcaagtgatatatatcacatattggtctatgttgcccttttttaagaaaaaaaattataactcttttaatggtacgcaagaaacaagggacatcaccttaagaaacaaaatgactttactcgccaacttactacttaacaccaccgcagttcaccgacattgaactgtggagcgagcgcggccgcgggagcgggagtggaaacagatgcttcctagctgtggtggctaatgccaagaaggccaccaccaaacccgaaattagggtaatcgtaccttgtcgccggagcgttgtgggcaatgctgggatggtgatcactaatggaagcttgagcttgagcttcagacggtgccggtgccgccatgtagctctacggccaatcgatagggaagctgggaatggcatgccgcccttcgtaggagtaacgcctaaatgcggggttgtggtgtacagaggagtaattctggttcatcatgctcgcaccgcagtagctgctgctgccactgctcccgtctgactatgtttcttgaggccatggaatggcgcctcctccaggtggaatgacgaaggtgggcaccggcggcgttgcttgtggcggtagatgcaagaacgccaacgccgtagtcaagtatgggacatccagcggtagtgtggcggccatggcttgttgcatctgcattgagtagtctgtgttgaaatttaagggtagatgatcatcgaggagtgtgagctatgtgtccatgaagacatctccttggggatggaggtgcgatggttcttctggcaacggtggcattggcaacgccggtgatctcttctcgagaaggaggtcagcattattctggttggcatttgtagattcctatggaggattgttgcctttcttcttcttcttcttcttcttcttcccctttctctccttgccgcccttcttaacaccggtggagtttttgttctgctcctccgccgatgtattaccttcattgctgccggaatcaggactaggtgctttcctcttcactgccttctcgttgttcttgccgcagttctgcttcttctgtattgtccatagggctggacgaaagcccgtgcctcgttagctcacttggcttgtgcctaactcggctcggctcggctcgactcgatatggttttgtaatgagccgagctgacattttagctcgttacacataacgagccagctcgagccggctcgcgagctgctcacgagcttaacgagctagacaaatagggagtaaaatcagactttagaaaatagcaggccataaccagtggcccatcgcccatcttggtggcatgcccagacggccagaccaaaatatagaatataaaaaaccctagaccggtcaatgcctcatcgattcctctgctctcccatcagtcgtatcctctcttcttcccgatccagatccaaagcgccgcatcgagccgccgcccgtgcgccactccctccaacccacccacgacaccgtcgagtctcccattccggcggcaagcatcgcgctccattccctccatctcgtggcgctgtgttccactccctccatcctacaacgtcgttacttgttccagcgaccagtgtcgaacttgctcgctcgatgcccatggtccatggagtagggagagcaggtagtgcttgtgccgcatgcacacgctgccacgcatccatgtatgtatgcatggatggatggaattatgttgcttgatactatgaatgtgagtttgtgaagaagtctattgcccaatttcttgtttgaatgggggacagccacatccatacgaaggatttttttttatggggcaattgtgttcttgcccttactttctatatcaattgtgattttacccctgtttttttagggtttgtggttttgcccctacttttttgaaatgaagtaaccgtctgcccttggtttcgacggtagttaggtgggcctgtaatttccgaattaaacgaaggaagaaaatggtattgtattttgtgaatgaccatagtacccttgtttcacttagggtcaaccacttgctggaagaccgatttccccaatccaaaaccgtagagcggcggcggcggcgatgcgcgagcacggactaccggcagcgccagcgcgcggcagggaggcgcggcggccccgtgggccagcttccgcggggccagcgcgcggcggagagaagcggggtcctcgcgcgcgggcagggaggcgcgacggcctcgtgcacgcgcagggaggcgcggcggcggccccgcggccagcgcgcagggagg

SEQ ID NO: 76907 - DNA, 16868 bp, Oryza sativa
  unsure (1)..(16868): unsure at all n locations
cggcgatactcctggattgtgctcgatgagtccgtggagacgcatgcagtgtgtttggctgcttgcacagtcctgctatgaattaaacaagttaggcctgcatggttgagggggctgctcctaatttcacttgtaatataaatgttgtcctgatcccgtttgtgatgaaattgcaagtgtcaaaattttgccaaaatatttgttctagttcggctccgatttaaattatttcacaaaatctcagttcaaaataattgtaagtttcatatacaaaataggggtaaaagcactactccctccgttccataatataaggcgcaactatttttttcagatgtttcataatataacgcgtgcatgcatgtatgcaattaattagtacctcttctccattaaattattgttttttaaaatccttcaccctaaagatctctaattgtattgggtgcatgcattttatttattaaggtaatacaaattaggaggtgataataattgtttcttggtgtttggattaagggtagttgtgccttatattttggaatgtagggagtagtaagcaagggtatgtatgtattttcatgtccgacttaacaccgttaaactgtccatccaaaccgggggtaaaactttccttcatttcaaaaaagcaggggcaaaaacacaaaccctaaaaaacaagggggtaaaatcacaattgaacttgaaagtagaggtaagaatgcaatagccccttattttattgtgatatgtgaatatatgatgttataagcattttttttctttgttgttgttttcgaattttatgaattttgtgttgtttttggatttttatgataatatgatttagacagaagagatgttccattgagctcatcatgtttaaagtgctgattgctaaacaaatgttttcagaatatgttcttccctgtctgctatctctgaagtgatgaaatggttgtattagcttacgagctaaacgagctagctcgagccaactcgagctagctggctcgttaacctaccgagccagagcgagccgagccgagccaagctagctcgatatccatccctaattgtccgtagcacccactcatccaactacaatgatcaaacaaagagatgttatatggtctctatcccactgtataaggtgtggtcgtacttggaatgggcgacgataaaactattcttttgacataatttagctttatcatcatattaatgatttgtagcaacaaaatagaaatcgaattcatatatcaatctaatgatattaatgttatcaaataaaatttaacttagtattagattagttgttagtcaaatatttctatttatagagttcaatcttaaaataagtgtgtgtctccttctgtggaacagaggaggcaataaaataggagagtattaaattgacatcttttcatgccaaactatttaattaaacaattgctattgaaacattgttcacaaatttatatactgtcaaaccgcgtgttctcaaaaccaatttgacatttttaaatgtacagactatttgacatttttaaatgtacagactatttttaatatattgtttgggtttgacatattagtaacagaacaaaaacttagaccggccaatttatgaaataaacaatcattttttgtggaattcaaatattttaaaatatctaaaactagacagtgattctactattgtagagtctttggtaaaacacatctctacatctagtcaccaatgagatggagatgtacttgatagtgtggtgataagaggtatgtgattttaaccataagttcatgtatatgttcaatacttaacacgctcacaatttctttttaaaatatttggaggaacgtctctccctccaaatctcgtttttatctatacaccaaaggaatccaatagacgagggtgatcaccaaccttatgggtgtttttgttctggacctcttccaaggatgcaacgctctcgtaactcgtacagtgtccagtcggtcggcttgttgtcatggttggcatagtacacgagcgtcctgacacgggcgaccacctcttcatcttcatcttcttctccggcgccggcggtgtagatgatcccgatagagccggtggccttctagctcccattgggaatccggaccggccgcgtgccaacgttgtacttcttctccctcttggtgaagaagaaccacctgccgtcgccccactccctgtactttgctgcacaattaattttcattaggaccaaagttagtttagaacaagcgaccggcaaattaactcagatcaacccagaagcaaagacatatacacacgtacctatgagaaatctggatagtccatgttatgctgctgctccatgtccgtgagatgatcggggcccatgttgtggatatagtactatgtgagatgatcggggcgttgctcgaggagattgatgaagatgggtagcaacggtggcaggccggcgatcttgtggcggaggaagtgaaggacgaggtcatcgtccgtgggctggaagtggaaagccaggggcagcttcagcgccaacttgttctgagcagagaactccatagtatctacgcatgccgacggaaagctccgatcatctgaatgaatcgggaaagattcttggatctgaagctacgaaactgactctgttccttcttcctgttgtttttatgtgtgtatagaggcagggcttgggaacgtaatggcgatagactttgagaagaaaatttggaagtagagacgcgaactgcagctgcgttgggaaaagccgcttctttttctctttgggaggagacacgttgcgggctttgcagcccaacccaaaaggctaaaatgctggcctttcaccgaaagtgagcccaaaaaaaaaatgcagcagcgaaacaatgccgactcccatcggtgcgcaccgcgcgcccccggttacctccgcaccgccgccgcgctcgccgccgtcgtccagagcctctcgacgagccccggccccggccgcggcccgggtcccagaccctccacgcgcagctactcgagtccggcctccgccccaccgacgacctcttcgttaagctcctcctcctccacctccgatgcggctcccaccacaacgcgcgcgcggtgttcgacggaatgccggcgccgacccacgccgcgcacaactacctcgccgcggggtactcccgcctgggcctccccgaggaggcgctcgggatcgtgaggcggctggcgaggtgcacggggaggctgaacgtgttcgtgctgtcgatggcgctcaagctgtccgcggcgctggcgctgccccgcgcggtgagggaggtccacgcccgcgtggtgaggtcggtcgtcgagtccgatgacgtcctcttcgcggcgctggtggacgcctacgtgaagaacgcgtcgcttcggtacgcgcggcgggtgttcgacgtaatgccggtgcggaccgtggtgtcctcgacggcgttgatcgtcgggtgtatgaacgaagggctgtacgaggacgctgaagagatattcaacacgatggacgagaaggacgtcgtggtgtacaacgccatggtcgaaggctacagcaagacggaggagacggcagagagctcgatggaggtgttcaagtcgatgcatcgggcgaggttccggccgaccgtgtcgacgttcgtgagcgttctcggcgcgtgctcgctcctgtcctcaccggagatcggcgagcaggtgcactgccaggtgatcaagagcagcctctcctccgacatcaaggccgggagcgcgctgctcgacatgtactccaagtgcggccgtgtcgacgacggccggaggatcttcgaccggatggcggagcggaacgtcatcacatggacctcgatgatcgacgggtacggcaagaacggcctctccgacgaggctctccagctgttcgagcagatgctgcggcggcacgacgacgccatccggccgaaccacgccacgttcctgagcgccctgtcggcgtgcgcgcgcgccgggctgctgtcccggggccaggaggtgttccagagcatggagcgcgagcacgcgctgaggccgcggatggagcactacgcgtgcatggtggacctgctcggcaggttcggcagcgtccgccgcgcccacgacttcatcagggggatgccggcgaggcccagctccgacgtgtgggcggcgctgctcggggcggccacgctgcacggggacgtggagacggccggcctcgccgcgagggaggtgttcgagctcagccgcgccgccgggaggcaaaggcccggcgcctacatggcgatgtcgaacacgctcgcggcggccgggaaatgggacggcgtgcgtcaggtccgggagatgatgcggcggcgaggggtactgaaagacgctgcctgcagctgggttggctccgagtgaaagttctccatccttttggatggtgtaatcatgtacattagctaaaacattctataaattttattgtctagtcttcttcctgcaagcaagcaatggcctgctcgtatgtaatattttgagcaggtcgtattcattgtttttgtcgcaaatttctaccgtttcagatgccatagatgcagaatttagctagaactttggtatattgaaattttgactggtaaaagatctcatctctataatgcatttatgcacacaaccaaaaggccggggagtatacaagcatcagacgcgggaatctactgacttcatatctaatacaccagggaataaaatatacaggcactaagaattttacagcatgtcgtagtatcttatgaccgcaattaagctactctgaagaaacgaactgaactccgcctgcatggaacttgcaagcacagtcatcatagacctctgataatttctaccgacagcagtctcctgttactaatctggaaattttgagcaggcggagcaagtcctgggatgtcgcggatgttcttgttatgtgggttgacaatctgttaaaaaaataaaatattgtgattaattgttattcaagttcaatcgtggcatagtaacaacagttagtggtatgatgcctaagaattgcaaaaacgaaatagaagtttgaactcaattggccaaaacaaaagtgccagatatgtcatttgtgtaagcagttggacaagtagcattaacaactaatcataactcggtttatagttaaaaaaatgtttcagagcattgtttcactcctaaagtagtgaaggacaaataagcaatatgctataagaatttttcatcaccaatgaaatttagttgtgtgtttgattggataatccactcataatcctcaggagatggaagtacatagaaaaaacctgaagaacataccttaacaacaataattgcaatcacaccacaaacaatcagaaaaagcaatgccataatgcatttgtcagttgcaacctgcaaggatttcaaatttcaggtactgctggacatgcaaaagcacaagcgcacgcagagggaagagagagggatgggggtacctgacggccaatctctttcaccagctggctagccttctttaacgaaaagtgaacagtatccagctcattgccaattctcttcatttgttctgtctgtaaagcaaaagagatttgttgtactagattgcatactaaacacacaagtataccagattgccaaaacaggcatgtcacaggaaaatcttgtatagtatgtaatgtagaaaaacttacttgctgtgatagcgctgaagcagtttgtgttccagtttcaatagtttgtgccacaacctacaagaaagatgtcctgtaaatttgacatgaaagaacattgacaagagtgagtgtagttcgtaaagcaaccatttttgaacggtcaatagcttgatcagtctgagtcatttgttctcttccagcatccatcagttgttggtttgtcatagctgcaagtttagacaggtgattacataagaactaacagagatatctagctttccatagtgtcattgtcagcgtgataagatcaatgagccagcaaaacccagtaataagatttttagtcttgaaataaattcttttagctcctcttcagtttttgagaaacttgtatcttgcaacctaccaggcaaaattaatcatcgtgaagcgaaaaggtatttatgaattatataacactattgccttcaaatcaaacaagataaataccatgcttcatttgcatttccatatagtggatgctgtaatgttacttaaccaaacagctcaaccatgttcgaaactaattgttttctctactttgttgttcaaaagaaaatctataatatagtctacttgtcattatagtatcaaaagttaagaaatcgatccatcacaatactttgtaatttcatatactctcaacatgattgcaagctctgcatcttatgctcagcaatcataaggcaattattacatttaagaagattattagcatggcattaaccacatttgaaaaagattcacatgattattttcacctgatgctatttggatgttgtcctcggcagcaggttcactacttccagcgcccatatcaaagagctcaaccctcttattattattacctaggctactttgatatctgcaacagatagtttgtgttagcattactagaagtaacaaaagacattacagaagaatattgcaggaggtacggatgttataaacaagagcattttttttcagtttaagaaactgggtttcctcccaatggaattggttatatataatacaacagagactaaactagaggttctgtgaaacatatttattcatcaagagaacttgctgacttacgtcttcctcaaggtgacataggaattcaactctttgatctgtacagttcataagaaacttttacatgagtatgcacagatgggctacaacaaatagcatatcaaagggaggtaccaaccatatattgctttctgtcatttagctgcttgtggacctcaggagggttgtttgactcctcatctttcaatatacgatcaaactctttgatcaaactggaaaggacgttttaaaaacagaatcagtgtatattcaacaaagcggaaactctcgtaaatccaacagattacatcttgttgtctgtttaattgtgaattaaaaataataatattaacaccgtatatcaacaaattatggtctagagggtcatacattatggaaagacttccatgctttcatttaggaataaaagaaagctgaaaggaggagcctatgaataggaaaataacaacagtataggcatcaaaaagaaaacaacaatttcgggatagcagactgaagaacgctcagcttaacctaccgcttgcactccttcatttttgctgtgagatcctccagctgtttagcttgcctacttgaatctttaatcttgtccatcttttgaaatccatttctgcaaaaagaaaaaaaataataggaaaattaaaattccctgcaagatcaagttagcaattaataaggcaggtagtacagaaatatttcaaatgtgaccaatatagattcaaacatatgtcgctatggtccaatgttatcaagagtacaattgactttggaccaactcgtactgtgcaattgttaggcatgctcataaggtcaatacgttagtgcttgaaacttgtcccttgggaaacttgtaactgtttcattggaattaaatacactcaaaataagaatggtttcatcaagaaaatatcatgtcccactgaatgcactaaagtttgttgtttcaagttccgacggtactcttatattttaaatctttagctgccatggcctcccagatgtgaatttgaatttgttgattttaagcatattgatttttggaatgtttgaccgcgcaacctataaagtgccatattaaaaaggatggagtgccctcaagattctgaaaagcagtaaggtagtatctatgtggtcacccaccttgcggaaatcatgtggcctaacaggccacttctgcagcctaactaccaactattcagttacaagttgagtactcattccttatacagccttatagagcccttttttttctttttttgaaaaaaaaagaatactgaattatacatcaggctgtcaaaaatatatgtttgtcggatactcaagcagtccaaaaagttcaatttgcaaggcgcgcatgttatcagacaatttggtatctaaatgttccgaaaacaagtcgaagtatactatcattatccaaattcatttagttaaaatcgttgaaatcgcaccggagcaaacaatctgacgatcgcttgggacagattaggcatccagttggctcaaaacaggagggagtaaagaagatagaaacaacgattgaaccagcgtgggttggcctcagcgcagagttgtgtgtgcgcatattaatagtactactagtaagtactgaacagaagagaagagtaacagtaacagtaacaggggagggagagatgtggctcactggagggcgcggaagatgtcctggacctcgccgtcgatctgctcgagctccgggctcatgggcacgtcgctcgccatggccaaaggcttcctccctcctccgagaccgccgcccccaaaccctactatagtagaactctactccagcggtgaagcaccaaccacgtagcnnnnnnnnnnnnnnnnnnnngccgcggaggggaggaaggagaagccgaacagggattggggattgggaggagaggaggagcctagggcttggctccgagtggtggcgtggcgtattagctggggtttagaatagaatccaatctgccgcaacacacaaagccaagaaacgagaggaaaggggacgggaaaaaaaaaactgaaagaaagaaagaaagcgacgcgctcaagcagcttacggttgacagcgaggactctcaagtcagataacgttgttaaacaacaagaaggtcgcaatctatcagagtgtcaggcccaactacctgctgtgctggctgcttattcttcttctgctgctgcgccaatggcatttttaggcccccattgaatcaaataaaaaaccatataaattatagaggattttatcctataagaaataatcctatagattcctttgaaacaaaggattaaaggattgttcctatgaaatgaatcttactaaagcaattttgaaggaaaataagcatgaggtttcaccatgttttcctcttcatgtgtctaagattccttcctgcgtttttcctgtgtgctaatcaaacaatagtttggagactttattgtgttttaaaatccatagtaatccaataaatatgacattttatttctatgttttttctactcctatgtttttttccaatcctgcgatttaagtgggcccttaatttttctttctttcttctactaattactccgttcctaccgttccattatatgtggtaatattttgagacggagaaaataatcttcttccgtacgaagggttttcacaaacttgcattttaggattttgcctgtctgaaacgtactaaatgactttttagccttgaatagtcagcataattaatatttttggtaacaacaacaatatcccaaatctcaaccttaccctttattttggataatgctcaaccttacccttgaaaacacaagctaaatccattaggcatggaagaaaaagaaaagaaacggttgaggcctttcacagcgctccacggtggatcggtgctacaccctgccacgcatgagtttcgctgaggtggagggggagaccgcacccacgctttgtacctcgtccccacacatagcgacgcagtacctgcccttcgacgcgagcacgcgcggctaggaggaggcgacggcgtgtgcggcggagtgggaggaggcgcggcgagaggagggcgaggcggagagacgagaggaatggctggaatcgtcgaatggatagggtcgaccctcgctctaggaggggtaggtgaggaaaatttctttgcccctcccgtgacctcgcgcattgttgggtaacgcccactgtgggcttggtactcttcatcagtgtctctatgcacataatatatgggtgcttgctctgtggggtgagtatctttgagctgtgactttgggctatgggtatgggccccatagcttgtagtgctattgccctgatatgttagggctattttggaacgtaagaatctaaaattactgaaataggaaaaaaattgtatatcttggtccattgaatcctgcggcagataaaaccataaaattactcaaaatagtagtagatgtttggaatttttgaaagaatttgaaaaaaaatgaggccagacctcatgctagaaatcctctaagggcccctttgatttgtaggaaaaatgtaggaattttggaggatttcaatcctatggaaaaaaatcctatgaaggcctttgagacaaaggattgaatcatatccaatcctttaaaattcctatggaatgggtaatcctatgcacattttggaggaaagttagcaagaggtctaaccttttggaacatttcctctgagtctatctctctcatctgattcctgcgtttttcctgtggtccaatcaaacggccattcctgtgtttttcctgtgttttgcaatcctctgttttacaattgtattcctgtcagaatcctgtgtttttcctattcctctgttttttcattcctacgattcaaaggggccctaaaatatgaagggtttttcctatcctaaggccccctttgaatcgcaggattgagaaaacgtagtaatatgaaaaacataggattttgataggaatgtaagtgtaaaacagaggattgcaaaacgcaggaaaaacacaggaatgaccgtttgattgaaccacaggaaaaacacatgaattggatgagagagatagactcaaaggaaagttagcaagaggttgaaactcttgctaaatttcctccaaaatctctataagattgtccattccataggaatttcaaaggattggataggattcaatcctttgtttcaaatggctttatagaaaattttcctatagaattaaaatcctctaaaattcctatgtttttcctccaaatcaaaggggccctaagaagttcttttgaatcaatcctacaagccaatatatcatatgtaagctggaaaaaaatctcaagaaaaaaaaggaaaggagggatagagtcgggtgtaatgggccatatcttatttttgggctcataaaagaacagtctcaccattgggcctccaatgataaacctcttctatccgttcgattccgttccgtcccggcggcagaaccgctgccactccgtcatgtttgagccggtgagggtgaaacactaaggagatgtttggatgctatactaattttaccactattgaccatacttttatgccatacttacctaagttgtggcttacaaatagtgacccgcaccttagctaacaaaataggattgtgccacactttgttgagttgatgacatatggagccataatggatgagaaggaatcttgccacaagtgtgactatgaacgaaacaatagactaacttggtaaaacttgcctaacatgaggtgcggcaacctctggagtaaaccaaacaacccctaaggtttttttttctttttgaggatgaagcagttaagtttagacgtggttatgtatgttatctatttgatagccgtcatctggtttatttctttgactataaaattcagttgtaaccccaatgatcctattaaatttgaattgttgcagttttgcatttctgctttatggccattcgacaatgaacctatgattttgaggagcttttctccgtttcagtacagccatctgaagggtgtccttgttacaggatacaaaggggccatagagcaacctgaatttcttgcacatatcgcggagctattaactgttgatacagtcgaagcaccgtggaatgatatctttggatacgtcatacgaatcaagcatcagcttagagcaccattttcgtcaaattgcagctagttaccttcatgaaaggctttcacctgcaacaaagctttgtgttgttaatttcttattgtgtttcttaatttcttcttcattggtgcacctgctatgctggacacatggcttcgacaggcttggtgtttctttgggtttttgcccagtcaaaaaaatgactctggataataccactggttagtcttgaacattttgtgggattctaatgatgaacattttgtactccgacactaaactctacaagaaggttacttgatggcaacttaattttgtttttatatttaagctattgttcatagacaaggagactctagagaatgcttttatgctcaaattgtagcatgtttacctgtctataggccagcttgaatttcttgttcgtatcgctgaaattaaaaacacccctgggctggagttatcaactgttgatacacttcaagcaatgtggaatgatgcctttggatataataaatcaaatattagctcagtgcatcaccatgctcgtcaagtcgcagcttaccttcgcaaaagacttgcacctacaataaaacttgtaatcaaatccactttctccgagaccttggatagaggaaaaccagaatgtccacagctaaagtcattctcaacccaagacgctaggcatagtttccataaactccatatcatcaagaaactagtactagaaactaatcttccaatgcaaacgccactattttatacttaaatttaatgctacttatctcacatgatgtcttggatgttatgtataaaccatgtcttattcaagacatggtttccttctctttcctcatttattcacttgctacgtcattttttattctatgtggcaacttatttaatactatggacaccatcctagtcattgggttaggaatgacctaactgcctcctcctcctgctgctgaggcaatggcccttaattttgtactacctccatcctagtttagttgtcactttgactttttctttgtaacatttgactattcgttttatttgaaaaattagtgcaaatataaaaattgataagttatacttagagtattattgataacaaagcaaatcacaaacaaaataaataataatttcatatatttttaataagagaaatgatcaaaagttaaaaaaaaactcaaagtgacaagtattttggaacggaggtagtatctgacaatgaattacctgattatttgctgatttactcaaccatggagtttcacttaatgcctgatgatatttgctttgtttgttctttgagatgtgtattgttgcattggccatataatacttgtccaatttgaactattgcaaattataataactaaaaattgtgtacaagtttaaaaatgtatacccatataattaattttaattctagcaattaatattaaactcgctaaaaccagaagttgacagttgacgctttatgttcaacttatttatataaatgttcctcttctaaatttgtacaaaagatgtactagatatgataaaatagcaataaattacagaaaatagcttaagaattatctaagctaattaattattacgtgttaaatactcaatatacacaacagttatgtcgcgcaaacaccatgcgtcttaaaaacctacatgtatttatccaaataattaacattctgatattacatataaaatataggtcatagttacgtaaatgcgtgacttaacaggctagttttcttgtgcagtttacttgatggccacttattttgttttttttaattaggctgattatttcaaaagaatgttttaagttgaaattgagtaacgagagagctatgtctcgctatgcagacctcggttgtcagccataatcacgaatagcgtcataaaaaaggaatgattagctgcaatgtcaccctcaggaaagaactttatctatctcctgttctgaaagaaatatgaaagtggagcctttttacaatgaaagcactaattttcactatttatgatcatacaagtgtttcagctagctgaggtaagtcaagggtcaatatatatatatatatatatatatatataaattttcattcggtccgtgtccccgaatcttggcaactaatggtacacacgtacgcaggcataatcaaatatagcgttcatgtgagtggccatgtgaagttatagtttggcatcaacttcttcagatgtttaacatgtatcttgtgagcctttcatacatcttcacgataaatcttcaactttgttagttatagaaaatagacaataacagactagctgattattaagcacatgaaggctgttgttaattagcagagttgtaatctgaaatcaactcctagcagtctgaaaaagatgaactgcgtgtcacactactagaaaaagttttttggcagcggccaaaaccgattttttcaggcggaggggaggcccgcctgtagcccaacgattgatgattttcgcagtcggggcaatggcaatggccccgcctgctaaaatgcgttgaaaaagcaaaaaaaaatcgcgggcgctgccgccacgcgccttgttgccgccgccctcccctggccggagccgcgccgggcgtcgtcgtcgtcgccgccgccccacgccgttgtcaccgccaccgcccccggtggcctcctccctccctcctccggccagatctgggagggaggggggaggggagccgccgccaccgcccctgccgacctgcccctccctcctccggccagatctgggagggaggtgggaggggagccgccgcagccgagccgtcgtcgccgccgccgccggtagagggagggaggggagggggcgcccagacgcatgttgaggggaggggaaagtgtttgaggaagagagagagctgagtgagggaaataagtgatggggaggggtggaggagaagataagacttataaatttttggggtaggtaccattttcgcagatgcggtttgagtggtccgcctgcgaaaatgattttcgcaggcgtcgcttaagtggtccgacagcaaacttcatcctgatttatatttttgtaggcggtcatttgactttaagggttatgtctgtctgtggaaatcagacatctacgttgagaaaaatatattttatagtagtgtcaggctgtcagcaacccatgaaatggttaacaaaaggctaagtaatgcgactcgacctaccagaccccaaagtaggttcgtaactcatcagtatactagttagcatctccacgagtatacttgattagcataagataaacaaacctgactgaaatcgagagtcttattaaaaagtactgactgaaatcaacttgtatttttgctcctgctctttataccaacagcgtcacacctcacacgcaaatttacacaaaatttgacaatcgaaggccaattcgaatactcctatctctgaccaaacgcacatcttaaatttggtcacaacagacaactacaactcctttatatatatacaagtccaatgcaaaagatccatgtagttaagctgcgtaagtagagtgctcattccgtctcataatacaagagattgcactgtttaaccactcgttttatttaaaaaattttagaattattatttatttttttacttactttattatccaaagtattttaagcacaattttttgttttttatatttgcataattttttttaaataagacgagcgatcaaagagtacaaataaaaaatcaaaatcccttaaatcatgggacggagggagcatatgttaagctggtaatgatctgatcaaaaaaatctatgcgtcgtcaaaattgatcgaatcgagagttcgtttgcaaaggcgacaggaagatacacacgctttgatgcatgcatgtccgtgtaaagatggtgttcttttttttttttatgacacgacacggacaagtgacgtggcgatcccttgtccccaccgatgggggaaaacaagcagctgcatccaccgttttggaccggctggggccggccaagtcgatccggcgtggcccatccatccgtccgagtcatcccgcaaaatccatcccccaacaagtggcagatggtgtgcatgcatcttcactcacacactctctacaaatgtctacatcgtcgatcaacttaaagtgaaacaaaattaccggagcatttatatgtgcttaattatggcatgtgctcggaagataaggttaggaatttcttcttcaatacataaagtggggtagctaattagcacatatttaattaagaatagttacgaaatgaatcaatacgattttaaattacttttctaacttctttttcttttacaaaacacactgtttagtttcctacaatcacacgatccagcagccacagagccagacatcatggagattatcccaaagacccacgcacgattcgccacgtcgacggtgaccccacctgtcagagacaccggcgccccccgctagattccttcctcaaacgtcccgtcgcggcggcatcgcataccacggggaccacgcgcaccccctactgtagtctgtaccctacgccatcccaggaatccgcgccctgggccccaccaccctccccccgctgacgaggtggggcccaccgccaccgcgctcttctagtagcccaaagctcctcccccgctgctgcttcttccacgcgctcacgcggctcccgttttcgcggctgcgttttctcgctttcgccgcagctcctcccttcgtcgtccgtacgacgccggccggccgatgcgccgccggtccaggggcgccgcggggtggtgctgttgtcggtagggagggagtgggggtgggtgg

SEQ ID NO: 76908 - DNA, 12744 bp, Oryza sativa
cggtacatgatggagttcggggcgcgccccacggagaggaacctgctgcggtcggcgcagttcctgcgcagggagctccccatccgcatcgcccgccgcgcgctcgacctcgactccctccccttcggcctctccaccaagcccgccatcctcaaggtgaccacccccctcctctcttttctttccccaccagagaggatgagaggaggatgaggagtgctccaccgctttgcgtttctctctagatttgggccaaccagtgcctcgacttttcgggaagattttttttttttgctctccttttggagaaatccgatttgggactgggattttctatgaagttcttttttttcccatttgctaaaagtagtagtactagctttctagtaggagtattggttaatctactgggatgtttatttgcgaccatttttaaaaataaaaactgttctgttaggatttagtgatatgttcttccaactcgattgttaaaattttaataaattatcaccccgctccattcctctttttggtgagttttttttggaggaggaacgggagagatggccagtgttgagacggcctcatttgttggggaataacaaattaaattggtccttctaaattatagtagtatctgttttttttacggaaaaccaaattttatctgttgtgttgctttcgtttaattacgcagatttttgtgagtggtgaccgtcaattctcgactaacactgtagagtagtttaaatgtcacactctttcatatcattcgcttgaaataacatcaccgaaatcttcttgttcaatcccagccagcttttcaaattttgctaaattttccatttgtttggtcgtttcagttcttcggaagtagtgtagcacagctgtgttttaggactagaggaatttgttaggttccttctcgccaacttgcttaaatcgctagtgtctttttttaaaagacgcattgactcctcgaaattatcagctcggccaatctaaaggccctgaacttgtcaaattgtaaattttctaggaggatttgcaaagttgagtcattatgttcttgccagggaaagatccatttgcaggactaacttttggtctttctccactgtgaaggtgagagattggtatttggactcattccgcgacttacggtgcttcccggaggtgaggaaccgggatgatgagcttgcattcaccgagatgatcaagatgattcgagtgcggcacaacaatgtggtgcccaccatggcgttgggtgtgcggcagctgaagaaagacctgggtggcacaaaggcctttccccctggcattgatgagatccatcagttcctcgaccgcttctacatgtcaaggattgggatccgcatgctgataggttagcagattccgcatgaagtatttattaaatgatgatggaaatggaatctatctactaatataatggccttacttttaggccattgatattccttggcccttgcctgctggataaaactggctaaaagccttgtcagcacttaacaatctggaaaatatagtttttctttgcacatgaatattttatttattttggtataacatgttggctatattagagcagcaatagctgtaatgtccaatcaggatgtctttttcctcagaatgtggtgattagaggatactcaatcatatcgttctagcttcttgtccagaaactaaagttaccacagagcagctatcaaccatttacggttacatgtcaataagaataatccttttttactttatttatgaatggaagaaattgtttttctttttttgatgtgaaagtgatgctaacataacaaataagtgacaattgctactgcacttttttttactgagttgtactaacttgcttgatttcagggcagcatgttgctttgcatgagcctgatccagaacctggtgttattggactcataagcaaaagattatcccccatgctggtggctcaacatgctactgaagatgcacgtgctatttgcatgagggaatatggatcagcccctgatgtgaacatatatggagacccagatttcacatttccgtaaatccctgatttaaatacttgctacatgtttttgtttaatttgatttaatagcacttcattgttagttcttctttgctattagaaatatttgttggccacctagtttctgttgtcatttaaatcttccatgacttctacgcaattgtcaactaagctgctctgcttactagtccatgcacaaatcacattttttggccttatttctgtttgtcagaaaccactctagctgaacaacctctatactgaattttaatcagaatatggctgaaggacaggaagtattaaaacagttgtcctgaactgctttgccttcttgatttcagatatgttaaactacatctacaactgatgatgtttgaattggtgaagaattccctccgtgcagtacaggaacgatatatgaactctgataagcatgcgcctcctgttagaatcatagtcgctgatggagcagaggacgtaacaatcaaggtatgactccttccccaagaattatgctgactttgaagtgttttctggactcaaatcatgctagcagatatcagttttcgcaatttttattgatgtgtaaacaatacacagtagtgattagaaattctgagctatttttaaatatggttttgagtttatttaaatagtatggtggtcactttggtcttgcagtttctgtttaaagaaagactggtgttgcaatagcatagcaagttctgctgcattttctaaagtgatcgttattctgtgctgatagtaataaggtcattactgttacagaaaattgggtcagtttttatgtgaaagcatcacccatttctccctttatttttcatgttcttctctctttcctagtttctccgcgtatgatagctttgttgtgactttttatatagatagttcttatgtatatgagattacaaaaagatattacgggtttatctatctttgatagtttaattatttgcagttacccaatgtatttattataggtacgcctatttcagttagaacctttttggtgcagattagtgatgaaggtggtggaatacccagaagtggtctctcgagaattttcacatatctctacagcacagcagaaaacccacctgatctggatggccgtaacgaaggagtgaccatggccgggtacggctatgggatcccgattagccgtctttatgctcgatattttggcggggacctgcagatcatttctatggaaggatatggtatgtccacagttcactttctatgtcctgtgaattgaagctcttcttttttatatggtaaagaagagtaatggccaaaagcccaaaacccttgggatttggaggctttcatctaccatgcgttctctctctataatcttcataaactgctgtgagaacttaccactcatgaaacatgatgcagatgttatactatcatcataattttgcataaacaagacagtttcatcatctaattgactgtcattacctcttttgtgtaggaaccgatgcttacctccacctatcacggctaggagattcggaggagcccttgcattaggagatctggaggaggaaaccctttgcctcagttctgataccactgctgtaattaggatgctattgcttttaccattgctgtgctggtatgcaaatacatagttcccaaggccagccagctctatgtgcttccagtttgctggagcgtgatcataattcagatttcagaatcccctctggttcacattgccattagaactcgttatccctcgccctcggtggctgcctgaaaaatgtgatgtacagttgtccgttttcggagttctgcatggggagtatcttttttttcagagttctgcttctgcgatttgggtaagcaaggatattgttagaaaaaaggaatttcttgttttgctcagataaaaaaaaatcgggggctgctagctcccaagtaaagtaacagcctgacatcttcggaccttaccttcctatcgcggcagccggtagccatgtgttcggcagtgaatgtttctactacggcaaattttgctacaggacatcgcgactttgtggttttagctgtaggacactgcacgtagtcacttttagaaaaagacactcaaaatgtggttatttgccaagggacaaaatgtggttatattttgtttatgcaataaaatattaatttctggttcaatagaagagataaacagtgtaaaaggtcaaaaatgccctcgggcccacttgtcatattcttcccccaccccaaacctccctccttgcctcctttacccccaccggcgacaacatccttaccccacccacggccacgagcaacgagctcggcactgggatgggcggccaacttggcgcagggggaggcggcgtgcgccgacagcgcccacggcggcggcctcgccgtagctttgccacgaatcgaactcacggggtcgagatgaagaagcggaagaggcgcggcagtggcacctccgccgactttgaccggagcgtcttcctcatcctgctcgccaccgccgccgtcggacagcgctaaccagtgaccccgagcagcctccgccaccgcttgtcgccgtcccaccgccccaagctgcgtccgccccccggcgctgtccaacgccctcctcagcgccgcccaccgccgccgcatcacgcgacgccctcgtcggcaccgcccgtccccgcgcgccaccgcccacgcccgtcaccatcccgccgcccgccgctgctgcatcacgcgacgccctcgtcggcgccgcccgtccccgcgcgccgccgtcttccgcgtgtgcctgcgcgccgccgccgcccacgcccgtcgccatcccgccgcatcacacgacgcccttgtcggcgccgtccgtccccgcgcgcccccgcccacgcctgtccccacgcgccgccgtcttccgcgtgtgcccgcgcgccgccgcccatcgcccacgcgccgccgcccacgcccgtccccacgcgccgctgcaacgcctcagtagcgacctcgctgttaaaggaggaagagaaagagagaagagggcaatttggtcatgccacttaaaaaagtaggcccctttctcgcttagtcagcacaaaaatattaatttaatgaatggagtgtcccctggcaaataaccacattttgagagtgtctttccccaaaagtgactccatccggtgttccacagctaaaaccaaaaagtccccatgccctgtagcaaaatttgccctactacttatcgttatctgtactcacgctttcaagctagtattaagagcaggtacaatagcagattattagccagctataaacatattttaatgagataaaagatgagagagaagagtaacaggctacagatttatagccagctgcaccgcggactccaagaggcaatgtgtgtataacaggtgggaccatgtattaatagtatagtaagcaactattgtatgaattggctatagatgaattggagctagtagtgggctatactattaaacttgctctaagggggtgtttaggtgcatgggtgtaaagttttggcgtgtcacatcgaatatacggatacacatttgaagtattaaatatagactaataacaaaacaaattacaggttccgtctgtaaactacgagacaaatttactaatcctaattaatccgacattagcaaatgtttactgtaacaacacattgtcaaatcatgtagcaattaggtttaaaagattcgtctcgcaatttatacgcaatttgtgtgattagtttttttcatttatatttaatactctatgaatgtgttcaaacatttgatgtgacatggtgaaaaattttgccagaggatctaaacatgccctaaacaaaaattatataggaaagttgtttaaaacaatcatattaattcatttctagaggtctttttatctgaagttacttaaccatgtgtcaatctgtcgctctattttatgtgtacgaagggttagtttccaatccatactgaagaacacagttatggatgcatttttagtcaaagcatatgtatcctttgttggcacactgacaacatgcatgcgctctaaaataccagcgtaggtcaagagttacacatggactctatccaatagcattatcacggttttatgtccaaccattattctagtagaatacatatattcaacacgaactatctccttagatcgtctataaaaaccgcctattcataattgtaactgtactcaaatttgatgaataaatttccactacatatctctcatgtaatacaatgaatttactataattaagttttatcacttatttattgtcggtagcacaatgtcaaagttttcggttactgatcattcaaacagtacaacagttgtattaatgttacactattcaaatctcccgccatgagtcaagtagtggatgagtaaatgacaacgtcaagcctgaacaacaaagagtattccttcttcgccagcaacattttacaagtattttcgttctacaacaacagatatactgagcctgggtacgcaaccacttgattagcacggaagccggccctgtcactgaagccgccaagttaccttgacacaactcatataggtgaagatcagtaaaacactagaacatagcagtgggcctgtttagaagaatttaagattctaaaagtaattggttggtaaccagtttttaagaatttaaaaaagctgagtttcccagcttctgactactagtttattttatggattctacaactacaccaataaaaaagtcacaacaaagctatcatacacgaagaaactaggagagagagaagaacatgaaacataaagggagaaatgggtgatgatttcacataaaaactacagcttctagaagttaaacggtttagtgagcatctaattatagaagaagctgcggtaactagaaactcccccggacagaccctgtgtctttgcgtagccgtgcccttatcgatttcttagtggggaagagttgatatgatccattcatcttccatcggacggcctacatcgactacagtacaggctcacctgtctccgactccgattccttctccgcggcggacagcgccggcgcaccaataaaaagaggccccacccggctggacgacgccttccggttttcccctcccccgcctgtctccggcgccggcgaaaccctaaccccggcagccacggcttgccacccgaggcaatgggggatcgcgcggcggcggcggcggaggcgaagacgtcggtgtggtgggacatcgacaggtgcggggttcccccgggctgccgcgacccgcaccgcgtcgcccacggcgtcatcgctgcgctcgccgccgcggggtgcgcgggccccgtctcgatcttcgcctacggcgacgccgcccgcgttgccccgacagtcctggccgccctctcctccaccggcatctccctcaaccacgtccccgccggtatgaatgctctctttccgtcaaatatagcagcatctgcacttgctcactgcgcgctactggtgtgaaatccgcatcatatttagaaggctattgatttttccacctccaataatttgcaggagctaaggatggaaccgacaagaagatgctcgtcgacatgctcttctgggcattcgacaacccgccgccgggcaattacttgcttatttcgggcgatcaggacttctccgacctgcttcacaggctcaggatgaagcgatacggtatcttgctggcgcagccctcaaatgtgtcatctcgagtgcttgctgcggcggcgaggactgtctggtcttgggaaaaacttgtggctggagagtctctgttggtagagtccacacatacgcatggattgccggattgcaatcctaaattaaatagcttggatgtatcgaagtgctcgcagaataagagcttggatgcgtcgaagtgttcgcagaataagagcttggatggatcgaagtgctcgcagagtaagagcttggatggatcgaagtgctcgaatagtaaagttcatgctgtgtgtggtaacggtgacagtaatgtgaaggcatgtgatcggtataaggtgaagcctcttcaaaagtatgtaaagaagactaatgcagtatcgagttccacaaataaccaaggtcaagtagtcgtggtcgatggattttctgatgattctgcaggaagcactggtagtgagcaagataagagttctgtttcgtcatcgtcatcaagttctgaatcattggaggtcgatctcccaagtctgctaggaactcctcctttggctgacctcccaagtctgctaggaactcctcctttggcacagtcatcagctcaggagcctgtggtgtctactagttctcaacaagttggaccattgaacatgacaggtaagaaacctagcacatcagtcaaatttgtaccaagaaagggaactgttgatcttggtctcagtaaacatcatcaccaaatgtttatgcaatcacaatcgtctgaagtaaagagtaagcttcattctgagtatgatatagctgaaaagaatgcaaagaagggtaaccaaagcaagtcaaatccaattcaaaggtatgtaaagaagacaaatattacatctagtcctgctagcaatcagcttgattcagatggaatgcctgagtgttccacggggaacactccaagtaaattgaatcagttgcctgtcttaccaccaccaaactctgaatcactggaggaaacaaaggtggatcactcgagatcgctaggtatttttaccttgccccagtcatcatctcaagcaccagtgctgtctactcatttgcataaagtggaagaaccacatgaactgattgttggcaagcagccctcttgcacatcaactgagctcgcatcaagagatggaaccaatgattctcgtgttagtattggacattatcattcaacctctatgcaatcccaatcttctctggcacaacatacgcttcattgtaactataatatgggtgataaggttggcaaggcaaaggcaagaaatcagcataaggtgacacagcgtcaacaatatataaagaaggcaaatattgtatctagttctgcacacaatgaaatagatttggttaaaggattttctggtaattctaaaggaagcatcttgagcaatccaagtaaatctgtgttaacatcgtcaatttctgaatctctggaggaggcaaaagcgaattgttcaactccgctgaaaaatcctcccttctccctgtcatcagttaataaacctgtcacacctactgatttgcagcacctgggatcagagttcatctttggtagtaatcatagcttatcaactgaatgcatgccaaaagatgggattttttattttggtgacattaatggtcagaatagtccagcatgtcagcaagcccattcttctcttttgccagaaatacataaatcaattcctcctagtgcagctggccattctaactcagtaaattcagatgttggcagctcatacccaacatcaactgggtttaatggtgttccttctgctcaaatacaaacatcgccaagcggcttaacctttcaaaacatgcttgatatttgctctgatttcagtagattgactatttctgagtgccctccaggaacaagtgagaaaaggccaccttttcaaggtattccttctaactatactgcttttggtatgccaaatacttctggacatcttagagttcctcatgagatcggatccactttccatcctggttctgtcgtcagcttccatccgagtcactctagtgctcgtcagtgtgcccgatctccttcctgcaacatgcaaaacactggcgatcatggagagacggaaggctctccaccaagttcttctgagcctgaagttactataagaaatatattacatgctttgcacatactgaaggctgagaagatattcccaacggaatcaaatattgcagactgtatacgttacagcgagatgaatatatcaggttttgatgttaagaaggctcttgagcttgccattcgacatcaagccgttatcatgaagaagttagtaaatgacatgccattgtttgttgcgaaagatgaaagcatttggaaatgcgtcaatgtgacaaatagcaatgcaaagcattcgaaggagacactagatgcggttcataagtacatatcatccactgatggttggtcagcaatgaagaattctcagtcaaggtgaggctttttaaaatccattcattcttttttgtgttgatcatttcatcttctgttctttgacacgccattacatgttctccctttattggtaggtaccaagctgcgactattttaaagaaatcgtgcttgcagcaacatgcccttggtgatgtcctccagattttgcaaattataattgtaaggaagaaatggcttttgcctcattcttcaggttggcagccgttgtccataaacacaacagtagttgatgcaactgctgtcgctgttggagaagctagatcttgattatgttctctgctgatgttggagggatgttttggtgcgctggtgaatggcgactacaaaatatcttcagcatctgcgttggtctgaaggttatctgaatgccgcaataatagtcaatctaaattctacggtaagcagttgggcggcaccagaagctgtcaagactttactagtcccttatgggaagattatgccccagatcaatggactgtgaagatgctggttttgcagcaattcagctatcaaattggttctatgtcatcagcaagatacacagtacaagagagagcttgtctctcttcctagttgtgtaggattaactcctagttgtatagaatttcctcctagttgtatagaagtgcctgggggcttagaagacgattggaaaaggcttatctgttactacgtggttgcagaactacattactgccctgatcttcagtgatgtggcagcccttggattagcaaaactccagtggttctattcccaggaactggtgccctcttagcttgatggtaagcatctgaaacgcacccagagcagctgcaaagactgcgaccgcaaagaagccagatcggtaacttgggtggatgtttcagttctcatcttgctttcacttctcttttgatgagtcctgtcatgtggtactaggtgttgggtgtgcaacttgtcatatggtgttgcaactgttcaaatgtacttcaccttttttttcgtcagtttctcgcataaataatgtcagtatccggggctttgtttggtgctttttgtgttctgatcgatgcaactctctgtaactgtactcctttctgtctgtagcaatcactattctctctacacatcacatcatcatcatatcataattcacagaggcatttcaagatgttccattccatgtgcagtgcagcactaactgatgaggaccaggcaactaattaaattttgcacaaaacagaaaagctttttgatgattctgataactcaattatttattcatactactaattcttatgtgacagaagcagagaatgtgagggagactgatgaatatttagcgacctgaatcagaatcacacaaggaataatcataataatacccctactgtcccaacccctcctgctaatcctatctgcaaaacaaacaccttcatcttccttccctgtcaggctaagcgacaatgtactatgaggtgctgacgtcactgcgtcgccggcggcgtggacttgagctcctccagcgccgtcctcacctggtcctgcagcaggtcgatgcgccggaggtacacctccagctccaggatccgctgctgcctccacctctcccctttcatcgggatccccggcgccggcggctccagcgacggcggcgccatcccggcggtgagcatggcgcgcaccatctccttgaacagcggcgccaggatgccgccctacgcgttcgccgccgacgacgccgccggcgaggcgggatccacgccgtggacgtgcgcggtggcggtgaccgccgcgccctgcgggaagaagtgcgggagcgcgtcctccgccttgacgggcgccggcgcgggagccggtgggtaaggctgcggcggctcggatgcgtctgcggcggtggcggtggcggcggcggcggcggccgtgcgcctgcggcggccgcggcgctgctgcgctcttgtggaggaaggggacctgacctccccgttggccggggcaggaacggcgacggcggcggcggcgttcgggagcgcgtcgtcgtcggagtcggcgtcgcggccgtgcttgtcggaggtggggcgccagatgccgcgggcgatctcgaagatggcctgctcgtgcggcgagcggaaggagaaggactggccggtggcgcggaggcggtcgacgcagttgcggtacttgcgcttgaggcggcggagcttctcgacgagcctggctcttggagaagtcgagctggaggcgccgccgcatgtcctcgtagaacgggtccgtgtcgtactggtgcgacgcgaacgccgtcccgcgctgcgccgtgaactccgcgaacgctcgcaggatcacgatctggtccttctccgtccacagccgctggaacagcggccgtcgctccccgcccgaccccgaccccgcgccaccgtcggcggccggacccgcc

SEQ ID NO: 76909 - DNA, 683 bp, Oryza sativa
tagctgtaatactatgttccactgcagagaataaatcaatagaatgcaaaaaaaacctctgaacgaagatcgtctactgatgcagctgaaaaggttggcaccagatcagctccattgatgactgtagtgataaaatgcactcctgattctgccagatcccatgtcatacaagcagctgcaaaatagagcatcaacaaaacaataaatcaatcccaatattgcaacttctgtattggagatatggtagtccatcaacattttgttcggagtttgcagtggaaaaaactccatgttcttaagatgcaaatatgcacatggctctattagattcgacaggcctaacttctaggagaatcaaaagtaagcttccaatgagaattggggaagaagagttaagtttatatgagattctaggtagacaacaattatgtttatgatagctccaaacaatagcagtttcaatcttaagatcattaaatcactatctacaccataagttgatctaaaaagataaggattggaaccattgtactcaaacgtgaggaaaaaaacatgtttacttttctgccccaaaatattaagatgcacgtttcaaatacccaaagaaaaaagaacttattcgtcaaagagatatctagtccgttatcctataatgtttactgcatgagatgcaggtttatgtt

SEQ ID NO: 76910 - DNA, 763 bp, Oryza sativa
ttctgagataaagaacctccagatgttggatataaactccccatcatgttcagcatttgaggtgatcctgatatcagaaatttaaaaaaaagaagaagaagctgaatgaaaagactcacgggctttcacctcaatagatataagctaatacatgatatacctcttgttaaacagtaaaatattatagatacatgacatcacaaacatataaaatataatgtttctaagtatttactcagcatcatattacttacataaatcatattgtgatgccaaaaaaaataacagttataaaaataagcaatagatattctagcatccgatgcatgcatgccaggaggaggaataccaatatttcctctaactctgacacctatcaaatgatagtactgttggaattttcatttctaatcttaatcctatcaaatgcaaccgactggtgttcttttaggacgcagcgcgacagcagatgctaagattgaccaggttataactttggacgttacaattacattacaaatgtggtaaggaaacatgaaagagattgtaaaacataagctggactgtgttggataaacagtgaaggcaccaattactttcagcagataggttgtggttggagcttttcttcaggtatgactgatttaggtgggaagcttgttaaggtcctaggatttttcttgtttctgatcatgatcccacttaccaaaacttttttgtttgctcactaacagcacaaggatcctacttttagaggataaca

SEQ ID NO: 76911 - DNA, 3584 bp, Oryza sativa
ctatttatacagtctgttccataatttaccttgctgaagaatgccattcatcatcctgctggatccttggacattcagaccgccactgccaacattgccactcaaattcatgcgtgatgctatgcttggcacagataatccaccagagcttatattccttccaatgttacttccacccacaatatttcctacagaaccagtgatcctaggacccaaatttcccaaagatggagatactgacatcccaggaacagaattacgactaccaccagcacccaggtttgaggataagccttgaatggtaccaccaatattcaggctactactaaatgctggacctccaccaacattcaatcctctactaccgactcctgaatgaccatgagggatctgcaacaaaacagtaacatggtgaggttacacgatcatttcaaccagcaacaatgtaccttagtttccacaagccgtcagcataaacaataaaattgcaatatggatgaaggaagtcattacaacctgggacatgccaactggaaggttgtttgaagcaaatctcccaggcatgctccctccaggctgttgaaccccagaggatggaaggccactcatggcagcattcctctgagaaaacgatccaggcatatttggcatatttaaacttccatgcatgttgtgcaaaccttgaaaaatggcaagaagatttactacatgaatgtagcattgtgcgaacaaactaaccaagctattttactatatgctcaccagagtgatggaaaccccctggaactgatccagattgaccagaaaaggaccctgtaaacggtcttccagttgagtcttgaagatttgatgcagaattgttcaggtttgactgctaggaaaaaatggcaagttgtcaaaacaaagaacaaagcaggtcatatggaattgccattatcttcaaaagcaaataccatgttgggttaagcagcagcataaaagaataaatagtgcccaaccaaacagattatccaccacagatatattagctctgtcccataatataagggattgtggctacgcatttgcatagacaaaagccccttatattatgggacggagggagtagctgataatgcagtgcctgtacatgcatagcttatttaggcaatcaatgctaatattccctgccatcacagttctcatatggaagtgtcaggcttcaaatttcatatgaagcatctcaacacagaaaactcacgtaaggatggcaaagaatggaagaggacagtgccgcagttgtaagaaataaatgtgtgtataaaatataaataaatcaacactatgttataacagaggacaattatcactttatcaggtgataaaagacaaatctattgctcgttatccacgcgaagctgcagcataagcaaactatttgatgaacaaactagtcagagagaaatcaagtaaaaagtttgaaatggaaaatagggatatcaagcgaaagcacaataatcagttgtaaggataagcacgcacattcagcaggcccgacattgtgacagcaacaaaagcaagtcaatattcaacagtaagcagctattccttccaatctgaaacagaaaatgatatgtgtaagtagtttgaacaaaatggatgaatccacagaaggtgctagatcactaaaactatgtagtatgtatgactccaagggtgaccaaacatttatatgtcttttataataataaaccaacgagtaagcacagagagcaagaggggtaaataatcggtataagattgattacaccagtcttccaataacaaacctagaagtaaatcatcacaccataaaacatactagcaaattttaacggtaaaaagtccaattaaggataattaagtcggtgccataacatatgcagattttaacagtaaaacaaggaagttaaacgttatcatccaactctttaacaatttagaaacatgattagcgccatcaaccacgtagtatgaagagtaaactctgaatgcaggaaacgccaatccacaatccttgatatcaaacgagaaagttacaaaatccccactatccacccgattctccctatcagatctgcccccgcaagtagtagcacaccgatctcaaccctccggcctccactccactctcccacaccgaaatgagcaacaaaccaaaatccaatccctacgaacgtccaggaaccctacggcagcaaccgatccgtttccggcctaatccaaggccccaagcgcgcctgggacggatcggatggggtggaattccacggaacgaccagaattgggggcaaatcaagagggttagggttgcctaccgagagagaaagagggagtccgcccgcgcctgcggcacgagcagaggaggaggaggatgagggatcgggcgcccgccggtggattcggcggaggcgggagggaattcggcggcgcgcgagaagatgatccggtgggttcgccgcggcgcgcgtcggcgatggcgcaggggagggtgggaggagaatggagcggaggaagaagaggggtggagttgggctctctgggccgtaagagcgtgatggattgatgggccagatactttttcatgggccttatcaagagggagggagcagtgagcacggagcacggttgttcgtgtttttttttatcatgtttcacaccttatactctcatgtttttcacactcacatttcctaagctattaaataatatttttataaactattctgtaaaaatattgttttaaaaattatattaatttattaatttagtttttatctactatttaattaatcatgagctaatatatcactttacataactgaaagtgtttctaaacccttcgaaagaacacggccttaactcccaaggagattgtgagaaagtttgttttgttttccgcgtgcacgcttctcgaaatattaaacggtatattttttaaaaaaattatatacgaaagttgttttaaaaaatcatattaatctatttttaaagtttaaaatactttatacttaattaatcatgcgctaatggctcacctcattttgcgtatcttctcaatcttctccaaccattttcgtttgagcttagacttcttggctacatgtgccttttaagctttaagtttattggtggaatatatcttaactttacattttaaaaaaagctactcaaacttagtttttagctttaacagtgtaagggtgacctgtggttttaaaaaagtcaaacaaaaagagtgatggtttatttggacttaagcttttttaaatatggcttaaaaagcctaaataaaaaggaccttagctcattgaagactctgtttagaccattatttgtgctattgtatagatagggcagcatactatttgtgctattgtatagattgtttaaagaattgtattaattcagtatgcatatctaaatatactgttatacgtccaatgttctaatgtgtaaatataaaatggaaaacttctatagattggcagttatgtataccattgcatcccttttcaactcttagaaccgtgatcaccccacccctattgttctgtttatcatag

SEQ ID NO: 76912 - DNA, 14890 bp, Oryza sativa
caaggataacccatcagataatcagaaaccacaatcaataaacatcactactatttagaaaggcgccagaataaaagttattaagcatacatgtatcaaatcatcactacaaacttcaccattcactagtggactttgtagtaatctcttacagatgtaggatcaaacttgtttgtcacaaacatacatgctaccaggaatcttacaaaatttataggactcagataggatcacaaaccaaaagtgttctgtccaaattatcttcaaggcctgatacggcattgtgcactcttctaatcacatcatccatctccttcagcttttggggcatcaaaacactgtaaattttaaaattttaactttacttagacaccattcaaatagaaaaaggcatggaagatgtatggtatttacctctgacggccaccaatgtggccaacatgatctaagcccaaatagtggagaatctgaaattaacaaacaaaacaaacctgattagtacataagaatagaacacttgcaggataaccttaggaaacagcacaaacaagggaagacagtgtaaagattgttagaacacttatcacaagaaacattaattggatacttggaataaattgttgtaatccaaagacctatattttactataagttcacaaaggaatagaacaagtgaacatgaactaagccaagaacataccaacatgttccagtctttggcagcaaactcagattccagatgacgagaaacattaaaatcaacctcaaccgtatctttcacctgacatccagtcacaatcattaaattaagttatacaggtagaaagactgaatgcaaaacaaagaggactgctattagcctattagcaaaacccaagcaccaaatcacaagcttaaaatacctaatacacaaatatctatagttggcaacctactgttagattagagtttcacacgatagtaagtttattttatcagtattccaagttcaagtacactctcatctttcaatcacattatcttgtgaaaaaaaaagcatgtgatgcatgagaggaactcacataaaaactgctcactccatcttgtctccagaataattttgggaacaatttgatccatgtctcatctcccagcatcactaacttataaccaatcatgtggagctgatctgcattggtgtgaacatattataaatatagctcataaggcattttcttgtttggtcaggccagaactgatggatgacgcagaacacagaggatgatgaatttgaccaacatgttgaactcaccatgttggcaattaggtatgcaaagaagatgattaatacaagagaaggataaggtcaggtatggagaggttctaaccaagaagattgtcatccaagaaggcttgagtattgaagttaaatgctacatctagaaaacctccaattgccccagataccattgcctgaaagtataacatatttaggattaccaaatacttacacaaataggaacctctatatagaatcagtcttacttttagccgtggcatcgtgacggttggaggtgcagctttcgcatgataacctgttgctttgcaaccagctaacagagattgggtgtagggcatggattccaccatttctttgcttggaggttttccaactctccccaatacgaattcagcaggaagcccatctataacctaaattgacacgcataaactcaaaatgccaaacattaaaagggtaagaataaagttgccactgaagcgcctaggattatgctgtgagaagaacaggcacatcaattttgtgcataccatcaacaccaaacgatcatacacaggagggacctcggagagttcctggaattaatcatagcacaagcatgagcatcgcaacactaaaaaaacactgcacagtatgaattaacttaacatttcaaatcttccatctctctatcacaagtaatgcgcagcagcatgagatgaacctaagccggaggaaccgagatgtctcaccctgtacagagatctgagctgatccggcggaagcgccggttgctccccgccaccggcgagaccacacgacggcatccggtagctctccgctccactgcggccaccaaccaagggtcaatcgaagcaagcgccatcgacagccgctgatagagcagagcagaggtagaggcgcgaacctgaacccgggcagcgtgggcttgacggggaagaagccgtagaggaacatggagaggccaaccacctgcagaagcactgcggtcacggtccaaccggcgaccgccgcgcaggaaggggaggcgccaccgccgccggccatggctgattcctcgccggtggccacgagacagttcgaacgggctgaagtgacgaacacttctgggcctaatggcttcaaaatgggccgtgggaagtacactagcgttggcccaaaatcaaaatgggcgttaaattgtatcgattcaattttgcttcgacaaaaatttgtcaaatgtgcaattccatcctaacttacatgtaactacaatgtattaccttcatatattttaaaaccattaggttaactttaaaatttatgtaagttgggaagaaaagaatcatagcacgcacacaggtgagaagattcagtctcacgatctttgtttcacgaaaatagcatattgtaaagaaattattaaaattacatatatattatattgtagttacatgtaaattataataatgtaatcacattataattatatatattatatttatatttgataaattttgagaagaatttttatatagtagcccccattggtttgggcccaaacaagcccacaaaaatattttgtcaccttcgtgcgcgttcgccgtttgggataaagcgtctcctccccctccgcttcgcgtcggctgctgctgctgctgctgctctctccgcgctgcgcttccgctgctctagggtttatctcctgctgccgctcggatttcgcggcgagcaatccaccggagatggcgcccgtgcagttctccgccgctggagttggcgcggtggccttcgctacgaaggggatggcctcccgcgacgcgctccgcctcccgccgccggcggccgtccgggtgctccgccaggcgccgcggccgtcacgcggcctcgtcgtcagggccgccgccgccagcgtcgccccgaaggtgcgttttcagtgcaatgtaccatggtgggcacactggtaatgctattctcggttcagagtttttcacttagagggttagttggtgaatcgctggattgggtattgcgggcaatgctattacgatagcgatgaaatcgacgatgattccgctgggttaactgatttatttctgttgaatttaatgatgaatggtgatagatggatatccgagcccgtctggtgtacggtgtgccctgtacacacctgtattgctgtggtggttagctcatggtgattgctgattaggaagttttaagattgtgatgcagtgagctgtgatgtgtctatcgctgctttcccacgttgactaccgaacttactgtcagactgatgaatgatgaagtgcaaatcagttttggaaaaaaaatgaattatgtatccttgtaataaaagagtaatgaagtgaattatagctactctatactttatattttaattattatgagcaataaaataatgacttacaagtacactatggattcagtgaagatatcgaaagggggggggggggttgaaagcaattctatgcttaatattttagtttattttccagaaaatatatttgttatgcttttcagtgatgaagttatgttctgttattcacttgcagtatacaacgctcaagcccttggctgatagagtgcttgtaaagattaagtctgctgagcagaagacaactggtgggattttgcttccttcggctgctcagtctaaaccccaagggggtgaggtagttgccattggggagggacgaactgttggggataacaaagtggaagttagcattcaggtatatttttctttgcaatatagtgaaaaaatatgtatgatgctttctaacagaatcaatgagccttactggtacagctattcgactagtcattcatggatcataaagcattgtttcttccagttgtctggagcatttgtttccatgtatcatttggttggtaggttccaaccaacctgtccaaagaactattatagaataataataaggtgcgaggctcgcctgttccagcctccaggtacatgaatacagaaatcagacctgaaacaaaaagagtaaaactggcggatttagcattggacccgtggctaataatccaataatgagcatgctgaaaagtcgggtatgataaagttgttaaaggatttatgttgcctgttttgacttaagatgtttcatattttattgaggtgaatcttacttgattgtttttttaaatttctcgaagtgtgatcattttgagtgtaaacaagctattactgttggcaaacaaaagaatatatactaaaatgcacatatgtgacttgcataggttggatcccaagtcgtatattcaaaatatgctggaacagaggtggagttgaatgattccaaccatctgattcttaaagaggatgacatcattggtattctggagactgatgatgcaaaggacatgaagcctcttagcgatcgtgttcttatcaaggtggacatttcttatacatttgtctggatagcagtgtaatgttgttgattaagtaggcatggccaactaaagctgaggccgccctccttttgattgtaataatttcttcctgttttcctacccttttctcatactataggtcgctgaagctgaagataaaactcctggtggcctattgcttactgaaacaacaaaggagaagccgtctattggaacggtcagtcactcaatttgttagttctgctggatattttgtggttttgatcaaagttaaggaggtaatgatgtgttggttgattggtgacaggtcgtggctgttggccctggtcctctggatgaggaaggcaagaggattccattgtcggtctctgcaggcagcactgttctatattccaaatatgctggcagcgagttcaagggctctgatggcacgagctacatagtgttgcgggtgtcagatctaatggctgtcctctcctgaattaccaggtgcgctcagctgagccatccatcgtactatgccctttcagcaaccatcttttttggaaaatattgctcctggagataacattaaagccactcgaatccccttttgttacaccaaaattggggtggtggtatatcatactgataaattataatgaatgccaactttttttggttgttttcagctttgtaatgatttatagaaaaatgggagaataactcctaacctttgcaccaatcaggatgcacatatccatttattaatcgtagacgctagaatttgaacccttacggcaccaatcaatggtggggtttggttgggagcttattgggcataggggaaccggggggttatcgttgaactcactactttttaagtaccaggtaggaggtgcgaattggtagggaatttcctctcttctgagattgagggaatgagagtacagggtttggactttggactgtggatgtgggagttttaggtgggattggggtggagagtttgtcctctaactccctcgcttttaataccggggtgggggtgggaagagccatccatcatcacttaaaaagtcgaactaaactttgtctcggaactagattaagaacaaaaaccaaactcttatgactatcctgccatcaactccctctaaactccccttcatctcctaagttactaccaaataggcccgtgatactagcgcttggtatgcgtgcttaaggtcccattcgacatggatattttgttgggttacttcctcgattttcattagttcctcgattttcattagcacgtttcctatactcctaaatgatgtgtactttacaaaaacttttcatattgaagtttttttttaaaaaaatcaaattaatctatcttcaagtactacctccgtttttaatagatgacgccggggactttttcttacatgtttgaccattcgtcttattcaaaaaatttacgtaattataatttattttgttatgagttgttttatcactcatagtactttaagtgtaatttatatcttatacatttacataaaatttttgaataagacgaatggtcaaacatgtgagaaaaaatcaacgacgtcatctattaaaaaacggaggaaatatataatagttagttaattatgtgctaattattcacctggtttcacgtgtcacaaatagctcagctcaaatagctgattcacgtgtcactatttggtggtggcctaagtagcccataagtgttagcaatgtgttttaagtataatattagaaagtttagctgggtaagggttagcttataagtcttgatgagttaaaccttttacacgtagaaacgatgaacgtgtaagtggggtacgatgtgaacaaagaacaaaaatctaacgtgtagaatggattaatgcagattttagaagctaagttgagacttgagaatgaaattgtaagggcatgtacaacggtgtgtaataacggattctcttcgttcccatgcaagtaaaattgatgatgtggaagagagagaatggaggaaagggaaacatagttgctacgcataacaacgggtcagagtcgactcttaacgtttattaaaggaaattttgttacatggaggtggagaaaaggaaagaagggtataaaaaaaatttttggtgcactaatgatcaagagttcttgttgtcttaactattgtagtagaatagtctctaagtgatatgcgttaactaaaagaccatccatcttagactttacctttgttcatgccctactacaacacaactgaaaaatatcgacaaatttgtacatatcctatctaagccatcaccattacattgtgaatcttcgctaaaattcccagagcacctttcatattccacctctattcttgtcccctcattgtctcacccacaatcccatgtatcctcatgcaccctccttttttttttgtccgcctcacgaactccgaccgcgagctctacacgtctcgaccgaccgagatacgtgccgcgacaactattcgacaaagaaccacaaaaacaccagcgccgcggcgctaccgcgcttagctctagcatatgcttgtagcaccacataaaccatcagttgcttgccgcacgtatctcggtcagggccctgacaagtgacaagtcaatcattcaacattttatttttcatttgaataacaaccattcaacattttgttctgaagtacaacgactcaacatttcgagcttgttcaaaccttaacattttttagtaatatcaaattttgtattaccaaattttattgtggtaaagaaaggtttgcggtctttgacgtgaggccttttcaaatttcggtagaagtttacgagaattgaagattccaaaattaccaaaatatggtagagttgtgttgaaaacagtattctttagtgaacaaccccttcagtttgtttgtgcttgttccaactcattctcctctttttccacgcagtgtgttttttttagcaaaaaagaaaattataggaaagttgctttgaaaaaatcgtattaacttattttttaatgtttttagctaatacttaataattgtatgctaatctattgctcccgtatcaggaggtgagtctcacataacatagccttagagcaaatttaatagtatagccaactactccaattatctatagtcaattcatataatagttacctataaacatatactatatccgtcttaaaatataacaacctagtattggatgggacatatcgacgactaggatgtgatgtgttccatcatgtcccaaattgttatattttgggacagagggagtactacccaattaatacatgatcatacctatcatatacacatatattttggaatcatggagttcgtcttgcagcagctgcaataaatctgtagcccgctatttttctctctcctatcttattatctttttgaaatatatttatagctggttataggttatagtatgctattgttgttgctcttgactcgcaactatgcggagacacccgcgcgctcgtactacgtggccgcaaccgatggcacgcgctggcagggtctcgcggccggagcgacacgatctccttggcaggtagcagcagcaagcgagcgagccggccaaggccaaagccgttcgtcaagccggaatcgcacgatccgttccatggtcgccatggcgagccgtctccacgtactcctttctcactacagctcctcgcctcgcctcgccccgccgcttgggaggctgggagcccgaccgaccgaccgcgcgcgagccgcgaggtcaaaccgcttccatgctttgactctctgaccgttctgtgtcgtctctgctgtgctagctagctccagcctccaattcattcatgatacagtactcctccaggagtactctagtatgtgtgattccaggcagcagctatatagctcttgaattcaaagttcaaagtccatctatatccaactttattttacggcggccaaatctcggatctccctgtatgattatgatccaaaactggtactactgcatagtgacagatcactgtagtatcgaataaaggagagagcgatgcatgcggtgtagtcaaacagtattgattttgacaaaaaagaaaaaatggatgcgtgcgtagcctggtaactgtaaaattatacgactaaatttactgtgaatactttataagccgagtcgtcctccgccttctccccatcatcttaggctgtcttcaggaggatgggttgggaactcctccccgacatgcacaacaaaaaaaacatattattgcacgattaattatgtattaactaatttttttaaaaaaaatggatgaatatgattttttttaaaataactttcgtataatttttttttacaaaaaaacacaatgtttagtaatttgaaaagtgtgtgcgcgaaaaacaagagatgtgagttgggaaaactgggataagaactcaaccttagttccccacgtaaaaggttgttagtaaaaagaccaccgcacctaaagatttgtgtttccagacaaaaatcaactagtataatttcaatcttgcagtaacttttttattattttttagagaaaaatattgtttacccggcctttacatctaatcggatatatgcagccatttaagttgagaacttagtcccacaaacaatccaatataaaattcgctcatatatagatttaaacttaggacttttggatgctactcaggttattacgaccgctaggttacatgctttttttatggtctcgtggtaactcataatgcatgaacatgacactaataacttcaaaggaataataaagtatcgtggctcaaattaaccacgtataattaactctgaaaggaaaaaaaattgtcactttctagggagtatcttgaggtaataaaaaatatacatgtccgttaattcccaatatactatggagtaatagaatatcataaataaataaatatgaatgtgccttaattttacattagacttcctttatttctaaataattttacattagacttgatccatgttactccctctatttctaaatatattttttctagattatttaataagtattaaggttaagcaaaaaaatattatcttttagttatcttattgattaatttttgaaattttaattgcttggattcccctcacacccaattgtattggaatctgtgtcaccaagatgtttatatcgtgtactttgtccattcaaaattctaaggcagacataaaaaaaaaatctaaagtatgttttattttttgttttttaaatgagatggacatatttgtaatctatatgtagtaaattaaattagtcatcttaatactaattggttagatgtatgcatataatttattggttttatcagacgagttaattttatttttatcttgatgaaaagaaattcaaccagtcaatcgagtagattgcattaaggatcatattagtcacatgagctaactattccactttacctatttgacccattcttactgctgacggatccagtttacttagcccaatcatcatgcggtgcagtgccagaaaggtgctagtagggaatccacttttgttctttaggtttcattccgacctgtcggaactcagggttgttgccacaccacacgttatcaaagaaaaactggtatcggaggggccatggatatccggtgcaccccaattctcttatttcttttaactccactttcatataatttaaaaaataaaccaatcaaaacttactattaaatctaaaacctcttgttcatgtcatcctcgttagtgacaacacaatcttacctaaaagaaagactttggcgtgacaacaatgaaaaatatttgactagcataggtggtgcggctaaaaaggttgttttcaaaatacatattgtagtgtttattttttatatttaaatgagacaggttaaaaaataaaataaactgcagccacgatcatgagcaatgctttaattttgctcgcgcaacttaagaacaaaggacagcggtcaagattcatggatgaatggcgatgaattgtttgacggaaatcattttgtgctggagtagtagtacgtgaagcatatctggtagtagtaatttggtagcatggatgttcattaatccagtgatattttcaacacggaggtgatttgcagttgtagagacatgttcttctttaacaatgcacttgtgcctttgtatcaagagagtaagagacacattttgtgcagttcattttgcattaatacacattttctcttcaggatttgctatttcacttgcgatatatttaggttcgtatctttcactttttcattcacaaaatcttgcatcaagaattatattcttatatatcaacttatagtacaatcagttacgcagcacttacacgcaattacggtgtatcaaaattagattttacaatgggtttttctgtagatttacgatttttgacatgtttattttttattgtatttaaaatgggttatatccattggtcagaaaaatttataggtaatcccttctccttaatttgcccggtacatgttccatccactattcagaaaataatctcattatactaaaacagagtgcctcaacagttgatgataacaacatactttctccgtttcatattataagactttttaacattgctcacattcatatatatgctaatgaatctagatatatatgtatgtctagattcattaacatctatatgaatgtgagcaatattagaaagccttctaatctgaaacggaggtagtaactaataattatgctatcataacataatttttgtctttaaaaaagagtatatcgaataaagacaaaaggcccaccggccgatatatctagtagaatccaagttaggatcgaaatcaacctcaacctagtcgtagtagcatcgcctcgctaagctttggttgctggctgacaccttgcacgtcgccgtccgacgcgccatggcgagtcaacgcgtcgcacccgacgacgcatggcgacggtataagtagccgaggcgaccccgccaggatgatccagcagcaagcaaacccaaagccaccatcaacacagcacgtacacgtacgtgcaacgtcactgcatgatgtcatcgtcgtcgccggtggtggcgtcaccgccggagatggagaagaagtacaagggtgtgcggcggcggaagtgggggaagtgggtgtcggagatccggctgcccaatagccgcgaccgcatctggctgggctcctacgactcgccggagaaggcggcgcgggcgttcgacgccgccttcgtcacgctccgcggccacggcgccgccggcgccgacctcaacttcccggactcgccgccgtcgtgcgacgcccgcagcagcgacccgcggcaggtgcaggccgccgcgctctcccacgccaaccgcgcccacgtcacgccgcagcaggcggccgcggcgctcatgtcgccgccctcgctgtcgccgccgccggggttcgccaccggcagcgaggtggtggcgcccgccgtgcgcgccgacggcagcatcgactggcgcccggtcatggcgcacccgccgccgctgtactcgccgcccggctggggcggcggccatgcctacgacttcttgcagccgccgccgccgtcgccgccgttgccgtcgtgcgacgacgacatggtcgacgtcgtagatgagagcagcgcttcgctttggagctttgacacgcgagactcctacttccgatactaattacatgcatcgattaatgcattatgcatgggatcagctggcattgatggtagcttagctgccccacacacacacaaattcattaactagaatagacggccattaatttagtttctacacgttcgaaacgttttttcaaagaattaacgatattttgcgatggtcgtgtgcatatgtcttgcatgctaaatggtatcttattcaaagcattatgggtaaatagtactcaccaatatgaaaagtagtgaggcaagttttgtcagtaaggttatatatgcagaaatgttcattgtattttaactccccttttagggaaaaaaatgttttagggggggtagttgaggttgtgcttaattacttaatttgatgtatgtgatctgatctgcacgcacatcacacactgcaaaatgagctcaggcttattaacatgtctatttcatgagctaaagctttgataaaaagccttcatgttcttctagcagcaacttgtcacataggcaaattttaaagacgtcattttcaagcatgtgacattttgcaaggtagaactggaatatacaatgatccaactgggcgatgtgatatatacaacacagtatatcagttcggtgtcgcaatcggggtttacacttttgtttttcaccgaaattccagaaatttcgaggtcaccgaaattgaccccaaaatttctgtagtttcggaacattttacacaaaattatttagaaatttaataaattttgaagaaaaaagagaatttcgggtgagatatttgcatgctggagggtagcgaaaaattgcaatcactagtcggtgacggatagtcccaatggataatttacggatagtgccgaatacggaaacggatacggatagtttttttttaaaacggaaatgaatatggtaggactagcatccgatggatatcggaaaatgttgggaactatccgcagttttatccggatatccgtacgtagggatcaattttttttaaaaaagtatatatacataaattaaggatctctcaaggaagtgaaaaatcatttttacatgtgggttaagaatcaactataaaaattaattttcacaaatgtttatggaaccgtgtaggtaattgaccatatagaatttagaaatgttgacttattattttaaaaaaataacaagcaatatctttttcattgattcagaaaacccaattagaggggttttttatattccgataagtaatcattgctatattcgttttgtttcgtagtcgctccatatctttattcgataatattcgattttatttttatatcgatgtttttatcctaattccaattaaaaaatgaaaacgaatacaaatagctagtttccgtgtgtttccgatcttttttgttcctactagtcgcaatagttcaactcttcaatccattgatcaagaggtgaaaaagacacagtaatcttttgtctcaatgcgtgacaatcggaaaaagctatagaaagatgctgcggtccatatatcagtgacacaaggaattaaggatctatgccagacagtgagatatgagcacaaatggaattaaggagtatttaattaaattaactcggaaaaatgagatgtagcatcttttatgacatgatggtgacttgcaaatttaaacgttcacccacttctacttcttcacggcagtggccacagcacgagacacgttgataaaaccgtatgtagggccctttaaaacacgggatacaataaaactgaacagaaaaaactccctctattttttaataaataattccattgacttttaaatatacatttgttttatttaaaaaatgtataatgtataggatataaatcatgcctaaaatactttgagtgatttaacaactcacaacaataaattattattacatatattttatgaataagacgaatgattaaacgtgtgaaaaaaatcagcgtcacatgtttatctaattttagagaaatatctaattttagagaaatgtaaaatacatgtacgtcaaatagtatccctttggtacatcaccggaaacaaataaagcaaatgatagtttctatgaggttggacctctcacttattttcctataaaactaagtcgtaagaatttagttttgtaaaagaatttctattctttcctatgaatgaaatgattatgtaggaatttttcttttgaaaaattaaatcctccaaaattcatattacaatcctcaatgcaaaggagcccagggtagcttcttcatcagcttcatcactgtcaaaacgtaaaacaaacacacgctattacacatgatgaaaaaacatagcattaggtaaactaaggcgactatggtaactaccgttgcctcacattttgtattaagatgactaagttttgtcttatcacatcttttggcaaacaaaataataagagtga

SEQ ID NO: 76913 - DNA, 670 bp, Oryza sativa
cttccccctaaatttctcttttctttttcttttctttttcttttcctttctttcccttttctttcctttccctttttctcctttccctttttcctttctttcccttttcttttctttcttttctctcctctctcccggcctcttcctcccttcctctcttttctctccctcggtccctctctcggcggcgacgacgatggagcaagggaggaggcggcggcttaccgacggtggtggcggcgacggcggcacgacgacggcgcacgacgcggcggcacgaaggcggcggtgtggcggcgcgagggcggcgcgacgagacgacggcgcaaggcggcgacgcaaggcgcggcggctccggggtgacggcgcggcggcttcggaggtggaggcgcggcggcacgacaacggcggcgctaggaagggggatggagtggggaaaaatgggggatgaggtgggattttataggggagaggagggaggagggaagaggggagaagggggagaagaagagggaagagggcagcgacgcggcgatgcgacggcgatggcgacggcgcgcggcgcggcagcggcgcggcgcggggcgcgaggcgcggcaggcggcagtggcgcggcgcggggcgcgagatggcgatgggacgcacgcgcggcgcgaggcggaacggcgac

SEQ ID NO: 76914 - DNA, 15346 bp, Oryza sativa
  unsure (1)..(15346): unsure at all n locations
tttgggttgttccgtgctttcacgtgaccaagaaagacgcacccaagggggggaaaaatcgtaggcacctggtcatgttctcatcggaatgatctccaccctccacgtcacatagcacaaatcttggagcaaacttccctaaaattaggtgtttgtttagggttttcaaaaacttggttttgatttgttctgctgtgggctcaatcaaaactatgatgttcagccaaaacaaaattttggttcatatccatattcgtagtattaagatgtattgtgtttgtttcttagtgatacagagagtagtacctactatttaaaatttttatgaaatgcacaaatttttcaggattttcacatgaacaagttcaattccttcattctaaaggatgccttatcttatactattacactcacacaaatttaaacttttatgagaacactatcttttcaactctatattttctatattgagaccaaaccaattctagaacctccaaaatgacttggcattatcaaaatatttgatagatcatcgaccatgaagcctcaaaaagacttcaaccttgtcaccaaaacctttttacagtcccatcctagatcctaaatatatctatgtccttgttcactcattggctccccagggcatatgggctttatttttaccaacaaacgctatacatataaaattatgttgtattcatataaaaaggtattggagaaacaatctattaactaaattggtatttcaattactcaaactagaaaggaaataagtcaaccgtcatttgcctatgttgacacatcgatgtgggaggccatgtgcgaggcaacatcttttgggcatcaatgtaaggtggtgtatcaacattgtaagcaaggagcggtgatatgagattagcggcgccgatttcgcaaagtgttgttagtgacttcggcgtgcacgtgagtgagatagcattggcagttggatacttagtcaacaactatgatttgagggctgagtcaccgaggcgcagtaggagataaaagtttgtgattgtggagaaggagtagagatgccaacgacggtaatagtatgttgatatagaaggattggataaaaggactaaagagaggaagatgcaagtagcggcaccgaatcttatataccgaattcaaggttggaaatcaggcatatgattggaccacgtggcatcttgagaatttgggttcagctcctctaaaaatatgccacgtgtcccatcgtcaccctcatccacctcttcttctcccctcccctcctatccggtgccttgcccactcccccgacgcttgcacgcactgctgcctcctccctcctcgggttctcctcactgcttgcttgtcattgtttctccgttccctcctctcatttctctgtaccaccatcgattattccttcctatctctagcgttgtcccaaaacccccctccctctgcccatgtcgccttcctcaccccctgtcctcctcacccttgtaatcgcccccatgctccccacccgcgcccaccaaggaggtctaccccatgccaccaacccattctccaaagccgagcccaaccgatgctcctccagcggcggttgtaacgacgccgagcgcagtttgtactgctcccgcttgggagaggacgagactgggagctgcactgcgaggacggtggtagggagcaccaagatcggaatgatgggaaggagaaagagaacaaaaggaggagagggagaggagcagccgcgttcacaccttctacccaagctcctcctcctcctccttgccaccattggcatccgccccgccgcaccggtcgtagatgcacggccacctcccgaacaccgtatctccggtgccgctgctccgtgctgtgagcctctacagtgaggcttgggcgggcaagggattcctccataccatctgcttccaccagtgccgatccaccaccagatccatacgctaccacctgtccacctcgacatggaggcattgtagtttatttgaagcagtcgcatgtagcaaggcatggcactggacatatttatataagataataacaaatatggatattaggacctccaaaccaattctcgaatctccaaaatgacttggcattatcaaatatttgatagatcaatcccgaagcctttaaaaagactgcaaccttgccaccaaaacccatttttagtcccatcctagatactacctctgtccctaaatatttgacgccgttgactttttagcacatgtttgaccgttcgtcttattcaaaaacttttgtgaaatatctacccctatatgtatatataaaagatatttaacaatgaatcaaatgataggaaaagaattaataattacttaattttttttgaataagacgaacggtcaaacatgtttaaaaaagtcaacggcgtcaaatatttagggacgtagggagtatatccttgttcactcattgggccctgaggacatatgggcttttatttttacaacaaactctatatgtacatataaagtttgttgtaaaaattcagtactaaccatataaaaaggtattggagaaacaatatattaactaagttgacatttcaattactcaaactagaaaggaaataagtcaaaagccctttgcctatgttgacacatcaatatgggaggccatgtgcgaggcaacatcttttgggggcatcaatgtaaggtaatgtatcaatattgtaagcaaggagtggtgctatgaaattagcaacgtcgattttgaaaaggtgttgttagcagcttcggtgtggatgtgggtgagatggtattggcagttggataatgagtcaacggttataatttgggggcagagtcaccgaggcacggtaggagacaaaagtttacgatgatggcgaaggagtagagatacccgatgatggtaatagtatgtagatatagaaggattagataaaaggactagggagagggagctgagagtagcggcactcaatagtgcagtgaagttggggtgtagtggactagtttgtgaattttttctatataaactattctttggtcttatagtgagtaacttacaaaactcaaaactagttaacggaaacgttgattgctctgcctgtccttgaccattctgctagaagctctgcgacaaataaatttcgcaaatctaaggtgctagtaggtgaatgtgtagcggaaagtttgaatatatggacctgtttggtacggctctaacagttgaatctagagtggagttgtggagttgagttgaaaccgtttggttaggctccaactctataagagatgaattggagttggagctatgtcaaacaagtcctatgtttgatgcaaattttatgttttgggaaaacaaagatataattaacatgtttcaaatttgcacagagcatgcattttctttggttataataagttgcatttcactgttgcagactagcagatagtagaaaacaaatgcgcaaaagcatacatttcactgtttcaaaaggttcctttcaggtctggtgcatcggcatcagtctctcggtgcataacacgccttgccatgctaagtgtcgagcaaccatatattaggcatgcattgccaatccaattcccacaattaagtgttcttaactcacaaactaaccacacttttttaccggagattatgatacagcagagtagccgatcgaagtttcgaaccaatgcccacagttcatcactattcccttctccatgaacacacgacctgcagcagcaagccagcacacacgttgctgccccaactccaactctgcaacaagaaacaactcacgctgtcactcacgcacgcatatcttccaaacaaagcaagcgaaaacctgcagccctctcttcacctccgcatgacatgcccaagcaagcaagcgtttgctcaccacaaaaaaatgagatggccgatcgagcaatgcagagcacgccccgatctagtaatcttagtcccagcttaaagcatgcaaaaagcccttgagatttcgatcggtatccacatcaccccaggacaagagtgcaagcaaaccaaccccagaaaaaccccaaaattaatccttccaagcaaccctctcaattactccccggacatcacctctaatccaaatagagtaatataattaaccccgcaaatatatattctcatgcaccaagcaaccacacgtacacctatataaatcatcacactcccagcattcaatctactcacacacacacgcaccaagaaagccaagaaccgatcagctttggtgttcgatcgatcaagacgaggcggcggcggggctgatcgagatggcggcgccgccggcgaggtcggtgagcgtggcggacagggcgctgcgaggggtggcggacctgatcaagctgctgccgagcggcacggtgttcctcttccagtttctcagcccgctcgtcaccaacaacggccactgcgccgncgcctacagcagggtcctcagcgccgccctcctcgcgctctgcggcgccttatgcgccttctcctccttcaccgacagctacgtcggctccgacggccgcgtctactacggcgtcgtcaccgccagggggctccgcacgttcgccgccgacccggacgccgccgcgcgggacctgtccgggtacaggctccgcgccggggacttagtccacgccgcgctctcgctcctcgttttcgccaccatcgccctcctcgacgccgacaccgtggcgtgcctctacccggcgctcgaggtcagcgagcgcaccatgatggccgtgctcccacccgtcgtcggcggcgtcgccagctacgccttcatggtgttccccaacaaccgccatggcatcggctaccagcccacccgcgccaccgaggacttcgagcacaagcactagatcgtcgtcgacgacgacgactaaattattaattaatttgggtgttttaattaattgatttcgaattcatcaaatcttaatttaaacattttatgtgtgtgcgtgcgtgcgtgcgtgcgtgtgttttgcaatgtcagggtttggtcctttggatttggagactcgagtcaaagtgtgaagtggctctgtgtacatgtgtgttcgattgtttttcatgtaatttgatactaggagctaccgctgaacataataaagtctacaattgtactgtttttttttaaaaaaaaattcactgtgcttcaacagaaaatttcgtatttgcttgtaaattgtggcaactcgatcgtgaggtttgcttctactcaacagcctgaaattctaatagctctcatctgtcgccgtcgattcgtgaccactgccgacccatctcgacctaattacgtactctatttagcacacatgactcttgtctttgtgttcatctttctcgctctacttatatatacatatacatatacataaacatatacatattttgttctgcttttgtagttttgtgcatgatattatttcgttcgtgttcgttgctgccacgccacaaccattccgatgtattgccgatacataataacaatcttttcaaaacctgagacatctcaaaaccttaatggcttgtttggcaacttgagggaaggggattgggagtttatacgagggaattgacggtgagattaagatgggaatttgatttttcatcccagtctcttgtttggtagaggtggtggaaattgataggaagtttagttggagattaagtcattaatgaaaacggatggctgagatttgtttagacgaagtaaaggaggaattccctcccaattaccaccccctacccaggtattgaaaaggagggagttcattctcaattccctatccccatcccaccaaaattcacatatctcccaaccaaacaaaacagttaatagcctcatccctctaaactcccaatcccttctaaaaacttcccccaaccaaacgggctgtaaatccttttcacacattcggaatatgacaacccagtttccaattcgaagtttttaaaaaatcttctcaaacaaactcaaacatattgggttgttacgttgggccccggcccacagaaaaagcccagtaggcggggcccagctccagcccacaatacctcgccactaaaccctctttcccctctaaaaccctccttctttctcctcccccttccgccgcgccattcgcctcccgcgaaaaccctagccgccgccgccgccgccgctggccaaaatgtccacgccaccggcgggcggcggcggcttcccggccaccgaccaaggcaagaccaagtcgaagaagaagagcaagaagcatcaggaggacacctcctcctccctggccgtcgccgcggcgtccgtggatgaggcggcggaggccaaggccgacggctacctgatcaagccgcagtcggtggcgccgccgctggacacgtcggcgtggccgctcctcctcaagaactacgaccgcctcaacgtccgcaccggccactacaccccgctccccgccggccactccccgctcaagcggcccatcgccgagtacctccgctacggcgtcatcaacctcgacaagccgtcgaacccttcctcgcacgaggtcgtcgcctggatcaagcgcctcctccgcgtcgagaagaccggccacagcggcacccttgaccccaaggtcaccggcaacctcatcgtttgcgtcgaccgcgccacccgcctcgtcaagtcccagcagggcgccggcaaggagtacgtctgcgtcgcgcgcttccacgccgccgtgcccgacaccgcccgcgtcgcgcgcgcgctcgaggcgctcacgggcgccgtcttccagcggcccccgctcatctccgccgtcaagcggcagctccgggtccgcaccatctacgagagcaagctcctcgagcacgacgccgaccgccacctcgccgtgttctggatctcctgcgaggccggcacctacgtgcggacgctctgcgttcacctcggcctgctgctcggcgtcggcgcgcatatgcaggagctccgccgtgtccggtcggggatcctcggcgagaccgacaacatggtgacgatgcacgatgtcatgcacgcgaggtgggcgatggacaacttcaacgatgagtcctacctgcggcgcatcgtcatgccgctgaaggtcctgctcactagctacaagaggcttgttgtgaaggattctgctgtgaatgctatatgctatggtgcgaagctcatgatccttgggttgcttcgattcgagaatgagattaaagtaggggagaaggtggttctcatgacaaccaagggggaagcgattgcgatcggcattgcggagatgaccacggctgttatggcgacttgtgaccatggagcggttgccaagattaagagggtggtgatggatagggacacatacccgaggaagtgggggcttgggcctgtggcgcttaagaagaaaaagatggttgctgaagggcttcttgacaagcatgggaagccaaatgaaaagacaccaagtgagtggcttcgcaatgccgtgcttccagctggtggtgatgcaatgattgccggcattgctgcagcacctgagccagagaagccaaaggtgaaagaggaggcagatgtggctgaagagaccaaggagaagaaaaagaagaagcataaggactgggcaggtgacaatgctgatgaggggaggaagaggaaggttggagatgatgatctctctgcttctgtgagtgcgaagaagattaaggttgaggaagaggctgatgcagtggaaggggaaaagagtgagaagaagaagaagaaaaagaaggacaaggctgaatcggcatatgccgatggagaggtgaaggctgagttgtctgatggggagaagggtggcagtgagaagaagaaaaagaagaagaagagcaaggaaggagaagctggggatgatgaagctgagaaaagtgagaagaaaaaggagaagaaaaagaagaatcgggatgcagaggtgacacaatagttggagagtgtaattttagccagatcgttgacattgtaggttgcagattggaggtgtctacactgacctctggcttgttgttcacttgcaaacaataatcattctagaggcctagtttagcatttttatatcactatccgtttactgctttggacatgaaatgcaaattaactaggccagcctttttatattgccccactcatgatggcctatttgtgttgctgttccagttatcacttagatgtgatgaattttgctccattgaagttattggtcttttgatttggtacatgctgctgcctcatttatgaaattacttgccttggtgatgaaataacattcatcttgatcttttgtagctatcaaaatgctagttttggtcagtggtgttgtcagttgtgtgacttacttggatggtgtatgatatctatcttggaaatgtgacaactttaaaatgcagctttgttgatattaattttggtctattgtgttgttccagttatcacttagatgtgatgaattttgctccattacagttttggtcttcaaatttggcgtatgctgctgccttgtttatgaaattacttgccatggtgatgaacagtattcatcttgatcttttaatagctatgaaaatgctagttttggttaggtgtgattcgacttgtggtattactcaggatggtgaatgatagtatctatcttggaagtgtaatagttatttgaaatgctagttttgttgatcttaatcttgaattatgggttttggcatgtaactctctttaatctggtggagatgctaggttggttttcagaatttctatatgtgctttcaggatttattacatcattgttggtcactttgatttatccattgcattaaaagttacagtagctatcattgactggcctaaatctgctttacatgtgaacatgtctaccatggcctaccttgtttcgttgtacaacactattagttggactgcaaccttttctgtttctgcagcctgtgataatgtgtgagcctccctccgaggcaattgatttaagtttgtcatccgcacatcatggtgcatcaggttttactcggcgaaggactggatttattctccttttccatttctgctgaacacaagaggtaagcctgctttacatttgtcataaggtttgtttgtttagcagtcattgagaaacgagctagagaatttctttgcgatgttcgttgagcattatctgtggtggtctgtactacatttgtcaccaaattcttgcaagaagatcaggagattcaggctagcacacacaaagaaaaaaaaaaccctgctttctgttcatttaggaacaaaactttactttattattggtagcttagctgaactttttgctatcaagtgcactgtttacagggaggaaacaacactactaacctcaacaaccctgctaacctctgcaccattgaaacagactaagctaagaactgaaacgatcaagaactcctatatttgacagttgttgccattttcattttcctacaagaaagtgtccttacattgcaggctcttgagaaagaatcgaagaatcgaagaagaagaagcagtgcgttccagagtatgtgatgtgcgttggctgctagtgattgacaattacccagacggcgtagatgatccccgggaagtagcccaagaatgtgagcaagaggcagatccagaactcgatctgatagtccatccaggcgagaagccaaaattgcatattagcatcgacgccaaatcaaaatgatcaagcagaatgcgaaatggggattctgaatatgcagatttcagagagagagattggaggaagcttacctcgcagccgaccttgaggaagacgccgaggggaggcaggatgatggcgatgacgaggtccacgaacgtcgccgtcctgtcggccatcgccggcggcctgtccgccatcgccggccgatcgaccacaaacaccggcaaaggcgacgcaaaggcggggagaggatgggaggagacgagacgacgcggtgtcagcgggagcaattcaccaagtttagggggacacaaaagcctaatccaatcgcccaaagtgcatgtcaatttttagcctcttactaattaactagtattgtggcccgcgcaaattgcgcagctagctaccaatattccttattttctattccaaattttcttttttttttctaaattgtatttttatatagattgtaaactcttatttcagtatttttttattttttatttttataaattaaagttataaattgtatttctatatagactcatatgtctacttctattttctttttttaatttcaaattttagttagttctaaattgtatactaatatggattctagttttttctttcaatattcctttttttaattcgaatttcagctatttaaaattgtatttatatatggactctattattctttttatctgatttcatatttcaattaattataaattgtacaccattatgaactttagccttctcttctaatatttattattttttaattatctatgtaaattgtttttctatatggactccgattaatatgagaatttctaggccatgacagcaaacacggagtctaattttcttaggctatctttagatccagggtgaaaatttttgccctgtcacatcggatatactgacacacatttgaagtattaaacatagtctaataacaaaacaaactacagaatctgcctgtaaaatacgaggcgaatttattaagcctaattaatccgtcattagtaaatgtttactgtagcatcacattatcaaatcatggcataattagactcaaaagattcatctcgcaatttacatgtaaactgtgcaattgattttttcgtccacatttaatgctccatacatgtgtccaaacatttgatgtgatgtttttcgccaaattttttggaatctaaagacaccctatattaaatctaaactgttataatctgaatctactatgacccaatggttattttttttctctttttcttgattagcatgggaatttctatttttcttgtccgttttcacttttttctatctttcttgtccgtttccaagttatttttgtccgtttactctttgtttttttgtccgtttccaagttttttttgtccgtttcagctcttaggtttttattttttgtccgtttccaagtatttttttgtccgattcgaattttttttgtccgtttctaagtttgtgttctttgcaaagtactcctccttctatttttctttttttctttcgattaacgtgggattttctaggccgtgagagcgaacgtggaagcttctttttctattactttatagatataatagatagatttgctactcctcagagtcagtactgacgctaaaaattatcgttgtttttattaccattcgacagcacagatgatggtgacgatggcaacagatgaacgatcgatccccttcactttcgtctgtgctggtatgctgattctgctcatggaggacaggatgcagtcatcagcttggctagtggaaacatgaggcgtgtccgagagaaaagcatcaattgccactacattatctgtcgccatttgccgatacagtcgtgtgcgtttctcagtctcgaaacgacacctaggacttttaggacagaaacaaaagggcaaacggcgcctccgttttttcttggctcactcaatcacctcgcttacatcgccattctgtcatggcatttggcaaaacagtagcacacactaatctctctttgagcaagtttaatattatatccaactattagcttcaaatcatctatagtcaatttaatagccaattcatataatagttacctataaacatatactaactaataatagctggtcttacgtaccatacgcacatcgtgtcatgaagtccgtactgcagttatctacaaatctattatctccttaaaatatatttatagctagcttgtagtccgacaacctactcttatcactaaccacagtcttctcctagcttataccttgttccaaagctgcttttccttgttcttatcacacgtcttttgacatatggcgcacgcacctctcctcgcttttcacggctcgcacggcatcaatagtccctccgttctaaaatacattccaaataaatcaatctacgtgatacttcctgatacatcaaatctaaaaataagcatttaaatttattacctcctccatcccaaaatatttgacgtcgttgacttttttaaaagtgtttgactgttcgtcttttttaaaaaaattaagtaattattaattatttttcctatcatttgatttattgttgaatatacttttatgtatatatataggtttatacatttcataaaaaaatttaataagacgaacggtcaaacatatttaaaaaagtcaacgacgtcaaatatttaggggagaagggagtatattaaaatgtgtcagctgtagtgtaggaggttaatttatttcggaattgaacgaagactacttaatccaataccaacggccaacctccgacattgtacttgtcagttgtcactctgctcagctgcggtcgccaacgaggggctgcaatggccatgcccatgccgatgccgccgccggggccgggcggcgacgcgccaccggcgccgacgatgatgcccggcatggcgatgccgatgacgacgggcatgtccttcacctggggccaccgggcggtgggtgctcttcccgcggtggccgggcgaccgcgccggcgtcggcatgtacttcctctgcctcctcctcgtgctcgccctcgccgcgctcgccgaggccctctccgcggcgtcgcgccggctagacctcgacctcgacctctcccgctcgccggccggcggcggcggcggcgacaacagctgctcgccgcgggcgtccacgcggccaggatggggctcgcctacctggtgatgctcgccgtcatgtctttcaacgccggcgtgctcctcgccgccgtcgccggccacgccgccgggttcctcctcgcccggagcggcctcctcggctctcgcgccgccgcgccggaaatcgacggcgccgccgccgccgccgccgccacgtcgaatggttcttctctccatccatcgtcagagccgaaaccttaaaaaatatgtaattctcttcatgctgtcccgtaattaccagataatgaaagttgtagtcaaaggagattatattaaaaaaagactgcaaaattgtactgcatcaaaatggtttattactgatcgatcgtctctcgatctgaatttcgttttcactcctgaaatccaagaacttgtcaggcttgtcctgcagcttcagtttttgacttgtcaaaattacaagataagtgcaagtattaatcacactgacttgctggctagtggctacactcttgagctggtagtacagtatctactaataattggcagctaggttactgtagctgtcgtagattggctcaagctagctgcggccatggcgaccttgctgctgctgcccgtggcggcggcggcggcggcgtgggtgtggtgggggcggtacgcgtggcgggcgcgggcggtggcgaggaggctggcggcgcagggggtgcggggcccgcggcgcggcgggttgctgcggggttgcaacgacaaggtgcggcggcggaaggcggaggcgaagccgaacggcgtgcccatggacgtcggcgaccacgactacctccgccgcgtcgtcccgcacttcgtcgcctgaaaggagctgtacggtacgcacccccctcttggccctgtggcaacaagagcaagaagaaattaatcctgtgcttaattgaattaattctttggataattcatagaattttcgatctctatatctacagaatcaaatagtaataaagaaatactacttggtttccactgaaaattttccgcgtctcacaactgagaaacaacaatataaagaacagcaacaataaagcctcgatcttccgttgcctaacatgtcatatcgaatctaaccattacatcggattccagccactccggtcatcaccggcatcgacaattgaatgaatgatcaaactccatcacaagaaatttctggggtttttttttttgttgttaaaagcacaaggacatgaagaataattatattgttttcatatagcctttttttaacgaaagatgttttcatgccttctttgctaggatcttgtctcaggcgggcaagcctcaagcccgggggatatattggacatagtagaaatgtaaatcatctattctttgggtatcaaagatgaatatactattaattaaaaagatgttgagcagtgcagagtggaaagttttatgccataatattatacctgtcgatagaaacagaacatatatatccctgttcttttcggatgaatggattaacgaacaatgtttcccaaactcctaaacaatatgtcttttaagacattttgtgtatatgactttcttagaatattttctaaatctatttttcaactttgtaatagttaatttatttgtttgcaccctcaaataattattacaaatcattcggctatttagcccttcaagccacacaagatcatatgacaagtgagagacacacaagatcatataacaagggagaacatgtaacaaaaatggggagagaaaaacctagcagaaatgaccatgcctagaagagaaaaaaatgccatagttaaataagtcaccaaatactccctgttcaatgcagaaaaatagcctattcaactatatatcttgtaaataaatttcagtgatttatatgaacctccaacctgtacttcttgactgtgggagtgagaatatgcaattctgaagccattccacttcagcaactatatatatactaactcttcaaattatatgttttcatttgaatggtgtgtaggaacgccatttctgtactggtttggccctcaaccccgaatctgcgtctccgattacaacttggttaagcaaatcctttcgaagaaatatggccatttcgtgaagaacgacgcacacccagctattctgtcaatgatcggcaaagggctggtgctggtggaaggcgcagattgggtgcggcatcgtagggtgctcaccccagctttcaccatggacaagctaaaggtaaatggtcattctaacctggctccaatttctagcaatggattcctagttccttcagaaaatctactcagattttgtttgggagaagcttcctattcctaattctaatcaaatttatttcactgttctgcatttaggtgatgacaaaaaca

SEQ ID NO: 76915 - DNA, 3750 bp, Oryza sativa
accccgcacgtcgaagcaaccacttcatcttatgagcgattgatgaataccacaaattccttcgtgaacctcaccgattgcaaccttagcttgatcggcactcaagcacttaaacaacaccccatcaatcgtccgataatagagctcatcatccaacaaagtatacttcaacactttgtaacgcaatttccgagaagccgattgagatggattctgtaaatattgatgtacatcatatctccaatcatcagttgttaatgcagcaacttcaaccctaacatctttgatcatcggcttataccccgatgccccttgggccaaatcattagcttcaatattttgcctctcgagagacatgcctcaaagtaaccagccgaaattccttcattagctcttggcacttctcattataaaccattaatgtatcattcttgcactcatattctcctaccaattgactgatcactagcaaagaatcccccataatttcaatagcattggcttcaacttccttgagtaactgcaaccctttgagaaccgcttcatactcagcctgattattagttgcataaggtttaatagtgtaagcaaactcaaaacttgccccccgaggggaaattataaccaagccgatgccacaaccatgagtgcatattgatccatcaaagaacaaagtccatggcacgacttcaaccgagccgattgaatcatcacgatattcaacaataaaatcggctatagcttgtcctttgactgccttcggtgactcataccgaagatcaaactccgttaaggaaaatatgcactttccaacccttcctttcaaaattggagccgacaacatgtacttgacaacatcggctttgcatatgatagtgcattcgttggagaatagataatgccttaaccttgtacacgaaaaatataagcacaagcacaacttctccacaggggaatatcttgtttccgcatccaagagccgacgacttagatagaacacaaccctttcctttccttccagctcctgaattaagaccgagccgatcgacttctcaccggctaacaaatataatctaaaaggtacccctttctgtggaggaatcaaaactagaggagagataagatattccttaatactatccaaagctttctgttgctctgcccccaagtaaacttttgatgggccttcaatttcagcaatggtgtgaaaggttctaatcttccaaacaaattagaaataaaccttctaataaaatttatcttgccgatcatctcctgtaactctgtcttgttctctagaggctgaatcttcttgatcgcattaacactcgtttgagttacctcaatccccctctcatgaacaaagaaatcctaaaaattggccagccgatacaccaaaagcacactttgtcggattcatcttcaggccatatttcctggttctctcaaaaatcttcctcaaatcggctatgtggtcttctatttctttagacttaacaaccacatcatcaatgtagacttcaaccaaccagccgattagatcatggtatatataattcatggctctctgatatgtagctccagcacttttcaatccaaaagtcattacaacccactcaaaaaagccgattgcaccaggacacctaaaagcagtcttatggatatcttcttcggccataaaaatttgattgtatcccgcatttccatccataaagttcaatatcttgtgccctgaagcagcatcaaccagctgatcggctactggcattggatactcatcctttggggtagctttatttaaatccctgaagtcaatgcacaccctcaccttgccgtttttcttgataacaagaactatactagaaacccactcagcataccggcaaggacgaataaaaccagcatcatataaacgtttaatctcagccttgacaggttcaagcatatcggctttgcatcttcttggaggttgttgatgtggtctaacccctggtttgataggtagccgatgttcaacaatcaataggccgagtcctagcatttcgtaatactcccaagcaaagcaatctctgaattcctttaacagctctatcaacttggttctaaattctgaagataaattcttactaataaatgtcggccttggtctatcacctggacctatgtgaatttcttccaaatcatcagccgacatgaaaccctgtccttgcttgtcatcgagatcatctactgtgtccttggtgtagacgtttgaaccctccatgacgccctcaaaagtttgaaccctccacgatgcctcagaataatagcttgggctctccatcttcaattggttgtatatcagaatcagacacttttagaaaatctccatcccaaactttaccagataagcaatcgagaccatccatctcccaaagagctaaatcggcactggcaacattgactgacctgtcggctggcacaattttaatcttgtcgccttgcctctgaatcaagcattgatgcatggttgaaggaatacaacaattagcatgaatccaatcccttccaagcaacaagttgtaagaacccttcccatcgatgacaaagaatgttgtagggatagttttgttgccgactgtcagttccacattcaaaacccctttggtttctgatggattgccaccaaaatctttgagcaccatgtttgtcttgatgagatcctcaacatttctgctcagcttcctaaatgtagcataaggcatcaaattactgcagccccaccatcgaccatcatcttagacatcgacttcccattgacgtagtcatttatatacaatggtttaagatgccgattctctgtcccttccggcttctcgaagactgcttgttctggtgacaaaatcaacttagccgattccccttcaactttatcgacatcggcttgcttgaccccaaattcagcaggcaaggtgaacccatgttaaccgatgcaatcacaaccccttttcctttagccaatctatttgcttcatcggctgcaggagcttgattcttaacacgccactcccgcttcggcttggtcttctttaaccgatgattgattttttactcaacctcctgaaagtgctccctgtttttcaacctttgacccttctcttctgattctttgtaaaaatactatgacatcattgagtcttcctgccttcattgttctcttggttacaatcttggttcaccgggcccaacctttgatgaacaggaactcttgcttgccttagctgattgcctctattatacgatcggcttgaaccttctgcaacattactgcacccaggacagtcttcaatagatggtagcctcataccttcattccagcaaaatctaaagaactcacagccccaatgaggatcaaaaccgccatcgtcttcttcataatgcatttcctgctgtttgtcatacttcttctgatactttttgataattttagccgaattcacctgaaaacctcttgcacgacctccatcggctgttcgaccagctgtatgcaccatattgacaagaaaaggattaccatcaaccttcatcggcctcttagaatcatcaaatttgattttgcctccttcaatagctgcctggacctactgcctgaagaccttgcaatcattggtagaatgagacccagaattatgccacttgcaataccttctcttgctcaattcttcagccgatgggattgtatgaccagcagccagttgaatctgtttctct

SEQ ID NO: 76916 - DNA, 9440 bp, Oryza sativa
attatatgttttcatttgaatggtgtgtaggaacgccatttctgtactggtttggccctcagccccgaatctgcgtctccgattacaacttggttaagcaaatcctttcgaagaaatatggccatttcgtgaagaacgacgcacacccagctattctgtcaatgatcggcaaagggctggtgctggtggaaggcgcagattgggtgcggcatcgtagggtgctcaccccagctttcaccatggacaagctaaaggtaaatggtcattctaacctggctccaatttctagcaatggattcctagttccttcagaaaatctactcagattttgtttgggagaagcttcctattcctaattctaatcaaatttatttcactgttctgcatttaggtgatgacaaaaacaatggccagttgtgctgaatgcttgatccaggggtggttagatcatgcatcgaacagcaagagcatagaaatagaagtggaattcagcaaacagttccaagatttgacggcagatgttatatgccgtacagcatttgggagtaatagtgagaagggaaaagaagtgttccatgcacagaaacaactgcaggccattgccatagcaacaatactcaatctgcaattaccaggattcaagtaaatctatctattcatatttcaccagtacttttttttcttggtacaaccttactgctaacgaatggcttctttttgattgtaggtatctccctaccaaaaggaacagatgcaagtggaagctagaaaacaagttaaggaacacgctcatgcaaattatacagtccagaattacctcagaaggaaatggatacggcgatgatcttcttggcgtgatgctcaatgcttgcttctcaacagagcaaggagaaaaacgagatgagctgatcctgtgcgtggatgagatcatagatgaatgcaagacattcttctttgcagggcatgaaaccacatcgcatttgcttacatggacaatgttcttgctcagtgtgtatccagaatggcaggatcggctgagagaggaggtcctgagagagtgtagaaaggaaaatccaaatgcagacatgcttagcaaactgaaagaggtaagaatataccgtgcatggattgcgcaaattaaaacagaatttagttcttgaaagtatgttttggaggctacggtttgacaagcgtttctgttttctattgttgtggcatgtcagttgaattattcttagtatctcattgtggcaatttgtagctgtagctaacattgaagtttgatattgcagatgacaatggtgctacttgagacactgagactctatcccccagttattttcatgtttagaaaacctatcaccgatatgcaactgggaaggctccacttacctagaggcactgcgattgtgatacctattccaattctgcaccgagacaaggaggtttggggtgacgatgccgatgagttcaacccgctgagatttgcaaatggggtcacaagagcagcaaagatcccacatgctcatctgggattctcaataggaccaaggtcatgcatcggtcaaaactttgcaatgttagaagcaaagttggtgatggccatgatcctgcagaagttctcctttgctctttcgccaaagtatgtccacgcacctgcagatctgataacacttcagccaaagtttggtcttcccatactcctgaaggctctggatgcatgagataatagttttgtatgtagctactattagtatgatttataaaatatgtatattacggggttgctagagcttcgggcgttatagttcttatccaccagaaagtacaccataaaactagaagatatgctgaagaaaggctgcaatctacattgttcagtgtattctgcatgtccagtctcttattatctataaaacttgtcaaggatatgcccagattatgtgtagaagatataaaaccttcaaagtctaatctgaattttggatggaccacctgatagcttggtctagcagctaaagatagaaagcccagttactgcctgatttggagctctatatattggcctgtatgacaacagtggaaaagcaaaggttgcccactcaatagcatttatgcagtaagtccaaattgtcctttcagctttgggtgctccattgattgccacaagtcatatctaatattcaattcgtctgtatgtgaacaacatatttcttatgtgaaaatgaagtacaaccaatacatggtgtgtacatctcgagaaaaagagagatggatgacacctgtttgaatggattgcacatgacatgaatagtccagcagctatggctgtcaaactgatctgtcctgaactagtgattaaagaacaggacaagtgataacgaatgcagggttgttcaattgttagcacactgttgtgtcatatggtttaaaacacctctagaaaatattaaaacaggagaatcaaaacatccatgtcaatcaattggtaagggtaaaggttgagtgctactaggaattctatgagaaggtgtagacagctgcagtgctcagcctgaggctgtgtttagttcatgaaaaaagttgaaagtttggggaaagttggaagtttatgtgtgtaggaaaattttggatgtgatatgatgtgatggaaagttggaagtttggggtagttgggggtgaactaaacacggcctgagtcccttaacagaatccaattatgattcttctagtgaagacacaataaatgaagagatgcacacatgtctcggcctcaacagagcccatatttgatacattaccttctctctcttttttttaagaaacgacagtaggagttctaccagaatttaattgaccctgtttataaggaaaaccagatcaaaaaccatacaactgcacagttttgctacagggaacccggcgaaaccccacagaagacaaagcaaaaaaacctgtggcaaaacaaccacgaaccataatggtgaccgagagaggagcaagaccttcaaggcgaaacctccaaggagggaagtaacgacggaagccgctaccaacgcccgcctaaaaaggacagggttttcacccaaagggaaagagagtcagcaaggcaacacctccatggaggatacggcacccgcaggcgtcgatgttgccgatcctggaataccaggcagggcttttgcccgagactcccttgaaaggtgcaggacctccaagaaactagagcagagtgctgagagttatcgttgcccagctcatcggctaaacccgatgcattaccttctctgctgagccatgtagattggtggctgttattttcattccacttacggtaatgcagtgtccctttcagttcatcaagggacagaggatagcatacctgataccttcatttgctacttgatgttgattgtgccatgacgtcctactatctgcatggcgtcatgcatgacctcatcttctgtatctcctgtacgatttcaattgcatacatacaaactaaaaaaatgtctctactctgaaagtggccgcacaacccaaaaagaccaggtaaatgcatacgagaaatttgtaaagtaaataattctctgttccattatttttcttctagaaaaaaggcagcaggatctctgccccaatatttgagatagaaacagcatggattctaaactgagattaatacacaagtaggcactgtacggtgtacgattagaaaaaacagaatgcacaagagaacagagttcttccccagttctttaatgacataaaacacaaactatgaagctagaaggatgtgcaacaaggcaaaacctggttctggtgtttccatgtagttatcctcgatgtcactcttacagcttcatcttctgattgccatagcctcaaaggtcgtatctcctctttcacactatcgttaagaagtgatagaaaggaaattcagcatggtttctagaacaaaaggattagattcatgactacaaattaatacacaagtaggcactgtagcatgtacgataaaaaacagaatgcacaagaatagaaaacagagtccttctgggcaatatgccttttctctaaaaaaatatagtccttccccaatctgttagcgacaaaaggacacaaaatataaagctagaaggatacacaaaatattgtagaaatccgtcgtgtctcactctcacaattttaccttctttttttcataacctcaaaggttggatctctctatcacactattggtaagaacccctttcatgtagtttccctggtaaattgaactatgctgttgctctgacatgaagaagttaattttgaatgtgcttacaccgaagtctttttttttttcatttccactcagccaactactagaacaatgtagagagagagagagagagagagcaaaaaattagtttcgcaaggaccaccttcagggctagaaggctaggacagacacatgtaaggaccaacttttttcttatgtcatcttttgtataaatacaccataaaaactataaatggccgaggatatgcaaatactccccagttccttgaaaaaaccatatctctactactataaaagcattgccatcctcctccctccccatcacattgcgtgcacaaccagcaatcctcgagaaaaccagaaaaaaaaaatcaaatggttggttaaaaaaaacccagaaaaggcggttagttaaaaaaacaaccggttggatcctatctcagtcatgcagctcattctcatatgggcctgttacaatgcacgggcatggtactagtgactataaatattgcaccaccttcctttcctctcctctccataatccaccacctctttgccatggcctctcttgctctggttttccttgccctcttgttgcctaccatctcatggctatgggactacatcattgtgccccatatatggaggccttacattgcagccaagaggctcagggagcaaggaatccgtggaccaccctacaagttcttgaaaggctgcaatgaggatgtgaagaaaatgaaggatgctgcagatgatctggttcttgatgttcatgaccacaattacctcccaagggttatgccatagtacctgaaatggagatctcaatatggtactagatctgctcaatgcttttttttttaatatgctgttgttttagtgcttggttagcaatgctgtatggtggccaagcaacctgactgacaattttcaaagctaaatgctcatccttcactataaaactaagaatagatcactaatgtggatggtaagcaacattgcaaatgtgaattgttgcaggagagccctttgtatactggtttggggcaaagcctcgaatctgcatcttcaactatgagtgggccaggcagattctttcaagcaagtcaggacactttctgaagaatgacactaccccaacagtgttggcgttgcttggcaagggactagtactggtcgaaggaattgattgggagcgccatcgcagagtaatcaaccctgctttcaccatggataagataaaggtaatcttatctcaatcgtcttaacatgtaggtgtgctagtgctacagaactgagtatggaaatgcaccccagaaactataataggttgagcagaaaactcgaggcaacttaaactaggttgttatatgtttgcatgtccatttgcaatttcacatgacagttcgtttgtagtaagaaaacaccagataaaaagaaaccaaaatatcgaaaccataatgaaaaaaaaatcaaaacaagacaatagaaaatatatcatacccaacacatttaattgcaacaaaattaatattagtatcgcttcactttgatatccatgcagatgatgacaaaaacaatggtagcttgtgctcaaaacatggtgaaggaattggaagatcaagcatccagcaacaagaatggagaaactcaagtggaattggacaaacaattccaagagttaacagcagatatcatatctcatacggccttcggaagcagctataagttaggaatagaagcgttccatgcacagaaagagctccaggaaattgctgtaaaatctctcctcaacgtgcagataccaggattcaggtaatatatctaatactcccttccaaagcttgtagaatgtgaaattaaatcccacgaacatgcaaccatattttggctcattcattcatatatttacttcttttttttttttagttcagctaccttcctacaaaagggaattggaggaaattgacacttgaaaagaagcttaggggcactctcatgcagatcatacaatcccgattatcatcaaaaggaagtggatacggaagcgatctccttggtttgatgcttgaggcttgcattgcaacagatcagggaagggagcaacatcagctcagcttaagcatcgatgaaattatacatgagtgcaaaacattcttctttgctggtcatgaaaccacgtcacttcttcttacctggacagtgtttttgctcagtgtgtatccagaatggcaggcaagactccggttggaagctttgagggaatgtggaaaagaaaatccaaatggtgacaaccttagcaaactgaaagaggcaagaaaactagtacctatgttgccttttataatctattttgatatcttttttttcttgtgatatgtaactccatgtgtatcattctaataataatggttcatgtatggctaactacaacataacatatatatatatatatatattgcagatgtcaatggtattccttgagaccctaaggctctatggtcctgctcttttccttcaaagaaaacctctaacagatattacagtaggagaaacaaaaatacccaaagaccatgcaattatcataccttcagcaattatgcaccgggacaaggagatttggggtgacgatacagatgaattcaatccattaagatttcagaacggggtcacaagagcagccaaagttccacatgccctactggcattctcaatagggccaaggtcttgcatcggtcagaattttgcgatgttggaagccaagtcagttatggctatgatcctaaaaaagttctcattcacactttcccctaactatgttcatgcacctgtagacctgttaactcttcagcctaagtttggtcttcctgttgttctaaggctactggatgcatgaagttagatgatttacatgttaccaaacttaaatggaatctgtatgccaaaggttgctactgacctacggcactatacattgtaccccacagtggatgtatccttataaaataaaatagctcgggccatgattcaatgtgaattactgttctggtgcaaggttggtaccattttagcataatactccgtatatagatttagtatggatattatactatcattgcgcgctacactttcggggcaacatatttttttttctgaggtatctttgtgatgctacttatgattgcaggtctcctctgaaaaccacacaaattatttcaaattcttatttgcacataaagtaatcgaatacgcaaatcccttgtaaattcacttccatagcaaaacaattgcaaaattgaaggttagtaatcttgtagataattttctgcaagcactgctatcgttgcaaaataccagcagtagctgtgcaggtttctgctacctttggcttatgaaggaagaaatatataacctatatatagatcagctgatttttcatgtggttttgatcccaaggccactggattagattccatagagttgcttgttcaatttgataatttcacatggtaaggaactcagcgcgtaaagcgatgaacacttttgatttctgaagtgggcaagtatatatatgatttggaacaaagagagagacatgagcagcatcaagtacatccaagcagggcatccgggagctcacctccggcgtgggcgatcgagaaggatcaaccaccacggggccgctccattgccggccctcgaccgctgcgccccttgctgttggggatgtagcgcaccttgcccagccatgtcagacgcgcctcgccgggcggctaccaccaccatcaccagccggccggccggccagctccagtcccccggcgcccggcatcctactgacgtcgacccccctcccgacgacccgaccgccacgcgcgcagcggcgcggcggcggcggcgagaaatcaggttgcttgggtcatcagttcggcacgatgacggggaaaggaaaaatcgatttgacgccttgtgccgcggaacaaatttgcgatttgtcacggattatttaccctgtctttaaaaataagttttcttaaaaaaaattgagggagactattctactttttttaaaaaaactgttatctttgtggagttttttttttaaaatatttaatttatctatatagttatatagataatcggtaataataatttagtgaatagtgtatgtttcaatctaatagatggaaagctaaacttagggtgcgatggttttaacttttcaggattagattctcctcgtttttcgttagcacgtttttcaagctgctaaccggtatatttcgtgcgaaaactttctataaagaagttgttaaaaaatccaacaaatttattcataaaaaaattatattataatacttaattaattatatgctaatattatttctcgttttgcatgcggctaaacagtccaccgccaccgctgaaacgttctcacccttactcgaaaagtactagaaagtatatagctaatagctccctgtttgttgtagcagaacgagaagggctgcttcaacccctagggatccctcaccgcctcttcgaccactccatggtgaactcctcgtgaccatgcaaatcctagccaactttggaggggtttttgtcaaaaaaaaaacttcttcaaatgttcagctgtgtcgatccattgtgaggatggtgactcggctatgatccagggcgaactgccatgttcggtcgcatccttcctgtgcaaatatcttgacattcctctctccacccataaattgaggaagatagacctgcacccattgttgataaagtaacttgacgactgctcctatagtaagcggagaaaatggtgccaatcggtatcatgaaggtgaagggagtcctaagctcaatttcaatctatttattggtttcaagtggatgcaccaaaatggttccttaaaggaattggcaaaatctaccatggattcctctaggctggatgggcaaatgcacagggtgggcattgccatgttgccaggtcaaaagtttgtgccatagtcaactatggcagccttggtatcctaaatcttgggctcatgggtgaagcccttcattcatgatagatttggctataacgcacatcaccgttgaagctttggtagggactagtgatcccaagcttgcatgcctgcaggtc

SEQ ID NO: 76917 - DNA, 6570 bp, Oryza sativa
tcagcaaagcatataagataaatatggttaaatcaggtaagatcggctgaaaccccgatgctaccgtaatcggccaccaagaagcaggctaaaggttgagattttaattacgactcataagatcaaactcaactgatgcagctataagtataaaaagaaggcaatatctagacaatcaagccattggaagtttcatagagttgtggatatcatatataatctaagccaacgtcgctatctaacctaatcggctgccttctaccgacatatgttagctgattgtagattagatagcaatattgccagagattatataagatatataataacttgacgaattacataaacaagattagagtatcataaagatggaagcactaatcccgagaacgcaagccgccataaaaagttttacctcttgttgaagatcgaaaccgatgcagctcaacccgaaagtaagaacttgtcgaaataaaacgaaagcaaaaagggtggcgatgcgccgagattgtattgaacgtgtgttcgtttgattacatggggttcggggtctatttatacctgagaattacaaaacgtgtccatatcggacacgactcttatctctaacaaactctaagataccataagtctttgtggcagacttttgcccaaacatatgtctaaggaaattacataaaatatcctaattaatagatataattgccttctcaggactctatccatgtgtggcaatcatcttgaagcacgtcaacctaacccgacaatgtatgtcgtgtcacattgtcagattcggctcgatcggctaaccctgtctgactcgatctctgccgaccctagtcgtagccgatttggacttcaaccgatccttactctggttccgggatgattttcatctcgaattccatttcggtttcttcttcatctcctatccttgaattaccaataacaggtttatatatcagcaataagctaacataatacattaaccttaccttaaacttttcaaatcagatcttctacctagcaccatgtgactgacagtgtggtgatgcatctatcgtttgagtgcaggtaggcgtagtggcggtaacgatccctttcctgattctttcctcgtcgcacaacgggttcgtcaggatctggattgtgttggccatatacatgagcatcagagcctttattagcacctggaggtaattaattaacactctatatacattcttgtgcaactgcccgcggttttgctgtctgaataaaattgaccttaatttaaattttgttttcgataatttggaaacaatttctatatgcgcgtaatcgatctaactgaaggttttatgtactatttatgtatgatggaagcagacagggggccatggacgcttcttcgcacatgggcacctggccagtccaaaagcaaaaaatggttttgtttgggggggaaatggtgagatactgatcaagtttgtggttttgatgtgtgatgcgatgattaatcatgtgattagacaacacattatagaacctctttttttgtgcagaaaccaaaaaatgcgtggaatttacgggcttctattggggattctgctatttgatctcaccttgcaggtgttggttagcaagctggattaattcgttagaatatgccaaattttgggttgtgtccgcatatttaagttcgtttttaatctgtttgttggttctatacttagggttgtacctgtccggaggaagaaggaaacagcatggcgaatcttcgttctgaaagggcatgcgtgccggcgggagtgttggtcggatggtggcaacgcatgctttggcgtttggggcggagagggtgggccttgccgtgggtgaaacgatgctgcacactgggctctaggctagcatggcagcgcaacgtcacaatgcctttgtctggcacgctgcgcactccctcactcatttacacctgtggccaccgtctgtccttgcttcagtccttggcctggtttaattgatggacattttgagattgtgttagtgatgatgagtaacaacaagatactatacatcagcggagtctgagactgacaacaacaatggcatgcaaaattcaactcatataaggtgagttggtttgattgagtcgtccattttgcattagttattttttgaattatttctgttcgcaatggtctactttggttatgctgaccgtttagtattgggtacatacttatgtttccaagcaataccaaggtgccattgagaataatctatgttatatgtgattttgtaggtaccgagcgttttgttgggtttgctatctattggatgccttctttacttctgaggatgcggttggttgcattgcatgtatgcctgatgtttgtctatatgtgtatgtacgtgttccgatgcacacgtgtctgcctgagtgttgcgttgcatgtccacgttccactgcagcacctgccgttggggcaatggggcatggacgcgaaccctgggatctcaaagccgtcctagatacttcattctttcgtgcttattagctccctctattttattgtgcttttgcttaataatggaatgtaatttttgtctttgccagtatattagcttatatttaaccactacatatattctgcatctcaatgtattctgtcgcatcgtattaccctcgacgtagttccttaatccgttaagtactttagttgtccctgttctgttgtactatattatttatgaataatatataatgtctttggtaatgtattatcttgtacttaacaagttcaagcatatgtattcatgcgcggcgacagcggcgtgtcgccgcgcttatccttctagtaaaaatccaagttcggaagtcttcggaagagttcggatatggctctagcagctttcttttcttcttttgtaaggcctatactttatttagaatattcttctttatacaattctggtattataatactctccgagtatatgaataccaactttactttatatccgagttatattgattatactgctagcttatttgggagatataatggtacgggtatagtgtttgcttatgcaatcactctgtcatgacgatgatattagagtagtatctggtagtttaggcgtggtgtcttactgggtatcattatttggggttatatgctgcggaagagaggtgggccgctgatggtgacagctcagcacgggtattcctccgcacgtgtatatagtctaagttaatttcctgaggaggatacttctccgtatttagccccggttgtatagtcatgacgggctgtcgtaaggaattcggcagtcaggggtggcttctcgaagtaccaggagggcattggaaagatggtattagctagttaatcttatagctaggatgtatatattatatgtatactagaagtataggaatatattcttttctattttcttttcacctagcttagataatttaatatgagaatgagtagccttatgcttgtgtgtcactctaccctttgcttatattatcccctatttagactatggttattacaggtaatatataaattattagtacagttctctctactataatctttccatgggattaaacaaataccatacacttggaatactctcgggtgaaatgttacaatggtatatccgtgcgcgcttgcggataaaatatgtaaccataatatactaggagtatttctgcaccattgatgagaattatatttctagtaatgttgttaagaaatacccacagttataacaaggtataaacacccaacagattgagacaattatacggatgaactattaatacaatatgtgttgtattcaattgctcttatcgagtgaacatctctgttctccgccttatctatattttaaagatgcgttcgccactggatggaaatagaggcggatctacccattaggcagggtgggtcgaccaactcagctacaactcgtgtcaccctacatgctcatgacccccttatccccttatagtagtcgtgggccatcaaaatttggtataacaaggtataaacatccaacagattgacacaattctacggatgaactattaatacgatatgtgttatattcgattgctcttatcgagtgaacatctccattctccgtcccatctatattttaaagctgcgtccgccactcatggaatcaggggcggatctacccattagtcagggtgtgtcgaccggctcagctacaactcatgtcgccccacaccctcaagaccccttatccccttataatagtcacgggccatcaaaatttggtataacaaggtataaacacccaacaattgagacaattatacgaataaactattatagcaaatttaatagtatagccaactactaactcgaaatcacctatagtcaatttaacagtcaattcatataatagttacatactacactgttaatacctggtctcatctatcatacgcactgtgtcttggagtccatgctacagctggctacaaatctttagtttgttgctattttctcttctcttttatctttataaaatatatttatagctgttattgtacattctcttaatacgatatatgttgtgttcgattgctcctatcgagttaacatctccgttcttcgtcccatctatattttaaatttgcttacgccactggatggaatggcggctcgggaggtggggattggaagctgttgctcgcgttcgtattagagaaaggacgggagtgaaggacggctaaccggcgacgaggatcgacctgcgatggcggcggcgatggtgaccccgatttgggtatatttgctctgattgcgatcgggctccggcgagggcctaattggggtcactgggtttaggggaacttgatggcggcggcatggtggagaatggaaggtgttggtggtggcttggcggcgtgaagcggagagcgagtgcggcgacggtgagtgtcgctcgcgaaggtcgagcccgagcaggcgctagagtggtagagtgaggcgcggtaggtgatgggtagcgctagaggacgggcggtggctcggggagttatttttcgccggtgccgagtgcggagacgaaacggagcggcacgatgggacagggcagagcgcgtgtcggccgacagcggcgcagcagcgagcggtgctggcgcaggggcggacctgtgtacgcgcacggcggcggagaccagcaagatggacgtcgcgaactcgtggctcggcgtgtgaaagcgctattccaggggtggcagaggggctgcgagtggcggcgtggtgtcgggaggtgccggtgcagactgtgcagtggaggtgttgcggtcaagcacggcagcaaagcggcatgtggacattttgtcgaccggctgccgggcgtggggaagaaaaggaagggccgaaggatgtaacagacggtagcggcatgtgggccccgctgtcggtggaggagcggacgcgtgcatgctgcggcccacgggccggtgcggcagagtgggccgcgcgagcgtgagtgcgagtgcgggtgagtgggcccgcggcagacgttgggcaacggtcggcggatgcttggatcgagatctatccgtccggtcgtcgcgtcgttttgagggctgttccgtccgtctagtagtatattcgttcagaaatcccctcttctcccagatccgcctctcgctcccccaagttcgggtgttacaagattatccccggttccttcacccatccattcccggtggcccttgtttaaccaagcctggcaggcttacccaccgccaactctactcacccctaactcccctgccgccgtccttcttcttccttaacttcggcgcagggccgccgccacgtcgcaccggggtaacttcgagtgctcccaaggtgacaaactttctttcgctttacttggcctattttggaagatatcacttaacctcttatttaggagatattacttaacctctttgacgggttcccatgggtttagcttttgaggcttcccctgtgatctgttttttttttctctatctctattaatatactactactagttgtttttttttctccatctctattaatatacgaggcaaagcttttgccctctaaaaaaaatcttggcctattttattcatgcctcataacccgtcacgtttaatcgctcgtcgcctgatccgggccgaacacggagtagaatccgtttcggtatacataaccggatgttcttatgctgggtgtgtttataactagttataagactccatgcatgctacaaggcatctaatccagtcattgctagcatagacagcaccccctgccctgagtatacggtattccacccatatttctgttaacgaggtatatttgctgttgctagtgcttattacgccatggacttgaataccgcaaagagtatgatgctggacgacagcaacatcagcccaagaaagaagacattcacgacacgtaagaacaccatgctgagcataagcagaaacatcaatccagcagaccaagaaatgctcaaaacatacaagaggagaagagtgaacagggc

SEQ ID NO: 76918 - DNA, 18655 bp, Oryza sativa
  unsure (1)..(18655): unsure at all n locations
ataggatgtttgtctttctgactgtcaacgaactaacaaagtaacaatgacactttcctctgcacttgatactgccatttctcgaccatgtgaatggcgtgtgcaaattaccatctgagcacaacacgtgtataataagtgtcagcaaatgggcaaattaccatgtcagcaagtttacttttagagtaattaaaacatttatacttctattctttatggcccaaaagcgaagcctaaaaatagaaaacaataaaataaaaaaaacccaaaattaagtttcaagtttaaattatagtcgtggcttataagccctacccaattccctattttttgtcagaaaccaaaagagatgtgaaaaaacccaattaacatgaaaacaagagatatcttattttattttatgcataggatctaaggctgagttattatctcagtttttctaactcacatatctcgttttccgcacgcacgcttttcaaattgtcaaaaggtgtgtttttttgtaaaaaaattctatacaaaagttgatttaaaaaatcatattaatctatttttttaaaaaaaaatagttaatacttaattaatcgaatacttaaaaaaaatccgttttacgtgccggggaacacaccctaaatctatactacttttgaaatagtagtggtggcagtaccaccccacggtccactatcaactccctacttttgttaaagggttaattggatccatgccactgcaaatgtggcaaatcaaaaaaatgccacacatattcgcgttatcggctggatgccactgcaaatttttaaaataagaaccatgccactccatcatgatttccgtccaatctgtcacattttccgccgtctccgtcttcatcttctcgtcgtcctcgtctcaacggcagcaccagcacggcagtacgaaggcaggcgcggatggcagcacggcagcacggtggcggatggcagcacggcaccggcgacggtcgtgccagcgtccgctccccgcgcccctccgtgacctcctcgccgacttcctctctctccaccaccgttgcagccgtcgtcgttgaccatctccgcggtggacccaccgccctcgccgtcgtcgaccttatctgcgcgggagagctcgggagtcgccgccgccattgttgtcctcgtcgtggtcatcgacgagccgcaccgcctctgcccagatctggcgaggagggccgctcgtcgttgctaccgatggaggaggcgtcgaccctcgagctccgccgccgttggccccaagctttgtcactggtgctgccgacgcccatctcctctctccacacgaccatcctcggcagcagctgcgcaccctccgcgacctccccgcgagcgtcctcggtggcggcggcggcctcgctcacgaccgtcctcggcggtagcagctacgcccgcgcccgccttcacggccatcctcggcagtagctatgcccccttcccgacctccccgcgagcgtcctcgccggcggcggctacgcccgcgcccgtctccgtgaccgtcctcggcagcggccatgcccctccgcgaccgtgctcgtcggcggcggctgcagctgcgccctctccctgcgcttgcgactgtcctcgccagcggcagcctcgttcttgctaatcgccttctccccgtgcagacgtgagagagagagaggaggatgacgtcgtgagagaggaggatgaaaatagtgacaggagtggcatggttctcattttaaaaatttgcagtggtatctagccgataacgtgaatatgtgtggcatttttttgatttgccatatttgcagtggcatggatccaattaaccctttgttaaaagataaaaggattgtagtcctaaagggaacacatgtcaatcacctctaccatccaactctttttttaagaaaaaaaatgatgtaaggctagatggtccatatatcagtactttctctgtttcacgatgtaagattttctagcattggctacattcatttagatgttaatgaatctagacatatgcatgtgtttaaattcattcacatctatatgtatgtgtgcaatggtagaaagtcttacattataaaacagatggaataacaaatatatgtataaattaatacgtgatatataaaaaaaatatggtaatagcgggttaatgatctgttgcaacgcatatgcaatatgctagtgactaccaaaatttaaacaaaagattattgtatcacatattagctcacaacaaacactacatatgtaaggtcaaattcggtccatggatgaacaaagaaatccaatgtcaaatgctctcactttttcagtttgtttatttttctcgagttataaatcaaattcaatcttacatgataatctatgttgactagctttttaagagtattttttttcttagctactagaaagtatgaaaggaagtgctatcaaggttctggggagctgtttatcatgcaatataaatgcatggtcactacctggttggtcacataactgtaacacggagtcacgtactgttattaagagtagtcctcgtcccttgtgaatttggaggtacagcttggagaattcttctgacttttgacgggtcaatcctcatgtaagagttgtcaacttgtcaccgtcaccgtctgatcatgagatctcacgaacgtccacttgcaaagttacttgccttgaatgggaaaaggccgtgttaagttgttttcgcaaaaaaaattaacctacacggacacgcatttaaagtattaaacgtagactaataacaaaataaattacagattccgcatgtaaacagcgagatgaatctatttagcctaattaatccgtccttaacaaatgtttactgtagcaccacattgtcaaatcatggcgtaattaggcttaaaagattcgtctcgtaatttacatgcaaactgtgcaattgatttttttttctacatttaatactccatacatgtgtacaaatatttgatgtgacagaaaagttgtaaggttgaaaggaactaaacacagccaaaaataatgtgccattctctctctttgcaggatatgatgcactgcgagcatatggaacattttttgcaaacacaaggaaacatggtagaagggatatgtttaaggcattttataaggaatttatgaaaactgaactaaattctgtgaaaaccgtagaaatccatatgttttatggagagctcgctccaagtttggcgtcctggcatggcaataaaacgtgtgcgtgtaacgaacggaaaggcgaaatttttcatgaataattatggcacacaagaaatgtatagtcttgggtttactatcttgagcctccttagctttatatatagttaattattagacaagtgccataaatttcctgagagtgacacttagctaacacacctgacagtcttgagacaaagaaccgaaggatctcattaagaaaaacaggaaaaaaaaagaaagggatttgcacggcacgcgtttggatagactataaaattgtacctttttctatggaccacgagcacacatgcaatgcacaagcagcacaatgcgtacaaacctacctcacagaagcttctcttctacctcttggcttcgctgatcgatcaagcttgtgttaattgctaacaatgtgatggtcctgcttataaatcatggtacaaccgattaatatgaagatccacctgggagcatgatcaccttttgtcttgtggaagaaatcaatttgcttcattgttccttcggaagctcagaaaagtcagctgacacattcagagatcagacaactcgtttcttaaagtgaatagtcctgttacaggtctttccaatgagtttgatacgggaaagcaaaagaaattacgtgtggtctgacctcacaggtgaacgtgattcacaactgcttgatcatggtgcagtgtttgatccaaatggttttgaaccatggaaattttttttcccagaagctgcaaaaacagcgcaaatagggtaagtgaaagtgatgtttacagaacagtggtgacatctctctaagatttaagaaacctttatgttgacattgcaagtacgtaaaccattattattgtaactaatggactaagtgttgtttgttaaacaatatatagcaatgaactcactttttagttttcaagcattggttctgaacttctagttgattccgttgacaagtctacaggctgcagaaaccagcagtggcagtacaatgatcagcacggcaacagtgataagagaataagaataagagcacatgtttgtaaatttatgtggttgttgatgtgtgggatctaataacagcgatagccatgaaggaccttatctgtttgtactacaaagattggcatatccccagctatctgaatccctgactctgacagttacttgctacacaatacctatcaatctctcagaaccacaaaaacatctagtaatatctatccatggtgctcctctttcacaaattgataaagatgtgtagtacttgttaagaacagaacgaattgggaacaagagtggccataagtagatagaatgatggtatgggtgacttacacttggctcaggctgagagcaggaaagatttggttccctgtcctcagaaaagaaagttcaccacttcctcaagctctgtccaaccttgcttcatgattgatctcttgttcacagctttcactcctgaactccttgtcatgtaaccatgcagcttccactgtaaaaaggaaacttgaaagataaatttataaagtatggtagtaaataaaaataaaataaaaatgtaacttaaacacactttactttccagccgtctagctccaccaagagtccaggtctgagggaggtgaaagtgaaaaaagaaaaagagagcaaaggtacaaaaacttttgccaaaattcataccactctgacaattgacatcatcaagcaccgataaaacaataattaacatcttttactttcagttgggcagggatggtgaatggccaagtgtatttctaagattgcaaggttgtattacatgtttggcagcaagaacaaaatgctggtggacaaatgaaatgagagatacaattagccactgcattcaaacctatgaagaggtgaatctcctatgtatatacagttctaatctcaaaaaacacagaaagactaaaagaacaaaaatgaggatgggaatgccacccatgttctgctgttagccttagccacctatatcatcatatgtcataatcaacttccgtgctgtttaccattgctgcacgcttaacaagctgcccttgctcattgtagagatccaaattctcgcatggttttggaaacactgacccgatgacacgcccctcaatgaaggaacactggaaaatatgtttcttcttgtagctgatgccgatagacatgtcctgaaagctgatgtccttgatgggaatgtcactgctgccatgagcacggactggcacccggacacctcgcccatgtatttccttgaatgatatgtttgtgatgtctggaaaggcatcccggtcatacccatcatcagcgtgctcattgtagtcaacctttatcacaataccagcacggacattgtcgaaggttatgttgcgataggagatatcgcggatgtagccccctcttcctatggcagtctttattctcaaacctcgccgtgactcccaaatgcggacatcctccactgtaacatttgcaatcccaccagacatctcactgccaattgaaattccagcactgcacacaccaagacaactgttgtaaaccttacctgtaatactctatattcaattcaaaagaacttaaaagttaatcctaatttaatagtttctttctcataccattttatcttgagcaggatttgaaaaagatatgcaaagaaatattttagatgaagcaatgcagccaaaaatgactcaactgttacctgaccaatgaacgagccattacattgcgtatcacaatgttacgagatgggcgcccatatgcaatcccatattgatcccacccactctttaccgctatggcatcatcaccaactgaaatgtagcaattctcaataagcacatcctgacaagaatctgcatacagctatatgtcagcatcaccaaataaaaaaaatgactgtcattgataacagaaacaaacctagatggtataacaagaagctgaaattatgcaggatgattggaaattactgaagaaaggttcgtatgattacctggatctatgccatctgtgtttggagcactagaaataggagctaagatagtaacattagaaacagttatattcgtgcaatcatatgggtggaagtgccagaaaggtgaattcttcaatgttatatttgcaacaataatgtccttggaccacatcagctgcaaaagaggaggtcttgtattattcagtatccttctgcgatgcttcatccaccaaacttcaccctgtccatttatgctaccgttgtgtcctattcaacagagaaaaaatagggagcatgtgaaagttaaataactatcatccagtgaagaagtgatacagaaacaccaaatgctctattagtgcaaggatgagaaccaaatgcatactggaatctctatagtacaagtgtttccattacagtggacttgcatattatacttagcaaagtatcagtaaggaacacaacaacaagagaataagagtgttttaactttttatttattttttacatgagcaggtagtgcgattatgcatactgaaagaaagttcattcagaccaggggataaaaatgggttaaacagttgttttatgtcaccataacatactgccaagtaggagaagtttccatcattaaattgcttaaaattcacaccatgcacttctgtcactgatgttgcttaattcacaattctacgactacatcattaggtggtgtagtttattcagaaaacacttcaaacctgtaatgactacatctttcaaattttgtccatgaatgagacttccaaagcgaggtcctttcctctccctgccatacccataagacggcaatgcaggcatgagcggccaatacctctcgtcctgccatggaaacataaggaatcggtacacctgtcaatcaatatatgcagctctgcgcatgcatctgagatatcacagcatgttttcaaagaccttaattagataaattatacaaccaggacagaattagcagataggtgaaaactagatcatccaatttccacccttttccaaatttcaataacattgatatcacttgagacttcagtctcagcaacacataagacagaaacaaattatccattcataccattgatttctttagccatgaagccaataagcaaactcacttttattcagctatatgcttacccgatcaaaaccactcaaaagaactaatttttgaacttcacgaaaagactatgaatgcattgcaaaattaacagcatcactccagttctattctacggcgtgaggtacgaggtatctttctttttcctttttttttttttttttgcggggaaggtatgaggtatctcaccggaatgccaaggatttctgagccctcggcaagaaatagcgtcatgtggctggtcaggttgaacggcgcggtgagccatcggccgggaggcacattgagctgccctccgccacgctccgcgagcgccgcgatggccttgacggcgcgctcgaacgcctcggtgttcaccgcccgcccgtccccgacgccgccaaaatccgtcagttcgtacgccttggggcgcagcagcggcgccgggcgcgacggcggcggcggcggcgccgaccgcagcctgaggaacccgccgcccccgccgccgccgccgaccgataccttggcgctctgccacaggaacaccagcgtgaacccgatgacccacgcggcggcgagcagcgtcttgttggccgcgaggaacgcggccacgctccgccgctggccgtgggggtggagcctcccgccgccgccggacgtctccaccattgcgctgtccccgatgccggaggcgagatctcccgatctagggcacggcgcgcggcgaggctcagatcgatcggtagggcaggacgcggcgagctcggattccgcggattggggcggaggcaaggggcgcagggtcggggatttccgccattggaggagttggtggtggggtttataagtggagggagcctttcgagtgaagtggaagcgagaaagatgtgggctttttgcggtgcggttgaggggaagaagatgatgagaattaccacactgccatcacgtcacgtgggctgcttcgtgccgtaggatttagatcggacggtgcgtattttatctcctcggaggatgtttaactacttacccacaggagtccagaatccacataatttagaattttacagagggagtttttctgcaatttccttatgaaatcatgcgataatagtgagccattttaggttatgttttttttccaaatataaattaaccaagatgttcagccggcctcctttttctccataaaaatattgtagtgtggaagagaaaatcgaaaggcaggaactttagtcgggccttttctttctctttgccttgtcaatgggcaacccagtcatcctgttcttgttatactccacttttccacaaagctgatgcaaaagacatatatattcttctttttctccccttatgctagctactacttccgtccacgaatacaagtatgtgcgagttgtttagcaaatattaagatttagaataaaatactttggtattcctcgttaaagaaaatatggtcaatagtaggagggtggtaagataaaaaaagagagagaaatgattaataaaacaagtcgtttatgaaatatttatattatagaccgatatattttaagattgacgaagtacacttttcacttaaagattattagcgatcaatgtgagcaactgtgtcaagtctaggatttgaatccagatgaattggttttacaaaaaaatcatttatatttatgaataaatttcacacgcttcgtatacttatatttacaaagagggagtaataatcagctagattggccgctggctgttagctaggactaacacacactatctatacccatactcttctccagtagtacatatcatgaggcgatggttaggtgcggtagctggtgatgagcagcgtcaccaattcttcctggacgccgatcgatcggttttggcgtagcagtcactactcgttgctctgatctctcgccggatcggagttagctagcgtttggtgagacgtgtctctcgttaggcgaataaaggtgggatatagctcatccatcagttgcagctgtgttccagtattgcaaagatcagatgcctgtgctttggatcatatatatgttctgaagatctgatctgatctgatcacttagagcacctaattgcatcaattcagatgtaattgctgcatcaatgcgcccgtgtcggtgggttatggagatgattatagttaatgcaacaagaactgcttaattactcatcatcaacagtagcttagctaactaagtaccgatttgatgtaataagtttcacttcgaaattaaatcaggggtaaagaattccatagttttctacttaagttaacgccaacttacaagcgatgttggaaagttgatcgaattggtaaatcaaatgtctctaaattctctccattgagggatctaaagtgaacttattcccatcgatgcagcagagacggcaagtttcggcccatttataaagcccatatggggatccaacccaactcccgttgctttttgttggacccacttggtgggaacggcctggcactacgtgggccgtggcccataggaaagggaagtgtgtgcctcgcaagcctcgtcgtctctctccggctcgccgacttcgctcgccttcctgccgtcgcctccggtgccctctgctgctgctgccggcgcgtgcgccaccgcagcggcgccatcgccgtcgccgtcgccgctgacctaacgtaggtacgcctcgatctcgatgtctccaccgccactccccgaaccctacggactccctcccaatcacgccgccggggtggcccgcctcgatgcctcccaccgtagtggcgcgccgctgggttccgatttgactggctgcgagcaaagctaagagggtgatggggttgatacgcatctcggttggtttggctgtgcttgcgcgatttctctgtctaacgggtcctgactcctgcgttggtacatatatcgggagatgtgggtgtgatcacccgttgcgattttttcatgatttatttgtttaccgaccactcgaatcagagtatcacttgtgttggaccaaatctatagtatcgattagctgcggatttagcatattgtttgtatcgtgatcgttgtgacactataatggctatgacatgctcttcttcttctgatgatttcaatggttcagctgaaaaatgaagagacaacttcccataaaaggtgcatcgggggcctcgggatctgggcatggaaagaaagctcctcaggagctggagaacgtcttgaagcaacatttcggatattcaggctttcgaggaaagcaactagaggctatagaagctgttctttcaggtgctcttcccgtctgtgtttgtgcttgtagtctttatttctttttagttttgctgaatatttctggtcaaaagaacttttgttgctgatcactgaagtatgctgtctgaaacttttgtgcaccatggattctattaatgtaacaagcaatttatttctaggaagggattgcttttgtttgatgccaactggaggtggaaaatcaatgtgctatcagattcctgctctagtgaagtcaggcattgttcttgttatctcacccttgataggtgaattgatccaccaaacttcagttatttccagaaaaaaatagtacttgacaaatgtgcatatactaatagcttcttgatatggttgaaaaatctgctgcttagcactaatggtaagctgtgttatctgttggtatctttttattgttgttcctgaatactatggatcatcatggtttatgaaaattacaggagaatcaggttgccagcttgaaaagcaaaggtattccagctgagtttctctcgtcaacacaaacatcgcacaataaacaaaaggtaaggtttccacattgtgcagattaaggtttacctaggatattatcaattatttatgaaaattttcgactctttagtttcaactgaaattttgactctataaattcatagctggctgagtttacctggtcacatggttagttcggtatgataacactcttcctcttgactttgtaatttgtcatacatgcctttctcccagatacatgaagaccttgattctggtaatccttctctaaaattgctatatgttactcctgagttggttgcaacatctgggttcaaggcaaagctaacaaagctctacaatagaggtctccttggtcttgttgctattgatgaggtataaattaagtagtgtctttactcctctagtaacaccctgttcttcttttatctgtgatgaagagcatctgtggcttattttgcattttttgtctctacaggctcattgcatttcaacttggggccatgatttcaggtatgcatttatttttagtgtttggtggtggctacttgctttcgtctgttgcccgtttgcagattcattggttaaaaaatgggttgaagcattcctccttgttacagaatttgtaaattgttctactcattttaatgaaatacagacctagttaccgcaagctttcatcactgaggaaccagttcccagacatacctatattagctttaactgcaaccgcagttccaaagtaagacactatccccttaatagtcactacctgccaccatcacttctcttgatattttaatctagtgttttctattcacacttcattctctttttctttacaccagagtccagaaagatgtgatatcgtcactgtgcttgagaaatccattaattcttagggcatcatttaatcggcctaatatattctatgaaggtaagttttccaacttatgggttcttgaacacttagcttgagtgcaccgaccttttatctttagactggggcatttgttttcttggtatgttgactattcttctgtttttacatttccatgctttccatcatctattgtggacgcgggacagtattactgatgttcccttccctcatgattatttagtacttttcagttatgtatctcccagaacatatggttcctgtcaattgtttactgctatgcctatattttgtctctatgttcaattctctcttaattacatattataatataaactactttttgcagttcgctacaaggatctccttgatgacgtttattctgacatatcaaatttactgaagtccagtggaaatgtttgctcaattgtgtactgtcttgaacgtgcggtttgtgatgatctaactatgcatttgtcacagcagggtatctcctctgctggtacgttaatttaaagtcacaatttctaagtcttaagacctattaggactgttgaattgagaattttcatggcagtcctgtgttctccttatcagcttatcatgctggcctaaatagcaaggtgcggagttctgttcttgatgattggctttcctcgagaactcaagttgttgttgccactgttgcatttgggtatagtttccctccacatcatttgaaatatcatttctgttatgtgacatgctgattccatgtctacaagttccagcacacatgtagtatctgagtactgttaccttattaccttccaacctgtagtacttgtttatgattgattttggcttctgtacttatattatatattttttccaaatgaggctcttactctgtttccctctacatcgcctctttcaatacgggacttcgtgtgcattgatatgttgattctccttccacagaatggtatgttatactaattgttttttttttgtcagtctttctgaagaagtgctttgctaatacattgggttttatttttttttcagggtattgatagacaagatgtccgtattgtgtgtcactataacttgcctaagtccatggaagccttctaccaggagtcaggacgagctggccgtgaccaacagccttccaaaagtgttctatattatggattagatgaccgaaagaaaatggtaattaggtgccagattgtacattgtcattgaacatgaaaactgaggcttctatggtcttactcttacaggaatttattttgagaaacaccaagaacaaaaagtcagagttatcgtcctcttcaactgaactttcagagaaggccttagccgactttagtcaggttggtgcactcttgctacctaacatggaattggtctactatatcatgcagtagatttcatgtttttttttacttgcatctcttgatgcagataattgattactgcgaaaattctacctgccgacgaaaaatgatcattgagagctttggggagaaggtatgacattaatcctgaatatattactaatactccctccgttttttaatagatgacgccgttgactttttctcacatgtttgaccattcgtcttattcnnnnnttttatgccnntgtctcncatatanctcacacttaaaagtactatgactaataaaacaactcatatcaaaataaattataattacctacattttttgaataagacgaatggtcaaacatgtgagaaaaagtcaacggcgtcatctattaaaaaacggaggtagtattttctagttttttacttccactattgcatgctaacctgtaaaatgagtaggtacaaccaactttatgccaacgctcatgtgatgcttgcaaacacccaaatctagtgtcctcacgtttggaggaacttcgtcgtgtgcccacctgtcgctataacaagatatccccagtcttcaaaaggtatgttagttgtgaactggaattttccttcatgtactcatgatgttgccttttagagagaacgcacattgcataaacatttttttgacctctcttttcatgcaaaataatataatgggtatatccatcaagatagaactgataacaaatcttatgtgaagtagttgaattttgggcaacaaaatctacctttttcgatcggcgttggtacccctacttgttcatctataactttttctcatcggacagtggcacatagcatttagtagactcaagacagactaagtggagtaatttacttctggattatgctgtactaataattcatttgcttggcagctcgttggctaatccaaaacacatggagacagaattttggaatcgtgaagatgatgcaagcatatcagttgaagatatatctgattccgatggtagagctcaccttttcccctctttgtgcgtatatggtcactgtgcactaatgtctgtggggtaatggcagatgggaaggaggtggtgagcaatactgccatttcaaagctcccatcaaaagcagggctagatgcaaaatttgaagcattggagcgtgctgaaaatgcttattatcaagctaaaggtcagaccaagcagcaggtgatagtttgcctttttgtgattcttgtttctttcgcaacaacaatgagttaataactgcttataaatttgacaagacatatttttgaaagaatctatcacgttgctcagctagtcataaacttcaactagtgatataaatagggtgggaagcttgttgacaagaagagcatatctcagacactaagagatgcaagccaaaagcgattgttgaatggccttggacaagcaaagttgcgacttgggaatctaccgtgagtttgttttattctacaatgatttattgtcaatacatgatttgtactgtcagtttctttcaagtttcttcactcattttttggccgataatttcataagtattaggcccctttggtttataggaaatacacaggaatttcataggattccaatcctatagagaaaaaaaaaaccatgaagaggcctttggtacaaaggatttaatcatttctttccctttgaaatacctatggaatgacaatcctatacaatcctgtgttcttttaaaaaaaattcttaaaaagcagggcactcacgttgttcatctaaaataacaatcttgtattttttcctatcttgtatgcaaacacatgttttgaagttttccctatgtttttcttcccataggattggagaagccaagcaactccattcttatgtttttcctattaccgtgttttgactttattgtgttcctaagggagccttaaccttgggtatagcattcggtctaaaatttcatgagtattaccctttggttcaaaatttcatgagtattaatatttggccttacatattataggtcgttttgactttttttctaagccaaacttctttagatttgaccaagtttataaaaaaatatagcaatatttttaacacaacaaaaaaaaatcaaaatatgttcaatgttagaaatatttttttgttgtgttaaaaatattgctaatttttttggtgctttaagtgttgctctatttttctataaacttagtcatgacttaaaaaagtcaaagcaacttataatatgaaacaaagggagtcctttagtctaaaaatacatgagtattagccttcggcctaggggctnangtcaanataagagggcnntcgaaggggctcgnccgaaaggctttggccttccgggagggccttttcgggnaaacgcgtctaggctcattcgagcacggtcgagctcagacgagccgagcccgagcctctcccaaagctcgcgagctctgtcgagccgagctcgagcttccaacgagcttaataatatataatttttgttgttatttaataaattaggaggttatatatgttatttgtatgtcaagtattggcatcatatatttattttattatttttcctcttccatttacatggtgaactagaaattattttttaaaagattatccttgaaatatatattgttttactgaaaaatcgagctcagtagtcgagctcgagccgagcctgtttgaaagctcgaacattttataggctatgttcgagctcagctcaagcttgtatcgagctcgactagttgacagccctacttcggcccaaaaatacatgaatgttagtttttggcccaaaatctcctaagcttcaccccataatttcatgagttagcttttggcccaaaattccatgaatgctaaccttgggcccaaaagcgttttagtattagcctttgaccaaataacacatctagtgttagcctttggccaaataacacatgaattagcctttcgccctagaacacatgaacattagcctttgaccaaaatttgtgggtattagccttctgttggcccaaaaatgtgattgttttccatcggcccaaaaacacgcacatattagccttcggtcccatgagtattaaccttgggcacaaaaatgcttgctagccttcacctataaacatgcaagtattagccttcggcccaaaaattaatgacccaaaaatgcatgattattagcctgtcttgaaaatacatgaatgtttgcctttggccgaagatttgttaagtattaacatttcgcccaaaaacgcacgacttaatgccttataaagacatgaatgttagctttggcccaagatttcagtagtattaacctttggccaaaatttttagtaatattaatcttgggcccaagaacatgtttagcctgttgccaaaattccatgagtgttaaccttgggcgcaaaaatgtataattattggccttcggcctaattacggatgaataagctttagcccatttacacgtatattagccgatactccctctggtccaaattaagttcacttttgtacatgaatttggacataggttatatccagattcatgtacaaaagtgaatttattttggcacgaaggtagtaatgttcatgtgttatttggtcaatggctaaaactaatgcgtttttatgcccaaggttagcactcatggaattttaggccagtgactaacattcatgcgtttctggcacactattaatactcacaaaattttgggccaaaggatattactcagaaaatttgtactaaaagctaacaatcatatgtttttggaccgaatttcaatgcttgtatgtttctgtagcttttttcaaaccgaaggcaacattcatgtgtttcatttgcgtaaaggttaatatcatgaaattttggaccaaaggctttatacttgtgtgttttggggatgaaagacaaataatcacgtgtttttgttcccaaaggtattaactcataaattttggttgaaggctaatggtgatgtgttttgggagcaaaaggctaactaatgtgtttttagctagaggttattagcgttttgtgcctaggttagcactattggaattttgggctaacatttttatgtttttgggcccaaggttaatactcatgaaattttggaccaaagggcgatactcatgaaattttgagccaaaggtcaattctcatgaaatttttggtgaaaggcaactcacgtatttttacgtcgatggttaataaacactcatgaaagtctgggccaaagtttaatagtaatgtaattaggaccgaaggcaaacaatcatgggtccaagcttaatacttgtgaaatttcaggcaaagactaatggtcatgtgttattcggccaaaggctaatattaatgtgttctctaaatatgagtattaccctcctgtgcaaaacttcagggtattaaactttgacccaaaattttccccttcgacctaaaaaaataagtgtgttagctttcagcataaaaaaaagattagttttagctttcaatctaaaaaatatgcctccaactcaaaaattcacgagtattacttaagagccaaaaagtcttgagtactatcctttgttccaatatgtatgagtattagcctaaggccaaatagctcatgtatgcctttgggccatttatgtatctataaatcttcaacccaaaaattcatgagtattatgccttcggcatgtgtacgcatttatgtatgatgaattcggcctgataactcatgagtattcacctttggcctatttactcatctgtataagccttcagcccaataaatcatgagtaaaagcctttgacccaataaatttatgagtattaaccgttggcccatttacacatgtatttgcctttgacccaaaaacacgtcagtattagcttttgttcctgaattcatctgttatacttgggcctcaaaacacgagtattacacctttgatccaatagtgcatttgtattagcatttagcctaataatccatgatattagcatttggcttatttaagcatgtatgtaagcctttgttccactgacttgtgtatataagccttgctcaataactaatgagtaaattatgccttcagcccagaaatgcacggaattacatcaaagctataacaggatggatcca

SEQ ID NO: 76919 - DNA, 4071 bp, Oryza sativa
cgtcccatatgtctgccgcacttatgatatcccatgatatagtttcatctactgttacaagagcaattgtggaacacttcagttgtcaggtttagtgcaaggaaaattattagcaaaaattttagcatgttgtgccaaggaagtgtatctattgatttataggtacaatcccaaacataaaaaggaaatatgcacctgcaccattttgatataccgacttctgaatattatcgagtttttcaagaaattcaggcgatgcaaccctcgatttgagaagatcgcacaactgcaaagtaaagagtgaactaaaaactttagtatacttatagaacaaaagaaataggtataataaaacctagcacctatttttatatgataggccagaccgccagaaaacagtttaggacagttcatcaagaaactgaattcaaaaggatatgacaacacaaacacctacgtccagtcaaccatggtaaacaagatacctgtcattcaagacactatgaagactaagagccactaatcaaactattcgaagatccatagttcattatatttgcaaactgtcaagttcccccctgtgacacaattgatttgacgatccatagctttctcacctttttttttttttttgctaaacaacatagctgcacgttttgattggccaatacaaaacacacttttcttcttccacaatcacattttaccgcaattatatacagcaagcagccataattagcttagctaaatagtggactcaacacacgacacgttacgacaccagagaaacatcatagcaacaagggagagccaaattatggcgccatcatgtcattcatacaaggctaattccgtgtaaatttcagctaattccagtaggctaccaattctaatccagctaatccgcgaacatttggagcatatgacattcacaaacgcctaaatgtcatgaattaccgatcatcaatcaatcgagccatcgacgttacctggattaccgaatcacctacaaaccccccggatcacaaaattgagaggcacagctctctcccccctcctcacctcgtccgtctcgtagtcggcctccgacggcggagacggcggcggcgcaccctcctcatcacacccgtcgctgccccccacctccggattcgccgccacggcgtcggcgccctcctcctcctcctcctcctcagacacggcgatgcccagatcagcctcccgcatcatctcgagcgcgcgctggcactgctccagcaccgtctccagcgtcctccgccgcagcttcagctctgccgcctccggcaccctcctccccgcagccgcggcttccggcgccggcgccggcgacgaggaggaggcgggctccatcgaaaccctagatatgggcgtgcacggcggcggcggcggcggctcgatccgtcgtggcttcgcttggcggtttggtctaactcgacgacggtggaggggatggagagggaggcgggctcgcgtggatgcgtcgccgtgctcgaccaaatcaccaaattttgcttctcttcgcgataagggagaggtcagaagccacggtggagtagccgccgcgctaacgttgcttgcaagccagccagcgagcgagccccactgacaggtggggccagtcatatggaggccccacacatgtcagtgtgagtgtaggttcacccgatagatccaccatgtggttgttagccgtaaataatactacaacgaagaggggggtaaaagggcgagggaatctccggagagacctcgtcacttgcggacctgcggtatgttataaattgaccgtgattaattagcaattaattatataaattgaccgcgaccaattagctagtggtactaatgagtactccgtccgtcccaaaatatagcaatcttgtactaggatgtatctcatccagtacaagattgctatattttgggacggagggattactaggactaggctagtagcaaaccggtcgcaactcgcaatgaccactggctgtgttttccctctccttttctaattcacctctcttttttttcacgcgcacacttttcaaactgctaaagatacgtttttaaaaaataaatatacaaaagttacttttaaaaattatattaattcatttttcaaaaaatagctaatacttaattaattatgtgctaatgagccacgccgttttattgtgctaaacggagtagctcattagcacatgattaattaaatattagctaaaactgtgttcatttgaatatattagttctcaaccatcctaaacgaacagcctaagactgttcatttgtgttggttgggaaccttcccttccagcacgaacaacggagaaacacattagcacatgattaattaaaatattatctaaaactaacttgaaaaatagattaatatgatttttttaaacaactttcctatagattttttttttcaaaaaatgcgctaaaccttcctactaggatccgtttaacaatttaaaaagcatgcgcgcgaaaaacgaaaggataaagttgggaacccctacaaacgagcgcagcctaaataggttctataagagcaagtttaacagtatagtcaactatgggtttcagatcatgtatagtcaatttaatagccaatacatacaatagttacctataaacatatattacactattgatgtatggacccacatatcatacacacattgcgtattgtagttcgtgttacagctggctacaaatctgtagcccgttactcttctctctcctcttttatctcctcgaaatgtgtttatagatggcttatagtctgctattatacctgctttaagagcaagtttaatagtagagctaaccaatagcttacgcatattcacatacttcaaaatgaatacattaaatgcataggagaagaaaaatacatgttaactctaatactccctccttactcgtaaaggaggccattttggacagcgaaacggtctctaaaatacaactttgacttcttgtttatataacaatatttattgaaatgtgatatatgtatatttttatgaaagtatttttcaagacaaatctattcatctaatttttacattttcaaactcaacaacttgagagttattcatgatttatattcctaaggtttgacttaaatattatcttaaacgacctcctttactagtacggagggagtataagctataagcttatagttggctctactcttaaccttctttatttttcaaattttctcttcttcacatggcttatagcctactaataaactttctcaatgagttcagatttcagattcctgcaccattaataaccgtgagctgatggtgtcaattgctgtcttgctgagcactctcctggcagtatgcttgcatagacaagatcagtaatcaaaagcagcagtagctaactgcttcgaagtaccgcttgggtaaaccataaacaacaggccatttatacttgacattgcacaggccgatgagaaaaaaacttccaccacggaccacggttgatatacatcaagaaaatctacactcagattattctaacgaatcgtataatgtcagggagcacacagttccactatatcagaccggatgatcgttacatttgttatggagcagtaaaaagaaacacaggtacagaaggtatctacaaggttgatgatgaggggaggtgaaactaatttgaccagacatgcaccaggcctttgctgtttccagtgtagatttcgttgcggtcctcgtcgtagaatagtgcggtgatgtcctcaagagcatcagaaacagtgctccgaatggtagatctgctgctgtcacctctttttcgaggagcaattgtgagagtagggtcgaggggggagatcttggcgacgcactttcccgtgaagatgttgctcatgttgattgatcccgtggggggagctgagtaggcaacttgccaatttattcatatgaattcaaaaacaaaaaaaaaacagaataatgaaatttgaaattacctatgccctcgcagccgccactatctctgacctcctttgaagctttgcag

SEQ ID NO: 76920 - DNA, 20505 bp, Oryza sativa
ttttcagtggggttccatcctcaattgagagtatctttaatggaacatgattagctgacttctgataaattacgagcatgattccaggactggagagagaggtttcatgaatgtaagaaaatgtcaaatcaaagatgaaaacttatttttttatgtaatcagtcatcagtgataaccgaaccttattttgatttcctggatgttcttatcacatatagaatacagaaagttgtagttcttcagatcaaaaactttgtaagtgctgcaaaggagaaacaattacactatgcacataccactgctgtcaaactgtaaagtaaaatgttacatacctatcctgggctgaaaaagtcagtactttgccattaacatcatcaaactcaacaaatccagggtatttcagtgattccgtttcaaataaaggaaacccatcattcaattggcctcttctaatgtacctaaaaagaagttatgataagagaaaatatgttgatgctttaaaatgagctagcaaacagatcgaggcatgaacttgtgagttgtgacaagcccaattatcactttctaaataaacataatgagagcaaagaaccagcatcttgctctgcagacaccaggaagctcaactgtttagcaccaaagatactcttttcatacacagaataattcaagaagaaataaataaggcttcttactctattggagttgttctgcacttgagcgagctgaaacgatctgattcataaactgaaacggtgataagggattcattgtttttattataaaacaaactcctaatcacttcatcaggacttatattcaagtagcatatgcgcttgtttgttgctgccaacatgagaagaagttttgttaggaacataaatctgacaaaagcaaaaccagttagcattgaagaatgagatttaccccgattaaatgcaccgcatagtccagattgggcaagtgcaaatatgacatcctttgctgcaacaatctcaataattttggttctgctccacaaaaatggcagctgaacaagaaaatggacttcatcatcataggtgtcatactcttcctgcacaatcaaattaaattcataaattagtaaacaataatttaaatattaaaatatctgaattgcaaagtagtcagttaagggaaattctgtgcatgaaagttagttgatcagatttagcaggtacgattatagaaatgtgagatcaggcgtgtccattgatcaatcctggagttttcttgccctccccttccttgtccaaatctacttattagccacttcctgatacctcagtggcgtttacatcaatgtcttctctgtttatccaacatatttggcacaatatggaacattttcacacatatatgcacacaagacaacaaaaaaggcattaaagactaaaaataaattataggaaggtcattatccagctcatgtccagactgtacatggagccgatcatgcaaatttaattggattgcacagaaagttttactactaaccttttttggaatgtagccgagttacttagatcctattatgtcaggtggacccactggtttgtcagggccaatatggtaggcattatcttcaaagaataaattggcttccataaacatttcaatgatccatgtttgttcagtacttttaatgtacagacaacagagtcagagtgatttaatgtttttaagattttactatggctgcggaggcaaaacccccataatacaatcatacatggtgccacaatagcagctacatatgtcttcttccatgtcattagcatatagcattggtcttgcacatgtcctcttcccacttgaaaatttccatattagaggcttccagtggcaaacatacaagcaaccaaaatccacaaatatcttttctttttcagctaccttcaccatattaccaaacaacactaattttaaagataccgcaaaaccgtcactactctgatatcactcggtttcttttccatgagcttcaactcaaccgattaggtatgtatgaaaggaattgtatgatatgttactgttactactcacttatatgtggattctggtaagcactcgcccataaatgtgatacagtggttgttttagttaaaacaatttctttaagccatcagaaaacagtggcattactaaagcaaaataactggcaacacccaaagaaaaggtcagttaaatgcgacggaggacgaaggtacctagaaaatgtggaatcatgaaagccttccgcctacaaattcctatcttacccatccagcttatggtttgccatatttaattaacattttattagcctagctggctagattcgcaaaagataaacaacacgtggccacgtgggaaatttttgcacgaaaagtctaatttgattcgcattgggtacgtaatgttttactgttgagagaacagaaagagtgaagagaagtataaaataataagcatgtattttaaaatctgtatagtatatgcatctcatgatgcctgaaatacaaatggtgtcatgctaattacagtttattcagctcatgcatcaactaatttcaaccccattcagatttcaaattttcaatagcattgaaccactgattcacaagttatgcaaatatgctatgaataatcaatagccttattttttttcagttatgcaaatatgctataaataatcaacaaccttattttttttaaaaaaaaaaaactaagtctgttggttatgcacactccatatatcaaactagaacatgcaaaactacgtgcaggacatcataagcatttgcagttgatattcctagcactgaattactagatctagccatggcaacacaccggtgcaatgttataacattgccagttcactaaccagattaccactattgtagcaatatacttgtgtctccacaggcaacactttctggttaaatttgatcgcatcgaatggattgccacctaaagttttaaaaaaaagatccctaactatatcaagtgtcacggatcagaatgaattaccaagcggcactaggttaatcacgactactggaaacctaggagcgaggagacgggcaagctgcacatacctgcagctggaaattccggaatttctcggggcaggagaaggcggaggaggagggcgccgcgggccgcggcggccggcggtgccccccgccgatctcgcggcgcgcgaccttgtggacggagtcggacgggtcgcggcgcggcggcttgcggcaggcgggctgcaggcccgcggacagccacgcgcgtcgccgcgcggcggtgatgcggaggcgcacccgcagcccgggcttgtggtggtggtgctccatggcctgcctccgccggcgaggcgggagcgaggggcgcgggcacggggacagccgggggaccgaggaggtgtaggggaggggggcggggactacgcggggttagggtttagaggaggcgccatggatggggaggggaggggaggggacgcgggaatctggaggctagcgactagcgaggaagaatgggggggagctggcagtggcactaggggcgtacggaattgcgaaggggaaaccgacagcggctacacgctactcgtacagatgaacccggttcacaattccaatggaatccgattcggacctcgtgaaatccgaacttttttgaatcgggccatcgaagacacgaccgattcctgaatttcaacaaaatttatttgtattttattggtttttatcggtttatcaatggattccgtgaagtccgatgataccgtttatgagcggattttgatacagtatcaagatggactatgggcccctcatagcaattttaatggtacccagcagatatcacgaataatagtgacattttctcaaatcggtaattttgcaatggtatgatccaattaacctttgaatcatagggccaaatagaaaaggtttgaataaaaattggatcttatgaaattccttataaatcattaaatttacccgctttcttaatactcgtatccaagcctaaaactctctaagatatcttaggatggagacaatatcatataagattgtgattacgaaaactcttagcaatagcatgaaaaacatatactccatctttttttaagtagataacgttattgccttttgaacacatgtttaaccgttcgttttatttaaaaattttatgtaaacgtatgagatataaattatacttaaaatactttgagtaataaaataactcacataaaaatatataattacataattttttaataagatgaattatcaaacatgtgtttaaaagtcaacggagtcatctattaaaaaatatgatagtagtagatttttatgaaaagagcgcccataatctcttctttctataaagctgctaatgctcactgaacacctaaagctcaacatgcaagcatagtatttactagcattcctaaaacctacatgtaagtataccatatcaacccattaagcccacaaatctcaacatgcagacatataataattatagctacaaatttacttcactctaaaactaaacatatacatgctaaatcatcattcttaaattattttcataatatttcaatccaaatcatttctcatttatctattgtttaacatatatcccgcagcaaagtgtagggcatcatcttattaataacacgtgtaagcacattgcgtggcaaggcattgtgatcaatgtcaagtcattatcgtgtgtgccccgtaaaccggttgataagtaagaaacgagaaatttgtcactcaaaaagttttttttttgttttatgctactatagtaatgttatgcatttgcttttgttgtccccgtgccgacattgctgtccttttgcatatgagtatacctacgtaatcagttgatcgatatcacatagttattataatataagctttggattcgaaggtaatcaactgtttattatattttgtactcttgtcgattttcagtatatccacttagaatccacgtgcttaatttgcatatatagaaaagaaaaaggctatacgtactaattttttcttactaaattcttactaacactgatgtgtcatgctatgagtacatctagattttttataacttccatctatttaatcaaacggttgagatgattgttagtaaatgtttagtaagaaaaatttagtacgtgtagcattgctctatagaaaatatgctagcaaagtgtaaaatagtgggaaaactcaaatcatcccttaaggggatatccccttatttttatatgtcacttaaaaagtaattaaaaaatttagtaggatagatcaatatgtgatatgtcgcttcacaaacatgcaaattcaaattcaacttatacaagtagaaataaaaataacaaatttaattatgaatagaacacgtaattcacagtcatatttgttatttttgtttcgaattgtataagttaaattttaactcgcatgtttgtgaaaagatatatcacatattaatctatcttgtgaaaatatatatcatatattgatctatcttgatattatttaaaaaaagtataacttttgaactacatgtacaaaacgaggggatatctccacgagggacaaaaatctacttccaaaatagtgtgcatctgttgaatgtgtgtatgcatgttaggttagtagtacaggttcctgctccaacacattactatacccagaacatgtcgagatagatagagcttttgaaccccacaatgcagaatgcagaagcaggtggggcgaagaggaatccgagagatcgggagcacaccggtgcaacaaggtatattggcatattgttttcctatagaacaaagcatttctgactctgaagataacttgacccccaataaggtctcttctcttgtcatacatgttcggagtactatactagactctgaagataacttgaccctcataaggtctcttctcttgtcatacatgttcggagtactatactacgggtgagtgtgtttagttcacgctaaaattagaagtttgattgaaattgaaacgatgtgacggaaaagttggaagtttgtgtgtgtagaaaagttttgatgtgatagaaaagttagaagtttgaagaaaaattatggaactaaacacggcctactataggtgatttgcttccaaccatgcgtccatggcactccattctcgtgacaaacacagcagcttaattggaggagccagaggctatacagactcagtgcagatcgagcagaggcgagaagcagagggtgtattcctacccggggccggcctgttggagatcagagcacaggagcaaaaattcctcatctgaatattcagacagacttacagttacctctgcatcggatgctcctatacctatccaactcaggtcagggatattaaatgctcatcagagagagatcaggcacagcgagagaagatgctatacgctgaactgaatttcttccctgttcttggtgatcgtttcgtcacctgtgattttcattctcttggacaaagcgcacccggggcgagagcagaagaaacggatctctgtctttctgacgacgggtgtgtcgatcctggattggcagcggcaaatgacagggtacagtacatgcctaggtttcgcacgttaccatgtccatgttactctcgcgaaacaggagtaccaagcaatgcaggtgtgcatagatgcgtggtgtttgtgacctctcgttgtataactacattctctaacactgactaatcacaatgcatacgtcagatgaagcgtgcgtagctcaactgattaagttccttattgctcgtatttatagctaactattcttttaatggtaggctacgttccaaattattctttcagtggtagcgagactccaatggtaacttcgtcaattttaagatatgccgacccaatctttcgaatgtgctcacagaggtaaggtatgcgtgtgtgcgtttataaagatgagtgtgtgtgtgcgttgtgggtgcttgtgtctgttctgtatttataaaaaaacaatgcatagatcggtttagccttaagacatgaaaaaaaagaacacgtttaaatccttgcgaaaaaaaaaaaccgtgccaaactgcacgaagctggcggcggcccgaatacgccgtgcggagaaggcgtcatgcgcgcggacggacgatggctacaaggtggattacctaagcataagcagcgttggacctaacccgctcgccggcctgacccagacccgcccaaccgtccccaccgcccgcccgcggcctccccaaatatccactcccaccgcgcgcgccacctgtacaagagaaaaaaaaaaaacgaaccaaacccacccgtcgtcgccgctccgcccgcgcgtgtgcgtgcgcccacgaccgcgcgcgacgcgacgcgccggcctcgtcaatcccatcgatcgatctcgccgtcgccggcatcgtcgcgatcatgccgctagatggtggggaggtggacctgtgggcgatggcggcggagctggagcggcagttcgccgggtacaagcagcggcgggcggagaggagcggcgcgccccgcggcgacgacgatggcgccgatgcccgcggtggcggcggggaggaggaggaggaggaggagggggacggagacggcggcgacgtgagggggaggaggtacgaggcgtacacgaggcggagggacgagcggctgcgggaacgggaagggtggcgcgcgcgcatggagcgcaaggaggccgaggtcagggcgctctgggcgcagctcgagcgtcgcgccgccggctgtgccaccgccaccgccacggcgacggacgacgacggcggcggcgcggccggagtccgagaggtaggtaattccgttgccaaaaaggtcgttttctgcttgcggtcgccggcacgacacgttccgtctctttgttgcaacttaacaagcgcgggtcgtttttaacgggtctcaagttgctaagttgcttctagccttctaggatatgattgattgacccaaatagtttggacgttgcgtttctgcaatctgcatgccattccatgattgatgaatccttctatctttcgctgaaaaaaaaaatccctagatcgatgcttcctgtgcatgcaagtatgcaactgcattctctttgatcaatccccctctcacgttttcgttctgaaattttttcttgagagagtcaaaactaattcgttctagttttaaattacgtgttatagcctataccctccctcctaaaaaaattattgtactacgaaaccggatatgccaagatttgattcatggcacatacttcatccgtcctaaaaggctaaaataagctaactatgtgttgtttagtaaatctaataactaatggtcatctttagactgcagaattctttatagtatttcgtagcgctttcgcgaaaaagaatagtgtttcgtagaggtcagttcaattttcagaagattaattatttcaccattcgaaacgggacctaaagtggtaaaatttttagtacggcacaagggttcacgtgaaacgataaatggtgggttcacgaccaaatccttgttcagcactttctgctgcagcacatatctctgccaaggagttaactcccggtcccgggaagaaactgcatgcgcaggcagcaagcaaggcagcatcaacactccgtgtgtcaataaatcgtacgtgtattcctgatgatatctctcatctcaagtctgcgagtccttccctgtgaatgcgtgcgctcccgtgcaaacgcatgcttcgtcaactgctcgactcatcgtccgtaaaagagaaaaaaaattggaaccgtgcttgactgcgtgagcatggacttgtttctctttttttttataaaaaaatatatatattcatgtcgaacttgtcgaaagagattgtttttacaccgtccaaaatgagagttacttgttggactattgggtttataaaatatatatattgctgtcgcatcggtcaactattaggtttcgctgtcaattgtatctgccctagcttacacgttgccacgtgaaacattccctacgtggtggtgctctgtgtgcatatgagttttctgtataattgtaaaaaataaattatgtgtgtatgtgtttttcgtgtaatcgtaatttttttatatatttgatacttatgttttttaatatatgatgtctttaactttttaaaatctgtttgatcattcatcatattcaaaacaatttatgtaactattatttatttattgtcaaatgttttttaaaatacgatttaaattttttatatttaaaaaaatgaataagataaactgtaatacggttatgaaaaagttacagcgtcgtatattaaaaaaacatttaaataatacattcggttgttgtttaatcgggtgtggtggcgtgtactacagaaagctgggaaagacggcgagaagaggagaagatccgacgtggctgctccggcgagtaggatctccggcaagaagcacgcacgcaccaggagcttctcgtccaccgccacgaagagcagcctccccgacgccggggcgcggcgagcgctgtcgcaggagccgccgccgccgccgacgtcagagcgacccaccacggcgggcgccggcagccatcgagtagcgcgggtcaccggcggcggagcgacgacgaccgcgccgaaacccagggtgttctcagggcacaggagctcgacggcgaaagagcatggctcatcatctgccaagggtgggacgacgaagccgaagccgccgcgctccctgccccggcggtcgagttccggcgggttggagaatctcaaggaggcggttctgtcgaacacctgtgccgcggttgcaccggcgcagagctgttcgaccgagcaggctactgtccatggcgaaaccgggaatgcttctcccccgtcaccgttcgctggcgcggcggcagcgaatgcccgcgccgcctcgccggattcagactgcggcgaggcagtggacggtggatcatacgaccgtgaagccgaggcgaagcgtgtcggcgagcacgacgccgaggaggtcacggtgtctccccagaagctggcgaatggagagatcaccagtgactcggacaccgagccgagctatgtctacgtcaagaaggacgacgtcgagggggaggaggatgccatggcgaggcgttctgaagctttggctgtctcagatgccaaacctgcagagctggaggtggagaagaataacagcgacgccgccgcgcgcggcgaggagaccacggctccaccgtcggacgccgtcgcggcagagagcgcgacgacgatcgtcgcggaagaggcaccggcgagggagagctccgacgagtcctcctcctcctctcctcctccttctccggcatcaggtcagggcgcggctcccctcccagcagcgcgccagcttcctacatctcgcgagctccgtccatcgagaggctgctcgaggaggacgccgcgctgctgcgcaagaagcggcagcagagcgccgacaagctcgccctgatggcgatgacgacgacgacgatgtccaccccgccggccagggtctccggcgcggcgcggtcgcgaggattcaagagcttcttgagcttcgggaagaagaacagacgaggcaaggatgtcaccgtcatcgactgcacctcgccgtcggtgccctcggtggccgacgacgacagcggcagcggagggtggccgtccggtgagacgatcaagccaaggatggcctcctcggacgctgcctccgacgacatggaccatggctatgccattgccgcctctccacagggtaatcaaatttcatgttcttccatagagtacatgacaattagtaattactagtacatgatatgttgtggtagatttctgatgcttgttaatgtgaattttcaaacgcattttgcatgttttaactctgcaggttgctctttgcaaagccttgtggttgcatctcctgcaaagtctgaactgcatgagatagacccacaggagaaatcaccaaaaggtgaaaaaaaatgttttgattttgttgtgtgttttgcagatcattcttgtttctttctgcctctgtactaatgttgtctgtttttttttggtcacagctcatcggtcgttcttctcgtttcgatcattcaactgtggcaggagctgatctgaagaactgggaatagacagttattactactgtaaatatagaccagtgtggaaattaggtcgctgcctgaaatattcagaaatcagaaacccttgcatcatcttgattcaaatttcaaagaggtgaaatgttgttatctgaatactattccttgatacagtaaggatattccatagaccaatcaggatgcaagaagagcagatttggagatacttctgtacgtatgatggcgtgtttatgttttcttctgatgttcttatcttaacagtctatgttttggcaactacctgtttgcatactgtaccatgaaaatgagaactgtccatccacaatatatatgtcgtgaactggttagttggaaattagcactcgtgcatgtttcagaacattcactttgttagcgaaatttcagaatatatatttgtgatttttagctttggttaattaaatgtgatgaaggtcattccaaacatgagtaaaaagctgaacatgctttcccctagtgatgtatgctctctacttataatttgtatatgtagctcttttctctacaaattgacattcagatcaaaacattgtaacaaacatgcatgctaggaacagtactcatttgtgcacttccgctgggagagacggctaggattatcagtttatcaccaaatatagtgcatctaataagacactatatgaagtagtaaattaaacatacttcttatcattcgttgccttctgatcgtacatgtgtgttttgttggaggtaaatctgcttgtacatgtgtagaagcatctcatggtttctgccgtataggaaccgtctatatactcactggaacggaatattagttaataccatgctatcatccatgaccaatattctcaagaacactattgtgtgatttaactaagacagttagctacctcttactggaacagcatattagcactgagaagaacatacctgagctttccatgcgtgtaggaccaaccaacatcaaacactgttggcttccctcacctgcatctttgctttctctctctgaaagtctttgtcactttgtcatgcttaacgaggacagtatgaaaatcagtagctagctctctgcaagttccttttttcttgttcaggaacatgcatctaagttctaggtcttgctttgctcacagtgatacccaccttgtctgtccataagcatactttgcttacatataactacatgctattaatagatgctactgtacaaactttgaggaaaagtataactttcgatggaactaactcgatctatccattggtggagaaaggaattaactttgacaggagaaattaaaaagtccatatatataccatttggtcaaaatcaggtgatccatttcagatgtgtctctgaaccttcctatgggctcagctagctaattaacacaccatattaatgaccaaattaactcgtcagtatcctgtttacctcaaaagttttcaggcaaatttccacgagtttccatgactttctagcgacaaattggctcaaaggtcaagaattcgatcaccttgtaggacctcgtttctgactaactcgtcagctagaccagctagctagcttaggtatcagctgcattcataagatccaatcaagaaaacataaacaacacttagaacacttctacttacaatgcatcggcgaatttcgatggccgatccatccatccatccatggacgtgctacttagctcgatcgatcacgagctcaagcccccactctaatggcggcgccgccgcggcgatcgacggggcgagaagccatgctggagaaggagcgcacatgctgcaagccggccggccagccagccccgccgtcgagcacgtgccctgcttctccagcacggtttgctcacccctccttcttcagttcttctcctagggctagagctagctaggccctagcctctctctcgccattggaggaggagaggagagctgggagaggtagaggaattgcatggtgatggctgcaacttgcaagcgatgtggcgtatatataggcgggcaaaagcatagtacatgtggtaggaagacatggttgtctaaaaagacctaactttctctgtgaaagggagcccaaacctgcctctcgaaattaaagttttcttctttttcatcgatcaaaggcagaccaccaaacctcggatccccatccatccatccaatccaattaatccgagttcatcagttaatcaacctaaaaacccagagttcagttcatcagttaataattaatccgagatgaaatctctgtctgtgtgacttgtgttagtcgctgtcagaggtgaatttaattagagggatcattcgagtttaacttttgacaaaaagccgctttgattacctggagatgatggcagcgtcaaggctagtttaaccgcccgtcggcccggcccttggacggcgaccgtaaacgattgtatgactctgatcaagcgatcgagatgaaagcctgcagcaactgggggttttgttaatggttagccacatgttttaacctaatcttggccgactaaactagtctttcctcacttatgtgtagttcttatctttatggtgataattaaccatttgaacactgctgatcaagtagaaactaaattaactatttgaacagctgatcaagtaggctatacaatctcagaaggagagacgacgacgagttgcggacaaaaagttgagagcccagtgcctggctatcatatcaccactaaacaaatgcacgcgcggcaactgatgtgatgtcagtgctcaaacgcagaactttttaatttgtaaataccatttttgtatgccaatttagggcgtatagaactatataaatatgcaatttacgcgacaatttggcgtgtatgtggttggggattggcatctaatcggcaacgcggggtgtcgtcagatgcagacagtgcagtcgcggacagagttgagagccggtggcatcagcgagagtgatgtgtttttgtggctaaacaaatgcacgcgcgctcgctgttgtcgggtggacatgggcgctgatgctgataagtaaatcgataatccgtgtgtgcccagttgcgaatttgatagaattttgattggattggtttaggcagagggtcaatgcatgcgtgcgtacctagctccatgggtggtttactcctgtctgccatgctgagattgctgatgcagcagctttaatttgcgttttggtgcagatgcagagctgcagatagcctactcctgttggaaagaagcttggagagagaatgtttggcaggaagaggaatgttgtgtggctactgtccccaacaaccatgaggttcttcagtgtaataactgtttctttgtgcttcgttgggaggaccattttgcttttacttgggagaagatggcattttttttctgtaacagtgtgtgaatatattaccattagggtttcaagttggttaggacattctggtttgggatggtagacctcagcatttcattttccttgacctacctcgtactatcagtctctttgaccggataagcataacttaagtcttaagacatgcgctgtagctagtttaagactcactgttgtaatttctagtcatttttcttcctctcggtcctcatccattgattctattcgtatcttaagaagtctttaaaatcactttgacccttaaatgatctcaatttaaaacgagctttcgactttctctttcagtttttcttagaaccttctcattctagaagtattttttttcacgaacgcgtaaaaggattgcacgtcaatatattagaagaaaatagttatagttacacgacgcaatcagccagactggcttatgcaaatagaagggaaaaaaacaaaataagaagctgaagcttttaaaaaaactacattctagaagcattttttgatttgttctaagcatgtaaccttttttttttcacccttcttagaaacttctttttatttatttgtttatttttcttgtttgtactaaacacaccactttatattggacactccaggctaccaaagttgaaagttgttaccaccagagccaatgagtcccatcttcctcaccgaagactcttgtttgggaagacatgcaatcctttttcaattttttgtggaacaaacaccaatcttctgctctgcatttcttttttgagatacagggaataagacaatagacatggaactattttagcacgtccattcgaagtgttaattcatttcaacttacaaggctataacctccgtcccaaaaaaagtttatttgtgggtttctgtgtacaacgtttgaccctccgtattatttaaaaaatataaaaaactttaaaaaaagtcacacataaggtactattcatgttttatcatttaataacaacaaaaattactaatcataaaaagcatttaattaagacggacggtcaaacgttggacccagaaacccacaaatgaacttattttaggacggaataagttcatctgaggtcccttaacctatcaacgaatctgattttcgtccttcaaccgaaaaacccagatacaacgggtcccttaactgtcaaaactggtgcaatataaatttcatggtggtttgtacgacggttttcgctgacgtggcgcttacgtggctaatttgactcagttttcatatgacgtggcagttacgtggcgcttacgcgacaatttgatttggaaaataataaaatttgtgaccccacatgtcagttacacaaaaaaataatttaaaaatgatgggcccacgtgagccccacgtatcattatcacccctcctcttctacctcctctctcagatgaacttattcctacagagggtgtaagcgattgtagagcccaatctaggcctcgtaaggcccattacgttatacagatccgtatctaggcccatccaagacattttgaacaaggaatacacagcccattaatgatacagaaatggcccgttagtgggtcgggcccaccaacacattgcaaaaagtgcaaaaccactcaacccgtgtgcgactcccacgcctcgccaaaaaccctaacgcattcgcctccccgcctccccgccaccggccacctcccgccgcccgccatggccgacgtcgacacgggcgagctcccccagacgccgcgctcggcgaccggagacgacgagctctccctcatggacggggagcccgacctggccgcggccgtcctggcgcggctcggcgggtcgccgcgggaggacgaccagcacctctgcgccaccgccgccgccatggcgcaggccgtgagggaccagggcgtcgccgccacccccgtcgcgtacttcgccgcggcggccgcggcgctcgcgcccctggcccgcgcgggggccggggccgcggaccggcacgtctccggcgcgctcctcgcgttcctctcggccgcggtgcccgcgctgcctccagccgtggcgcgcgcccgggggcgtgaggtcgcggacgacgtggtgcgggtgctcgagttcccttcgacgcctgactccggtgtgagggctggggtaaggtgcctcgcgcacttgatctcggctggggagaaggcgaactgggaggcagtggagccgctctatggggtggtgctacgtctagcagttgatccccggcctaaggtactagcaaaataccaattctctcaactatgttgctgtcaaaattattacttatgcgggtaaatatgcactgctgtgtaacttgttgtgatatactgataaggtttactgggcatccaatgctgtttcagttaatctgatttaggatgcagaataccgtttagtttaatgggaaattctagacttcataattttagagtcatactccctcatagtaaaataatataactaaactcatttctcccgatgtcaaataaatttgactggagagagtaataatcgaagaaggatactgcacacattgtattcttggctcagcagattttgttcatgttgttagctttactcgtatcaaaattcaattgctctgtatcatgctgaaaaatcattcatagtttgctttgatggggctgtaggtgaggaagcagtctcattcatgcttgcgagatattctgctcagtttccagaggcaagctgttttggtccctgcgagtgaaggaataacgagatgttttgagcgttttctactgcttgctggtggatccaatgctgtaaacacagatgtagcagaaggcggacctaagggggctaaggaagtcttgtatattctgaatgctttaaaatgctgcctccctcttatgtcatcaaaaccttccaataccatcataaaatattttaaagctctgttggatctgcaccaaccaatcttgacacggagcatattggagattctgcatgctgttggcgacagtccaactgtacagcttaaatctgacgtgctactggatatagtatgctctttggggctatctgtctctgttgaaagaaaatcaggggatgaaatggcttcaattgcaaggcttctaaatgttgctactagaaaaatttataatcagaataagaacatatgtgttgtaaagcttccactagtatttacttcacttggaggttggttcttctcacaaaacttggcacctttaagttgatcaattatacctagtaagtcatattatgtcttttgtgtaaaagtcttgttgtaaattgttcgccagatatattggcaagtgaatttgaagaagcaagattttctgctgtggaggctttcaaaagtttaatagaagactgcatcgatgaaagcatgatcttacagggaattacccagattaagtctagacatccagggataagatctgatcccacaaccatagagaagatatgtgctatcctagagggcttgctaaatgtccggtacggtgatgtctgggacaaatcatttcatgtgatttcaatggcatttgacaaattgggtaagtataccactacgttagcatatcctcatcattcaatagcttaggaataatatgagagtctctattttagtaatctggctcctctggtcagagcattaagattcaatgtagcttcttgttcacatcttttgtgttggactctctttcttgagccattaacaacctttatccaaaggtgtttttgttaaattgaattatgctattggtaattagttgcttgattatttgtgataattgttcctgtactgatctctaatgcaaaactacaggagaatcgtcagctgaccttttgcctgaagcacttaagaacttggcagacatgcaaaacttgtcagacgatgacttctctttccggaagcaggtaacttttcccatagaaaaagcaccattgtccttcagcataatataaacaaatttatacctttcatgcaactaactttgtttactccatgtatgtttggttatctcctggcttaccttcatatgcatttatttgcagcttgattcatgtcttggttcagctgttgctgctatgggaccaaagaacgttcttaaaatcctgcagattcattcaatatctgatgaaaatgaatggatcttccccattttagaaaagcacattgttggtgccagtttacaatttttcttaacagatattcgggacattattagagctgtagagaagaacattccaaaggtatcgtccattttttttgaaaatcctaatagttttaaagcaaaaacagattaagcactttcattttaaactgcactgactgtttccaacatcttcaattgaacagcttttaaaggaagataagcttttctccgccaagagagcagaaggttatgtgtattcactatggtctttgttaccatcgtgctgcaattatgcacgtgatacctcaatccactttagagctctgcagaatgttttgtgcgacacgcttaaaaaccagcttgacttgcgtggtatcatttgttctagtattcaggtatttcacactgcatctggttagttctatattgcaagtacttctgtttaagttatgcttttgagcttatttttctttttttttggcttgtatattttaggttttgattaaacaaaacaaggaagcattgtcagttcctgttgaagaggccatacttgctgaggatgaaataagcaaatctgaaagaagagcaaaagaacgctatacgaaagagtttgcagaggaaaacttaaaagcaatacgggctttctcttcaaagtttttggaagttctatgttctatattcttagcttcttcaaatgatgctattggacttctacaggtatattgttgatgccttctatattgtgccatctgcttgctgggctctaaggatctgtactttcgggaattgtttgatttggctctggaagttgatttcttctatgatcagccgacaggtcaaaatttgaaatgtttgataataatctaatgacttcatccgaatagatcacagtggggaactttgaacctttgggtgttaattgttgttgaggattaataattggattgttttgttgattgtttttatatcatgtacaagcataaatgtgacttgttccttctttattgaacagcctgcaataagtgatatagcttccatatcagagaaagacactgttggcaggttctttcttgatgcaataaggaagttgttggatgccacaaaagctgttaatgcagaacaaaagaatgatagttcaatgcaaatcgaagctaattccaacacaaataacatggcaaggtctgcgcaaaatttatattcttgttacttcttattcatgtctagattccagttgaagccgattgttaatttcaatccttgatggatcgtagggctctcctgttggactttgcagcttcattaatgcctggtttagctgcaaaatcgatcaatgtgctattcagttatgtaaaacctgcaattaaggtacatatatgatatattgcaagtatccaagctgttctttttttttaaaaaaaattgtaagttgtgttgtacctgatattttttctcacgctcgtaggatactgactcattgattcaaaagagagcatacaaggtcctttcaatgctgctcaaggtatgtctccgttttcagtttgcactttatgtgaatcatcatggcagatcacagagagataacttgaaatctttatgaatgtttatcatttcaggatactgagtttattgagcggaatttggataccttgttgggcttgatgatttcttctttgccatgccaatttccatcaaagcgctacaggcttgaatgcctgcatcacctt

SEQ ID NO: 76921 - DNA, 614 bp, Oryza sativa
gtatttcttcccaaatctgtgatgcttgtggatgatttgggatatttagggagcaaatcgattgagcaatgaaacaacaacaaaaaaaaaaaaagaatcaaccaggactgctccaccatttttagtcccggttggtaataccaaccgggaataaagatggatttttagtcccggttatttcacccgggactaaagatgggtatttttagtcccggattcgtactcccggttgtataaccgggactataggggggtttctaaccgggagtaaagcccctttctctaccagtgcgaggtcctcatggagatttttatcaggctgccggcgaaaactcttgctcgtttcaagtctgtctgcaaggcatggcacaccatcatctctgaaccattcttcatccgcagtcatctccgccactctgccttcaagcataaacaggagccctccttttttgtcattttgcatgcgctggacaatgtggttgaaattactttctcgaataatgtccccgtcttccggtggaaggatggccagggcaatgcatgccttgtgcatgcaatggatttccatggtgagtatcagataatcaataaaatgtctcactgtgatggcctgg

SEQ ID NO: 76922 - DNA, 1181 bp, Oryza sativa
gaatgcaaacgacaactgagaaaatggcgctacagctaagggctgtagcacctcccccgattggaccgatggcggtgaagagggcatcgtcatcaccggttcctccaccgtaaccgcgaacaggggctatggcagagaaggtggcgccgtcgcgagtgactacagcacctctgctgtcgacagcgtgggcggcggagagggcgtcgtcgtcgtagtttccaacgtcgccccctaggcctcaaaacctgcacggagtgccaacaccaattctgtcaccttggcaagcctagctgtgatctctgtgatggaggtctgcatggccctagaggattgacgcagcatgtagaggtcatggatggcaggcatggtgaatggcgtggtggggcggatgacaggatcatggtcgtctgataccatatgttatgcgcgtagatggattgggtgctcgacaggagggcgaggctactgtagcctcgaagcaccggagcctaggtgaggccgaacagagaagagggagactagagatatgtttaacttctttcttgattacctaggtgaaaccccgcgcattgctgcgggaatttagtatgataacaataaaaaataacgtgtaagatagctagataacatcagattaagtaaattaatgtggtttatgataatttaaatttaaatagtatatagaatgttgattcaaacgtaaaatgtaaggtggtatgactttatggaagaagaaaagtagggagatagtttggaatgtagattaatcatctaaaggctaaaaacaattgatgtgatatgacttaattagaggaaaaaggagaaagataatttggaccatagattagttacatattttatccgcaagcgcgcacggatataccattgtaacatttcacccgagagtattccaagtgtatcgtatttgtttaatcccatggaaagattatagtagagagaactgtactaataatttatatattacctgtaataaccatagtctaaataggggataatataagcaaagggtagagtgacacacaagcataaggctactcattctcatattaaattatctaagctaggtgaaaagaaaatagaaaagaatatatccctacacttctagtatacatataatatatacatcctagctataagattaactagctaataccatcttt

SEQ ID NO: 76923 - DNA, 716 bp, Oryza sativa
cacagtactagcacgatgctgcaatgcaagttaatctagagccaaaatagatcgcacagtagggggaaaaagtggaaatactgaagtaaaatgtcagattggtgggtaagaggcgtactcacggacggcggtgtctacgatctggcagacggagagcgagatcatggaggtcttgccggtcccggactggcctgggcgatgacgtcgcggccgctgatgatggggaggacggcgcgctgctggatggcggagggcttctcgaagccgtaggcgtagatgccgcggaggaggtcgtcgcggatccccattggtcgaagctgctgatgacctcgacccccggggaggtctcgaaggtgaggttctcgtcgtccatggcgcccgggccgcgccgcgacgtggtggccgccgccattgggggagacgaaaccctagaaagagaagagaactagagaagagatgggggaaggaggtgaggggtggacgggtggtcggaagaggatcttttgactaaagtcacggccgtgcagtttcaatacgtaatatccaccgtccactgccatccaacggttctctatctgctgctttcctttgcacacgtccaacgtggcaacgtctccttcgcatcccatcccagtgtggtcgctgtcgtcgcaggggaggacttctctgcgtgggcttgcaacctgattgaatttttttcatttttagattttttt

SEQ ID NO: 76924 - DNA, 604 bp, Oryza sativa
attcttctgtaatgtcttttgttacttctagtaatgctaacacaaactatctgttgcagatatcaaagtagcctaggtaataataataagagggttgagctctttgatatgggcgctggaagtagtgaacctgctgccgaggacaacatccaaatagcatcaggtgaaaataatcatgtgaatctttttcaaatgtggttaatgccatgctaataatcttcttaaatgtaataattgccttatgattgctgagcataagatgcagagcttgcaatcatgttgagagtatatgaaattacaaagtattgtgatggatcgatttcttaacttttgatactataatgacaagtagactatattatagattttcttttgaacaacaaagtagagaaaacaattagtttcgaacatggttgagctgtttggttaagtaacattacagcatccactatatggaaatgcaaatgaagcatggtatttatcttgtttgatttgaaggcaatagtgttatataattcataaataccttttcgcttcacgatgattaattttgcctggtaggttgcaagatacaagtttctcaaaaactgaagaggagctaaaa

SEQ ID NO: 76925 - DNA, 7171 bp, Oryza sativa
  unsure (1)..(7171): unsure at all n locations
ggcatcctccgaccaccgcgcccgccgtttcgcatcatgggtaggggccacggccagaagctctcgcttcatggccttgaggctccggcgagaaacgtgagcgcacgctcccccattgacggtggcgacgatggccccgggctcctggaaccccaggtcatcgtcgccatcgtcgacatcaccggtggtggccttctgcttggcctcacctcgccggttgccggcgggagccgccggggccttgccctcacggcgctcctgcctccgctcctcctcccacttcctcgtccgctcagccaaacttttgaccgcgcggcaatccgcgaggtcgtggagggaggtgttgtgcacggaacaccacttgccaaacttttgaccggccttcttctttttgtcgctcgcaggcctcccctttcgggtggcccgcgaagcgccctcgacggcgaggacgtgaccctcgtcgtcggaatgggccgacctcttcttcttcctcctgtcccgccgccctgaccgagcggcggtcccggaggcggccggagctgccacaccggaaccggaggagttccaggtccaggcctcctccttgcgagccacacggtccgcgagctgaaaaagctccgcggtggtctggggctccttggaggcgatcttctcgagcatgcggttgtgccgcacgccccccctgaacgcgtagatcaccgcgtgtgcagggatgcatggtatggtgttgcggacttgacagaaccgctgaacatacgagcgaagagactcatcgtcccttcgctgcaccgcatgcaagtccgctttttcgcctgggcgcggatatgtgccctggaagttcgtggtgaactgctggcacagatcctcccaagagtggaccgacgcgggtggcaagttcattagccaaccccgcgcctgacctttcagggccatgggaaagaaattcgccatgaccctatcgtcacccccggcggcctcgatcccagtcgtatagatctgaagaaactcggcggggttgacgcttccgtcgtatttttcggtgatggtgggccggaaccttgggggccaacggacgttccgaaggctcgccacaaaggctcgacagccggcaccgccaaccggggacacggggggctggcccctgtgcccgaaccgaagtggcgctccggacgaggaggcgccctccattgcgtgggcagcacgacgaccattgcgccggcgctcgatactggggcgggtatccggccccccacgcacatcttcttgggtcggaggcgttgacgagggaatggcggacgaacggcgggaaacggtcgccgctcgccgggcccttccgcttgacgacacggagccggtggtagcagcaccagaggtcttggtggcggaggaccgcccaccggcgcctatgcgctgctgcgccgtcatgaccaagtcggccacgtcatccagccaacgtcgggctggagtctctggatcggggacgatgggcgggtgacgtaagagcgcgccccaagcctggagcgcgccctggggcgtgctaccatcgccgtagacgaggaggcgacgctccccgtcttggcgtaattctccatcgcccgcgggcggtgaagtcgcggatctttcgaccccttcgaacgcctcctcccgcccaagacttcggcgagagggggacggtggagtacgaactcgacggcgcgggttctgctccccgtcgtcaccgctagcgctcggagagaggttgtgcgccactgcccgttcggccattgggccgagcgggagaagcttggcgcacacgaaagaggatgagggcttagaaagacacacgcgccccctacctggcgcgccagatgacggagcttggggctcctcaccgggagaccgcgcaggcccccctttgctggttcggccgggggcgctcagtgaggttctttgccctcggtctggggaaagttcgcgagagagagaatgcacaagacacgggcgatgtagacaggttcgggccgctgagaagcgtaataccctactcctgtgttctggtggatctgtgtatggagaagttacaaagagctggggagcaagagagttcaggctctagaacccctctattccccccctggctctcgatctgatcccatccccttcttcggtgggtaaggtcttccttttatatctcaaggggaaaccacatgcaccacttctacctactcttcttttgggtggggacccaccctatcttgaccaaaacttggctcgcatcttcgcctggaagctaaatcatagcttgtccttgagtgaggcccagcgccgtcactcgcctgacataggggatcaccctgtcattccttcattaatgggcggagattgcaatggctgcagtccgaatgacccttcgatgggatgggtcatacctacctccactccgccggatgcagatgcaacgtgggagcacagtttgtcttccgatgacgtgaccggcatcagaccagtcacagaccggtcattcttgtccaccacgtgtcagtttagcatgccgcacgtctgctcttctttatacaattacttccttgtaatggttgcgatgaagcctggcatgaacctagccgggactgacgtgccaactgcaggagttagcacgccggccccggctagggacgagttccaggaggctctcatcattccgacgggacggggcgaggcgtgtgacaggccgcctgttgccacctaacccgcgatctgaccggtctgtgaccggtcacacactgcgaccggtcacggaccggataagcgagcgcgctgcgctgcattaaatgcggcgtggcgcgctcgtccaaactgtaataaatgcggttaggtgagccccgctgtgttcacctaacccatacacgtggcgccagaaccacagagggtcggggcgccccagccctcggggtcgaaacgggagcggcccgacccctcggggagacggaggaaggggtggccacgtcaccctcgggcccgaccccccccaagggggtcaggccacgtgggtgaccgcggctgcccaagcctctagtcatgatactcccggtctcatgtcaccgacaactgtggtaggtagtggaaatatttaaaagtttgaaatttttgttcaagtttttgtaaacttggttgggttacggggctccagtgacaaactccaccttttgatccaggcacaaccacacagcctggtagctccaacatatccaaccccttttctctctcaccattttttttggaaattgtttgttattatttattttttttaactcaccacatttccacataactctgccgcatgctcttgcacataccatgttttgctaaaatgctaatacaatcaactagaaggcattttctaacataacacgtctcttgagttctacttggataaagtgacacctagagagtatgtaagacatcacctcctagaaagagaggggaaaatctttcgaatgatgaaacagataagtcatcccaagttgacactaggagaaataccgagtcatttccacattgctaagagtcattgctaggagtcccgttgacttagactatactagattagggtcttcaccttatactattgagtatttatagtagatcaatacatataaacacgatagattgctattacccattaggaggctcgatttgtataaaaaccattacctcctacttcatagctcaccttcgcgagcatccttgtactgatcaatccttatatctgtataaaccattgtctcctacttccttattatatcttgatgagcatcctttactgtccgactatacaaaatcaatactatagtcatgccctaacatgttagcaaaggtatcatgtgagcatctctatgacatgccacatcaaatattggattgatgctaatacatttaactagtttatggggggtataatatgtattttttttaagtttgtggacaaacataactcatgtttatttactcatagaactttgcatccacgattcacccatccataaatcacactatggatatgacccttggagtcaaaatgcccttgtttcttgagaggaataagtctatttcgcatccctcatcttttatccttgatcgaatcgcctcctccaaccgcaaaatcgggtataacacatcccccatctttgaaaaccggtgcaaatcaactcattcggtggtgtcgaagtagttttcataggtggggctcacatgacaatgaggtatggcaaaaatatatggccccacctacaaaaaccaatttcgaaaccattaaaggagtcgatttgcactagtttttaaatatgaaggaggtgttatacctggttttgcggtttggggggatgggattgatcaagggtacgagatgagggagttaaaatagacttatttctttttgagaaacatcaacaggagaggaagaattatacttgggccggaaaaagtacatctaaggtccctcatcttgtcatcggattacaaaattatcccccaatcgcaaaaccagatatatgggatccctcaacttataaaaccgggtcactttgggtccctagacggttttgacccggttttatccgacgtggcagctgagtcagcatgggtcccgtatgtcagtgtgtccactttatcactccctctttttcccatctctcttcatcctctcttctctcccttaggtcccgttcttttctccaacaaagagttggatgaagattaagattttcgtggcacgcttttcaaactgctaaattgtgcgtttcgtgtgaaaactttctatatgaaatttgctctaaaatatcatattaatctatttttcaagtttgtaataattaaaactcaatcaatcatacgttaatgccacctcttttgcgtaaaaaacttaatcttcatctattcatcttcgggagaaaagaacaccacctactcggttactctctctctctctctcaatattctttgggcaggccgacccgcgggtgcgaggtggaagagaggaagggcggccgatgctggggcggcgacggccaatgcgggagaaggggagacggtgtctcgtcctaccgccacaacgacgccgtccattccttcctccttgctaaggcctctggctctgatttcgtcttctcccttctccgccgcatcctctcgttctccccacccgccgactccctcttccgccaacgccgtccactcctaccctcctccgccacatcctcataacctcgccagcggatggttgaagatgaagtggctggggtcggatgccccgcggtcatcccgcgcggcggtacctggtaccgcccgagctcctccagcatcgcctccaccgtgaccaacgcacgcgccgcggcaactccgcgagacacatggaggaggtgatgctcgcccacaccaatgcctcctgcgagtttagcatcatcctcgacgcccgtctccctcccctcccccactaccgnncgaaccccacccggacgacgcgcgaccattagaattttcgtggaccacccattgtgcagtgccagactttgaagtacaacatgaagtcgagggctgggagaggctttatccctgaggtgctgaaggtgatgtccctggtgtaccactatatttgagtagcccttatcaatctagtgtattttttgtaccctgggggtgtttagatccaggggtgtaaagtttttgtgtgtcacatcgagtattatatagggtgtaaaaaaaactaattacagaatccggcagtaaactgcgactctacgagacgaatttattaagcctaattaatccgttattagcaaatatttactgtagcaacacattgtcaaatcatggagcaattggcttaaaacgtctcgcaaattagtcacaatatgtgcaattagttatttttatagcctatatttaatacttcatgaaggtgtttaaacgctcgatatgatagggtgaaaaattttgatgtgtgatctgatcagggcctctgtttggttaaatctgaactgtttgcttgtagataatagataagtaactttgtcttgtcagtagattagaaacccccttccccttctctaagtgttgaatgccatttaaatttggattaagattctagtttcattgtctaatgctttgagtgtgttccggccatgattagagcaggtacaatagcatgctataagcgagttataaacatattttaaagagataaaggaagagagagaagagcagcggactacggatctatagccagctgcagcacggactctaagacttaatgtgtgtatgacaagtaggactatgtattaatagtatagtaagcaactattgtatgaattggctattatattggctatagataatttggagctagtagttgactatactattaaacttgctcttatctgtagaaaaaaaatacatttgcatatgtaaatttatatttgtgttgatggtgttctcctataatcataggctgcgaacatcccgaagaagtatactccgaccattggaatttccgtggaccaccgccgcaagaaccgctcacttgagggctccaggctaatgtctagaggtttaagacataggccttgtttagttcacgaaaagaaaatttttgagtgtcaatgtttaacggatatcggaatgggttttcggatacgaatgaaaaaaataatttaataacttgcatgaaaaccgtgagatgaatcttttgagcctaaactaattcgtcattagcgcatgtaggttactgtagcatttatggctaatcatggactaattagacttaaaatattcgtctcacgatttctccctaaatgtacaattagtttttatttttatctatatttaatactccattgtccagagattcaatatgatgtaaaaatttctggggactaaacaagggcaaggtatggctgcagtttgttgtccctgactccttgtatatgtttatcgaaggtattgtcttctagatctggttttgagcttgattgtgctagctcttgtgtcaggctggtgattccactgccgaggagcttgccactgccacccaggtccagggtgattaattacatgcctattgctcgcggtgagaagcgctcggttgaggctgtgaaggtcaccgatgagatgaaggcgttcaaggcctacgctaattaag

SEQ ID NO: 76926 - DNA, 2294 bp, Oryza sativa
  unsure (1)..(2294): unsure at all n locations
catgtccaagtctacgatgccaaaacatcacatctttatcaaacttagcaaccaaacatgttatcacaggtgaaacaagattttcaaaatcagctttaaacactcttccatagcgagaaatattcaacacagaatcaccacaagaatcaaaaactttacttctagttttcttaaagtgaacctcaaaatttttatcaacaatttgtgaaaccgaaagcaaattgtactttaagtcctcaaccaaagctacattcttcaattcaaaatttttatttacctttaccaaacctgtagcgagaacgacacttgtagaagcatcaccaaagataatcgattcagtcttggatgccttcttgatagaggagaaccaatttttatcaccggtcatgtgccgcgaacaaccggaatccacgatccacacgttctacttccttgccaccaaagcctacacacaagcagaagtcgaagcctcagtactggggttagataataataaaaatttaagaatccagtactgagacacacgaccagaagatctaataggcatatatccacgtgcaaaatcaattttagaattttcagaaaaattccaccgaggccggtctgaccgaggtacagtggccggtctgaccgggggcctttgtaccggtctgaccgcctttgtaccaccggtctgaccggtgctcagcagccggtctgaccggtcgccggtctgatcgcgggacccactgcggtctgaccggtttcctcgagggaaaacccgattnttgccactttgattttgcagaaccaatctctctctcctttttctgtttatgagctaatctgaaacaaaaaccaacaatatgtccatctttgccacaaaaagaacaagtatatttttcacgatgattagacacattggaagcattaggagatttagcaacacaagcaacaacaggagattttgaatgcacaacattggattttgaagaagatgcattcaaggtagacatgataccagcagatttaaacacagttttgttagtattaggtttaaccaaaatctcacttctagcaccaacacctaacacagcaggaggatgtctagaattatgagcataaggattaaaacctaaatcacggttatgtgtgctaacctttgattgatccaaaatcatgttgaggttctttttaccattagaaaatcttagcaaagaatttttcaaataagaaacctctttttccaaattagcacaattttcacaatctaccatgacacctttgcttttacgacatttagggcaagaaagcacttcattgtttttcacaacatcttccatgtactcaacacgacctaaagcatctttcaatttcatcttattcaaatcacatgttgagcaaaccaaaacatcatgaggttgttttaactttttagcagaaatcatattaaacatcaaactagcatgaaaagcaatttgatatttttgcaacaactttttagttaaaaacaactcatccaaagtgcgtgtgtgcaaagcaaaactacaggcaagagaagatttatttttcaaatcatgtgcagcattaacatctctaatttttgaaatctcattcattaaaacctcacaattttcgcaatcatcatcattaggaataagagattttaatctagcaatttcagatttaagagattcaatgataaattcctgttttctatatacatcttctcacacttcttattcttttcactcaaaatattaatagcttcctcaaaagcacttacctcattatcttcatactctgtgtcagattcaccacgcgccatgaagcaaacatcggagatattcattcccttatcatcatctccactttcaccatctacatcacttagtggctcgaaggcggcgcaaacttgttgaaaagccttcctgagattctccagcttcctctcttggtatgaacccttcggcttgttgttgttgttcttctcatcatctttgtcttctcttttgcctctcccaagcttaggacaatgcgaacgaagatgatcaattgaaccacattcaaagcaacgatttggaccacctcttttcctgttcctggcattattcatagctcgagcaattctatagcaaccaaagccaaatcctcctcctcaatttgttcgagttgatcatcggatgtggcattaaaaacagcaagaaaagaaggcttagatgaagaagcatcaatatccaaagaagaagaagaagaagaaaccaaagcactcaacttataatcaactttccgagaaagaacattcatctcatgtg

SEQ ID NO: 76927 - DNA, 89945 bp, Oryza sativa
  unsure (1)..(89945): unsure at all n locations
tgatgaaaattactcaaagcattccatatctcatgagcagttcgaagatgagcaacacgatcataatccgaacgagaaatcccactcaaaagaatattgcgagctttgcaattttgttcaaactcagtttttaaagcagcagtattaatctcttcaggaatcacataaggataagaaacttttctccaaatatcataatcttcagccataatataagattgcatcttactataccaatgagaaaaatccgttccgtcgaaaacattaggcttagttgaaaacctagtaggagtagccatggcaaaaaaaaactctagatcgataaaaatccaaagaagaaaacaaggctctgataccacctgtaggatcgaaacacaagaactaagccaaccagagggggggtgaatggttggtatacccgaaaaccgaaaactttttgcggaaataaaagttaccctcaatttcgatgagatcggtctaatcggagtagattagccggtctgaccgaagcgtagccgccggtctgaccggtgtggatctaccggtctaaccgccaaaattcgtcgctgcctcatgtcgccgaagccggtctgaccgctgtgtgcccgccggtcggaccaccgcgatgccgccggttagaccaccgaaacctggtgaaacacaaaacgaagaactcttaaactagatgacaactttattgattctctctgtgtttacaaagtgcaccaatagcactccttacaaaaatttcgactaaactcgaaaccctaactcaaaactcaactcaattgctgtcacaccccaatctggtaccgccgtacaacggcacctgactggagcatgtcgtaggaaaaacagcgcgaaccgcttcatacgaaaccgcaatctcagtaccagtcccaggacatagcgctggtacccacagtgacaaatttgaatcattgcaaatccttaacataaatagaggacttatttaccttaacttagcttgcagctcagaacagcccgagaatgcaaccgacgacgctgacgaggaaacaccaacaacagcagcagcagcggaaccaacgaacgaacacccaacaccacaggcgacggctgggaaccaggacgaaaccctaatcttcacttcactttatcttctcttcaggccggaggaactatatatatttatatagagcaagggtgagtactttggtactcagcaagtcacgggaacttaggtgtttaatgcaagcttggaagagaggcaaggttgttttgcaaatcttttgtttgaaatcattttgaaatcactaagtgatttatttctttttaagtttgggtcgaaaaaagacttgcgtctcaaatcgacttaagagatgcttttcaacagctcaattggaaatgtaccgacctcccgggtcagatcattacttctcggctcccagagccatttcacttgattaagcggctcccagagccatattcgtttttgcggactcccagagtccagctgcccagcagcaaagcaatccgtttccactcgggaaacctagtctatgatgcccgcaaacatcccgaatcacacagattcgtttctgaccactcagttcatccatctgccacataggctgattctggttacgattcccataccacaacaacttttcacaaagcacatgcaaacaaatctacgcaatgggaaccacctcacatccgcccatgaccgtgggcatggctgttcaaacagttagttaacctctgcagaggggtacactttacccacaagacacgaacttactccagacactggccggtgtcagaggttcgcgacaaagccttttccaagccgacccagggatacctcatgccacatagaaggatcaaatcctcacataaatataggccattttagacattcacaaatcaactccaaccaccttgatcggtaagtgagcaagcttctcgtccttgccttaccaggaacccggtttgtccgaccccgccccggcgttcccaactattggcatgcgaggtttccctgaacagactagttacttagccagcgtgtcccattccaccttgtggttgcactttgattatgttcgatgagtttcccacaggaatcggtccttatacgcgaatacgggacagtgccacataggcacaacccccgcatcgcgagttttcacaattcattttattttcaaacacaccgacaccacatgtcgggttttcaaggcttctcaaacccattttccaaatttttgacaaacaacggtgtatgtgggataattggtatacgcgcttagagagcacggataccgaagtaccacaatggtggagcgacaagggatcagggtatgtcagcctacaggaagtagtgcgactactgggtaggtccgtcggtttagcatgcaaaccgaggccaagcaagttaagtgtgtgattctaataatgcaagttgcaaacaaaataataatgatttttcaattataggagcaattggtcaaagggtgacttgcctagctcaaggtcttcacggagcttcacgaatcttcgagaaaacccgcgatcgacgaaaatccggtaaccgcaactatacacaaacaatcaaaaacctaaacaaaagaccacaagaaagatcctatttagactaaataatagtgccattaaatagatctcaattttacggaaatactggaagtggaatgaagtcaatcggacgaacggatcgagagatatgaattttggaatcttaactggaatttctggacaaggaaatgatttattggatttttctagaacacgagaaatggtttatggaataatattctcaagaatattattgatggtcactgacgtgcgggaccaaaggaaatgattcatggaatttttggaataaggaattgatttatgaaaaagggaaaaggatttattaatccctttggataagaaaaggaaggagggataggaatcagactttctcgagcgacttggcgcggcccgagaggatttgcgcggctaggccgatcttattaggccggcacgggctacggggaggcggcccaagagaggggcgcagggagagagagggggaaggggagccgggtggaccagccagtgtctggagtaagttcgtgtcttgtgggtaaagtgtacccctctgcagaggttaactaactgttcgaacagccgtgcccacggtcatgggcggatgtgaggtgattcccgttgcgtagatttgtttgcctgtgctttgtgaaaagttgttgtggtgtgggaatcgtaaccagaatcagcttatgtggcagatggatgacctaagtggttagaaacgaatctgtgtgattcgggatgtctgtgggcatcatagactaggcttcccgagtggaagcggattgctttgctgctgggcagctggactctgggagtccgcaaaaacgaataaggctctgggagccgcttaatcaagtgaaatggctctgggagccgagaagtaatgatctgactcgggaggtcggtacattaccaattgagctgttgaaaagcatctcttaagtcgatttgagacgcaagtctcttttcgacccaaacttaaaaagaaataaatcacttagtgatttcaaaatgatttcaaacaaaagatttgcaaaacaaccttgcctctcttccaagcttgcattaaacacctaagttcccgtgacttgctgagtacgaaagtactcacccttgctctatataaatatatatatatagttcctccgccctgaagagaagataaagtgaagtgaagattagggtttcgtcctggttcccagccgtcgcctgtggtgttgggtgttcgttcgttggttccgctgctgctgctgctgttggtgtttcctcgtcagcgtcgtcggttgcattctcgggttgttctgagctgcaacctaagttaaggtaaataagtcctctatttatgttaaggatttgcaatgattcaaatttgtcaccgtgggtaccagcgctatgtcctgggactggtactgagatcgcggtttcgttggaagcggttcgcgctgtttttcctacgacacgctccagtcaggtgccattgtacggcggtaccagattggggtgtgacaattgctctctaaagcgataacgggaagcctcacgctccccctctatttatacatgaggtaggcagcctaaagccatgaaccaaactcatactaagagtcctaaacaccttaggaaaccctctagtacaagaaacaaactttacataaccaatcgtaccaaatttggactccttccaaattcgactccgcgtcccacacgcacacaatacctccatcgtatgccatatggaatctccatcaaccacgtgcatcaactctatcctaagtatcccgcatgatctctgaccaccacggacgtcgtcttatccccaagccgactcccggtccatcaccgcaaatactctcctgaggcatcgagtcacctacacatgaaataaacaaagaaaccatattccaagaccaagctatctccaacttgactcattagtagcaaacaacagtattacatacgtatagtatccatctagaagccataatcatgaaacaatcacggatatccaaacaaacaacccgaaaccgaaaccgacacagcgtcggccggtcagaccgcgggcttgccggtctgaccgcgcatataccgccggtctgactggcaacacctgcccagtctgaccggtcacataaaataatagaacctgtgattcacctgtaaatccaatcatctccaaaaccacttcgtgaataaattccaaataacaaaaccaataatctccaatgcccaattattcatcacagagtaataatcaaaaacacctttgattttacataatcctgtaacaagtttgcaaaaaacatggctatccatttgttgctatctcgttctttcaagtaaatcctgtaacaaattaatctgtctttctaatccacctatcttgttgatgtacttttttttctctcatttttgttatccatttgggcctgcattcacaacacgaaatgggctacaacgaggtctaattacatcaacgtcatcaatgatattattcagaaaggaactaactgatggcccattggtccaagcccacgatcaggacatgattagaatttagaaaggcgccgaaacccaagatttcatttgaactaatcacaacagattgcaacaaaaagcaactgcagattagtacttctgaactgagtacaacagcaccaattaacctactcccaaaatggagatgaatcggactgttcatccaaattcatcaaatttgaaaggaaacgaaaaggggaaaatgggctgcaaattaatcctgcgggccaacagagacatacaaaaaacaacaaggtttctctgaagtttgcctcatcagttgttggagcgctcttaaaaataccgaaacactatcggctcgatcaactcgttgagaggagccagctctgccctgtcgatcaaatggaattcctgcaagtaaaaaattgtgaagcatagcagttagcctaagatgaaaagattcaattaattcaacactgagctacagcaagatttgatggacaaatgtgcatgccttgttttatgtgattcgaccctcattttacaactaaatgcaagtatttaaaaaggaggttgagatcaaactaaaaacatcatcatagcctcatagggaacaaataatgcagcaaatggaatgcttgtgtgtccccaacaactccttaatttttacaaagatggttcttaagaacaaaagttgactttgcatgcagaatgatggatcacaactgctaaagaactaaactgattcaaacaaattaggaaaggcatttgaatgattgcaccaaagacattcctttatttttgcattccaatattccattaaaaaaaacatgtggctcatatgtggtgttccttcaatcttaggcagacataatgcatttgttcccatctttgttccttttgaaaaaaaattgcacatataaggattatcattaatatcattccctcaagatctctgagagagagagagagaagaagaggaagaagaagaattaattacccaagtgaagagcacaaagtgcttgaagcaagtgctgagatgggcctcctccttgagcttgaggatcatctgaaaatgcgagtggtacatgtgggagtacaccctgaagagccgcttgaagatggtcctgatcacctcgcgaaagttttgagggaagggagcccctgcaatttagtcagttacattaattgattgacgatttctccatcaaaactcatcatcagcttaactaatctgctactgtagtgtggtgctgcaacgaacaaattaattaacgattgatcattctcagtcagagattagcttaattaccaatcttttgagggaaaatggcctcatcatcaagctggctctccacccaatccatcaggtactccacgtactttggagcagacacttgaactggcttcttcaccttcattccatcagcccacctgtactcgtacctgcatttgtcaacaaaaattgttttcgttccttagttctcagttatttcagagaatacatctgaaacagtacatgatcgatttctgattcagaaatattcttgtgtaatactccctccttccctaatggcccgtttggttggagggagtttttaggagggattgggagtttaaagggatgaggctattaagtgttttgtttggttgggagacatgggaatttaggtgggatggggatggggaactaaggaaggaactccctccttttcaatacctgggtaggagcaggtaattgggagggaattccttctttactttgtctaagcaaatctcagccatccgtttttattattgacctaatcttcaactaaactccctatcaatttccatcacctctaccaaacgagatattgggattaaaaattaaattctcatcttaatctcatcatcaattccctcatgtaaactcccaatccccttccctcgagttaacaaacaagccgtaaatgtttgacaccgttgacttttttaaacatgtttgaccgttcactttattcaaaaacttttgtgatatgtgtaaaactatatgtatacataaaagtatatttaacaataaatcaaatgatagaaaaagaattaacaattacttaaatttttttgaataagacgaacggtcaaacatttttaaaaaagtcaacggcgtcaaatattttggaatggagggagtatgttggttcgctggatttgtaggagtgaaaagattagaagtgatatctacatactttggtccggcagacatgatcgggcaggtagatgaagtgcagaactccatcagggttccgtacagaaagttcacttggttgaagaagtctacggctgcagatagaggacatcagaattcagagagtacatgttaaaacagcagtgcaattagggcatccacattgttggctttttagccggtaataagcaatacatgctctcttcctacccggtaggaagcattgtgagagtggcaaaaagttaaaatctggtcatacagctactaccgatgaacaagagataaacaatattatttgtacagtgtttctgacagaactcgcgggaaggagtcacgcagcagtcatgggaattttactatcggtgatttttttttagctgggcccaccttattcctctccaacacgcataaacaatgtgaagggtgcgatggtttaataccatctgaccccttggcccacaatattgctgaagtcggcaactaacattgcacttgcccttatatttctagtgcgtcaagtcacgactgattttactgttctttgataagatactaccatattttctaatgtaaaatttaatatctctatatactagtaattatcttaaaatataaaattttgtagtgaaaaatttaggtacctcaagataatatcgtaaaatatctcaaatcaccgactaaaaatgtcaaataagaacagtccagaaaagtgaactacacatgacaacttgactgcatgttgcttcacaatcagagactagcaagttcctgctacgtataggaagtgataaagctctcaatgatacgtgccatactgccagcctttcttccattcgatttaaatagctaaaataatctattatattattaaaggaatagaaaaaggagcctccacgtacgctctcatggcctagaaattctcacattaatcggagaaaaagaaaaagcagaatccatatagaaatacaatttaaaaatagctgaaattcggaattaaaaataaggaatattagaataggagactagagtccatatagaaatacaatttagaaatagttgaaattcggaattaaaaaataaggaatattagaagaggagactagagtccatatagaaatacaattaggaaataactgaaattcggaattaaattaaggaatattagaagtagagtatagagtccatatagaaatacaattaggaaataatagaaattcggaattaaaaataaggaatattagaagtagagtatagagtccatatagaaatacatttaagaaaaaaatagaaattcagaattaaaaaataaggaatattagaagtagagtatagagtccatatagaaatttaaaactaactataatttggaataaaaaggaacctccactttcgctctcatgatctagaaattctcacattaatcagagaaaaagaaaaaacagagtccatatagaaatacaatttagaaatagttgaaattcggaattaaaaaataaggaatattagaagaggagactagagtccatatagaaatacaattaggaaataactgaaattcggaattaaattaaggaatattagaagtagagtatagagtccatatagaaatacaattaggaaataatagaaattcggaattaaaaataaggaatattagaagtagagtatagagtccatatagaaatacatttaagaaaaaaatagaaattcagaattaaaaaataaggaatattagaagtagagtatagagtccatatagaaatttaaaactaactataatttggaataaaaaggaacctccactttcgctctcatgatctagaaattctcacattaatcagagaaaaagaaaaaacagagtccatatagaaatacaatttagaaatagctgaaatttggaattacaaaataaggaatattagaagaggagactagagtccatatagaaatacaattcagaaattgttaaaattcggaattaaaaaataaggaatattagaagagtagattagagtccatatagaaatacaattaggaaataactgaaattcggaattaaaaataaggaatattagaagaggagactagagtccatatagaaatacaattaggaaataatagaaattcagaattaaaaataaggaatatgagaagtagagtatagagtccatatagaaatacaattaagaaaaaaaagaaattcggaatctaaaaataaggaatattagaaatagagtatagagtccataatccatataggaatttaaaactaactaaaattcggaataaaaggagcctccacgttcgctctcatgacctagaagttctcacattaatcgaagaaaaagtaactaaaattcgaaattaagaaaaacatgggaagaaaagtttaaagtcaatatagaaatacaatttagaagtaactgaaatttgaaattaaaaattaaagaatattgaaagatgagtttagagtctacatagaaatacaattagaaataataaaaaatcagaattaaaaaaatattaaaagacaagtctagagtccatataggaatatatataatttacaaataactaaaatttgatattaaaaaaattaataactaacacgtatataaaatacaatatgaatattacacattagtagtttcgtaaagttattgcaaaatttaaaattatgttgtcattgtaatatattttaataatataatgagaaaacatatatgctattttatgagggaaaatataatgatgttaggcacgcaatctgcgcgggccaccatgctagttaaaagtatttaataaaatgcatcaatcttgttgtttcacctacatgcacggtcagattcgagccatagaagggcacacaagaacaacaaattcaattccgaatgtcacggcacctttcgtagtcttatttaatttgttgtttgtctgttctccttctgtagcttgaatttaattcttcatgtttatttaatattatgcattttttagattgttttcacaattatttagattggaatgaaactatgaaagaaacaaggacatattcttcagagctttatatactctctctcttactagataaaagaagtggactttaagccctctaaaacgtgccatcttttcttgcattcaatttaaatagttaaaaacattaaaaacattcagcaaaatagattgttggatcacttatcattgcacagtcatacaaggccaaattagagctacagaagggcacacagaaacaacaaattcaataagtatgaatatgattgcactattcacaatctggttttgttgttctcgtgtgttctctttgtgtaactctaatttaattttgcatgtttgtgccctattatatgacatcatgtttacttttctttacatggttttcatatttatttatttagatctgaatgaaagaagcaatgacccatattcttgagagactaacatatatactttctcctaccatatagaagtacaacagttagaagttagaacaggatccccagatcattacatcagaggttatgatgaaattggtactagttgagatggtagcttactgttgacagcgagccattcgttgagatcttctccaattggcagacggaccgcctctcgcaggtttccgctgcccagggtggcgtcgatgtgcttcttcagcggcaagccctgcaagcaagcatcgcgtttaatttgttggaaactgaaacacttaacagtttcagaactgagcacgcaaaaagctaaaccccggaccaaatacactttacacataatttaataagtactcttgagtggatcgaacctttcctagatgtgtccatttcagccattgtgcatgccaccatgcatgaacaactttggcgttacaaaaaagctagccaactacccacaagggaacaagagatttgttttggtttttaaaaacttttttaataaataaataaatatatagatttttttattaaaagatatatcgacattcttagctagttacatagtacctaacgacaacatgtcgccgcagtcagaattatgctacatgcaaatctatttatatgcatgggtggtgtgtgtttaaacataactctgtcacctatagagttttagcttaaaaacagatagaaaatcggtgcctctactttgatattttcataacatagttattgttttttaaaaaaaaagacgattttttttaaaaaagaagacggataaataaagggacaatatgaaactgagccatttggtaaaactaaaaccctttcatctcccatctcatctcatcccatctttttttttaaaaaaaaaaaaagaaaaaaacacggcttcaccctttacttggttagcctaagatcatggaaagctagcacctgatgtggatagctgtatcaacggtaaatcgtcgtatcatcccatcccctaattactcgttgatccctgatgctctatgtgacatatatatctcccatgcaagaactcggagaaattaattaagccgacgaaaaaacgaacaagaattggaaactatctcgtacacacgtaccttgctcccggaaggggagctcttcttgggcctgaacgtcagctggctcctgcaagcacaacaacaacaacaacaacatcgatatcccacagtcaatacatgtaggagcacagatcgatctactctactctacttccagaagagcaacaggaaaagcaggcaaattaaggtcgtctcctacctggagctccgcccaaacaagctcatcttcttcttcttcttccgctggtggagctggagtagtggcgagagagatggacggatggatggctgcctccacaggcgtggcttatataggcagccgcggatcagccgcctatgtgtaaagtacgtacgcggatgtggacaccacgccgaggaggagaaggaggccgcgggcgatcgatcgaacaggctggcgcggtgaccgttcaccaccgcgcgcgcgcgtgcctcgcgttggggttggggttgcagcgatcgatggcggctggtgcacactcgactcgactgatggatggatggatggatggatgatcacgctctccgctcgcctctgcctctgctcatgtatctcagcttctcaggcaggtcaggggccttttcatgtgtttcctcctttcctcgtcgttacttcgggcttttgatggtgggttttgatggatcatcgatccatcaacagctagcagctccaccccttttgcacttgatgatgatgatatatgatctgcatcctcccctgtccttgctgtcatccttctggatgccaaatcactcccatttttaaccttcatcccctctctctcttttcttttgctaattatttatccgctgtcaagattaatattccttttctctcctgttgttttgcaaacgttatgtttacaggttgtcaagggctcgctagttcataacttccgctaaaactttctataatcagcgatggaggatcatggaggtgggggagtgtcttgtgcgaattacggcgtgtggttatcgttacatttattttacggagggaaaaattacgaattacccccctttctctcgaactattgcggtcattcgaattacccccctgaaccataaaactagacattcttcaccccaaactatataaaccggacgaattaccccccccccatcgacctaaatccacggtgcttttggtctacgtgacatatacatggcagtccagtcagcgttctatttattaaaaaatgtggaacccacatatcatatcctcttccactattcctctctctcttctctctctcactctctgtctcttcccccctctctctcacgcgcacagcagcaggcggcagcggcgcgcacgcacgcggacagggccggaggcggcggcgaggacagcagcacgcacggcgccgcggtgcgcatggcggcacgcacgcggccgcaggctcaaggcctcgacctccctctggcccgcgcgctcgtcctcctcgacgcgccgccccatccacgccatcgccgctgccgcgcctcttcgcgccccgtgccgccgcatgccgtcacgtcgcctgtcgtcgtcgctcgcggcgggccgggcgtggcgttctcgtttgacggcctctgcgacctcatcctgctcatggccgtcgtcgtcgacatcagcaacggcggcgccaccgttgccgtcctgtacaggagggagagggagttcgccatagcccgcacgggcgagcgctcatggcgtctcatcaacaacaagctggacagaatcgtcgacatggcgaggcacggggatggcaagctctatacggtgcacctctccggcaaggtcgcgcgctggaagttcaactgcaatgtctgcaggtcgccgaagattcttgagtcggtgctggtcattgactcgccctaccactacgtcgtcaaggcggacggcaatggcaatgccatcatcatgtctcgggaatacgaacacgaccaccgcgaccgcgccagcgagtgctgctacctcgccggagcaccgcgcggcacgctctacctcctcaagcgggtgtacaagcacaagcagggcggcggcggcggcggcggcggcggcggcacctcgagccccgtccgcgcgccgtcaccccacgctcgcgtgcccgcgtgctgccgccgtcgcgtcgcctcctcgcgccacgccccgccgcgctgtgcatgccgccgtcctcgccgccgtgtgcgtctcggccacgccgccatcctcgccacaacctccggccccgtccgcgtgcatgcgctccgccgccgccccgcctgctgccgtgcgcgtgtgagagagagaggggaagagacagggtgagagagagaagagacaggaagagagaggaatagtggaagaggatacgacatgtgggtcccacattttttaataaatagaatgctgactgtactgccacgtgtacgccacgtagaccaaaaccaccgtggattgggtcgaggagggtaattcatccggtttacatagttggggtgaagaatgtctggttttgtgattcagggggtaattcggatgaccataatagttgggggggtaattcgtactttttttccttttacgagtgtctagtacgaggtaaggcgtgtggttgtcgttacaacaatccattcttttgcgatgccataggctaaaagaattgttcgctatttctgttggtcggtagttgagtaactctagtgaagtggggtaactaaaagggctatacatatggacataatagctatggcgatgacaaaaatactagatacagtaacagaagcacaggcatataacggtaccgttgcccaatgggttgaccggatgacaatcggaaaacgacatagttgataacggaaacaatcgtacaaggtacatttggcatctaattaagttgattacatacaacagcacaaatcaacatatctaccctatagttcaacaaatactttcactcatcactcattctttcattcatcactcaacggttcagattatccgtgtgaaatccaatgctcatgatcggttccacctcccacctcccctctcccttccgcacccctcacctcggttgcgccctccctgctcccctcattcacgcgctccctcgctaaccctaaccgcgctgcctcaaccagtcaccgccgccgccacctcgccctgtgcccttgccacatcgacgttgcgacaccctgcctcatcgccatagtcgccttggagcatcatgagtcggatcccctcctaggtgaatccgggcactcctccaccgcgcaaccaccggccatcgcgcttgccaccaatcgcccattgtgagttcatcgtcgatcctctgcggattgaccggatccctctccactatggtgccatcaggtcgtcatcgatccgtcgagccaccatgccaccatcaggtcatcgctaatccctcatctttccatcacgccgccaccagccaccgggacccctcgcacccgcaggtcactgatcccgcacgccaacaaggtaagcatccttccttcaaccgttacatatagatccgattccttcaaccattgcatagatttggtttgctattctatagttgaaaaaaaaatgcaattttctatatttagcgatggcggatcatggaggtggcggagtatctggtgcgagttacggcgtgtggttgtcgttacatttattttatggagtgtctggtgcaagttacggtgtgtggttgtcgttacaacaattcattcctctacgatgtcgtaggctaaaagaattgttcgctattttgaaataggttatcctgcaaacattatgttacatgttatcaaaggattcactagttcataactttcactaaaatttcctatattcggtaatggcggatcatggaggcgatggacccggagaaagtgtccggtgcgaggtacggtgcagggttgctacggacaaatgctgacaatagaataaaaatacaaagctgttgatgttacaaaaatccattcttctacactacagtagcttaaaaagtgttcagtatctaccctataattcaccaacggtgtgttacatcctcattcctcattgatcggtcaggattgccccaatcaaatccaacgcaccacgttactcccacctcccgcgtactctctctccagcgatacggatcgcccctctctctctctctcctctcacgcgcaatctccgctccgctccgctccttctctcccatcgctccctctctccccgccctctctccagccgtcgcctcaactcgtcgacgccgtcgactcacctcgccagaacagctgaacagcgacggccccattgctctcggcgccgcatcccgcccctccgccgtcgtcgtcacccgcgatccctcctcccttggtacgccgccggacggtttccgttgcgccgtcgccgacgatccctcaccgtcacctgcgatcaccacccccgccccctgccatccgctggtcctcacgccgaccgctgatggtcctcccctccagtaaaggtaaagaagatttctcctgtagtctcggatactgtaacatattgcagagtagattttgatgctatcaatttttttcatcagtttgattaatgaaccgttttcctgggtgaccaatgttgattgtgctattcacacttttctgctaatgtactgagacatatctgctaatcctcctttaccagatcagtctgaacagctgcttcccatacgcaaactgttgcgatgtgcttatggtcgaggcggttgtgaaccaaatcagcacatcaacctcggccttgacacattcagtcgttcagaggtgacccgacctgtgaaccctctactgcttgtgtgttattagtatgaagctttgcatacatgaaccatgtactgcttgtgatttatatatttagccaaagaaatatctgaatgccaaagcaatacatgatatatgcagatcaatcaacggaagcagtggcagatggcactgggcgtgcaatggcaggtgtgcacgaataagatcatggtacgatgtgcatattcgacagttaagtttgaacaccattgcaaattattagttttttcgaagtaacattttgattcctacactgataagctgactaaacaatttagtcatttgctggttatttatattcaaatattgaccatttcttattgtcaggtgatgcttccttttatcaatttattccattttcagtgcaattgtggatgttagaatgccagtggtttataatatagtaattttcaaaaagtttaatctgagataattcatcagatttacttttcatgggcttatcctaaaagagaaaatgttatgctgaccacaaattatatgcaggactgtgaagggctcactctggtgaatcagagttcaagtgaaggattgaggaagggttgaagggagaatttgatcaacttgctttggttcatttgctttggacccagaaattatggttcttttgctcatttaatataatttgttaatcatgcttgaccacttgcatattctgtattggttatttcttccagtttgatgaacaagcttgtgggcatttgttgttttatagaagttcagtgcgtctacatggaggatagggaaccactatacacctttcaacaacctgaattcatgttatatagtgctatgactatgcaaattcatgccatatgactcatctccaaactcatcttaatggtggtgaacagtggcacttcccttatcggttccatgacaatcgtgctgagttctggcaccatgtcaccatgaactctcttcagtggctcctgtggctgttgttgcgattggtgccattcttgtgcccggacgcagtgcataccaaggtatacactaattgctcttctattatattgcttgcaaatcaaaccaaagtatacactaattcctcttccattatgttgcttgcaaatcagcaaattagtttgaagatgtacacattgtatatttgtgtgattagtctcatgtgattaagaacaatattataatagaattaaccttttgtggaagggagttggcatccctcttcctgagatctcaaaacccatgaaaccaggctgcctgatgaaacgctttttaatgtaaataagttggtgatagatttctggagctttcaaatttttagatgtgttttgatatgcggttcaagaatttgtggcagtactgattttcattttgcccaatagtcctcgctggaattttgccgcatctgtctgttatcttgaactgaatcagctggtcttaaactagatcatgttttctgtagtccatctattaattattgatgtctaaatggtagttcatgggccatttgatactattgaaaaaataaatggggcaactcctttgttgtatgcccatgtgtccatttcttatgcttttatatgataaaatttgccgctgacactttggcagaatttcatggagggaactcttttgcagtacgggggacatgaggaacttcaaatggttcatgagatggagctgctgactccctactgctgaactatttttgatctagacctgttgtttctctgaaaatgtgttgttttcttttgtagtatgaggggttgccatgtttgcttgttataacaatgtgcacaagcacaggaattcttcgtttatatatagagcacaattaaaacatttttctacatttatagatgcatcagcaggatcgattaatgagaacaaacatcctaatatctatgtgatttggtgtttttgtgttggaaagcaatgcaaatgcttttcaatgttctcatattattttgagttaaatgcctttacagctgtaaatattgtcaatgaaaaaagaaggatatgagacatctatatcatcttttgggagtgatatgtatttcagtaaaattatatactagaataacatattcactttttattatgtgattaccataaacatttaccatcaccgtagcgttagcacgggcatggtactagtttctgatggttggacaactaaaaggttacgcatatggatatgatagctatagtgacaacaaaataatagatgttgtaacggaagcatgcatgcgtgcatgtaatggtaccgttggctaatggattgacctgataacaatcagaaagtaacatagttgataatcgaatcaatcataggaaatactgctgatatctaagttgattagagacaacatcacatgttctagcggaactaaattgatcactacaacaccgataaagggacacacagtaacacaagccactaatagggcaacatcacgcattcaaagatggcaactcaaggcaccaatagggtagcggtttcacgggtttcaccgtatgcaccacaatgatgagttggatcaactaaaagacaaatacatatgggcatgacagctatagtgacaacaagaaagtatatgtaacagggtacgacggttcaattgaccaatagataaaaggaaaaatatatcattttttctaaaattaataaatcatatttttcgtgaaatgtgttatgcacattttccctataatatgttatccgcattttccctataggaaaatgtccacattaattttatatgttgctatccatccaaatttaatttttatgtaatattaagaagtttttaaggggtaatatgtaaaaattgtaatgagagtatgtggggtggtagattcattgccaccatcatttatatagcatttttttctaaaattaataaatcatattttccgtgaaaagtgttatgcacattttccctataatatgttatccgcattttccctataggaaaatgtccacattaattttatatgttgctatccatccaaatttaatttttatgtaatattaagaagtttttaaggggtaatatgtaaaaattgtaatgagagtatgtggggtggtagattcattgccaccatcatttatatagcatttttttctaaaattaataaatcatattttccgtgaaaagtgttatgcacattttccctataatatgttatccgcattttccctataggaaaatgtccacattaattttatatgttgctatccatccaaatttaatttttatgtaatattaagaagtttaaggggtaatatgtaaaaattgtaatgagagtatgtggggtggcagattcactgccaccatcatttgagtctttttaaaggagtacagatataatctgtaattcagtttgtcgacactttggtgatgctatataggagttcgatgaatgtacatacgatgcaataaaggaagaaaagtaattaacttttgtactactaaattttttatgcaggtggcgtgcaaggaagataaaagattactagcttccaggttacggagtacacctggatggcgacagctatgtatgatttggatttgttgggcagttcgatcggattagtcccggaaaaatctctcaatccctgcaggtgacagccagcatatatatgcgaccgtgttctaaggaaattttcagacgacaaatctgatcatgcactgtggataattaattaaacaccttaatttcataagaaattttataagaatatggcatagatttcacaggaagtatctttctttgccctgagcgattcctttcaagaaaaaaagaaacattgccctgaaagcaaagtactttgctctctagttttcagagaaaaaagaatgacacttttatctagtgaaaaggaagatagtttcatatgatgggattcatgcaatggctaataaagactgcaattatatataagagcaagtttaatagtatagcccactactagtttcaaaccatctatagccaatgtaatagccaattcatacaatagttgcttactatactattaatacctagtttcacctattatacacacgttacgtcttgaaatctgtgttgcagctggctacagatctgtagcccgctgctcttctctctcttcctttatctctttaaaatatgttggcttctagcctgctattgtacatgctctaagttctcctccgtccacaaacgcaatcttctcaaattatatacaatgaaatcattactctagctactttggaagaattaacaatgttcaatatggagtacctcctctgtccctaaatatttgacgccgttgacttttttacatatgtataaccgtttgcctttttcaaaaaatttaagtaattataattcttttcctatcatttgattcattgttaaatatacttttatgtatacgtatagttttacatatttcataaaaaaaattaaataaaacgaacggtcaaacatgtttacaaaagtcaacagcgtcaaatatttagaaacggagagaatagatgacaaagtcatctcaaggctaggaaggctgtgatgatattgcgctttctttgctaattaagcagtcatataaacaaatgagtcccaaatatataattaaccaccaatattaacttattttctgtttgcagcagcagcagcagctccaacacttgacagtcctaaatattcagatctgcgctttttctgatgattgtaacaccaggctgttcgatgatctcatgttctcatgctttcttttccctgcagatatcaaatgattagaactggattattggaaggggaacgtagtgacttagatttttttagctccaagttgttaataaaccagaatctaattatgatcatgattgtattgtccggctagctagaattgcataaaacttcacgggttgcagagaacctgaaactagctaacatcgtagactctagacaccaagtccacgacactatttgcatcagaagccatacacgtgtaaagatgatttttttctttttttttcggggatgatgattttagttaagtataaggccccattgtttggctttttccctaataagccaagggaataaaaataaatttataggtaaaacttttatatatatatgttcttagtgacttaaaagccaatactgaaaaaaaaaactacgttgaaaatatctcaaaatcattcttaaaattaagtttgaaaatttaaaatttggctttttctttggcttattagaccatccgatggagccatagtcaggaagctagctcacaagtcacaactagctaggcccttgtttagttcccaaccttttcttcgaacttccaacttctccatcacatcaaaagttttctacacacataaactttcaacttttttttaaacttttaattttagtcaaacttctaattttagtgtggaactaaacacaccctaaatcattatttggatggctaacaaatggatcaaaggccgctaattcagcgagttaagctagcggagagtcagtgccttcttcttcttgatttcagacacatctttaattagtttgagcatttctttgttctctcttgatgatgggtggtcaaatcaaagctcaaaataaatgagcaataattatataacattatatatttgcatattcttcgtgggttcatgatggtatataatgttagctcgctggatggaccagagcaaatcagcctagctggatggcagttgtgactttgttattttggtctgcggcctttttgttgcactgtgctaactattggaagattttgctccctttttgttttcttccccctcagaaggtggtggtttaaggcccggtttagatggcgaaatcttttgggatgggccaaaaaattttggcatagggccactttttgcgttttgtgaactaaacgaggggcaaaattttttggcagatgtgcagtaactgttcacccatggacgagtagtacccctcaccctgctcctcgtcgctccaccaaaatccccaacgtagccgcttgccccttcgttcgtcccactgccgccgcatgccatccctgacaccgccccctcccaaatcgaccccctcctcccctacgctcgccctccctctctcagccgcctctcgccctccctaaaacagccagccgccgctcgccgtccgtgagacccctgccgcccagatccagcaggttctgctgcttcggcgttcgtcgctcatagcggagccacccgtcgtctctcacaccgctgccgcccagctccaattcttccaccgcttgtgtggtcgtccctcccccgccgacacacgtcatccctccaaccgccgccgcccacccttccgattcaccgttggcacccagatccgccttcattcccgcaatggccagctacgggggtggctacaatggcgacgaaggcggcaacggccacgacgacgacgtgtacggccacgacggctgcaccaaggacttccttgcgtccgggccttggtgcgcacgccaagggggcgcggtcggcgctgacgcggcgcatcccccgcctgattcctctagcggcaacacctcccgggtgcggttcgagtcgctcgacctcaacgacagcgacagatggccggaaatggctatgtacgcgggcatgctgcaggccgacgacgacaacatcgaaattcctccaccgcccgttcgagttcctccccggtgaatatctcgcaacctcggaatccggcccactcacagcgtggggggaggaggagtacaaggcgcggccgccggaggaggacgagcaggggccgcaagcgctggaggaggagtcgcaggcgcggtcgtcggaggaggaggcgcggccgtcggtggaggcggcgcggccgtgagcgcacggcctgcatcacgcgcatcagtgcgccgcaatgtctcagaccttgcggccgagcactccgatgctaacgacggtattccggtacgtacaacaattccaattacaattgattgcctgcttccaactagtttaaaattttgttaaatgcaaacttagttcacatgttcggtgttgttttccataactattgatgcatttaggttaggaaagataaggcaaattggtcagcgagaaatactcgcaccttctgttccatctggtgccatcaaatggacataggaaactatgttcgcggtattatgcaaaaaaatggctggagggacatcattaagaggtacttccaagccactggtttagttcacgacagggagcaattcatggggagacacaggcaacttaggaagcaatgggcattctgtaataagctccgctccagctctggcttagggaggaaccctgatgggacttttgtcgccgaggatgattggtgggctgccaacaccaaggtaaattggtcatgtctctctaatgttgtgaacacatgttaagtttagcaggccatgacatgtgctttcgttggacagggacatcctgattggaagaagtttaggaaaggcttgcctgaatatttgcctgaaatggacagaatgtttgagggtgttgcagtggatggttctatatcctttgttgcgactgctgaccagcctgtagagtgcgacagctctgatgaagcggatgatgatgaggacgacgatgagctgactcctcttagtgtcggcaacaaaaggacaagcagcacgagcaccacagcctcgagtccaagtaagaagtctaggagtccagcggtgagggtaatggacagaaacatgagtgagtacaacgaaatttcagggaacaaactcagtgtcctggagaccatgttgcaagtaaagtaggatgctatgcaggaagaacgcaaagctattgagcggaaggtggcaaaggttaacgagctggcaaaggagtgtggggtaactccctctgagaccccaacattgttcatgggcgtcctcgaaatcatcaagtatcaaagtgtgatggacttgttcattgtcactgagcctgaaggaaggatgctcatcatcaagaaatatgcaggggtcgacaactagtccagctaatgttttgtcatggctatatttcctactttatgtactaatggccgtatgttcactcggatgtatggtgcatgtatttgtgtgtttggactatgttcctgatgtgtgttatttaaacatcagcatggtactactattaatgaactctatgtatgctgctgatttgaactatgtaatgcatggctgagaaagaaatgcatattaatcatgtctatgtatttttcattgttaatattttgcattgcttgttttgacaggatgatgaccaatcaggttatgtggaggatgatgaccaatcaggttatgaggagtcgcaccgtcgacttaagcgttgggaggatgagatagacgagttaatcattgcattgatggatgatgatgacgacggttatgtgtacggtatgtaccggtatgccattcacattgacaagcatttgactagagctgagtacacaacctgccatgactggtttggaatgggtacatagaaaacttggggacagaaaggcctgttataacatgtttagaatgagtccaactatgttccttcgcctgcatgatctattggtacagtcgtatgagcttaaatctagtagcaagtcaacctcggttgaggcacttgcgatgtttctttggatggttggtgccccgcaatctattagacaagctgaggacagatttgagaggtcaatggggactgtaagtagactgtttaacaaagttttgcaatctatcatcaagcttgccgttgatgtcataaagctggttgacccacaattcacaacaatgcatacaagactgaggaaccgtaggttctttccctacttcaaggattgcataggggctatagatgggactcatgtaccttgcgtggtgccaagtaacaagttggtgcagcacttgtgctgcaagggcatgacaacacaaaatgtgatggttgtctgtgactttgacatgaggtttacatttgtactagctggatggccaggttcggtacatgacatgagagtatttgatgatgcccacacaacatacacccatgtgtttccacattcacctacaggtatatgctttaatggtacttgttccttctttgttatttgaaatatgtcatactaactcatgtttgatgctgtagggaaatattacctagtcgactctgggtaccctaaccggccaggttaccttgctccttacaagggaaccaagtatcatcttcaggagtatcgcgacgcccctgaaccacaaggtaaggaagagaacttcaactatgcacactcatctcttaggaatgtcattgaaaggtcatttggagttttgaaaatgaagtggaggatgttggagaagatccctagttatgatcctcgtaaacagacacaaattataattgcatgttgtgcgctacataacttcattaggaaaagtggcatacgtgacaagcacttcgatcgttgtgaccgtgatgagaactatgtgccgccacaagctagtgccgatcaacctaagaccgaagaagtgtttgatgattgtgatctgatgaatgcatttcgtgattccattgcacttgctttggtacacggttcttgaattttgtttgtcatttggaacatgcgtatggactgtcatgtatgcggctgatgtgtatgtttgacaacttatttgtggatttctattgcttgcataattgttgactgcatttgtaatgtgctactgttatggaggatgtaagccaagagatttatgttgtatgtcagtatgtgtgtgacgtcgcatggcagctgtgtttgctgtaccatgcatgtatgccaaattcattatttgtttgcagcaacagcatcgcccatgaagcaagtttgaaagtcagccatgcatgcatggcattaaatatgggcaattcaggaattctgtgtcaggggcccaaaacttcttgccaaaactttctgcatgtttagttcccaaaatctaaaaactgtgcagttcccgaaaatttttgccttgccccaaaaattttgggcaactaaacacggcgtaagtggcagtggttgtgctatctctctaatattcctggactgtcagtttcccaccattttgggcccaaatgggactcagattatgtgctggcccagcacatcactagtgtttagcacaagtggatacaggggtaatctgctgcattataatctgtacctcgctagtgttaaaagctgtgttcgggaggcatatggttcccaaccttgcctcccgacacggaaaacaaagcatactattatagtgagattaattagtattagtataaaaaaacatgaaaaatggattaatatgattttttaaagcaactttccaataaaaaaacttttgcacaaaatacaccgtttagcagtttgaaaagcgtgtgcgcggaaaacgaaggaagtgagttaggaaagagggggaaagaacacagccagttccaataggaaccgtgcgcacggaaaatagagcgatccattagcgtgtgattaattaagtattagctatttttttcaaaaatgaatcaatatgattttttaagcaactttcgtgtagaaactttttgcaaaaaacgcaccgtttagcagattgaaaagcgtgcgcacggaaaacgagatgagagagttgggaaaacagagtaggatcccaacaagaacattgcccagtgcccatagaaaacagaaaacagagcagcatattagcacgtgattaattaagtaatagctattttttaaaaaaaatagattaatttgattttttaagcaactttcgtatagaaactttttgcaaaaaaaatacatcgtttagtggtttgaaaagcgtgcgcgcagaaaacgaggaatagaggtttggaataaggggtgccgagaacaacctaagttgctacttttgtaactctaaagagtcgatacattgactgtctcatggcaaggtacatttgaagtgcatgtttctttactttcagaattagccaaccccataacatggctcatatgtttggaaattggttgaatggttttgaacctagacttaaaagataaatttatatgggcattgcggcaattttgtgggttttatggcttaataggaatgatgtagtctttaatggctccaatccaatttctttcatgcaggtaatcttcagagggactcattgtgcaagactttggtcttgctttttaaagaggacgatggagatgccatccaagttcattgtagaattttggagacacgagtaatggagttttatgcaacttatggctgaaattttagaagaaggattgaagcttagctttctatgattcttaatatgggttatatctttatgtgatattgcccatgtatcgggatgagtcttatgcaaactttcgtagctcgtgttgtccctcatataacttgatgagtcttatgtactcttggaaacttgtttggttgtgtacaccctctcacaggtgtagaggctaggtttaatataaatccattatcttaaaaaaaaattggaaacaggggtggttttgaggctaatcaaatcagatacattctacgacaaataaggataaatggaatttaaatcaacaagcccgtctagctcagtcggtagagcgcaaggctcttaaccttgtggtcgtgggttcgagccccacggtgggcgccttctttttttaatttcttttcacacccgtttcatattttgatcaatacattttgttccacacatttttcttaccatttcatcttcttctcacttaacattttgttccacacattttttttcttaccatttcaccttcttctcgcttaataaaacatttcgtatttttcttctcacttaatataaacatttcttgatcaatgcattccttttccacacctttttcttacttaatagaccatttcgccttcttctcacttaataaaacatttcatattttgatcaatgcttttctttcacacacatttttcttagtactacatcccctccaaaatagaacaatctaggatcggatgggactaatcctaatactacgaccatttcatattttgatcaaatgcggtgtgtttagatttatttaatctgctccattataatctgtacaatatataaggaaatggtcatctgactacgtcagtaattcttcagcagctaagcttcaacgtacgccttctgcgcctacttaatcgatgagatctctcttcgtgccgatgatccgactcgcaggaacacacgaccagcaaagcaatcatcgatctttctcaactctcaactctcagctcgactgattcgattccacaatgatccatggatggatgccgctatcagaggagccatggcgcgaactccaagtagtcgtcgtcttcgtccccaagcgaagaaggcacctcctcctcctactggtggtggtggtggtggtggtggtggtggtggtcaccgtcgtcgtcttcctctgcttccagctgccccagcaacgcctccaggtcaacagctccagcctcgccaccgccaccggcgccgccgagctcatagccaatcggcatcggcagattcggcaccgctccggcggcggcgttaccgtcgtcgtggccgccgccgcgccacgggctgatcaggaagccgtcgagtcctcccagctcgatgtcgtccaagtcaaggtcgatacagacggccggcaccggcaggtcgtcgtcatcctccgctccggccagctcttgctgctgctgctgctgcaccgcctgcggcgtggccaccttatcagccgccgcgtctcccggcgcgccgctctccggcggacggccgccgtggctgcaggcgcctgcctgctgcaccaccactatcccgctgctgctgttgttgttgcaccgcagcgccttggtccggattgggctgacgacgaccgtgcggggctccggcgatcgccggcgtcgtgcagcagcgccggcggcgtcggcattgctgctggtggtggccgccgccggcatgctggtggcggcggcggtccgttgcatggcgacccgcttgctgagggtgctgttccagtagttcttgatttcattgtctgttcgccccggcagcctcccggctatcagcgaccatctgcatccatagttccatacaagtcttaccaagttttcaaaattgaagcaatttcgaccaaatttgaaaaagaaaagaacaacacaaaagttttggttcgctacgtattgcagatctacagcagtaaacaagttttaagtatagatggccatatggcccgaggcccatggcccggcccaaggcacgccattttggcccagcccaaacatggcatgacccgactggggtcgtgcccgtactagccagatccaacaaccgggccatgcctgggctgcaccctaggcacggtgggttggcccggcacaacaactatagggatgcaaatagacttaattaccgtataaggcaaggccaaaaagaagaagaatacaaaatagacttattttccagccatatgaacacagtcaacagagttgagggataaaaaatatactttttttttagaagcacaatgggccgtcgtgtctttcggactgctgtgtatgcagcccgtgggctggcacggcacggcccggcgtgtcggtcgggccatgccgacctgattaacctcggcctaggcacggccgtgccgtgccgcccatttgaccaactatagttttataagttccctcgcttcgtactccatgtgtcgtaaagtttcaggcctattattatttttaatatacggtcttcaatatttgaccatctatttatttcataatacgtaccaataactataaaattagcataagcttttaaaaatacgaatataattatatgataggcatcacattagatatagaaatggataatataaacatagatatttgaccatatatttatttctcattttatcccctttttgtttttaagagtccaattgtcttcatactaatttatgttagcaggtcgtagttgtaaaatctcctctctttttttctatgatacgtaaggcttttacgtgttcgtaaaataattattagttaaaagttgtctagattgatttttctaaaaacaaggacgtctcgttaaattgagacggagggggtattaagttgcaatgcacaatgtgagctgcacttttccatatgtgaaagcacaatgcttgccacgtctgagagaagtggttgtgcattcatcatgtgctcttccgatcctaggcaaaaactttgctcttctttcttgtgtgagtttgtggctttaggtgtatatatagaagcagccttgtatgattccatctgtcatcatcaactttgctgacctaattactcttttcagattaccctaatctggagagcagagactgcactgacaacaaaaggtttgttcttctagagagacagctgatctggaaaattgtgcaggtggtgactgatttgggtaaaagtgtgcttaggtggttctgttaattggaggcaattagttgttggcttagtcatggctgtgttggcctactttgtctgtttctcatctcatggagcagacagatgtgtgatatctgtcatcaaaccaagagaaacgaatagaaagcttcattccatcatgtgctaaagagagcaagctagttactagggagatgatcatgatgagtccataaccctaatatactgatgtgcaatcttttaaaggaccctctctacatacgtctagcaataaaattctcggtgatattctcagaattcttgatctcattttggggaaaaaaatgattccttgtcagagtattttaaagaaaaacatttgaattttgaaaggaaaacccaattttgaacaattcagatctaaagaaattgaggggctgtttggttcgcgtcttgatgcttgcatgcctggccggagcgctgcctaagctccaacaactacgtgtttggtttgtgccctggtgtatcctgagctagcctgacctgactcttcattagcctgctaaatcctcaggcaactttattagcctgagccaggccatcgaatttggatgcctgagcttcaggcagctactcttaatgatgcatgtgtcatttattctatgctttgctctagtaaaagttgctttttgatattttattattcttcaggtatgtgcatgaaccaaacacacaaagcttcaggctgcctatgaggcaagtgttgcatctcccaatgctgcctgtccggcgtgagtttttctcaggcgtggccctcaggacacgaaccaaacaacccctgagtaactgcagcatttttgtgggagcagaaaaaaaatctcggcgagattcatcagaactatggtcatccgccagtagtgatcatgtccttgtacgctctagctaaaattcattcatttggctcgcaagaaaagaaaataaaatcattcatttggcttgaacactagtgtcaggctgtctgcaatctgcatgttactgttcccctagagtttagcatcggagtttggctgatttagaacggacttagaaacagggcgccaaaaaaaagagagagagagagagagagaggagagaaacaggattttactgaacaagaatgcatcatggctgcatcgtcaatttcttcagcaacgcaggaatgcagatatgcaggcatgcagagcaaagcagtcctatcaagtatgcaaatcaatcactaactactccagtacatacactgaattggcgagttaaattactgataagcaagcaggaaatgaaagtggtaggccgggctggattaatttgcaggagaggaggagaggagaggatcagagacaggcctgttgccgaggagagtgtggagcctgaggatgagctcctcctcgtcgccggagatgttgcccctcttgatccccggccgcaggtagttgagccaccgcagccggcagctcttcccgcaccgcttcagccctgcattgcattcatccatggcgatctcatctcatcacttcatcagctgttcaccaccgatcgaaggcaaagctagagagtagagaggaggaggaagaagacgacgaccgaccggctctcttggggagggctccccatttgccctccccgtgcttggcgatgtaggacaccaggatgtcgtcctccattgccgtccatgcccccctgttcagcccctccttggagcagcacggcttcctccccatccacgattgctcgatcgatcgcctacaaacaatgccaatggcggcagcgtctctcttgctctctctctctctctctcttgttgatctcaagcagagagcaggagacacgtctggctatgtcatatgtagtgactccaatttgcacaaggcattccgttcttagatgatgtggttatctcaaggggatggatttggtcgtctcaattactccactaaccagatacaatcattggtgccgtggttaggggcggatctacagtataagtgtcggtgtcaggcgacagactttcggcaaaacctattgcaaaacttcttatccatatactataacactataatctaggcataattaacatattatgacatcgatagacatgccaacgaatcgattttctggatccgtagtagctttgatttgcagagtgaccacatacagattctgaggttggcattcaccatcagcggttaataccaaccaatttaactctttaacccaactgttcgtgccttacgcaaccgaccactttaaccaaacggcgcctggaattttttagggaatcttctttaacaaaactgggaaggtgacctgtatgcgcgggtatttgtacggttgaacttaaaattatactccacccgttccaaaatataagtatttttaaaatagtgtcaattcaaacatttttaactttgactattaatagaaaaaaaataaaaagatcaatcagttaaaattaatgttactagtagatttatcattgaataaactatcataaaatgcaactccctttatttaaaacatcttacttttatatatattgttaaccaaagtagcatctaaaaattatgtcgaaatccaaaaatacttatattataggacgaagagagtagtttgtttctatgatcatatgatttgtataatggctatttgagggtataaacaaatcaattaacttttacaaagttgagaatttgttatagaaaagtataccaaaataattatatagtatttttcacgaaaagtatcatagcttgggaagcgtgcaaataaaaatccaaaatctagaataaaaaaaataacagggtcttagctaggctcccctataacactcttgttttgataataggtctagtgatattggttaatattttttttcacttacgtgaataagtagtactaaatataaatacaccctagtacattataattaggtaattgaccatctgttttagctcacacgggtttacatgttgtgaaaaatcaaaccacgctggttaattcttctctctgtgcattacccttcaatttgttttgacgttattaacaaactaaacgttatactttgatgaatttgatacatcttcaccttggcaaagtggtagcgtgcagctgttgtgatcgctttggtttaatatatttcaatgcagaaaaaatatatacacacatacacaaagtttgtatacgcactaaaaataaaaaaaataaaaaatacatcacgtatagaaagtttgtatacgcgtatataaagtttgtatacgcgtatataaagtttgtatacgcgtatataaagtttgtatacgcgtatacaaacttcgtatacgcgtttgtatacgtgtatagaaagtttatatacgcatatataatttgtatatatacgcgtatataaaatttctatacgtatgaatataaatttggtatacatacgaatataaacttggtacttatacatctttagaaaaactgtaaaaaaccgaacagaagagaaaccggaaaaaaaaccgaataaacgaaaaaaccagaggaaaaaaaccaaacgaacagaaatgaaaaaaaaaagagaaagagaaaaaaaatggaaaattcgctcctctccctcgcggcgtgtccgccgctccctctccgcgtgcgacacatgtccagtcgcgtagagaggggggcgcgcgactgatcgcgcaatgtagaggaccggagagagatgtcttcagaggctttcgttttaacaacagatagatctaaagatctaaacaattggtccattgtttaaatggaaattgatgggcaactatttcttttacaaaataggtttgaacttagtataaattagtcaatatgtgaagagtaaattgcatattgggccacctttctttaccattctgtcaatttagacggggatagaacaattttttcactttggaccacctaaatttacatgtttgtttccttttgggcctcttcttccacatccagctccctctctcttatctctatttcttctctctttcttgactgcaaagggctagaggaaccaccatgagcaggccaacaagtgatcatcagtgctcgtaccgaagctccgtcggcgtcacctcctcgtgcttggaaaggagatcgatctccctggctgttgggaggtcaagctccagctcgaggtagagtatggcaaacaacgggactcgagatagtgaggcatcagcagagcttgagaatgagtgcggcatataattcagggaggccagagagaagatcgatggagttgaaggtggaagagtgccccaaaataaaacaatatgtaaatataggtggtttaaagtgaaaatgttactctatccctggtccaagttgaaacaatggtaaaaaaaggtggcccaatatgcaatttactcgtgaagagtaaatagatcatatggcggtgtaaattttattttcaaaccccacgttatttaaaaatgtttaatgatgtaaatggataaaaattaactatatgattcaaatgtttatagttctttaacatttattatcgttgtcacctcggcagatcaccttagttgtctcatgtatgaagcttcatcatacatgcgaaagcaaagatgtacatgtgcattgtgcagagggtcagataaatgttcttagaggctttgttttcatcaaaagatagatctcatattctaaataataggtccactggcttaagcaaaagatttttaggcaaatatttttaattaaaaaaatagtttaaaataacagattcacttgtttaaatataaattggttaatatagatcatataatagtgcaaactttttttttctcaaacggtgcactatttgtaaatatttaacgatgtaagtggataaaagttagctatcaatttattatacttttttcaaattaaatatcactttattttcaaattaactatcactttattttaaaattattgtaagtggataaaattttgtacatgtagaggaggtcggtttagactaatgtttttataagtttttcttttaataagtgagattgatttcctgtggtgcatcttgtaggcccatggtgactgaaccatgcatatggttggcacgtctaatagaaaatgtctaatagtgttctttaggaaaaaggaaaacgaaaacatactctaccgtacttgatcggtgtttatagttgtttaaaattgagtgaagtgtatgggcagtacttaaacttgtataaatgtgtcatctagatctctaaactctcaaaatgtatttttgggtttctgaacttgtcatgagtgtcatgtaggtccaaacgggctccaacccgctcgatgagatgacgtgacatgccacggtgacgcttacatgtcagtggtatccacatgtcattcgcataaaaaaataaaatttaaaaagagaggagagagagagaggagaaaaaggatgttttcaattttgaaaaaataaatgaaaaaagagaggagaaaagcaatattcttaattttttctatatatgactgacatatggattctattaacacataagcgccaccatagcatgccacatcagcacacggagtgagttggagcccatttggatctatatgacacccaagacaagttgaggggctcaaaatgcatttgagagttcagggacctaggtgacttgacacacctacacaagtttagggaccgcctgtgcactttactctttaaattttattgtcacaaaatgaatttccatctaactaatatagcataaaaagagaagagataggaaatagaaggggaggtcatataggggaacgcgagtaggtacatacacatgatggtacgggaggtaggcatagcacagcaaaccgggctagaggttgacccgctctggttgttagttcaccggttgaaccaccggatcactggtcgaactgccggtttttttatttattaatattatatttgatttgcattatttgaaatatagaatcatcataaattggtgaaaatatgcataaataaactagtatatctattattatatggccacaacatcaaaaaaaaatgtagtgtggtaacataataaattcataatgctatactggtaggacaaattaaaaccggttcgattcttcaaaaaccactcccaattcaccggttcccataaaaccgcccggttcacaggttttttaccggttcgattgcagggacggtctttttgttgaactgagccatcaaggtcgccggttccggtttttcttgattcaaccgccagctcagtccccccccccttttttactatgcaggtagggcatagtgtctatttttctttaatataaatctaatctaatggtttataatattggacctaccgatttaattgaaaaatcaaatgatgtgttttgtttttcttatcatcttctctaattaattaaaacgccacgtatcagcttgagagtgtttttgaacgctacatgtcaacttaagagcgcttttataaagtttaatggacttttagtatgtaatatgaatatgatatgatacctaaaataactttataatatgatacagaaagagtaacaaacatggcatcaaattcactgtgatgcatcgtagcaacaatggagtgagttttttccccttgtctacggacaacaaacatgtgacttgagtttcctttcggcctaataccagcccaacattgtgcttacacgggccgtaacccactaaattcacctccgagcccattccactcgaaaaagaccttcgggaagcctctttgcctcccgctcctcgccgcccccgccccgccgcctcccccccacttcaagtctccattcctccatcgccgcctcgatctactcgccgatggcgctctcccctcccgcggccgcgcgctcttagcatccgccgccgcctccgccgccgtccacgccttcgatccactcccatgtcggagccgccggcctcatcctgcctgcttcagtaggctaaccgacaggggggaattccggccgggagccaggctgggcgcccatgtccccctccgccacctcgccgccgaatcgcccacaccgcaagcgccgcgccggtgccggtggcggtggcgctgacgacggctcgacccgccgccgcggccgcagcgctgtcctcctcggccccacccacttccccgccgttcgctccttcggcctccgcctcgccctcgtcgtcgccccagccccacgtcaccgccgcaagcagcgcccgctccactacgcctgccgccccacctcccttccctgtcgccgccgccgtcgcctccgcagtatcatctccctcctccacctccccatcctccgcccgttctacctccgctacatcctcgcggcagccgcatcaggcccctgccgctgccgccggaaggaatccctggtaggcatgggaaactacatctcgcgggtgctccggaagagctctagtgaccgtggtaaggcgccgccagccgacgatacagccaagcaggtacccaatttttaatctaattgagtacatctggcatgtaatttgcttgaaccgtcagtttgcacagtaaaattgacaatgcaacatagtttcaaaagatggtaatacgtttgagtcaatccaaattgcttttagtgaaataagtggataagtaggaatttatattagctatattgtatcaagtattttaatccacaagtgagagtaaaaagttaagtacttgcatttccagcctgttcatttttttttcttttgaagtcaaatactgttaactaaattaatttgagcactgcaaattgacctttgttgtcatattttatccttgactattccaggatctatgtgaagtttttacacctctgacaaatgaagaagaaagtgaagtaaacaacattttgtatggcagtgatcaaaggtattgtaggcaaccatgaatttaattggctgattacttctcctatatctttagcacaatcaggaattgattttccctttctttttttgcagtaagaaaataatagtgatgcatggaccttccaatattgatattactaaagagaaaatctggtgcttgagaacttgtaattggttaaatgatgaggtgaatacggcctgtccatggaaggaatcctgaagaatatgttaaacaaatgtcccattctttctgatcttgacattagtggttccattttccatgcttcacagaaccaagactgcatcagcattctacttttgttccttgcaggtcattaatttgtaccttgaattgttaaaggagagggcgcaaagagaaccaaaaagatttttgaaatgccacttcttcaatacattcttttataagaaggttagataatttgcatatttttctttccggtgctgtatgatggaatgttcttttcaatatttctgtagttctgttacacacaccattttatgatcttcagcttatcagttgtctctttgaagcactatcaagtgatatttatgcaattattacttgactcttttccctttttttgaggggaatttattattttccttccatagtaggaattatctgccagttagcaggaaaacctgtgattcttttccttcgatagtggaaattgttggctagtttgcacaaaaaacctgtgtttcaacactcaagcatacggtaccatacatttgtttgagaacacgcaattcctaccttatccttaatatatgttgatgtgtgccttgtatttacttaattgatgacccttttcttgagttacaaattttgtgtggttgttattctcttacttttttttttgctaattttccttgtaggttgtaacatcccttactatcccttactatttattaataaccttgcttagatatcaaatgaattctagcagtagtttgcaccttcatgattttctgaattctcttcagcttgcttgtggaaaaactggttatgactatcaatctgtaagaagatggacaaccctcaatagattgggctatgggcttgttgagtgtgagaaagtaatgttactgttattattttttcaatgtttttcatgtctgtttgtctttcaaacaaatcatgagatttattgtgcagatctttattccaatacatagaaatgtgcattggtgccttgcgataataaacatgaaggataaaacttttcaataccttgattcttttggcggcatggaccatgctgtgctgagaatactggtaagcttagctgattacaagtatattactggattagagagccagttacttccaattagttcagttacaagtccgacttatgagacgttagtttggtaagatggcacattgatgacttaacagttgattcagtcatagcatttggacttaattgctccaaattaattttgctaagtatgttatggtgctctctatttggatgccataaatctccagctcccacaatagttaaagggtggacaaaattttacccctgatgcattcatggacttattttttggtgctatagaaatgagaaaggtcttacgttatcacaaatatttgtgatatcttaaaatctgacatgattcagagttattctttgaaatttaaattgtgacttacgaagcagtaatccatgttaattagaatttacccatcaggtgctatttcaagctttcagttattttcaagtgaagttctgttttctattcctctcaggctagatatatcagggatgaattgaatgacaagagtaacatacaggtagacaccagttcatggctgaaaatatcatcagattcttgtcctttgcagcagaatgggtacgttctctttacatgctacatatgacctaccagaattacgtatggaatgaataatggtttaccttcggttctgcaatgaacacagatgaaggtctaaattttatcactcagtgcattaatacattatcgacatttgtgttgtgcatatcaatgaccaagcatggtccgcatggatatgtctgacactgaatttctcttttaataggtgggattgtggtatgtttatgcttaagttcattgatttccacagtagaggtattggcctatgctttactcaggtgagtatagtacaaaatactggattcaagttattatatatgcttaatctgttcactcattgatttgctgtttgcactattaagtcaatctcaaatgaagagtcttaacctgctaagatgaagcacaatctctctctttcatacatctaaagtggagtaacatgtaccttgtacttaattgtgtttggtgtcatctaaatcaatcactatttgcaggaacatatggattactttaggaaacgaacagcgaaggagatactgagattgagagctgactgaaaagatgtcctttcttgttcacacactcttgggcattttgtcaaggtaggtattcttgcgacctattggaaaagacataatgatgtatttattttctactagggtgttttgttgattacaagtggctggaacaattttgcataattctttaccccttcattttctaggatcttattttgatagaatagggagagattgaaatgagaccccaagggaacaagacagagctaacagaagtcggaatgtaagagcttagatgattagaacaagaatgcttaacccataccatgtatagccgccaattagaactataaagagataaaagggggtatgaatccacattttgttattctttaaaatattcaagtgaactgttatgaaatagatatgaggtgatttacatcaattatattttgtgaaaagggcgtcacccatcaaatttttttccttatagcatctcctttgcctctggcagtattagccattggctaacttgaaaaataattgtcgaaggtgatcgtctttctggaactcatattgcccagcaccacaggatatgaaatatggtaactcacaacccgcaaatcgctgcctgctggtgtaattaagtaatcgacatacttcctgtaagcacatacgaagttatcatctctaccccaacattcagttggatgagatcataataggcaactgtaagctgaagtgttttcatcaaggatttggaaaattgcagtatttactagcaaaagatattgacatcatatattgctgtttacagaaaagaacctgtataggcggttctagcaataaactacaaataactagcttggtacgtgtaggacaggcaattgtaaagttggatacgatctatgaatggcttggcaatcagcatgtttggattcgtttgctccagtgcttaaaatgatttcaaattttccctgcataaacaaagcacaacgatcgagagagaagaatcatatggatacatgcagacaaagcgatggatttttttaaatctctttcctttgtccttccttgagtcaatatctgatcacctgccaatcaacatacacacgaatcagatggccttggatctgtgtctcgtactcatattcatcaaacattcccgaatatatgacggcttacgatatcaatatcatttctcaagagctgacaaaagagaacaggatttaaaacctatcaaatactccctcctttctaaaatataatgtcacacattttagttatatcaatctagatagggacatatctagattcatggtattatgatacatcccatttgatcctaggtttctatattctgggacgaaaggagtatacatggtaataggtatacatctgcatgcaaaacagcttaagggtgtgtttgattgagctgtggcttttgaaaaagtagctgttggctgtggatttttgaaaagtagctatagaatataggctgtggcttttggaaaagctcgtttggttcagcagccgtagcttttgaaataactagtctcgcttacaagcgggtcccacatgtcataaacatattggatcttcttgttcgtctcaccaccataggatgcctgagatcactggagctgctcggttggggcagatgcggcggcgccgctggatcggtaagacggcggcgggggttccagctcctcggctccgcccgccacgcaagctgcgcctgtccgcctcctcggctccgctcgccgcctccgccgcgcccctgccccggcctgtgccggcctgtgcagccgcctgcaggacctcaccgcgggcgtccaggtcctctgacgccaggttaatttagtactagaataagttaatctagtaatagaatagaatatgatatcctagtactagattaacttattttcagacggagtagtatgaatttcatgttgtcaatttgtcatccatccaaatgacatatttcttcacaggcttgctcttggctgtcactatcatctatcagtacaatattgttccagcgaagacttagccaggaacagaagcatctgtgctttgatatatcatatgtttattcttgcgagcgcacatcgtaagaaagagcaaagtaatcacgacaaatagcatcgttaaaggtgaaatgcacgtcatcgtactataggtatgtcttgtaataattggtgggaactgggaaggtttctggagttaccgacttttggtcaatatcgtcgtatcaacacggataactttgaaaagaaaacaactccaagaaaacaaattgatcggtacttcaaaatcaacacgactattactcatataaaaatattacaccataaaatattttcagcggccaatatggggaaacagctttgacgtatatagttctgataatctggaacacatcaatttcaaaatttttaaacgttgactgcactgcacacactctaaaacaagaatggccagaaatgtgcaagaccttgctctagatcaagctgtcaagtttggtgaggatcttgctactgcaatctttgctgatgattatggggttgcaaattatcattaaacaagaagatcggacccggcccatgtggatgaaaagcttctcagattctcgtccttgggttcgattgcaataatcacatggagcttaagagtcaactatcctatcaaccactggatcagcaccagctttattcctcaaaagggaaaaaaaatcctgattgtactctcatctttattctgccccagcagcaatctcctctatctgaaaaatgctgtcgatctgtcatttgtgttaggctggccctggccctggtctggccaccagggctcagttttggtgcttttgtagctagcttggtcatgcaaagttgctttctcttcggaagatcccaatcggtcgagagttgattatatataaaaacgacttattattgataaaaaaataatttgagtaaaaaatttatatagaaatgttgttaatgacttaaaagccaatactttaaaattatgttaagaatactctaaaatttaagttttaaaatttaaattttggtagtgaatgatatgttgtggggcaaacgatgaggcctttgttaaagtggaactacatggcatattcagaaacaaggttaaaaaaaagggaatatacaatagtggacatattgtggaaaatgctaataatattccctgcaaaaaagaaaagaaaaaggctaaaatattaaagagctagtgattcatacttgtaatagccaactattctgcaagtaaaggagatagatattgtttcccatcaaatcaagagatggaatagggtgcgagcaagtgacatcttgcatgaaaaggaagggatcactcagacacactaactcactaatttaaccataacaaagtgtaggctaatttgtgttttctttcttgaaaactattgaggtgtctttgttttaaagcttccaataacgtctctaaaaatttcagcccttttgccaacatgcattagttagacaagttgaaatcttgacagggataggagaaaaaaaaaaggagaaaggggcaggtacattcccaactttccattggccattacacaacactttcacaatcaaggcaggttctagctctagctcaatctcttctagagctggagtctaaccaaacgatttcagctccataaaaaagaaagcggaacaagctaaagtgatatgagaaaaagaactagacaggtggagcggagtttgggctgctccgtggctctattgctaaagttagatttagtagttggtgccctaccaaacagatcattgataactctacaaataaggagacattttgttcactttgttaaggaaagattcatttattagggcaaaatttcactttgcaccaaatttcctttgtgtagttgtggtaactaaactgtgtatacaaagaaatacgcattgttttcattggctggtccaaattgtagggaaatgcagacgatagtgatcacatcaacattgtaaatgcatacaaatatagactatatgtgtgattttgacacaaatgtatttcaaagcatgcatatgcaaatatcaaggaaatatgtttttgttatgcgccggatgggggcccaaacgcctaagagcgtagttgtgcttgatgggagggtgagggcgcacgcctcgcctccccggagccatgccggcgaacggaatagaaggagaagggaagagattgaactggggataattgcttgctttattccctgaatgatctgccatatataagcttacaactaaaccgaattgctaatttaaaggactcaacaaactaacaaactttagataaaattgagaaacaacaagaactgtagcaatccgaaaacgatgttgacgctcccctgtgcgcgcgatgcctcatctgcccacttacgtcacaccaccctcatccgttcccgcttgtaggcttcgctttatcgcacgacggtggtatgaaaatccccacataacagtttttatcatttttatgaattaagactttgagatcctcattgccatcggtctctgcagctgttcttaaaatgttaaaggcatggacagcatggtgcaagaatagaaagaaatcaagaatttggttatatgttctatgaaggtcctgttattttctgattaagcgtcgaaacaaattttcggcaatatgaaaagggggtagcgcacgagacctaaaagtggatggatgcggagacaaagatttagacaggttcaggccctctcaatgagaggtaataccctactcctgtttggggatttgaatctgccgagtgaattatagatctgacgatctagttgtctcatgccccctagagggcctcctgcccaccttatataggatggggggcaggattacaagatagaaaccttaaccaatatggtatcggtttcctaaatctactttacaatcttatcaaaccagaactttaggccgttccataatatacagggaaacataatacccaagtcatgatccgttacatattccatagatataagttatcccctataactagtcggataatcatgccgtgtgggtatgtggtacccataatctccacagtagcccctgagaccttcacagtcgaaaagataatcttctctcgaaccagattactccaaagccaagtacttcaatcatctttgccatgatctcccgagaacttttaccaaatctaaagactgtggagggctgaaaaataaagttggtgcatcgactagatgcaccttataggtgtagcccccgactatgtggttagcttgaacaaactaagcatatagtcaaggaataaataatccaaccaacagagtggtcttgataattgtaatcaaccaagtgacttgatatcaatgtatagcatatgcggtgtaaatcctagaataatatgattcaagtgatataccgtctgctttgtaaaatatgatgcgtgcaacctaaagttgactacatcattgaaaattcacacgcaaaacagctataaagaagcttttatgttgtgaataaagaaatttccaaagtattgggcatacaccatgcgcacactgctttaacagatgtgcttaagtctctaaaagacacatggtttcaccacacctggaaatatacggtatatgtggtgtaaaatccgagtaaataaactcataaaggatttaccaactgcctggaaaatgaccaagatatataattagcctaagccataatattggtcaataaaaatgcacacttacgtggcaaaaagcaacgatattgtatccaatcaattgcttaaaaatccaaacaacaccttgacttatataaaaaagtcagcggggcagctatataaagctttactgtttgacaccttttaagatgcattgtaccaactcctaaaaagttgagtaactgcggtataaaaggattttaaggtattgggcacttgatcacgtgcactttggcctaagcaaaaagtgcctaagtccctaaaaaaacgtaataggccatacctgaaaatatgggctacagacatattaggccaaagccaaaaaatatgccttcgacaccctttaaaggatgacgcatgtaacatgctcccgagtaataaatctttcgggtgatatagaccaagtgtagctcatatgaatagcttcttatctgagtgattatcccttatgtgatactccaaaatagatataataattgaatcccgactagcacaagtattcggttgataacccttacggggaataataaatagtccagtcttcgagcatagaaaataatctcagaacaaaatccaacttgaaggtatgatccttgtgtttgagttgataagcccctgagcatataacttatccttctattgtagtcacatttgtccattgatagtaactgacgcagtcggcatggagacgaaatgaccaacatgaagatgatatcacccatcaaagcagtcggcggcggcggaggcaggccggcaataaagacgtagacgcgcatcaacagcgatgatgaaatccactaatcatgaggatgaagaaaatagtcggcgacagcaaacgcaaccgacatgatgaagatgacgatgtcaatgatccagtcaatagtagtattgcggccgatgataatgacgaagacactcatcagtgtttgcatagtaggtcaaccatgacggtgaaataacaagctggcaatgacgaaagcaactggaggcgaagacgtagtcactcattagcaacggcagagatgtcagggccgatgaagtagaggtgctggtgatgatgtcagtgacaataatccatcaaactgttgagaagatatcaaagcttgagtagtttccttgatgcgagtgtgtgcataaagaagattgatgcaacgctccttgatttatgaagatggcagtagaacttggtattatagctgttgcagatgcttcatttggaggaaaataaatgatgttgtccaactcgttgaatctgagttaattggttgataactccaaactcccgaacatgtagattaaatcttgaacttgatacttgagaattttggagtagattgtggcggcgtggagaagccaaaattgccggtgtaataattagagtcgctgaaattaaatgttggctctaaagcgaagacgaagataataactcctagagttgactcgttgattgattgattgcttcatcttgccataaagcttgtcgaattttgagagtcttgtatttgtgtagccctcgactctttggttagttgggaaacaactgaacatagagtcgagatctgtagcttcttgtcgtcgagtactcattgcttgagtaaagatgcatgttgaagatgtccgggtagaaatattgaagattgtaacacctcttgttgtaataaaataacacggcatcatatttggtgacgcatgccgagatgtcgaagctcttgtagacgtcgtggttggtgaagtagcaaaacttgcgaagcagcggcaatagagtttgtcggtgccgaagataatgaagatgaagtcgctccaccatgatgacaaagttgcatagccgtgatgaagtgaatacaagtcggtggcaacataaacaaaccggtagcgaaaacgcgtagttgtgaagataaaaacaccagtcggcggtggcataaccagtcggcgatggaagaagtagaatgatgacgaaaacgaagacgtccatcagtagtggtagtagtataaaccagccatagaggtgagggcactagtcaacagcagacgagatgaccggcggtgaagacgataaggccaatcaacactggcagactcatgcagccatggaagtgaagaaaccagtcagcagcagacgtagatagcttgtgttgaaggtggtgacgcctatttgcagtggcggcgtcgtggccagccatgaagacaaaagcaccagttggcgtcatacgaggcagccggtcggtgaagatgtagacgcccagcaacggcgacctaataggccaaccatgcaggcgaggacaccagtcggtagcgacgaaggcgagccggtcggtgaagacgtagacgcccagcaacggcgacataataggccagccgtgcaggtgaggacaccagttggcggcgacgaaggcgagccggtcggtgaagacgtggacgcccaacaacggtgtcacaataagccagccgtgtaggcggaaacaccagtgggcggcagacgaggtggccagtcggtgaagacgtagacgcccaacaacggcggcataataggccagtcgtgcaggcgaggacaccagtcggcaacgacgaaggcaagccggtcggtgaagacgtagacgcccagcaacggcggcataataggctagtcgtgcagacgaggacaccagtcggcggcgacgaaggcaagccggtcggtgaagatgtggacgcccatcaacggcgacataataggccagccgtgcagacggaaacaccagtcagcggcggacgaggcggccagtcggtgaagacgtagacgcccaacaacagcggcataataggccagccgtgcaggcggaaacaccagtcagcggtggacgcggcggctggtcggtgaagacgtagacgcctaacaacggcggcgtaataggccaaccgtgtaggcgaagacaccagttggcggcacaagaggcgccgatggtgatgttctgactgatccattcctgaagcgtaagagataagattaaagccatgaatcgctatcatgcatatctggatctagatcctgcagaacaaacatataggatgagtagtatctgatgtaaatacagtacttaagaaaaattcaagtattttaaaatatttgtaaatatgtatttctcctcttgtcaattttgatttccccgagcagatgactccatacgtttaaacactatgtccgactagtcatagcccccaagcatcgggagtcggcctaggcacttcccaaacatgcatatgagtgacatgagttcgtcattaatggaacaaagtttcacgaatcagaatttactactcgggtacttttgcaattgtaaagagcagaaaataaatttatcttatctctatgcttttgatttattctgaataatacttagcaccttgcgttactcggtccatccaacgagccctcgggtgctaggaatcggcccaaaggcaactatccatcaacaaaccaaatggaaagcataggaagatgaaactctataacccgataggcacttttgtactcagattatgtcgcgagcaatcaagataaatgttatgaaaattgttaaaaaatatgatataacatctgtagcccccgactcactagtcaacggcgaaccagttgatatagtgaggcagaggaaaagaaaaatatcatataaagaaaaataatgatgacttagctttgtaatattcccttggtgatggcagaagtagctgatgtgggaacaaagccgtccatcaatggcaatgaaaacaccggtcggcggcgttgactgcagccagtagtgaagacatggttgccatcagcaacggcggcgtagtacaccaaccgtgaaggcgaggacaccagtcggcggcggccaagtccagctggtcggtgaagacgtggacgcccaagaacggtggtgtgaccaaccaaccgtataggcgaggacaccagtcggcggtgacggaggcaggccggtggtgaagtcgtagacgcccaacaacggcggcataataggccagccgtgcaggcgaaaacaccagtcggcggtggcgaaggctagccgatcggtgaagacgtggacgcccatgaacggtggtgtgaccaaccaaccgtataggcgaggacaccagtcggcggcgacggaggcaagccggcggtgaagtcgtagacgcccaacaacggcggcataataggccagccgtgcaggcgaaaacaccagtcggcggcggcgaaggccagccggtcagtgatgacgtggacgcccatgaacggtggtgtgaccaaccaaacgtataggcaaggacaccagtcggcggcgatggaggcaggccggcggtgaagtcgttgttgctatcagcaatggcggtggtgaggacaagccggcggagtagactcacggccgatcgaccgaaaagctgagacgcctcgagtccatgaccagcattgatcgcctcaatagtgccgcgtaattatatgcgaacaacaacaaaaaaaaaatagcaagagattaatttgagattagaaatcaatctaaatatggaaaattacgaaacggtcaagagatgtgcactcaggccaatgttcggcacgaatcccggcgagaacaatcaacaggtgacatgcaaaaggcaacgtgcacgcgtgtgctttctcactcggcatgcagcatggccaaatctcctgtgtactgagttgcaggtagcagcaagccagtgaccgatccaggcctatgagcttcagcatgtcacgtggtcgctgagtggttcccggtgtaggcgtggatccgaactcgcaccgtgtgggctcggatttgcactgggaggaggctgatattgttgctcggcaacatcgacgacacggaaaaattgattccatcacacttttcgacgggaaactcgacgcacccctacctggcgcgccaactgtcgaaacaaattttaggcaatatgaaaagggggtagcgcacgagacctaaaagtggatgaatgcggagacaaggatttagacaggttcaggccctctcaatgagaggtaataccctactcctgtttggggatttgaatccgccgagtgaattatagatctgacgatctagttgtctcatgccccctagagggcctcctgcccactttatataggatggggggcaggattacaagatagaaaccttaaccaatatggtatcggtttcctaaatctactttacaatcttatcaaaccagaactttaggccgctccataatatacaggaaaacataatacccaagtcatgatccgttacatattccatagatataagttatcccctataactagtcggataatcatgccgtgtgggtatgtggtacgcataatctccacattaagatacaatttttaactcaattttcattaacatgctttttaaatgaattgccaaatggtacatttcatgataaaactttctatatagaacttgttttaaaatattagataaatcaatttttcaagtttaaaaaaattaaaacttaactaatcatttattaatggctttcttgttttgcgtgcccgtacataatcttcatctatcgctttctcgaattgggggccaaagtcctacaaaatttacaaattgtcaaaacttttgaaaggttacatattagaataaaagcatcaacttaaagacacaggaaagaaataattttttttcctccacttatattgaatagtctattcgataagaatcttgaaaaaattgttgtagagattatggataccccatatctatatggcggttatattccagctaggtacagggtaccgaataaagatagaatatcttcatgagggctcgggttagattctaaacttgtatgtcaaggaaatacccgggatcctagtcggttacgattgtattttatctgtaattccatgttcctttgggatatggactgtattttgtaaagcggaccccttcccctatataaggaggggtccggatgcctctcggggcgcggttttttcctagatcatacaatcaataatacactcggcggaatcatcccaggacaggagtagggtattacttcttgaataagaaggcctgaacctgtataaaattctttgtctccaaacccatccactttcctagcttgatagccacccccttttagtattgccgaaaccttgtttcgacagttggcgcgccaagaaggggcagcgtcaagtttttgccgactaagtgcgatgggttccgtctccagcatcgacgacttcgccttccccccgggcaggcgttccggttcggcagcctcaacttcatcaccaataacttcggcaagctctctctccttgactcggattcgaaccagtcagggagaaaccaggtcctctcgccgttcggtattccgaactcggccgatgtctactccaagatcgtctctcccgagttagtttcaaaccactcggacgagatccaatctacccctcagcgaccagatcaagatgacgggtcctatccttcaatcctgatgagacttcctgatgatttggccactgtcttcacagccaaggcatcccccgttcgaagatctagacgagcttcggcttcggccccaatccaatctagatccagggaggttggcgttatactccaatctcttgggacagtctcaacggaagagttggatggctacctcagctcccctgacgtcagttctcgaccaaccgagatcctcgactacggcgacttcgacaacttcgacgacagctatgaggataattacacgcctctcttctgcggcgtattcatggctgacaacgaaacggaggaacaacgccgagcccgagaagcggacgaagagcgcacacgacaagaaactgaacgtcgtcgactggaggaagaacgacagcgacaagagcgagaacgactacagcgtgagcaataagatcgcaagcgagttgcaaaggaggctgaagatcgacggcagcgcgccttggaatccgggcgacgagcgagagagctgatcgggcaacaagacgtcgatggaacagtggttttttgcacccccccagcagaacgcggttgcagcaatcactctcctcgacaccctcctcaaggaagaagcactcaatcaagctgatcatgttgtcaacatcttgaaccagacgaagaccatgatcgctgcctcgcttccagccaactccgcaagcacccgcaccccgactggtagccgagtccctcaccttcgatctcaggactatcaccagccaagcctcagcattgccggcgccggatctagtcgcaggagcaggggacatgatgaacgatctgttcgttcgcctcccgaatgatatagggagcgtcgagttgaacgtccacactccccacatcgaaggcgccccgtcgatcttcgtgacaccatcaaccagctccgcgcagcaagaggcaatcattcaccggatcgctacgatgacgatatggacggagttgctgccttcacaagtgaactgcgtcgagtagattggccagccgactttaagccgactggaatcgagaaatatgatggcaccaccaaccccgagtcttggctcaccgtctatggtctcgcagtccgcgcagtaggaggagacagcaaagccatggcgaattatctacctgtggccctagcagattctgcccggtcatggcttcacgggctaccccgcggcacgattggatcatgggcagagctacgcgaccacttcatcgccaacttccaaggcacttttgaacggcctggtacacacttcgatctctacaacattgttcagaagtctggagaatcccttcgagattacatccgacgcttctctaagcaacgcaacaagatctccgacatcaccgacgacgtcatcattgccgcctttactaaaggcattcgccacgaggacctagtcggaaagttcggacgcaaacctcccaagacggtcaagcagatgtttgaaaaagccaatgagtatgccaaagccgaagatgctattacggcgtccaagcagtcgggcaccacttggaagccaaagaaggatacgccgaccgcaggagggagtggaagtaacaaccacagtaacaaccacaaggatcgcaagcgtaagcccgaagaacttgtggcaataacctctccatcttcccgacaacgttcccgcgtcaacaccttcaacaagataatgaactcccaatgtctgcatcatcccaactccaaccacgtggccaaagattgcttcgtctacaaacaatttgcggagcaatatgtcaagaacgcacgtaagccctcagacggagatcaaggcacatcaaacaagaaagatgacgaagacgatgccccgactggttttcaagatcatcgcaaagaactcaatcacatcttcggcggacccctgtcttatgaatctaagagaaagcagaagctaacagaacgggagatcaatgcggttcagcctaacacgccccaagaccttcggtggtcagagatagcaattaagttcgaccgctcggatcatcccgaccgagtggtccacccggggcggtaccccctggtactagacccagtggttcgcaatgtcaagctccgacgaactctcatcgatgtggcagtgcactcaacatccttttcgctaagaccctggacgatatgcagattcctcggacggaattaaagccgagtacgcaccattccacggtgttatcccaggattatcagctacaccactcggccagatcactcttccggttacctttggcactcgggaaaattttcgtacagaaaacgtttgtctcgaagttgccgatttcgagacagcataccatgctatacttggacgaccagctctagccaaattcatggccgtcccacactacacctacatgatgatgaagatgcctggtcctcgaggagttatatcactacggagcgacatcaagcaggccgtcacaagtgacaaagaaagttgcgagatggcccaaacccacgagatcactctcgctcgcgaagagatctgactggctgcgaccacggcaagcgaaggagaagtgcctgcgaccaagctgtcaaagaccgaagaaggcgacgacaaaactaagaagattccactagatccctccgatcctaccaaaactgctgtaataggcgctgagttagattgtaaataggaaagcgcgctcatcacctttcttcagaataataaagatatttttgcatggaaaccatccgatatgcctggtattcctagagaggtgattgagcactctttacatgtcaaggaagacaccaaacccatcaaacaacgactccgccgctttgcacaagatatgaaggatgcaatcaaagaagaattaaccaagctgttagcagcaggcttcatcaaagaagtcctccatcccgactggctggctaacccagtcctggttcggaagaagaccgggcaatggcgcatgtgtgtcgattacaccgacctcaacaagtcttgccctaaagatcctttcgggttacctcgcattgaccaggtgattgactcaacggccggctgcgagctactcagtttcttggactgctattctggatatcatcagatccgactaaaagaatccgactgcttgaagacctcgtttattacgccctttggggcctactgctacatcaccatgccctttggattgaagaacgcgggagcaacctatcaacgcatgattcaaagatgtttttcaactcagatcggccgcaatgttgaggcttatgttgatgatgtggtcatcaagaccaagcagaaggatgacctgattgcggatttagaagaaacctttgcaagcattcgtgctttcaggatgaaattaaaccctgaaaagtgcatcttcagagtaccgtcaggcaagctgctcagatttatggtatctcaaagaggcatacaggccaacccggagaaaatcaacgccatcctcaacatgaaaccgccgagctcctagaaagatgtccaaaagctgactggttgcatggcggcgctcagccggttcgtttcgtgactcggcgaatgggggatgccctttttcaagttgctgaagaaaactgacaatttccagtggggacccgaagcagaaaaagcctttccagacttcaagaaacttctcactactccaccagttttggcctcgccacgtccgcaagagccgctattattatatgtgtcggggacctcccaggttgtgagcatggtcctagttgtcgagcgtgaagaggaaggccatattcaaaaagttcaacgaccaatttatttcgttagcgatgttttggccaactccaagacaagatatcctcaggttcaaaagttattatatggtgtgttaattacagtcaggaaattatctcactattttcaaagtcactcggtcacggtggtcacgtcgtttccactcggggatatacttcataaccgcgaagcaaacggacggattgcgaagtgggccttagaattgatgcctttggacatatctttcaagccacgaactttgatcaagtcacaagctttagctgattacctcaccgagtggaccgagtaccaagaagacatgccagaggagaagatggaatattggactatgcattttgatgggtcaaagaggcttacgggtgctggagctggggttgtcctaatttccccgactggagaaagattgagctacgtattgtggatacatttttctgcgtcccataacatggcggaatacgaggcgctgctccatggattaaggattgccatctctttaggcattcgccggctaatcgtccgaggagattctcagttggttgttaatcaagtcatgaaagaatggtcctgtcaagatgataatatgaccgcttatcgacaagaggtacgcaagttggaagataaattcgatggacttgagctcacccatgtccttcgacacaataatgaggcagcagatagattggccaattttggttcaaaacgggaagcaatcccttctgatgtgttcgttgagcatctttatgaaccaaccgtgcctagaaaagaaaaaattgaagccatgaatactcaaggcgtaagcatgattgaagccgactggagagaacctctcataagatttttaaccaaacaagaactccctcaagacaaaaatgaagccgagcagatttccaggcgcagcagactctatgtcattcacaagaccgagttgtacaagaaaagtccatcaggaatcctgcaacgctgcgtatctttggaagagggaagacaattgcaaaaagacattcattcaggcatctgtggtaaccacgctgctgcacgaaccattgttggcaaggcttatcggcagggttttttctggcccaaagctgtttccgacgccgacaaaattgtgcgaacatgtgagggttgtcaattctttgcccgacaaactcacttgccagctcaggagttgcaaaccatcccgttgtcttggccgttcgcggtttgggggcttgatatggtcggtccattcaaaaaggcagtcgggggttatactcatctctttgtagctgtggaaaaagttttccaagtggattgaagccaaaccggtcgtcacaatcaccgcaaacaaagctagagatttcttcatcaatattgtacatcggtttggagtaccgaatcgtatcattactgataacggcactcaatttacaggcggaatatttaaagatttttgtgaagactttggcattaaaatttgttacgcctctgtgtcacaccccatgagtaacggacaagtcaagcgcgccaatggcatggtacttcaagggatcaaagcacgagttttcgaccgactgcatccctatactggcaagtgggtagaacagctgccgtctgtactttggtctttacgcaccacccccagtcgggctactggccagtcgccgttcttcttggtttatggcgcagaagctatgctgccaagtgaggtagagtttgaatccctccgattttgtaacttccgggaggagcgatatgaagaagatcgagtggatgatatcaaccgactggaagaagcccgtgaagcagtcctaatccagtcggctcggtatttacaagggttacgccattatcataatcgaaatgttcgatcgcgagcctttttagtcggcgacctggttctgaggagaattcaaactacacaggatcggcataagttatctcccttatgggaaggaccgttcataatcgctgaagtcactcggccaggttcttaccgactcaagcgtgaagatggtactcttgtcaacaattcttggaatattgaacaccttcgtcgattttatgcttaggcatttcatttgtatttttcctcttcgactgctaacttcaagtttttccttgaagttttcagtcggggggctactataataataatggaacatgatttttatcaattcaatttgctaacttgatttatcattgccctgcttgattttttggcttagacaatgaggactgaaagtttttaataacttttgcgagttttaggctcaataagtttgacaaaagcttttaagaaatcagaggctaagtttgaaatatctagcacagcataaattcatcagtattgtacaaattgatcttccatcatcatcagaatcactgctactaatcagtgtcggttttttcattgtcagaattatcagacccagtcggccgaaggtcgacatcctggaatctctcaactacgtcagcaacaatcttgtcagcggctttttgcgcatcattgatgaggttgagggctgtttcttcgcttgtcccgtctgcaaacccatcaacagcgtcaatatcgattttggggtataaagatttggtcatagctaatgccatgcttgctcccatacttccagcctccctgatattcttgaagtaagtatccggagcgactctcagcttgtcgaagatctcggaagcgtcaagtgtactcgaaccggcgttattgaagaacatggcttggatgagtggggcagcggcattagcgactttgtccctggccccttcaagcctattgatcttgttgactaagatatcaaactgtgcctgggacttgattttgcgatctgcacgaataaattcatatcaacaagtggctataagaacatggggaatcagttatcattaccttcaacatcttttaaggctaagtccctctgctttgcaagttctgccttgtccttctccagggcttcgacctgcttctctaggtcggaaatcctggaggcttgcattgtaatgctttttggttaatcgatatgacaaggaaggttttacgaatacgtcagacggatatggtatttacctttggatgaaccactcaattcatagttggattcttgaagctcggagattctattcctcagatcatgctcagttttcctcgcaagttctctgacttcatgtaactggcttctggtggcttcaagagttccaagatggggaactaatttctcaagagttgtggtctttgcctcattcctgaggtggattctctgcgataagaatttactagcgtttcagcaaaatatgaaaggggataattaaagctatgcataaatggacttacattcacaatgcgagtggcctggatgagtgcctttttcagcaagcatacttcctcatcttctttttgtttgtttattacgattccttgaggttgcctatcatcgtcccaccacttgactaggatgggagggcgtgagtcctcagttgcttgtatacggggaatttcttcttcatcaccaatcattggtcctaatgtatccactgacaaaggttagacaattgatcagagtcatttggatcaacatggtttcaggcaaggtgtttacctgtgatgatttccggacggggatgagtcgactcttgcgtcttaactggggaccctggcatcgggtcgttactggcgtcttgtctacgagggctgtctgcccgagctccaacttctggaatctcttggcttggcctagtgtccgactggttttcagtcgggggctcctgattaattccagctccagctttggccgactcatttccggtcgggggttgatcaccagatcctacattatcggttgctggctggttgtcactcggctgatcctcggcaattggctcggtttcttttaagttcgtttccctgctggtcgggtcagagtcttttccagaaggatctatatcagatggtttcctgcaagtttgattatcagtattatttccgcactaggtgcgcatcaatcaaagggagatcgttatatgatttgtacctagaagacttcctgatctttggcacaggacgactggatgttttcttccttggagtagcctgcttcggcagtttcttggttgcctctcggtctccaggctttctagcagtatcgctttcgtcgtcacttgacaccaacttccttttgcatgaatctggctgaccggctggattggaggtatttggccgggcttcagaatggatcttgggacccccgctcccttgaccggtttggcggtggggtgatcggcgttgaacgactgggggatccgacttcatcaaagcaaattcctgggcgtaatatccttcattgttaattgattcaacaaaaagacaaggttatattttgtgaaaagttgaaatgtttgattacataccggtggaggaggattgaaagcattgaatggcacgactggcagcaagtgcgaatagctgacgacggtagcattcgagaagatcttgtacatcctctccttcataaccttaaagttaagagagtctggatcttcacgatttggatcatgtttgctgtcaaactcaaaagctgtgcgggacctctctttgattggagctaaccggctttttatgaagtgccgagtgatctgttctccttgcaaaccttgctctttcagctttatcatgcgctccatcagttccactgcttgggctgcctcatctcctgtaggcaatgaattccatgtatcttggtagactggagggagacaagagtactcgggaagggctggttcaggattttgaacatagaaccagttagcgtgccagcctttgtttgaggtcttgaagggcatggagaaatatttttggcttagtgttcccctgagttggaaaccagcgcccccgacaacgcacggtttgctcttgttggctggggtttaaggaagaagatgcggcggaacaaggcgaaatgaggcctaatgcctagaaaagcttcgcagacgtgaataaaattggcaatgtgcactatggagtttggattcagatgatgcaagctcattccatagaagttcagaattccccggaaaaatcttgaagtgggaagagaaaacccgccatagaaaaagtgagaaaataccacgacctcgtgtgtatcgggggttgggaatgcctcgccaaatgccggccgccacccgatgatctccttcgtaggaagaacgccgtgcgccaccatctctttcagattttcctcaatcaaatcagaaggcgcccactggctctcgaaactttctccctcctccgccatggatgcgagctaaatggtttgatttgaactgagatatagctcgaggggaatggggaatcggagcggtggatgcgtggagaagtttcgtgggattttgggaatggattgaagcggattgatgaaccctagcttcatcggcgcagttctgtactgtagcaaggagtggggaaatggtgaaagtctcggcggggaagacgaagtgacgcttggacttcggtgtttttagggtatcgggagtactaatgggcctgggcctatacagtacttcaacccaatattacaatcagcgtggcccgttgtgatccctagggatttaggcacgttttgctttggcaatttgtgctcacaatgatgtggcccgatgctattaaaatcctttttaacgcggttcaataattctttggaattattatgatgcaaataaaaaggtgcccggcagaaaggtgttatgctatttttgtaagctttattaggctgcaaaagctgtttgggtagatttgagatgactagtttgctaatagtcattctcttagcattttatatgcttattttggttgtggtgagggtcatagcttaggctattagactcattgattaccatgactttttatcatatttggtggagtgtctttggagtttttactcggattcctgtcaaataagtctatttgagggccttttgagcgtttatcacacgggtcttctcattttttttctcgatatattaaagctaagaagtagtcggctgggtattttactgacttctacgagtgttttgctgtataatgtttggttgtaaaaccactcagttcttgactttatgtttagtttttttaactaaccacatagtcggggggctacacctaattaggtgcatctactcgatgcaccatgctttattttcgcccttcacagtctttggttccagtactcggcaggctaaagcaggaagagttgaagcactcggattattgttttttgttctgagatggctatttcgtcgactgcgaaggtctcgagggctactgtagagattatggataccccatatctacatggcggttatattccagctgggtacagggtaccgaataaagatagaatatcttcatgagggctcgggttagattctaaacttgtatgtcaaggaaatacccgggatcctagtcggttacgattgtattttatctgtaattccatgttcctttgggatatggactgtattttgtaaagcggaccccttcccctacataaggaggggtccggatgcctctcggggcgcggttttttcctagatcatacaatcaataatacactcggcggaatcatccccggataggagtagggtattacttcttgaataagaaggcctgaacctgtataaaattctttgtctccaaacccatccactttcctagcttgatagccacccccttttagtattgccgaaaccttgtttcgacaattgtgtgctcgaattatttatttcaaatgattttggagattttttcctatacaaatcagatgctctaacttttttttgttccatagaggctattccaaatttatgtcagttcaaagttactcaaagaacagtatttttcaagacataacggaataataagttatgttaattaaatagtattatgctggtatataacatcaattactccatcccatccattctaaaatatagttatttcgagcgtttaaaaaaaatactctaaattaagtaatacttcctctacctaatcactagtcatttaatttttcttagtcttactataaccatctcccactctgcaaccatcccagaggcactcgatggttcatatcctctatcataatgacacgacactgacttgtgaggcaataaagttgcgtttggttaaagggttgggatgggtcgggttgggttgaacccatttttttaagtgtatttggtttggggacatgtgggataggatggtcaggaatattcccctaagatccgggttgacatggtcactcaaaaactgacatggtccctcaaaaactgacagaccattccaacccatttttttctcacgctgacatgtggcccattccttcaaaagtaggattattatatcccttatgccaaacaaatagatgtgatcatcccatcctaaaaacagggatgagtccaactcaatcacatcttgtctccaaaccaaacacatgctaagagagtgggactcacatactaatgattataataatagtgatattatggtagatgatgttcactcgacactcgcgtatatacctaaggtcaggaggacaacttatatcccttgtcccgtgagttgatcatgtgtcgtaaacagaaggataaccagatcaagtggtaaaatatgaccatttgataataggtagtgacaggagcagaggggattaaagaactaaacatatactatgttactgttagggcatttcgtcatggggcaatgccggatgtgggcacctttactctttattatatttttgccccagttttcgaaagaatcctcaaatcacagaaaattacaaataaaggctatcttttgtgaaatctgtttaatttcttctctttcatttaaaagcgtcacaaactggaaagggaaagagtatgattagaatatggtctcactgcacaaagtgataagatcaggattcctcttcatctgtctccatcctctatgaaaaagagtagatcaagattatcttcacgcaaacgattgaataaaccagagccatgcaaaaagaaaatactaatatatttttaaagataatccaattgacgagaggactcgtgctactcgtaaaatatttgtgaatataaatatcaattttagtagctagagtgtatttaggttcaaatggggaccgctactgatgattttcctttgtcttgaactatcgtcaactccaacccttcgcaaattaatgtcacaggtatatattgattatatatcttggtgacagtgacaaacattaaaacattggggcaaatgtattcttgcccctactttcatttgcaattatgattttacccttactttttaaactttatgattttgccctcactttttgacgttgaatggtctgtttgcccctggtttaaacgtctgttaggtggactcagattaaatgagtttaagaaaataagaaattgacttgcaaaatgtaaaaagacatctctatcccaaacctttcaacctaagccactgctgactcctccgtccccgattcctaaccctcgcgagcggtggcggcacacgcgggcaagcgagagcgaggagcgcgcggtcgtcgcggaggagctcggggtgaagcaggctgggccggcgccaaatggcgatgtcaagctgagctagcccgtcgccgtccgccgtggtggtcactgggctcgtcggcatcggcctcggctatagtacccgaaccgctgcacagcagatgatcgagtacatacgtactgctgcatatgcgtagctagctaggctgtcttgccaccattagcatggccgcgaggagctcgcctgaggcatgatggtgacaaggaggagaagaacagcaaggagaggaggagaggaacatttgagttttattgtcttttactttttcttctttgtcactccccctttagtttttatttttcttactgccttgaactattggttggttcctaaactggacaggaccaacaaagctattctgttgttgaaagctattctgttgttgaaagaaagagatgagagtagtgtttcttgtttgcatattcataaatcccttgactgttaaaatgattaaacatgcagggcaagttcatacgtcaggcattgaggcattgaattcatacctcagtccatagtgtttcttaattaataaatcccttgattttttttaaacatatgctggagaatcgcatttcttgtgtagttacaagttggatttcgttgttaaaataattaagcatgcagggcaagttcatacctccgttttctactgtaatcgtgaaacacggccaaaacacaaagtcctcacaagccaaatctgcaagggcatagatgtccttttacctgtcagttaacaccattaaggctctgttcgtttcctggagttcccaactcccccatctcattttccgcgcgcacgcttttcaaactgctaaacggtgtgttttttgcaaaaagtttatatacgaaagttgcttaaaaaaattatattgatccatttttgaaaaaaaaaattagcaaataattaattaatcacgtgctaatggactgcttcgttttccgtaccggagggatgggttcccaactcaaccaaaagaacagagcctaagtcctcctgacggaacaggggcatacctgagcttcagttcaaaatagtgagggtaaaatcacaaagttaaaaatacaagggtaaaatcacaattgcagttgtaaatagggacaagaacacaattatccctaaaacacaagtacttctaaaatattctcttacaggacgagagatttggtgccgaaataataaatagataagaaatatttctctctttttttttggcaagaatcgagctgtctcgtgtaaaacctgtaaaattcatgtgctttgggatgcaaaggtgtccaaaggggaagtgtgggctatacagatgctcgggcctatatgtgaacagtatgtactatagaggatctcgattggtccaaacaaattttaccaccacaacatatttttagtactctctccgatcataaacattcaacgtttaaaacaagatgttgtcaaacttttacaattcaatggattgaacagtaaaagtttaacatcctaaattactctcccatttagaaatgcttatattttggcatggagctagttgatgtttgttacgggagggaatactccctccatcccaaaatataataacttttagccttttgaatttatcccaaaatataacaatttttctaccaatattcgcttctcaaccaatcacaatcttccacaatttaattctatgtgctttcctaataactgtgtctaactctaaaactccttagaacaggcacaatagtaggctataagccagctataaacatatatcgatatgataaaagaggagagataatagcaacggactacagatttgtagccagctgcagcacggactccaagacacaatgtgtatatgacatgtgggaccatatattaattgtgcagtatatatttataggtatatgaattgtctattaaattgactataaatgatttggagctattaattggctatattgttaaacttgttcttatattctgggacagatgaagtattaactaagcaagttcatggacttattagtgggatcccttttacttctgtgacatgatgcacacaaccgctgtgtgcttacggttagttctctctgttaataaaagtatatttcagtgtcctgaacctaattgcatatcccaagaatgtttcacaaagccatgcatgccattggcttagatagagatatgcaagccttttgagggaagaatgcacaggtagtacaggagatgaccctctgcaaaaccattcactggcagaagtgcagaacaaaagagtggtcaaaaaagctggccagcttccttcttttggttcatcagattctggtcaagtgctgcatgattggcaacttaagagtgcgtggaagtttgttaaagatttcgttccggctggttttggtgtatctctgttatttgtaaaacttaaattcacacaattttggatattctgaaactatattatggtgtctgtttatctgcatttggtccagtttttctttattgaaaaagaacacattcataacttcacatgaatcgaatgcctgtactgcaagaggaataaacacacatttacgagatggggtcaaatgcgctcatcaggggaatctcatgcacaacccagcatccactttatagcaaaaaaacatgctctcaccaaaaaggacctgatcccattggcaagaaaaaaaaagtactttccactactacaattttttcaggagcagagaaaacaagtgcaatcatccaatgctgaatgcccacacacactgcaacagatttctgcaaaaagtgatgctgttaaaaggaaggcttcattcattcatttttatttcttttttacaggaataggcttcattcattcatgtagagagaggagaaagagaggaggaaaaaaaaggaaaatggcaacagattctactactggtttctggtatgaccaaatagcagcagtacgaattcaaagaatataatagtattttgtttgaaaagggagagatttgttgggccccatcatggcatcatccatccatgacatttggtcatctatctatctatccctaacagcagcaagatagttttcagttcatctagcattttcagtggaagatccactactagtagtaaagagttaaaagaaaagtaggagtttaccaaaaaggttttcaactcaagtggagccttttttagtgcagccaaccaactgaacagaagctgatacactgttactgaacttcagattggaaagaaaaaaaaatgatgtttttgggaattcagagaagtgctcactctcttgtattggcattgttgcatcaaaatccatataatagctcatcatatcagctacaacaagatgaaacaacagctacaagaaagaaccgaagatgattgtactacctccgttttaggttataagactttctagcattacccacattcatacagatgttaatgaatctaggcacacatatatgtctagattcattaacatatatatgaatgtaggcaaatgttagaaagtcttataatatgaaacatcgggagtagttgtgagggggcgttaattgctcatatgtagatttatagattatagctagatatacaagcaagcaagagctcgatctttaagctaagctagccgaaattggaattggaattggagaattggaggtggttaattgagaaaatgagaatggttcttgttcagtcgaggtgggtggacctgacacgcttgtggccggcgtggcggacggcggtgccgacggaggcgccctcggaggcggcggggccgggggaggaggcggcgaagagggaggagaggtcggcgtagaggtcgacgacgcggcggatgttgttgttgagctcgcggatgaggccgacgttgcgggagaggtcgccggggaccttggactcgtggttctggttgatctcgttgatcagcacccggttctggtccagcaagctctgcacctgcacgaagctcgtctggaacgcgtgcagcaccttcccgtcctccgccgccgccgccgacagcgtgtcgccgtccatcgcctctttgcttctgcttctgcttgttcttgctctctgcttgttcttcttttgcctctctgcaattctgcaccccaaatggaaggaaatggtgaagagtgagacgacaagaacagaagctcgatgggcgatgaattgacgagttcttgagacaaaagaaaatactagtacattctttatctattcgattcaccgctgaaaatggtgagacgacagaacagatgcctgatgagttcttgacgcaaaagaaataattaattgttttttctttatctgttcggtacagcactgaagattttgcagttctttccatgaatgaaaagcaagatttttcagtttttatcgcgaaatctttgcaaattggagcagctgtagcgaggaaatgtaagattcactgtttggggggcatatgggacgacaaaagcactgttcaacaagatcagatgtacttgacgaatctttatttgcttggacccaataaaaacatgattaaaaccttggaacttttttccccatatgtaatctcgaaattaacgcaatggttggggataatatatatatatatatatatatatatatatatatatatatatatatatatatatatatatatatatatatatatatatatacacaagaaatcatgtaagtctaaattccaagaaacacaaagcgcgtcaaatttggaggggaaagaatcaaagaactcaagaagaaagaaacagtggtcgtgcgggaagggatgatgagttcggggaatagctgagatccattgaattcttcgcgagcaaccggagacgaaagattcccagcaaaaaatagaacgaaatcaagaacaagaacccaaaaaaacaaaatccgttactccgatgcgaatgagattggttttcgaccaaaattcgctcgaatcagtagaacaaaaggggaggggaggcgaccgaaccgagaaagaaattcaggcgagaatcgcaccgggggggggggggacacaagaaatccatgtgaaaactgtctcaacaggtcaaccttaggcacggccagagcacaagatacaagaacttggaggcgaattttggcccgccaagatcctaataatccgcacaagaaacgaaaagaacaactcgtcgctcgcaagaacacagcagcagcaagaacatatttcactacttctcccaacataattcccggactagagagagaaagcgaggaagggcgagcttgactcacctcaaggacgccgtagcatctgcgctcctgatgagatcatgcgaccacgagagagaagagaagtggaatgaagaagaagatgagattccacaggggaataggaggaaaaggaggatggatggggatggagagagagagagggagggaggagatcaggagatcctcagacacacgaaactactcaggctagcagcactagcagtgacccatcatcttctcctcctcatatatacggaggggaatagtatacttttctttctgtatttctctctgtagctttaaaagctctccttatttttcttttcttttcttatagatttagatttatagatggagggtattagtagtaggagtagaatcttttgctagagagagagagattgagatttgtggcatgttcggacacgtttctcctcctcgatctccttctgtatctccattctctctcctcgcatcgtctcactgtctgtgtgcttgcttgctgctgcagctgggttatcctttcctgcccggcacggtgcatttccgtctaccggtggtaaagtaattactcatgtacagtggtcatgtttctgaaaaaaaaaattctttttattggtgtactccctctatccaataaaaaaccaacgatttagttcttttcgcgcagggagtatatttgttcatgcggtacaaaccaacatcatctttactcgatttcggctagtcggcaaaacatagtgggacacacttatcaaatataaaccttgttaaaatgttcttatcattgttcgtaaagaagttagtagattgccttcttaacaaatgcaagggtgtggttaacattatcaaatcgccatcacactgaagtaagggttgttaaaattcaacaatactaaaaatggtagaataataatgcaaacatactataaccttactaacttctatcggtaatttcagaaaattttacttataacatttttaaattttataagtaccaaatcaaataacacctcgaccatcttaacattatcaaatcgccatcacactaaagtttagcatcaccaacttttgatcagattgatttttgcaacaaaacaaacaaaccataaaagcaatttaaacctttctataatggaacaggttatagtgataacaataaagacaaatgaagataacaaatggtagccattattcgggatgaaagctgactaggggcctatttgggttagctaagactttgagaagcagctgattggtatgcagcttctggtttctagtgcattttctaaattctacaactatagcttcttaggagagcttctgattctggaagaagctgcagcagctagaaactccctaaacaagccctaggattctaaagggaatgggtttagagacttatacatggcagtgtaccataggggcaagttatcggtgcacgttgtacaatgggatatttaggcttatgcatggcagtgtaccataggggcaagttatcttgtgataccgagcgaaagaagaacacatggtttgtaactcataatagatttaattgttacatcacattccgtgcaacaaaataaaagccagctgggcaaggtatataatgtgatattgttgaggcgtggttttttttggaggaaaagagagcttcattacttgaacgaaacagaggcgtggtttttgagattcaacaactcttcaaatggtaaatgaaagacaatgctaatttcgcccccgttgattggatcagacaacaatatcagcgttcattctgaaggtatatccttgaaatttggataaccttaccagagatctggttacaaatccttaatttcacctctctccttttttggttgaaactgataataaatgatgagcaagtcatgtaaatcttactcatacagtgagttgtacctctttctacaagtgtacctacaacaaccaagctacaattaatatctcttcaatgttcaattactatgctggtgtggacgcatagtttggttccattgtggtgttctacttgtctcacattgtctagctttggacagttttagaagtgtatttgcatctcacatagacactcattaattcagtccaaagattggaactttggaagttataatactccctccgtccaaaatataagaaccaaagatgggatgagacattttctagtgctacaaatctagacatgctatctaatattcaatcaagtcctagattcttatatttttggacggagggaatagctttgtttgaaaaggcaatttaagccggattggtaaattaggcagcctgtacctaccttcacgtggtgtacttggacatgcgtttcttgatattctttcctgcgtacattagagacaatcaaaccaacaaatcttcccgatccagccatcgtattttgcctgaaattcagttctgatgagaatattctaccagagaacatagtcactagtcactagagtaataagtttattagagcagaagcaatgcaagctacacatttgaggaccctaaaaaataccacatacactaaagacacggtccaaattttggttccccataccgcaaatggcctcgtgagaaacttcaatttttcatttcagccctcatatttttctcaaattacaaagaaatccaaattttatagcaaacaccttaaaatggagaaaataatataaatctcaaccccacccaccaccactaggtccacaaccatctccacttcccccacccacccacctagacgagttcaccggtgataccgcagcctccggcctctccccactctccccacctcggcaatgaactctggcaccgccgccagcctcttccttctccccatcgcggcacctctccactcctggacgccgctcgagcccaacccacacggagatgcggcggtggtcgaggaggccgaggcggcggcagagccactaagcaaatcgacgacaaggaggttggcacaagcagggggacgacgggctcatcggctcataagcggagcacgacgttgagctcggcagcacgcaagcgggggacgatgatgagctccgtggcacgtgaccggtgcccctccactcctactctccttagagggcgaggacctcaacgacggtggcacagatttggagtggcgtgggagctcgaccgccattgtcgtcgcctctcccctctcatgagagttgaggacgagccatggcacggcgacagaccccggctctcctctcccctctctggacatcagctccagcatcgcaaatcgggcggcggcgcgatatctcaacatcgggctcctccacttcaccttctccagtgggtgacggtcctctcctcccttctctagttgaggtggcgaggtcgcagggtggcagggcagcggcgcacaagtcggttgcagcatcggttctttctcctgctccacttttgcctagcaccattcctttttccaactgaggagctcggttctttgtttggagccgagaaacatcacaaagccatggccctccaccttctctatcttctaccacaacacctatcctatgtggcacaacgaatccacgcgacacggtggcgcgtggaggcccttctgctacctccaattttattcattttatctgctcattaaaaaaaatcatgtacacaataatatagtatctctgatatacaaatcctaaaactatagaatattttttattagtttgctttcatacaaccccacttctttttgtgcatttcttagagcttatgtagagtgactcgttctttttctccccatttatcttctacatcttatcattcaatcctataagtaaactaggtgattctcagcgctttgctacgaaaattactaagtaacttttaatattttttaataatcgagctaaaagtaaaaattatgttaagagaaaaaaataaatttagtagactctgtatgagattgtagatgaaatatgatatcccacactttgattatatggataaatatatgttaagtattataaaaatgatggatatatatatatatatatatatatatatatatatatatatatatatatatatatatgttaaaaatattgtgaaaaataatatgaaggtagatgattggatgttgatttgtagaatttaatgaattatagatgatgttgcatgattacataagttttgtatataattattgctagtgtatgatgaggtgacatgtttgtatgtagagatttagaattagtgggttataactttatagtaagataggatggctcggctaacgttttattacattaaacattaaatttagacacaagttcattacagtactgtaccagaagtttgttatctaatcaccgacattagaaatttgtaataattgaccgatacgagtgctaaatgcgtattgatggttggacctgttcatttgagatgtgctttatataggagtatactaggtgaaaccccgcgcattgctgcgaaaatttaatatgataacaataaaataaataacgtgtaagatagctagataacatcagattaagtaaattaatgtggtttataataattcaaatttaaatagtatgtaggatggtgactcaaacgtaaaaagtaaggtggtatgactttatggaagaaaataagtagggaaatagtttggaccgtagattaatcatctaaaggctaaaaacaattgttgtgatatgacttgattagagaaaaaaaggagaaagataatttagaccatagattaatcatttaagcactaagtgatgatgaactatataagtatatagcgtattataaaacataataataaagatatacattgaaacattatgtgaattatgttggatgataatttaatatgtttgtatttgaaaagctcttaaattataaaaactataaatatatagcatgtttgcatgatgtttaaatgtgatgattgctaatggatgataatgtggcatcttgttaattagtggatgatgatgtggcatctttgcatgttaagtttaaggagttagcgggggataactttatagtataggatatgagtataagtcataactaattttaaattaacttaaaggtacaagtatacaactattgccttaaaaatgatatctctgttttttttttggttctggatatgcgtctttggaagctgtataagcttatgcgtaggaccaacaatgatatctctcgtgattcatgctttaactttcggctaaatgcatggttggatcttgtcattttcatttggtcctctacttgacccactgggacacagagcttccaataaacgccgaaacactttgctgaacatccttggttgtatggtcaaaatctcatggagatgtcccttgtgccaggtaggccatcacaaaatcagctgatgatcactcatcactcgctctccttaaataccactaggttgctgccaaatcaaggagcagaaatgctgcggctaccaagaacatttacacaagagaaacaggcgagtgctttgctgacaattgctgggcttcccactcacagtgataaatccatgaaagcattaaacctatcaacaaaatcaaccaactatatagtttataattaattgcaaaaaaaacaaagtttcctaagtaaatttctctagaaatatagatttgtcatacatgaatttttcacaatttggtccttttcaaaaccttattttacaaatagacccatgaaaaaaacttattccaaaaatggtcctttttggacgccaaagtcgcttgcaccgtggtccaataggatggcaccaacaactctggtgccatcctcctgccaccgtggcgggtcggtgctgacatggcagaggagcgcgccaatgaggctagcaccgccctcccaacccacgccctttttttcctctcctctgtagaggagagatgtcttaggagcacataagaaccaaccatagaaaagttaaactcaaatggatgtaatatgtgacctgtagaattttccaaagctctaccgaaaagcttctcgcctcgaaaacataatcttgcaagcggaatttggaggtctaatttcaccaaacccgatgaagcgggggacaatcagatgtaactttttatgtacatgtccatgggtatagaatttgcctaattccgagtccgtataagaaagttatgcatgttttaaggaaggacactcgagtgtaaaagaaaaaactcaacaaaccctatttttttataggatactattttttttggttttttttactataggaaaaacaacgaaaaacaggaagtctcctaccgatataatcttgagtgaatttgaggagaaggggagagagcaagaacaagcagtcgaactcggacttgggaggggggggcgccananatgctggcgcgctccccctaccatgtaagtttctgacctccacggtgatagaagggtggcgccagcaactctggcgtcaaaaaaggactatttatgggttaagtttttctaggggtctatttgtgaaatcagtttttaaaaagaatcaaattgtgaaaaatccagtttgccatactcattccgttctgaaaagacgtttcgtgtttttctcaaattaaatttcttcaagtttaactaaatttgtagaaaaatataatattatttcaaacccaaaaatatatatgctataaaaatatattcaatgatgaatttaatggaacttcatatagtagatattgttacaattttttatataaatttttgacttattacaaacataaaatggcttatgggggaaattatatgttagggtaatactaactgttaatctaaatgttacatatggttttaagaaactgcaaattcatactttgttcaatataagagtaacctaatacaaatataacatatatatatatatatatattataactataaatctggatttagtcctaaaatatactagtatcatatctgtttgtatttgggacgaagatagtatatggttgttttgtgctgctttgagcgcgcctgacgtgtggtacaattgcctttgattgggacagttctgttttctaatgatgattcggataggttttcaagcgaaaacaaataagcatgtccacatgcttgtataagccaagtaagagttgcttcactttacatatcaccttcatgagttgactgacatatatgcaagtcaaagtcaatgcagccgtagattttagactttctgaaaagtggagtatttatgttggttgatgagaccccaatttttgttttgagtgagatttaattagggcctatttggttgaggactaatgctctacacattaactaagatgactaagttcagtcttgtcacattttgtggcaaacaaaatgataaactaaggggttgtttggttagcatctaatttagtagatagtgtttgttttctgccacaactttactttccttagctcttagccacctgacagacatgtcatatattttatttttcttacctaactttggttaagcttagtttgtcattttatttgccaaaaaaatgtggcaagatgaagctcagctattttagtaaaaaatatgtggcgtcattagtccccaaccaaacaggccttaagctagggctgtcaaaaaaagctcgaggctcatgagctattcgagctcgactcgtcctaggctcgattcgagctcgacttgtcctccaaacgagcaagcccgagcctgtcccaaagcttgtgagctttatcgagccgagctcgagcttctaacgagtctagtaatatatgattttttttgttgttatttaataaattgggagatcaaatatgttatttgtatgccttgtattggcatcatatatttattttattatttttcctcttctgctaatatgatgaaccctaaattaattattttttaaagattatcctttgaaatatacattgttctatttaaaaatcaagctcggtagttgactcgagctcgaaccgagcctgtttgaaagctcgaacattttataggcttggcttgagcttggctcgagtttgtatcgagctcgagcctaggcagacgagctcgctcgagctcggctcgttgacagccctaccttaagcttagataaagttagataagaaaatagagtgtatatgacatatggccaggtggctaaggttatgtaagatggatttgtggcatgaaccaaacattatcgactaaaactgtagcttacctaaggtaaggtgtggcaaatttaactgtagcttacctaaggtaaggtgtggcaaatttagttgccaaccaaacaactagtcgtttatctgatcatgaaaacatgtcactcttactccatattggtagtataatactgcaatctctccgacaaaactttgatcactgatatttatattgttgtatactagtacttccgttttatattacaagaatctttaacttttatctaactcaaccttttttaaagtttgaataaagtttataaaaaaacttagtaatatttttgacaccagataaatatattaccaaaatatattcaataatagatttaaatgcatttggtgttgtaagagttactatgtttttatataaatttgatcaaccttataaaagtttgattttagaaaagtcaaaatcattttataatacgaaatgggtggagtatttgtgaaatcaaacaaaactgaaatattgttaaaatatttttcaagacatgtcaatggtatgaatgtcaatggtactagagtaactttttccaagacactgccagatgccaatgctgtcgctgtgaatctcatgcaagctagggccatatgatgtagtactaagtccgtcctaaaataagtacagccgtagatatccgtctccaacgtttaaccgtacgtctgtcttatttaaaaattttgtgaaaaatttaaaaatatttagtcacacataaagtattattcatgttttatcatctaatagcaataaaaatactaatcataaaaaaagtttctacgtaaatagtacaaaactgcacttattttaggacagagggagtacgttctcctccatgatagattcatttatgcaagagcaaatgagtgaatgacactttctgttactgaagtttcgcttagagccaacctttacctaatatttttctttggactaaatattttggtctttgttattttaccaccttaatgctaagtgacggctctggaaatttttccttaacagtgcctacttcatgttcgaaattgccatatcactacaaacttaatataaatttacaaaaattgctcaaaatatagtacaaaatagtccctccgtcccaacatctaaggatttttaaaacttcacgacggttttcgaaatgctactttgactaatatcatttatatagataagtttttcaaaataaaaagatttacatactatgatactggtggagaaaccatctctggtcggtcgacccaaatccacaatagtcctggttccattaaaaaccgggactaaaaacgatttttagtcccagtttataagcataacaggactagatgatttttattcctggttggagttaccaaccaggactaaagatctaactttattcccggttggtgttactaaccgggaataaaaatcaacacgtactatataatccctattacttatcctctttttccgtccacacaacgaactctttctctatctcttttttcctctctaagtccttatcctttcttctttcttcttccttagttcttccttcttccttggcgccgcttggatcggagcgagagcggccagccgcttggagcgagagcgggccaggcggcagccggcggctggtgcggcagcgcggagggacgggtggcggtggccggccggcgcggaggggaagctggtgcgacggtgggcagcagcgcggagggccgcggcggcggcgcgggggccggtcggcgttgaggggaggcggtgcggcggcgggcagcggcgcggagggccgcgacggtggcgcggcgtcgggcagcgccgtgggggccggccggtgcggaggggaggcggcgccgcagcatggcggtggccgaccagccggcgtggaggctaggcggtagcggccggccgtctcctctgttgttttttttaagaatttgtgatttattgcaggatcatgtgatgaatttgatttgtgtgtgatgtgaacttgtgatgtatttgtgatgaattttgtagaaacttgttgtcgacgtttgatgtcgcgattccggtatttgcatagtatggggatcgttggtactagggtatatgcaagactgagataaaagagatggagactgggatttttatacaggttcggacccctgaattgtcaggtaataaccctacatcctgttggccgaagccgatattgctcttattcaccataatcacaccaatacaatatttggggcagcctatctaactgttgtcgatatggcggtctgaaggtctgactcgtagtcgacaacagggtagtcttcctcctcgagttcgtgcccgacgagatcagagacagcgctttcatctctcctgacagtatccggagacatcgtaggggactagccgtgcttatccctgaagtcgatatccggtgtcttgtcttggcgtatgttggcttgtatgttgtggcttctgttgttccgtagattgtggtgggtgtgtgcattgtctcttctatggtgggtcttgtatttatacccataggtgtctccttgtccaagtagaactagggaaaccaatatggatacaatccgagtagtccttgtcgtttccatgcagaactctagttgtctttccttatccggaactcctcctatatccgcaggttgtttccgtataggacatggtatgtggtggatcctgccgagatttagtcaactactattaggtatgtggtatccataaccctgacagtagcccccgatttcaatgcaaatgagcaagttcatattctcaaccgcagatcttggaggaactgttatcgagctctcatgaccattctcgatgagttcagagataacgttagacttcctttatcagcctcgtgcgggcacctaaagggtttgtctgagtcaatctccgacgtcaaccaagaaagtaaagagcatacgactaagtctcccgtcttactgtaatcgagaatttggattgaagtcaagaaattttatctcggcgggtacaccatttcttcattccgtattccttgtcgagatccaccaaccgttctcgagcgatcgagaaggtgtagaatctgcgacgaagccttatcaacacttgtcgtactcgccttagtcgatcttggtgtagaaccatagagacatgaagtcttcgataatgtcgaatagaattttcctgaaatcaatactcagaaaagaatattagatagaaatagcctccgagcgaacgctcaaagggtaacatgttatagaatgtatggaaaaccgaaaatgaattaaacttacagaccaatgttttgtatatgagcgtctactcttttaccgacttcgatcagtcagtttgtttagttatacactctccctagcccccagccttgtcgtcggagaatcgttctcggaggataaggctcttggacctttgacctaccttggttgaacaagcactgatcctagcccccagccgtgaagttggaaaatccaatttccgattacacggcttggttaatacgcacggcgagaactcttacacgaccagatcttacatggtctttcgtctctgaaggatccaacaaggccttatccgctctgggcgtccctagccgaagttcccttaggttcctcagaggccttgtcaagacggcgtaaagggacattaggataggtttcaacgctaggtgtcttttgtggtaagggatctttgggtaaaacacttggcgatattgtgcacctgatatcaactctgttggagtagagataatgggagaatcgctacacctctggtcaagaaccaggtagtagtcgtaactcaaccactataagtaaatgtacgagagatcgttacgattgactggttgagaaccagtgagtaggtgtctctcgatcatttgaagtcgtggtacgaggaccgctgcgttattgctgtagtcgtacctcgaccatctgaggttgcggtgcgagagattgctacgtactgcttcgaggaccaacgaacgtgtagaatcatctctcgaacaccaatggaggttgcggtgcgggagattgctacgtaccggttcgagaaccaacgagcgagtagaatcatctctcgaacaccaatggaagttgcggtgcgggagattgctacgtactggttcgagaaccaacgagcgagtagaatcatctctcgaacaccaatgagggtggcggtgcaggagattgctacgtactagttcgagaaccagcgagcgagtagaatcatctctcgaacaccaatgggagcgctagagttggtttattacatgtgcatctcatgtggccagtatgactcacacacccaacttgtagcatatctggatgtccgttcgcaatcatgttgggtgatcaagccgatagcgttcgcgaggaattatccgttaccaaccttttctcgagtagtccagccatggccggtgctatgagataggtcgtcggtcttcgttggtaggttgggcgtgacgactctacatctgtcgagatcgttctcgataatgcggtgtacttgaccacaacctactcgagtgctcaattgtccctgaaaaatattttctagaagacaagacatatagcagataatatcgagtatgtactcaaaaaactgcatggatcttctagcattatcaggatataacgagcagattaaatatcagggcattatgtaaaccgtagacaagcatgatttatacggaaggaaataaagcaagcccccagcgttagaccgtagtcgatttaacatcggggacactcgcgcaatagatagtgtataaaaaacatgctctaggtaaacataataaatcatatatatgataatatcgtatggtctgaaaaataggtacggtaatttgtatataaattattgcgtacctttgtagatacatgccggatgtatctacggaattagtagatcaacttaaaaaaccaatctaccaattaccttgttgcgtactcgttcaacatcatacgatctgacatctttcggtacgccgcgaagcttgaggcttggatgatctcgatagaccaagttgtcgatgacgatgatggttctgatctggttaggttggatctccccctcagctgaagtcatcgagtagctcattgtcggagaatccatcccttaaacccatcttgtcgaaaccttgaagcaccaaaagatcccctacctggcgcgccactgtcgacgtttgatgtcgcgattccagtatttgcatagtatggggatcgttggtactagggtatatgtgagactgagataaaagagatggagacagggatttttatacaggttcggacccctgaattgtcaggtaataaccctacatcctattggccgaagccgatattgctcttattcaccataatcacaccagtacaatatttggggtagcctatctaactgttgtcgatatggcggtctgaaggtctgactcgtagtcgacaacagggtagtcttcctcctcgagttcgtgcccgacgagatcagagacagcgctttcatctctcttgacagtatccggagacatcgtaggggactagccgtgcttatccctgaagtcgatatccggtgtcttgtcttggcgtatgttggcatgtatgttgtggcttctgttgctccgtagattgtggtgggtgtgtgcattgtctcttctatggtgggtcttgtatttatacccataggtgtccccttgtccaagtaaaactagggaaaccaatatggatacaatccgagtagtccttgtcgtttccatgtagaactttggttgtctttccttatccggaactcctcctatatccgcaggttgtttccgtataggacatcatatgtggtgggtcctaccgagatttagtcaactactattaggtatgtggtatccataaccctgacacttctgatgtaatttgatttgtgtgtaattttttttaggatttgtgatgtatttgatttgtgatgtaattttttagaactttaagatttgtgatgtggacttgggatcttacttcgatttgggatatgcataccacccatattcgggagaaaataaaaaagtatatgcataccacccagattcgggagaaaataaaaaaggaaaaaaaacctggctatcctctttagtcccggttggtgttggactaaagataccctatctttagtcccagttggtgttaccaaccgggactaaagatccatctttagtcccggttatttcaaccaggattgctactcccagttgaaaacccgggactaaagggggttcccaactgagagtaaaaatggtttctctaccagtgatagtttgtttagtgataaatctagtaacaccattctcatgtgatcaatctttttaattttttcgctattaataattaaatttaaaaatatttgacttagcaatattttaaaaatgtttatattttgggttgaggagagtagtaattatttttgcaaaaatataatatgaacatacaaatatgtcaaaatctagagtggtagaaggcctacatggaccatgccttggagccgccacaactaatgtttatgtcgagccacatccaatcttttctctggcaaagatgtaacttgcacataactagaggaggtcgtcactatgaggatgcatatgttgttaaggctgctaaatacgctcacaaggagatttggatggttcaaaatgtagtaaaaaaaaaagagagcaaaaactcaagttcgaagtgaaaagttacagaaaaagtgttccaaagtgaacaagatatatttatccaattgccatgtttctctgttttatagtaatattgttagaacacaatacatggattttgtcaaacacgaaacgtctggaaccagttgtacaaaacaatattccctccgtcccataatataagagattttaagtttttacttgtaatgtttgaccactcgttttattcaaaaaaatttgacattattatttattttatttgtgacttactttattatctatagtactttaagcacaacttttcattttttatatttgcaaaaaaaatttgaataagacgagtggtcaaacgttgcaaacaaaaactcaaaatacagagggagtactaaagttcggcacaccattttcccaacccatttactcacatctatcgttttccgcgggcatgcttttcaaactactaaacagtatttttttcaaaaattttctatacgaaagttgttttaaaaattcatattgatccattttttttaaagaaaattaactgatgcttaattaatcacgtgtcaagagaccactccgttttgtccttcagaaatacgcttcctgcaatttcaattcagtagcacaagttttcaatctctcatgaataaatgggcaagtacaagtaccatgatcgaccgtgtgcgatttacataatattcacaggttttgagaggtgagtctgtacatagcaccatttcagagttcagaatgcaaactcagagaaccacaaccaaaatgagcttcagattcagcgcaactgcgttgccacacgacttcgtggtggaaataccgcaatcctttctttcccaacaaaaaaattactgcatttcaatcatacttaacttgtcaccgttttcgtccgctcagcaaaccatgccttccagtcagtaaccttttcgtcaccattggccacctgaagtatacgcggaagataagaaacaggccctaaacttgtttgagctagtaattatctaaaaaataagaaccttgaagcatatgcttgagctaattacctcaaaaatgagtgttgtctggggaatggagtccagggcctccacacagattgtagcagcatcttctttgctcattcttcccttggctgctgcaccctacatagttcaagaatcatatgagagtttaccaaaaagcagaacatcagagcagcaaaccaaattgatgttcccaaaagaaaatattcttatcaatttgcctcttcaaactgctaggtggaaactacagcatgcttcgaatgaagggaactactaatggtctaatattacataacgaacattataatatttgaatgtctttgcctagctcattgtgcaaggttactaaagtaagataattgccatgctgatacctctgtaaaatcgaaacctctatcaccaccaggagtgctttgcatcgagccagtcctgattatcgtggatgggatcccagatgcaagaaccacttcttcatccctctcagcaagtttccgcagtttgctgttcataatagcttggagaccaccgctacctctgtagacagagagctgcattcttatcaagatctcatatggttggtgattgaatctaagctgaactggattagacaaagttacaaaagcactgaaacctgggatagcagaacaatgtgttgcacacccttgaggtccaagtcagagaagaaaccatcctattgaagcataaatgtttaaaggaagcaaaacttagaatgaggaaggaaagggaactctagaagcgatacgacgttttcgtgtaagtatggagcacagaaatggttcacaatctctcatgccataactcaaatctaataatcgttatctaagaaaaatactaaaccccaccaataccctaatcatcaattgcagtcaatgtaattaggtaatctgataaatcaataggccaagaaaacaaagtttgtaacatacatcagctggacaaattatagcacgaacaccccttagtgctttctttgtgaaggacttatcttccatattaccaaccatgcactacaaggcagcagagaaagtgattatgaggataatatttcactaaaattgttagtacaagcatgatgagaaaacatccaaaaacatctatggcctttttctaataactgatgcaccaaagaggtggtatacaagaacgaaaagcatgttaaagctatatgtgtgaattacaagctgtcacctccacgtaagttccaaatgcttcttcagtggatcgcctgtccttcactaatgcttttattctggcccttttcaggattaatgataatatcaccatctgaaaaaaaatatgggcagtttaatatgaagcaaccgagaaaagttaaaaggaacatgtaactcaagatgaaaacaaggaacttgcaaggttcactaagaaaactattaaaacaaagaacaggagtctttctgggccgacccaagctaggccaaccaaatttacttaagattaagggttacgtacaaatatacaagctttcttacttcaacaagaagctgtcaaagtagatggaagttgccacaaaagcgacctcccaaaagaaaaacaaattacggctcggttttactctcctaaattcctgatagtgaatttatccgtagactgtctcttgagcatttgttaagggggccactcatgtgtgtgtgcgggtatggtggtgtgcatgcacgtctgtgttccatgcagcaaaaaaaggagaaatgattgaatcataaaatggtttctccaataagaatatgcatagaaagaatattcagcggaaatccatataggatattatattatatggaaataattatatacaccaatcttaaatctcaaattactcgcctgacatgtggctgtggatctacattatctatatcctgaaacaataagttgatggtataagtttcaaattattgcccaatgatctgatcatgtggctgtgtacccacatatcaagattgtagtataatattctggtcactactcactagtgaatggcaagcaacttttaggctttgtgaacattggattcgttagcaaatctgcagcagaacaaaagagtaacttgaagaataatggcaacctgtccaatctcgctatcgccattggtgactagcacagcatctcgaggctcctcgatatctatttctcgtcccaaatttgcaataaataagaaacagtgtctaggaaagggtaaaaaaaaaaaagaacgcagcgtactgtttctacgcacctgaaggctcatcctccccatcctcagcactcccatccttgggaagcaaatcgggcgctccataccaccgcctcaactttggaccccctatacgacgaatatttcagaagaatgcaactaagtcacataatgctttagctagttaagctgtccaataaaataaaatcagcttaattttaaagacttcgtccactgacagacaaggcaatgtaatgacagcaattgcatgtcaaactaccaaagtacataaacaagtttgatatattttttttcttcatttttatagcatcactgcacggctacccgtgcccatgaatcctgcaccagcaactgaagaatcgagaatttattttgtgttgattcaggggaaaaaaaaa

SEQ ID NO: 76928 - DNA, 2282 bp, Oryza sativa
gtcaccgacagtagcccccggcgttatgtcagtgtgatcgcccccctcgagggaagcgctcgggcgtgacgccactccttaggcctggtggcaggtggggccgatttctacaggcggacaggaacccagcggtcgcaaatcgcgcgcatcggcaagggaaaccgaccgacaataatgagcggcctcttcaagaccgctacattattcgagtagcgcgcgaatcgggatgagccggttcatttcacctggagagatgatgatggcgcttcggtcggcgagcgtagtaaacgcgcgcacgatatgtcccatctcgactgccacggccgcacgtccgcctcgtgcgccgcaaacgggcgagtgggattagtggaggcgtgggcgcgagaaacgagggggcgagatagtgggcgcgggaagcgaggagccgggcatagcgttggcaagggtataaagacgccgaggaagagattcgtttccttcctctcgccattatttcccttgccttcgccgcttgcgctctaactcctcgtttcctgtgccctacccttgccacactcactcgttctcaagctcctcctccgccggcgtcatggcacggggctccgcaccgctcgatggttgcgtgctgccgccttcccgcatcgtgagcgagaggcaggccgggctgccgcgccgattcatgccggaatctgccactggccgggaggtggtcacgctgggtgagggacgcccggcgccacactacccggggcggtccgtcttcttcctctctttcgcaatggcagggctagtcccgccattttcttccgtcttcatggatgttctggagctttacgatctccagatggcgcacctcacccccaacgcggtaatgacgttggccatcttcgtgcacctgtgcgagatgttcatcggggtgcgcccatctctccggctgttccggtggttcttccccgtacagccggtgtcgccgccgtcggtagtcggtggctgctacttccagccggggggccggcgctgaaccgctacatcccttgcgtcctccgcaaaaagtgggacgactggaagagcgactggttctacacccccctcgccgacgaagcgcgcctccgacttccgagccagcccccggtgcaggcctccagctggcgggcgccggtagatctgggagacggctacgacgccgttctttaccgcctggcgagtctgcggtcccaggggctgacgggggccatggtgtacggcgactaccttcgtcgccggatcgcgccgctccagcggcgcgcccggggcgcctgggagtactccgggtccgaggactacatgaggacccaccaggggcacaaatgggattgggtccctgaggacctgaggatggtggtccaacgggtgctgaatctcagctccgtggaggcatcccttatcccccaaggtgtcctccccctctgcagcgatccagatcgcgccagcatcctgtccatcatgcaggcggtcggggcgtcgaaggagcgggctcctcgaggccacgatggcgcgggcgggagccgcaggggggaacaatctaccccgggagggggtcgtgcttctgggccccgcgacgggggtccggggggcaactgccctgccgacgcccgggggaagaggaagcaagagggtaccccttccccatctcctccccgagggggcggggcggtgcgtgccagcagcaggcgcccggagggtaccgcgccgacgtcgcagcccgaggggggcgaaagaagaagcggctccgcaagatgggggagacggaaccatgccggggaaacctcatctctcccccaaggtggtcgtttagccgacctccccgcaggttcgtccccgcgcccactgcggccgtattcattctcccatcccccaaggcgagtttttactcacccgcttctttttgtcttctggtttttcttctgcttcagcgagatcccgtcgcgcccccctcgccattccaagtccggccggtctgaggtcgaggagacggcgaccgcggagactcggaggcgagaagctgaccggcgagaagccgcggtccgcctccgggaatccgaggaggctgtccaggaggccgtccgggctcgccaggctgaggaggccgctcgggaggaggctagactccgccgggccgaggagtccgtccgggaggcggagacggcacacgcacgccaggcggcccgccaagcccccgacccgactccgcctgaggcgacgacgacttcggaggccacccacgacaatgccgcggggggtac

SEQ ID NO: 76929 - DNA, 14517 bp, Oryza sativa
ggtcacctcagcaaatttctccaacggctgggtttgtatcaacgaacgacgagcaatgtcactctgatttctgtaagctgccggtcctgagtccctacgataaattccttgcgggctctggctgctaagatgaatgttacttggggaatcgaagaacacagcccggcaaaaagaatcgaagaacacattgttggcccaatgtctatcgactaacaaagaaaggatacctcaaaaccttggatattcggtggtttcttgattcatgccttcatgtatccttgttatgcaagataagataattgtttgtatctgggctccccgttttgtgtcacgtgttgattcgtacatggcagtaagttcatctgctcaatcgggcaacccttcttactcatgagaaggaatatcaattttggtgattctgtggaaggaatgaaatactgtcagctccaacaatggccttcttcgtctgcagggtacagcctatgcattcgctgttgttgacacaagacactgtacaggctacaacgcgcagccagccatggggaatgcagcagaacgagcccaaatattgattttgttgttgttattgttgatagggtttttttagaaacaaatcataataattgaggttttatattacggattcttcaatacttaaggttttgtgaaacttactagatttaagaagttacggcaatttcaaacaaagcctaagtggttgtacacttttatgtctaaattgactttactaaatttcagtagtgccaaattttggcattgtccaatactgtttacgtcacaaaatatgactatccagtactggatgtgacacattctaatactacgaatcgagacagaagtcatagtattaacatgtgtttcatctagtactctctatttcatattataagtcgtttgattttttttcttagtcaaagttctttacgtatgactactaagtttatagaaaaaattagcaacatttataacaccaaattagttttattaaatttaatattaaatatatgttgataatatgtttgttttgtattgaaaatattagtatatttttctataaatgtgatcaaacctaaagaaaatttttttctttaatgaagaaaaaatcaaacgacttgtaatatgaaacggataaaatactagataacaacattttcggatagaggaagaatttgataaggctatgatgtgcaagctattacctttataagtttttatgagaagaagattctaaaattaccaaatcttaagagtcaacttttgacaatatttagatggttacatttgctaaattttagctttaaaatgaacagccccctaaaatcaggcgttggacaggataacatcgtgagaaagtttgtttcgttttccgcgcacatgtttcccgaactattaaacaacgtgtgttttgcaaaaaaaaattctatataaaatttgctttaaaaatttataaataatttatagtcaattaatcatgcgctgatgactcacctcgttttgcgtattttcctctcttctcaaactcacccctaggccgtgtttagttcacccccaactacctctaactttcaactttccatcacatcacatcatcacatccaaaacttttatacacacgtaaactttcaacttttcccaaacttataactttttcaggaactaaacacagccctattactagagggcgcgtgtcagccagatcagcactgcgaccggaaaccaatcctgacgcgccaccccggcgagcaggtagaggtacacagggcgctcccgcgagtccgccaccgcaaccacctcgcctcgcccagacgctgacgacttcactccactccacgccctccttcccccgatactgctctcttccattccttccaaggaatcctccccaccatcttcatctccactccctctcctctctactcctctacgcggtcgagcaatcaacccgccgccgccgccggaggggccgctctccgtcgagggctcgccatcttatatatgggccggccgcctccggctgcgctccagctgatcggccgccggaaaggtgcggcggggtttcgtttcgctcccatttggatcatgccacgcgggctcaggggctcctcctcgtgttcctcctagatctggcttggaatccatggcggtgccccgttcggctgggctgggtgcggtgggtgggtggttgtgcgtcgttcccgtgcggaaggcctcctttctgtttccgctttagagctgtgggcatgaataactgtgcactctttgcctttgtgcacacctaccttgacaaaattcctttatgttttccatccacttgcgaatttgcgaagaattatatgcttctgttaaaaacaatactactagactgaattggagtacattcttgggcgaagttttctaggggtggtgtgagagtggatgctttggttgtttcacttgctaccgtggtggtaacgctaactaaattcgtggcttttgggagagacgttgtttggtttatgagctgtgagaatggggaagcaggctgcttgctacatttatggttgcaactttttttagtagtagcatttttagaatgggaaaatctctgaccgtttaaggttagttatattagcgaaagtggattgcttgtagctttgtaatttctggacattgtctacctgtattcttgttatctagttgtgatgacctatttttgtcttctttcctttttattcttcccatgctgccaaatagtctatatcactgtgtagtgcatattcttggttcgctgttggaatgttttttcttcagttaaattttagtattcctagaataggaaatggctgttgccaattgccactatgttccagcatttacttactgctggaactgttttccatggcttggataaattatcatctggatatattaccttgtactggtgacattgcacagaatctgcaagaagatgagttcacatggattttctacaaaaggcggagatgcagggtcaaaattaccaagtacagttaccaccctaaatccaaatgcagcagaatttgtcccttcaacttttaggtcgccttttggaagtagaacagttgcggatgtaagtaaaccagattttagggggctctctggtaaaacgaaccttggtaggtcggaatcatcaaaatctaataactcggatgatgaaacacaccagttttggcatagacagcttcctgatgatattattccagacttcagtgatatggaaaaagttgaacagcaacatggagaattgtcattttctggattgtcattgaatgcaccccctttctttggcacagcagccagcaacttgtcgagagagcatcatgggttattgtctcaagcaggcaagaatcttgacctggggcacaatgatttgtattatgatgagaattcaggttcaaacagtgggaagcaaaatcatgcagataacctatgttatactaatgggaagcttgacctcctttatgatcatgacccacttgagtatttagcatcccagtttcctggtttttctgtggagagccttgctgagttgtactgtgctaatggttgcgacttcgaccttactgttgaaattctcactcagttagaggtgatctcctaatctagtccttataattaaatattaatataaggaaaataaatctgtaaaatattcttgtcttgatagccagttgtgcacccatcattcgcaacattgtggtgtcccgtattaattgctttgctgggatgcagagttgggtattataatgtagtgttctattactttgctttgactggtgctaacaacttggacatcttcactaagtgagaataatgaccaaaactagtataatgttcactcaacttccgtttgctcatctattagctgctgcattaggctgtcagtacaaagcacaaactgtatgtatgaataattcgtgctatactgctatgcattagtattagagctttgtgttgctatcttattgttttagcctcttttgacctgtaggcagatcgttttgttttaaagttattcttttttcaagtaaaaattttaaaacttctgcttggtacttatagatgggacattacattttctgtgtaacagtacaaagttgacccttaaagctagagcatatctatatttaactgtacatattttttgtcttacattttttaaaaccttttagtgcatgttgtgttctggagattttgtggcatatatatgtaggctgggattttcccattctcttaaaaaaaatgcagtacttgcacgcaaatccgaccttttcttttgattgcagatgcaagttgatgctagctcctgtcagaatctgaatctggccccaaatacaccaaacattggcacaggaaacttccctgtactacctggaacagaagaccttaattgtttgtttgaaggcaatgtaggtgcccatggaattacaaacagacacaactcttcaacaatgtctaggactggagattttgtttcagctattcaaagacttgcattgcaggatgctggccacatgaagtttaaaaatgaaagtcccaagtatgctaatggtcttttgagtattgttgcgcggaaacagtatggctgtgatacaaggtcttccttaggaaacaagttccttaaggccagtagtaatgttcactcagccccagtcagtctaaagactggtgatgccatgggtaatattctcatccagacattttgatttccgaccatgctccagttatggattgatagcctgcatttatgctactgtccagcaagcatgtgctcagaatcaaggggggaagctggtgattttgcccgcatacgcaatacatgttttgaacaagtaagcactcttaaattgcatgttcatcttgcacaatgtattcatggcatcattttgtttacttgctttgagttttcttgtgttgactacctccatttattgatcactgtcctttgatctagtggaatgtttattttggatgattggaatattttctggcaggccacgcaagcttatatgatgggaaacaaagcgttagcaaaggaactgagcatgaagggacagttgtacaacctgcaaatgaaggcagctcatgagacagctagggaagctatttatcagcaaaggtggattaactccctgataaccaattgacatgaccttaacctttcataaataaaagtatttttcaacctgccaacttactgaccactaacaaaataccaggacctggactgcacattgtattcatcttttctcctcttgcatacaagtatcttttcgcactctaaaggcgcatctagttttttttagcttcccctgcttcgttgcaggaacccattttcatctgaacaaggccaggaccgtctgatcgacttgcatgggcttcaggtgagcgaagccatccaggttgtgaaggctgagcttgccctcctgatgggtgctacaaggtcagctggagaaggcacagatcatgatctgcattggaacaggacaccacaccaagggctctcgcgaggcaaggttgccggacgcccttgaacatttcctcctggatgaaggcctccatcacacgcagccatagcctggtctgctccatgttaacctgtgctaacatcgtcttctaggtaaacaatctgggagaagaaaaggaggttagggggaaaaaagaaggtgagccctaacctgacaatgtaaaatatatctatctatacctgtatgcacaatgcacgtatactaattagctactccaagggccagagaagaacggcacgaaacatcatgtatgttgtattgtttctcgttgtacatgtcgtatgtacatatcaggtataacttgtttttagttaattaacgtggagacttacggtagtcctctcaaccaatgtttatgttcttattggaattgccacatgtgttgcgcatgaatttggggtggaggtaaactcatgattttccctttttctctggttaaggtgattattttttgatgttgaaatggaggtattatatatagggattgagactaaactgaaattatctagctaagaagtttcttactgaggtttgtggtcatgtcaggaatctggaggggacggaagtttcccattagaatctctcatcatttttactgtcaaaatgtgcgtattagagcatgctcaatgtataatgtctacttaagcaataaggtgggacccggtattagttatggtgtttgctacaatatatatggcaagagaaggcattagcctgggtcctactagtttcactcaattatatggcatgtgagagagaagaggagagagagaagagaaagtattgttattttattcttatgacattatgggtagcttatcttaaagactactatatggattactttcacaatgtataatgaccactttagagatttaagaccctctcctattgctacattgtggctgcccggtagatgtcagacctaaaaaagaaagggacaatttacagaagttagttaaaccgagtgcagtctgcagtgagctgggccttacaaagtgaaagctggtcccaacgagaacgagtgggtttgcgatctcgattgaccagtgaaatttgagcccaacgagacgtcgactaattttgccacgcttcatcctctcatcttttcgcttatgcttatcagctaaaatttaaattttcaaccttaaatatttgattttaagatttctttttcatcatagtttgtttttcggcctttgcttttaaatcgttaagaacacgtatataaaagttttattcacaaattattttttatttgcaaatgtaacgttacgcttttgcttattatcaaccaaatgatgggtctgtcaatgaattttgacaaatcctaaacgaaatccacactcgagacgatgagaaatccgatcgaaatttatcgacattctgaaccctactactcacaagccgtatggccacacacagaggtattcctatttccgcatgctacgtttgcccagggttataattcaatgaaatccaaaaatgtggacttttcggatttggttaaaaacaaaaacctcttcattttttggatcaagttttatcggtttatcaatggatttcacgaaatccgatgttaccgttcttgagtggatttagatccgctatctgaggctgataagctaattggtgaaaatattttgacttttagtttattttttagttttacaattacagtttcttgtgaagatctacagagcttgtgagagctgaagggtgaaggctccagctccccaaacagccctctctctctctctctctctctctctctctctgactcttgactctctttcgctgtgcctgtgagcaacgctgttctcctccctccggcctccggcctccgctctccgcctcgcctcgccgcccgatccgcgcgtgccttctcctcctcccccttcgttgcgtgctcggcctccgcacccaccctccgcttcgatcagccgcagcccgactcccccctgcttccccgcctactccgcgccgcccgcctttggcgctcgccgccgcggtcgcccccttccgcggctcgtcgctgggttctcgtccagcacgcgggtgccggttgcttcttcttcttcctcctcatccggtcgccgcgtcaccaggttggtgtccccgcattgcctgctgcgccgcgcgcggtagatagattgggcactgtcgaatgggttgatttttttttcgaggatgagctgctgctattgcagtttctagatcgggaagctcttagaactcgattgctttttgctaattatgtcactagagcaggaattactttgacctaattcacccccctaaaccctaaacctttggtgtactttctaagttctaaggaactagggaagcgtagtgttagcggttgcatgtgctattattatctgagttagtaaagccagatttgtttgattttgcgatttattttttagtatgtgctcaacaccaccattgcagtatctgtagaaatattttttcatcattggctcatgtcctactatctgtaattgcagggttagtgcatggcagtgacaccgcatcatcggctatatgaatttgctaagactgcccttatcaagattttcgcattcccttatgccacggtctgttatctgctcccctctttcctgatcttcgattttgttccagatcagcatgttccagatcagcgtgaatcttagaatcagaaaactgatgcttctctttgttgattgtgaaatacaataggtctgtgacctgtattgtgatggtggggttgatacagacaagtggggcgatgcacaaattggtcactacatagggattggtaggataattcacactagcctaagcctctccatggttacattgtctagtctgtcttgttaatttgacgaacatactactttctacaatagatgcctctgcatcaggtgtcaatgatgctcgtgagctgtgggagagcagaaagaaacttttcacgtctgagttcatcgagttagatccttctgctgtacaacctccatccctcctttcatacttgcaactaaatacactaacattctagcatgagtagtttatagctgacacttttagtggtttatacaacaggatgactttgaagctcaaatgcaagaaaagggcatccaagcagatatagtttgttgtatgcagcatttgcaggcaagttgtctgttctctgttgctgtaatatggtgtttacttatgagctttgctaatcttcactgttaatctatattgaaagacagttatgtttcgagagtgaggaacatgctcaaaagcttctgaataatgtatcatctttactcaaacctggaggctattttgttggcataattcctgattcatctacaatatggtatgggcaactcatgagaattctgtttttttctgtctagcgttatagaccaaggtcttcaaggctgcatacaggcaatgggtgcctaatcttgtagcacataaatagcataagtagtcctttatgctgcataagtattacaaggggcataacacttaagttttttagaaccttgtttatgtcttaatttctttcttcttgcgattttttaaaaaaaataatatgattttaatggaaaatcgcaaaaatataggtcggttaggcgaaatcgcaagtttagcaccctgtcgaacaaccgtggtttgacaggggaacaaccgtggttcgacaggggaacctatcgaacaactgtagtagtttgacaggatagttggtccaagaaaaaaaaaataagtacttgctacagtatccggtaggaacatatcgaacatgcaaagttcgataggggacatatcgagcaggcaatgttcgataggggcgcggctacagtgctacagtgtttttttcttttttttaaaaaaatattttatcacatgtcgaactgtcccagttcgataggtaccctgtcgaactacggttgtttgataggtactctatcgaaccacagatgttcgacaggttgctaaacttgcgatttcgtctaattggcatatatttttgcgattttccattaaaattgtattatttccaaaaaaaaaatctcttcttgcattatagattatataagaaatagccaatggcataaattttgcagttgctaagatagaaggctagaattattaccaagaagaataagatcgatacctcaattgagttagccgtaactgttggatgtttctaacttatatgatatttctaaattgtaggacaaaatatcaaaagaatgtcgaggcttcacataataagggtctgaagactgttccaaatagcattcgctcagagaactatgtcatcacctttgaagttgaggaagaaaagtatgactcgagcttgtgtattttaaatatatataaaaattcaggtttgttatggtgagggatcatatgcaatatggtgcaggtttcctttctttggaaaaaagtaccaactcaaatttgcaaatgaatcaatgttcgagaatcactgcctggtccactttcccagctttatgaggtaatattttccttattagtcttccaacaattgttgtacagccttatttcgtaaggtatcacattgttagattatgttgaaacagattagcaagggaggcaggacttgaatatgtagagatccagaatttaaccgagttttacgatgataacaggtgccaatatcctattgcaagttctatattattgtctttgcatcattttgttgtttatttagagtaaccattcttcggtttttttatttgcgatgcttaggttaccctgtttaaagctgatagttacttttttgtgtgtgtgttctcaccgactccagaactcagtttgctccattgcttggtggttatggttccagtttggtggatccgcgtggaaagcttgtcgctcgttcgtttgatattttaggtgatgtagccttttcccttcaggattcactgaaggtcccagtttactcattgcctgatataatttctgcaggcttgtattcaacttttgttttccagaagcctgacccagatgcaatgccaccaattgtaacacccgaattgcatgatcctgagaatgatcaagaagaggtctgctctgcatttagcaggtgttgatatttactatcacattttactgatatttttttgttaactgtgagtgaaatatcaggaatggctctggacgcagcaggcatcaatggacgatggaagggtctcacgtactgatatacttcctcctgcggataatgagaaaggcatccttggtcctggacctgcagatatgaggctttaagttcactgaacaactggatataggctcactgctggagttggagcaacgatgctcctgcaaagctgcaattggtggtttatggatgcatacatatgcatgatgctcacgtagtttctaaatttatttaggctctacctgtaaaaagaaaacctttcagttattcttgagaagatagaattagcaccaatgtcatatgtcacggtagaagatattgatagagtagttcactaattttgtagtggatcctttaaatattactccctttgtcctataatatagcaacctaatactagatgagacattgaaatgttacaatgaatctagataacctcctgtccagattcggtgtatcatgaaatgtccaatccggtattagattattatattatgggatggagggagtacatcattacccgtttacgactgactcagtaccgactgtcttttcttttgcatgatgtggtaacaaaccatcgcgaatcacttccgtctcacacgtctacgctgcatttctttccccctcatgaactctcgtatccattccatatgcatgtgccgagagaaagggagaaaagaaaagataaaaagagcggtgtctagaacgcgacgacgaactcgatgcaaagcaaaagtttttttgttgggcatcactcgtgcctgccgcgatgcgcttccggacaggcgacatctgcctgcggttttgtgccgtgccgcgcgctttcgcgaccgggtgtggaccaggagggcacgcagacgcaggcaggatggaccgaatcgcgcgtgcaaagcgggggacgcggttgatcgagttggtgttggaaggttggtggtggtgttgccgctggccactgcagcactgctggatgattgttgatcgcccacggcggccggggacggaggcacacggaccgggaccggtggcccgctctcacctgcacggcaccacgactgccttccttccccgctcaggagagcaccaaacctcaaaaaataaaattttcacctgcttcaagagtagtaccaatatttgtttttatatactccctctgttccataaaaaccaacctagaactagatatgacatatcttattgcaacaaatctagacatactagaatatgtcatatccagttctagatttacttttttaaatgaaaaacagcacaggtgtaccttttcattgaatagagtaggagaaaatacaacccctaaaggtaaaccgcttgaaacactggccaagctagaaaaggtaaaactgaaattcatatttttatagagtttgtttgaattgttgataactggataacagtcctgatttggagtttggacgggcacaaacacaaatcgctactcaccgtctcaccgagttcacagttccgggaaactgttactccgagacccacttcgccgcgaagtaaccggacccttatcctatggatatagttggggcccccttccccggcccaccaccgcacgcaacgcatcggaccacttgacttcgcgcagcggcagcggcaaaccgcttcccggaaaagaaaaaataaaaaagaaaaaaaagagaagagccgcgtctccctcccaccgaaatccctcctcctcctcctcctcgtcccccattcgccgcagggctcggctccacacgaacgcgacgcggcggccgccaccgattccatccggaggaaggagccgcgccgcctccttcctatatccctcctcctctcccgtcctaaaccctagccgcgaccgcgagttcggggtcctaatccggatcgactccgcctccccgagtcgctcggacgcgttcttcttccgggtaatcttaatctcctactattccgcgtttgagcctttacgctctctttctttttcttgtgtgtgcgtgatttggcggtgattctcgaggtaattcgttgcttccgcacgttggttttctcggtcgatttattatcttgtggttttttttggggggttgatttggtgtaggggttcaatgatccattattactacttgtgctgtatgtagggctgggaaaattagggtttgttttcccgtttgtaacggctaattattatctcggtgaaaaatcgacggcctcgctgtaatattaaggctcgaaatctatctgtgtggtaccaggtttgactttgtgctgcccaagattgcatctccagcggaagaatcagagggattaaattaacgctgtctggctgcgccattaataaccttgggtggtggtggtggtggtggtggtggtggtgctccactggagtggaggctgtgagcaagctagtggagtgggggcgtttcttaggcaggtgctatggcgacagcaacaatggcaaccgcagctggcgcggctgcgcttctgtactacacgctgaaccgccggcttcaggtggagaagctgaatcaggaaggcgattgcggcaatgaaagagatgccgcgacgaggggggccctcagtaccaccagcaggagcagggtgtcaaggagggatgttcgtgcccctgccacatggctggagacaatttccactctgtcggagacactgcggttcacatactcagagacccttgggaagtggcccatcggtgacctcgcttttgggattagcttcctcctcaagaggcaggttggtaaccattcctttgttgctaataaacatgcatctttgtaatttgtactacttaataattgtaagctaatagggtctgcttccatgatttatcttgcaaatattgtagtgattataatatggtgcagtgtgcatttatattagctttgttagcataatggggctcttcaattttgttaaactaaaagtaaaataattttggaaacactttatcctagcctataaattgatttgacgatctgaacagctcgcagatcatttacctcatattattcaatctgtattattggctttttgtcttgaacatctgatataagtaaagggagaaggtgctccatacaaccctgcaaaattttacccctctccggaacaacaatttctggtagaagtacatgaaggatttttgtagtatggataaaaaaaaattatggtatcattgaaagaagccctttatgtatatatcatttcatgggaacatatcctgtacacaagccttctcgtgtaaacactgtgcccaccaactaacaaattttataaaaaaatctagaaaaaaatgtacaagtacttccaatagtattacacttatatgcaaagtcttaacctcaaatcaatatattttagccgtgacagaaaagataaaaactcttgacagttttgagagtataaatctgttagaaatttgtctctttttttttgctcactatatataatgaatttgaaaatgagactttacagatagatgtaatactactaaaagtacatatacatttttttttttgaatttttggtgacatgttttagtatatatgagaagacttgtgtgcataggatatgttccctcatttcactccattaaatttacccccattccttttgtatgttaccatccacaatgctgcccatcctaaatacatacaactgaaagcatattttttacagcataaaactaatctgtagtgcacaccggcacacacacacttcagcagagtttctgatccactggttgtgacatgtgttccaggggaatgtacc

SEQ ID NO: 76930 - DNA, 659 bp, Oryza sativa
gaagtgtcgtgaactgaaatctgattattctttttattttccactgaaagaaaatgacaaacctaactagtagaggactatttggacaggacgaagaagttgacacatacacataggataaaaaaccatcataacgctcttggataaaaaaaataaaaatctcttaattaattaattaaattttgttatacctggtgcatatgtgtacaacgagatgctactgttgagtagagagggaaggcagatgaggcacacggcatgggcctgatcgatcgatgttttgggccaccgctacagtgcatccgatcataagattctttttgcatggatggaccacttccattggcatcagatcactgtgctccaactccttacctctccctccctgtatctccatgtctccatatctctctctctctctctctctatctatctatctatttctctctctagatatataaatagagagagaagataatagtcttctccatatgcagtagtcgccggcggcaaggtcggcatgatagatagatatacgtacaatgtggctggtggcttcttccttgatccaaatttaaaactagcttcaatttgcagtagatatatatttaggctatgctcaggaggaagagttaggaacccctcctttgcagcacgca

SEQ ID NO: 76931 - DNA, 2120 bp, Oryza sativa
tatacatatatgtatgtacaccgatcatgttatacatcgatcgagtacaattaattaatattccgttaaatttgccgctttgctggccctctgcatgcagattcttctccagatcgatcgatggagactgtgtggaattaatctgacgcaagtaaatgcttccacctgccgcgatctaattaataaactaaaaaatatatatacatatatcatcgatcgtcgtcgttttgttcgtacccacaactgcaaatatagcaagcaaagcacatgcatgatcgatcaagcatccaagcctctctcacatgctcgtcagatcatatatactgtgccctgagatcgatattgacagagagagaaacccaattataatcaagaacaaagactgatatattactgtgcattaatcgtactagcagctagtgtatgtgttcaattcgatttcgccgtcgccgacggcgatcaaggcgatcgaatcgatcgatcgaacgaccccaccaacacataaccacgcatcctgttcatccacagtccttgcattacatcgcattgcattatgcatggtagctgcatccactatactcatcatcatcattccgctccatcgcgtgcgtgtgtgtacgtacgtgcagctacctagctagattaattatctcgatatggatgcagatttgcagagcgagaggcaagagggcaaacagtctctagtctctacacctgcataagctcaggaagagagtaattgtgctgtccccggctggtcgatcgatcgacgacgacgacgcagctagcagaagaagtactgtaccttgctgtgttggcgtctgaattcgatctgatcgatcgaggtgaagagtgatcagggctaattgcgagctaggcgatttattctgggatatggtgatagatatgcagaaattaattgaagattcagacacggagccgtatgtatatatcgatatcaacagtttcctcgatctgatgctgcgtggctgcactacctgcatattgcatcattgcatggatgcatatataatgatgagtttatgaccggctggtccggttgggttttcgatctaggtcatatcgatcgatctctgtgggtcatggtgtctacccagatgcatgctctgcatgcaggtggccacttttgagagatgcaggagattgttgactacaaccttttccattttcagtctggaattttgttgctgttaaaattaattttctccaagattcttgctccgacgaacttcagcttacgagtcgcactcggtttaacgtagttcttgttttgacgtactgtaccccccaccttccagtaaccgcgcacttcagcaggttgctgatgtatgctacttcctccattccaaaatataataatttttagcctttaggatttatctcaaaatatagcaattttttcatcaagattctattcccaaccaattacaaccctagctttaccattcaattttcctaactacctccacttatcatccaatcataacctttcttatttaattctatcaactttcttaataactgtgttcaaccctaaaaatccttataatctaggacggaggtagtactttaattttctcgtacaagacttttaagcttccaaagaaaaaaaattcttgctccggtgaactccaccgagctagtcaattaaattcccctctactttgcgggcaacaatgttatactcctccgttttatattataagtcgtttgattttttgttagttattttttaagtttaagcatgttcgtagaaaaatatactaatattttcaacataaaataaaaatattattaaaatatatttaatgctaaatttaatgaaactaatttagtgttgtacttgatgttgctaaatttttctataaatttgatcaaacctaaagaactagctaggtggcctgcgcaattgcgcggctagcacccaaacaaaatcatatattttttagtatgatttttacttaaaatttattaaatagttatctcattgtcttaagactttgaaagacgaaaccttatcatcctcatgtttctaattatatagtttttaaaagtcacaccaattgctaccccttatgtcatctcctgggctgcaggaa

SEQ ID NO: 76932 - DNA, 2103 bp, Oryza sativa
ttcctgcagccctttgagaaaggacgtgctcagtagtgtggaacaaaaacttgcataaggtactgcattgatgaaggcttcctttaaactcaaacagatagcagtattataacctctgtagtcaagagatgtttctttcctgatgatgccaccatttctttgattgtatcatcagaaatgcgtcttgtttcattggttgatcttctggacaaagtaccaggtgaagttagttcttcatcaagaccggaaacaccagtttctcttgagtcattaacatgaccatctccactcagtttagcattggcaatcgcatttgctcttacagaggaagaagttgtatcctacaaaccacatgtagtgaatagtgaagaactataatgcaacagacatatcagttccaagaagtataagatatcatcaaggaaaaagcgaaattgctaatgctgctgacggatgctaaatcatgccatgcaaaggtacacgacctcggcaaagagcatgcctacttactcaaccaacctgacctacccataaatataccgtaaaaaattgcaaacacaccggtcactctgtcagtaccatttgacctagtgtagtgcaataaaataaggggaaatcactttgctttttctaatgcatactatgaattttatattcatttagttgataaacaggttcccacagagtggcatccacccccccccccctacccatagcttaccctcccctttccagagggtgaatggaaaagagaaggataagcttaatgcaaggaaagagatgttataaaaccttaccaaaaaaaggctaaaatcgactgagaagcaatttttaaatatatatatatatatatatatatatataaagagtactggtggacagtacaaaatcgcaacctataccaaactttatctctgttgtttactctaatatgccactgaatctaatcataaaatattgtgtggaattataacatactacaacatccaaaatttgctagattatatttgatgttcatatttacaccaccgggtgataacatgggccaattgcatttctgccactatggtttaacggcaccgttctatcactcctgttaggctaattgctgtcatgccactagattggaattttgttgggatacttcccacccatcattaaaaaggaattacacccccccccaaaaaaaaaaaatccttttacagaagtgcctctacattgcactgcctgagaagcgtgtatcgtaaggctgacgtcaaccagcaccctatccatggtttaggaagacacgtgttcatctttaaaaaatcaatgtaacctgtgggttagatggtactgcctaaaagatttaagccattaaaatcatcacgggtaccttgatcaaccaaccatatataggatttttgataattggattctttttttcacaatgtgcacatttcttctgtcttttcttcattagctttgagaaaatcgaaagagcctccttcagttggatcgatgtccaagttttattctccctctccgaacgagccgatttatcacctgaagtggcctcagtttcatcatcttctttcgaaagtactttgccacccaagtcttccaaatttttagcatgagcaatatcacctcttactaatagttcaagctcatttgtgtatctgtctgcctaataaagtaaacagaaaatcaaatattttagtgatgcgacagaaccttgaatgctccaagataaagaaaattgaaaaacaaaataaataagatgaacatgggcacacctgttccttgttcaaccggaacttgtgacaatggaagcacgtaacctggagaaggtttttaagactcataaaaagcaatggattaaatagtggtttcgccaattcgatatggccaaaatggccggggcagcgaatggactgctgaccacaactcttgcagctgtacataaaatttagacatggtcaaaaactgaaaattctaattttcccaaaaaaaaaagatacatgcaaaaagaaacttcaagggttgcatcaaatatacccccgagttaaagtaaatgaaaacaaaaatagtccctcaaaacatgtagcattatagattcaa

SEQ ID NO: 76933 - DNA, 7208 bp, Oryza sativa
tgtcagtatcattcgtgggtcccattgctgggtcaagtaatccacctggcacaggacagttcttggcatcgacacgatccgactttgttatctgtttaacactgatcctcttaatttcatcatcattgtagaagctgaagtgatagaattcacttcctctgatgcggcctgcgcaagaagcaaaaccatttaacagcagaccgtaaatgatcacctaggaataaggctcaaactgcaatatacatatgtacactaaaagtccaattagaatcatgcgatttatcccccactaactcgaaaccaaaagaaaaaaaataagacagtcagtgaaaagtgacaagacacaaataggccatgcttttcctgaaaacctttcaggactgaagcgccccaaccttaatcgtaagcatatcggtacgcgttctaacacaccaaaacaagcgcaacgagatgaaatttctagcactgagaagcaaagggaatatatgctacgacttgcaaaatcactgggaatgatccggcaaccaaacctcgtcgggccgcacgtcggccatcctcgagctcgcgagcgcgcgctctgcccagaaacaagtggggggaggtggcggcgggcgaggagaggaggcggcggccgccccccgcgcggcggaggcgagaggggggaggaggaggtggggattcgccggccttgggccaccgccgcgcagtgtggagggagaagggaggaggaggggtttcaagcggcgctagggtttaaggttgagaagcaagagagtcgacttgcccggcggcgtgtttctcgggctgtagccccacgagtccgctcgattggatcgcttgtgcttttgggccgggccagatttctacgtagagagccgaaatactcctggaacaaagtataatttacgtccctcaggtatagcccgagtttgatttgcatcctttaaccccaaaatcagatatggagcatcctccaatttctaaaaccgacttccttgatggttttagaagcttttttaattgacgtggtgtttcgactgcgctgagttatcatgtggctgaccccacccttgctaaggcccagttgtcaacctcgtggatctagggggaagtggatgatagagaccatatccaaaagcaggcagcggcccatgtttgtgtcggctccaggggtgtcatagtcgtagaggacgacaacggtgagcaatagcgcaggggcaggaagccacgccacggcatacgcctcgaacttgtgcctcttgacttcatcgttgccatcaccgaagttgtccttgccactagggtgaaaagcctcggcctcttctcagcgaggcacgagcagcgacgagctcctcctccgagctgggccatgacgcgatgcttatcttgcccgagcgcgacgatctcctgattttgacgacaacatgcctcccagtgagctactttgacggcacctacttgaagaattgccacctctcccctgatcaccagagccatttcaactaagccctccgtggtgttaaaaaaaaaaaactaagccctccgtgaccggggaatagaagttcttctttgaatgccttcggcgaaatggcccaacctactgccttgtttagatggggaaaatttttgggtttagtcatcacatcggataaacggacacacatttgaagtattaaacgtacatagtctaatacaaaacagattacagattacgccaggaaactgcgagacgaatttattaagccgaattaatctgttattagcagatgttactgtagcaccacattgtccaatcatgacgcaattaggcttaaaagattcatctcgcaatttacacgcagtctgtataattgtttttttatacattcaatactccatgcatatgtctaaacttttgatgtgacgacgtgaacttttttttttatgaactaaacagggtaggggtgggcattcggtctaaccgaaaatttcggtctcagtcttcggtctttcggtctttgaaaagtgaagaccgaatttcagtgaaaaaatgtcaagactgacaaattcggtctcggtcgtctcggtcttgaccgaaactcaacaacattttcatatatgcaaaaaaataatggaaattttcaatacaaaaatcacaaaaaaattcgtaagcacttatgagtaaagactcttattaggttgcatgcctagaagaagtagggatgtgaaaattagagtttaatcctattaaacatagtggattgtaagttgtatttagacattttttgataattcggtctattcggttacccaaggagactaaccgaattgaccgaacaaaattcggtctttcactacgtaggaccgaatttctcgatctcgatctttttggttcggtctttttctgcccacccctatgcctacgaatgctcccagtagtttagttgaacctccgctccgccgggcgtgcccgtgcattagcgaagacaagacaggagtggcaacgcatgcgcgcaagcgattcgtccagagtatcagtttcaaccccaagcccaaaaaggttatgctgcgccgctcagggacttgagcggcagggctgtcagggagagagacgtgacgagaagcccggctccgcctgcttttcctgccgggttccggtgtgacataggcgcacgtccggccaggctatcctcctcacagtggcaacaaaaacagcctcagaatcccctcaggcctcaacaattagtatgatttaggatgtgcttggttaggttttttaacctgcttttacttttgtaaaagctaaaagccaactaaagagttcaaaagtcacagctattttgctcaaagccagcttttagtgtagtacaaataaaaagtacctctacccctactttcacccgcttttgagagaaaaaattacccacctctgccattatgaaaaaacggttcgacattctattcctatctcctctcgcttcgtcacacgcgcccgacgcggggatggagcggcgcatctgccctccggccagccagcggccgccgtcccctcccaacgcctaccgccgctctccccgcccgacgccggccgccgccctccctgccctccccgcctgacactggtcgccgccctccccgcccgacgctgcgtcgcctcgatgagctgccaccaccgtcgctcctcctcctcgccaagacgccgccgctcctcctctcgtccccgccggcccactccgccccctccccgctcgacggtggcgccgccccttctcctccccgtctgacgacgccccttctcctcctggcaaggtagcaacatcccggcaaagcggcgcgcgtgtcctcctcgccgagctgacgagccgccgccgccgctcctcctcgccgagccgccgcgcgtctgcctccccgccgcacgtcctccttgccgccccgccgcgcgtcctcctcgccgccgcgtctgcctccccgccgcacgtcctgctcgctgcgcgtcctcgccgccccgccgcgcgtcctcctcgccgaactgccgccgccgctcctctttgccatggccatctcccttttcttttttttttcacgtgtgtatgacatgttgggcccgcttgtcagcgggactagttatatcaaaagccacagctgttgaaccaaacgagctttttcaaaagttacagcccatattccaccgctacttttcaaaaagtcacagcacacagctacttttttaaaagccacagcccaaccaaacacacccttataaacttacgttttttagctcgaccgccttgtgttttgctagcaactcgagcaaatgcagagggaataagagaaattatctgtctcaagatggtagtagtatgttgcaacagaattcagccgaacttcttataaactgatctgttcgatttgtaatctatgaacatttttcagttgtttccatatcgacagttctctattcagtttcttcaagttttgatgaactcgataaattcatgcatatacagaatattttgtccctcggtgtggaataggattcactcgcattgatcattaatttgatccatatctttgacgattagaccttactgagtagctgaagatacgtatgggatatttgagaaaatgatatttgacacataaaactcagtagagaacacttgaacctgaaaaaaaaatcctctttgacatgataagactacagggaaatctagccaaatagtatttgtgtagattccagtattccacatatactaaacgaagaaaaatcttcccaggaagtgtggttaccatacatgttgttttcatctcgtccataattatctgaggccaatcactatttttcccccttcctcgtttttattgagaatcatatcactccacttggttagtgcaatcttttcttgttactatttatgatttttttctttttttttgtgggggtggatgctcactttgtgacaccacttgatacattgtggtcggaaatgctgtttggcgatcgatcccctcccccctccctccctccacggctccacccctccacctggtttccttttttggcactgcattacttttctattttagtaaatttatatacctaaaatttatacacctcaagtttacacatctaaaccaaaagtttatatatccgattcaaatttgaatttgaatttaaatattttgtatatatagtatttctatacatctaaagtttatagatctaaagtttataagtcaaaagtttatatacccatttcaaatttgaatttgaattatatctgattcaaatttaattttgaattcaaatattttgtatatatagtatttctatacatctgtatatatagtatttctatacatctaaagtttatatatagtatttctacccaaagtttataagtcaaaagtttacatatccgagattcaaatttgaatttgaattcaaatttttatatatagtatttctatacataaatttttctaacttttgttttttaaaaaaatttgtgtggtgtactgtagtagaaatagaagaaagggaggaggaaggggagaagagggaggcgcgggggggggggggggggcaaaccgatcaccccctggcgatcaatcgcccattagtctcccccattgtggtaacactgggcaaagttgtccgtttgttccataaacaactctgtggcagcacttgatacccctagtcccactgcccgtattgtttgtttcataaacaaagggacatgctatgtgcacaacccacttgcatttttgttcgtgtgttgagttaccgacttccctacctcgtttttcaggtacatacttttcaaactgtaaaaatgagcttcttttgcaaaaaaaaattccatacgaaagtcactttaaaaaatcatattaatctatttttaaaaaatatattagctaatatttatttagtcacgtactaatggatcgttcttttttatgtgcgaggagcacacgatgttggttatccttgccttttagtgcatgtactgaggtggtgtttgaatccagggaataaactttattccctattacatcagatgtttggacactaatttggagtattaaatatagactatttacaaaactgattacacaaatgagagttaattcacgagacaattttttaagcctaattaatccataattagagaatgtttactgtagcatcatataggctaatcatggattaattaggctcaatagattcatctcacgaattagtctagggttatgaaatgggttttgtcattagtctaaatttaatacttttaattagtatcaaatatacgatgtgaccaggactaaaagtttttagtcccatccaaacaccacccgagaatcgacaagcttctttgagaaaaagaactctacaaatgcaacctagagatctttccattattaaactgcactattgtggtgtggttaaattatcctcctttttgctttgtagcctaggaaggaattcatgtggagaaatgattgcaactacgcccgtatacaagtagggttggcttggccacagtcataccaatatccacttttatatgcagctcttgcctatcaaattcagcaaagaagaacggttttttctatggacgagccaggccactcgccggaaggagtggaacagcgacatccggcctcccacccgcacgggagattctttggcggttggtggtcccaaccaacgtcgtcctggccctaccccccggatccaccaaaccacacatgacattttttttactcatacagttaactttttaaatatattggatcgttcgttttatttaatttctttttaaatatataaaactatatatatatataaataaaagtatatttaacaataaattaaatgatatgaaaaaaaattaataattacttaagtttttaattaacttaataagatgtacggttaaataaatgtaaaaaaattaacggctttaaaaatatttagcgtcggagaaagtattattatttcttcattctttctttctccctctactccggtgaggagcagccgccaagttattgtggagtgaggtggagagcacgggagatgacgtgggcgctgacacagtgatcagcaacgggaggcggaggaagcggatggcgtttgcatggacgaggaggccagccgctgccggtagaaaaggcagtggagcacccaaaccacacagccgctcttatcggcaggagagtggaggaggccctcacctaaaccctcgtcctccaatctcaggatggagcgcgcacgccgcctcgccaaccgcgcgctgctgcgccgcctcctcgcggcggcgacggcggagtccccggcggccccgtcccgcggcatctcgaccctggccaaggggtcgcgcccgcgcgcccccccacgcccggcgccccaccagtacaccacggggcggcggcccgtgtcggcgtcggcgctgcagccgagcgacacgttcccgcggcggcacaactcggcgacgccggcggagcaggcggcgatggcgtcggagtgcgggttcggcaccgtcgacgcgctcatcgacgccaccgtcccggccgccatccgcgcgccggagatgcgcttctccgggaggttcgacgccgggttcaccgagtccgagatgatcgagcacatgcagcgcctcgccgccatgaacagggcctacaagtccttcatcgggatggggtactacaacacccacgtc

SEQ ID NO: 76934 - DNA, 744 bp, Oryza sativa
aaaaccataatctctagcctgcttcttgattgctaataagggtttcatcggggtttcagctggtgagttatctggacgttgcatcggctcataaggattgcatatacatataagttggatttagccgatgacaacaaaggcttcactgtttaatctaatcttgtggatttcatgacatcggacctccatccgatgtgtgctttgaccttcggatcgatgcttatttatcatatcattatttgctgattggtttatactggattatattgttattttattacatcgtcgtcagccgattgcctttatatcattatctacattggacatatagccgattgcttaaaccctatcggcatcggctgctatcagcatcggctattatcggcatcggctggaactactccatcggcttgtcagccgatcggttgttttgatctactatttgcatatcttgtcagttacaggatcaaactgactggcacgctcgtatctcaccaatctttagacctgcactggagttaagcagatctctcaggctggtgtgttcgatttttttcatcagtatctagcatcgatccacatcagggccatcctagttacatctacatgattcatttaataacctccttaattgatgctaccataatggttttattttggtactaatcaaaacacacttttgaacaaacttgagaggataagcgttggaatcggtacaatatttagagtatatttgccacagct

SEQ ID NO: 76935 - DNA, 656 bp, Oryza sativa
tgtcttcgttggagattttcatgtttcgtgcatgattctcgttggaggcacggatctatgctgcagatttttttcatgccgaatcggcatgacgggagtaacacgatgaggcggcgtacacaatgggttcgtcttatgtcgttagttcttacgtctgacgacagcattcacagatttcctgtatgctatttcttcagaaattttacgatcctaaaagaaagtacatgtagagcggtcttacttatatctgtaaacttagagaatgcatgtttagatccacgatctcgttttaatgtaccatctcaggttcaatccgcgcttgaccaggtctgactgcagtacatttgcattctcccccctcctaaatccctctgtcgcaaacctaaatccccaaaaatccccaaacctaaatgccctctgtccacttcccagggagagagggcgacctcgacgactccgggagaggcggcgcggagctgggctccacgaggggcgtcgacgcggcgggggcggcggggctccgggataggcggcgcgccgcgcgcctccgcgaggggcgtcggcgcggcgggggcggcagggctctggttcgtggcggcgtggcgctgggctccgcgaggcgcgtccacggggctgtgtttgtcatgtactgaatt

SEQ ID NO: 76936 - DNA, 20738 bp, Oryza sativa
gccttcctttttgacctttgcaagaattgaggccggtgttgaggctgtacttcgaaagatccttgcattacgctccccccagatctcccaggtgactagcatcagtagcgttcgcagaggggctcttggggtgctgggggattcgacgacaaggttccaccaatgttcaatcgaggggcagtcattccatttgtccatttggaggtcagtatgtgtccatctttggatttctgcccaaatcctcttagtgactctacatttggccagaaggtgaaccgctgattcgtcgattgtgcggcagagggggcaaaccttttgatttcgctagcctcaattccccaatctgtcagccgtccatagcctattctgggtagcaagccaagagaagaatttgcatttcggcggcacccacgctttccaaatcgattggtagaaaacggatcttgctgctcccatgaactgcagagatgaaatatggatacttcagtcattaagacccacacgtcagtgagacataacacgtaccacttcaacacctaaacttaaacatcacaagaccctaaagaaaaaaaacttaatcatcacaagcaaataaacactccaataaatcttcagaagagaaaaaaatgaatccaaaagacctggatgatgaagggtaaaaccgccattgacgtattgaccactacatgatccaaatgaagcctatgttagctagtgcatgttaagggcatgtgggcatgtttatattgtagccaaaataaactttaccaaattttggcaatgtcaaaattttggcaatttggcaatatggccaagttttgttaggatttattatgtatttaccagagtttcataaaaaaactaaatgggtgcacatatttgataaatttaccaaaatttggtaaggtttatttcgactacaatctgaccaagccttaagtgaccacgtagttttagtgtaagtacaacaaagtgatataaacatattgtaagagtttttatatcaaatttatgtcaagttaaaaagaaaaaagtagctacaacagatttacaactagctgcagtataagctccaatcaactttttatgaaaatgagttgtactatagagaaagtattatatacctaaggagacatcccctcgtatattaaaaactatccaaatggtcatagaaagttctttaaaaaaataacaatattcaaacaacatatttatgccacatcacaaaatcttaactctaaaatcaactcacgtatcgagatataaagaacaaatctatgaactgtattttgcactcaaatttatctctttatttttctcaatgtctaggcgattaatttttttaagtaatagatgtcactatacttataacattattaaaataatttaaatttttctaataatcatttttctctaatcaacattggatttaagtgataaaggatctgtttagattggtgccattttaaaccataccgttgtttggtaaaattaacaaatatatggttgcatttagtttgttaccaaatattggtaatgcatagaaaattttggcacaacatatttattccaacatatcaaaatttggcaattctatcaatttgtcaaaaatttggtattgtcaaattttggtaaggttattttcggaactaatctgaacatgccgaaaggtttagggtgaatacccaacgtgatccttgaactttcgcttaaggatcaatttagtccctgacatttcgtgttgtccaaataagtaccttaagttcattgtgtgattcaatatggtccttagaccctctaaacatgccatgtgtacatgccacatcatctatgcatgcaaattcaatatttaaatatcctttacacccttatgttttcatatgaaataaagaaaaactattgagaaaacacacaaaaaaaagcttttgaccattggcaaaaatgtgtagtaggggtgaaaacggttcggaatttttccggattccggacctgttttcggaaacggaatcagccggtcgaaattttttcggaatttctcggaaacggaaatattttttcggaaacggaatcgaatatgataatagcagtttccgtcggaactcggaatcggtcggaaaaaattccggaaagtttgtcggaatttccgaagttaaaaaggcccatccaaatagtccataattcctccagcccaacccaagtccctactaaccgaggagacaggctaaccctaggatagaggcggcgcatccaggaggttgagtcgagcacgccaccgctggccgccgtctcgtcgcccttcctctctcgctcattttcgccgccgccaccaccgacgatgacgccgacgacgccggccactggccacaccgccgacgccggccacaacaccacactgccgacgccggccacagccacacgaccgacgacgccggccactagccacaccgccgacgccgccgacgcctcgccttgcaggcagcagcagccagtagcccagtggcagcaggtgttcctgcttctgcttatattatgttctgttaattttgtagaagagaactgtattattaatatgttctattgccattcaccaagcactccaataaagacagactgctagtatgtccagctaaagacagacggtgttcttgagcctaaaccgttgatttgatttcttttatcgtacagatttgtgatttgaactttgttttgtgatgactgatgaactatgtactaatggagtgatgtgttatgagattgaactaagtactgaaatattgatgaaattatatgaagttatagaagactatattttgctgtgaagctcagtttgagtggtttctgtattccgataaattttcgttactgtatccgcaccggttcattttcgctccattttcggtttcgataatattcgtttccgttttcgtttccggggtttccgatttcgattccgattccgaaaaaaatatgaaaacgaaaacgataaaggttgtttccgtccgtttccgtaccgttttcacccctactgtgtagcattgatagataaaaaaattaatattttttgttttatgattgcttcttcttgtttttcttttctttatttgatagaaaattgaaggttaaaatggacatttaaatgcacgaatgacgtggcatgttcatgtggcgttttaagtggtctaaggactatattaagccgcatgataatctttagggtcatgtttagacattataaaatatgaaggactaatttaacctctgagcaaaaagttaaagtactgaactgactattcacccaaaggtttacgagggaatacttctcgaggatcagtggtggattaactgaagatgagatgctctacgtcaggtcaacatcggtctttgcttgtagcatcgttcattccacgctggtagtggtactatcttaagctagaaggccggccatctcgtggtagagacgtggacgcctctgcccttgtgtgcccctcagttgtaatccaccacgtctggctccgtttcagcctcccgttgccctatctatctagttatgtaagctagagctggactttgcttgtactccctccgtctcctaatacgagggattttgacattttttgcgtataccatttgaccactcatcttatttaaaaagtttgtgtaaatataaaaaacgaaaagttgtgcttaaagtactttgggtaataaagtaagtcacaaataaaataaataaaaattccaaaatattttgaataagataaatgatcaaacagtggaagcaaaatgtcaaaatctcttatattaaaagacggagggagtagcatatactatttcctgtctgtctccactgaaatttcgtgagatttcagttttcaaaatggggcctagccatgcacgttcgttggcttcttgcaagcactggatgatgttgtccttgtccctgagatgctgaattctaaactaatcacgcattgcttatcttattactacctccatcacaaaatgtttgacgccattgactttttaaaaaatgtttgaccgttcgtcttattcaaaaaatttaagtaattgttaattctttttctatcatttgatttattgttaaatatatttttatgtatacatatagttttacatatatcacaaaagtttttaaataaaacgaacggtcaaacatgtttaaaaaaattaacgttgtcaaacatttaggaaagaagggagtaattctcaagcgtcaagcgtgcacgctgagcttcgttatggcgttgaagattgctgcacagtagcagcagacagagaccttggtcaatcacactacagtccctgtctttacagctagcttgtggcctctggcactcatcagtgaggattgatcaatcaatcagagccttccctttctttttggcttttctttcctcatgcgttagacagcggtaaaggttcatctctgtagattctctacctgactatccgttacttcctccattttatattataagactttctagcattgttcatatttatatatatgttaatgaatctagccttatgatttgctgaactgtgaaggaaatcacttaagctcgtctccccagctcgtctcttcagctcccagatctgcacctgccgccgccagagctgaccggcggctaggacagcggcagcggcgggaggggggggcagaggatggtggaggatggcggcggtccgacagcaggaaggcgggtcggcaccggcagccctagaggctacggcggcggtggttcccgtcggtgccggcagccctagaggctgcggcggaggatgacggcggccctaggggatgcggcggtggctcccgtcggcggccctagaggctgcggcggcggctcccgtcggcggcctagaggttgcggcggcggctctcgttggcgctggcagccctaggggctgcgatggaggacaaaggcggcttccgacggtgccggcggcactaggggctatggcggcggctcccgtcggcgctggcggccctaggggctgcggcagctcgagacagtggcagtctgtgcactttgacggtggatgcctaggattcgggtgaagtgtaagtcaatcccgtaggttcgatcgtgtttggttggctagttccgactatacggcgaatgacgacggttgagagtggggccaacaagcggcgcgtgacgtcaactctcctgaaactgatgaagatggcacaaatggaggtttgcatcgacggcgcactaggggcggcggcgaccggtagacttccactcgtcaaatctaggcagagaagcaggatgtgtcgaggtcgtttggttttcttttcctttttggttctgttctcctctttgttgaggtgtgagtctaagtactcatatccttttggctgtgtatatccttcatggatatagagggccggattaataaaaatctattatctaaaaaaatgttaatgaatctagacatactatatacctagattcattaatatctatatgaatgtggacaatgctaaaaagttttatagcctgaaagggatgtagtaaataatttccaatggaatggtaaaaggaagccatccgaatgttataagattattaagagaaaaaagatacaataaacacaatggaaggttgttgaggttggttgtgcaatacagtgtacatccacgaaccgagtcaaccacacaagcacaaacccctaaaagggaaatatagcaccgaatcgaccgccgctatgtgtggtcgatcactgttggatctataacaataccatagatcaaagtctctaaatacgttgtcttgtaaaagttacaacgttaacgctgtcgttgtcgcccatctaaggaactggacgtagttttcatatagagtttctcgccaaaagagggagagaaaggtacatgtgaaaatcactgtagaatctaacctgagaaggtgacaaaaggtagattctgcttgttcaggaactgacgcacaatccggtagtttggtgctcttcttttgcagcctctgttccagtgttccgggcaggcagcagtacagcacaaacacaaacacgtttggataattgcagaaatgattcagggtttcctgcagaatcatgtcagttaggtgacacacaaacggctcgtcgttctctgtcaccgggggaccttgtgcagtgccgcagttgcgtcttgtgtgcatctctgaatattcattcagtcatcggaaggaagattcagacagaaaatgcagggctcacagcagatagcagcggatagcctgcccctgcctgctctgtgccaagaaagccacaggctagctactctcttcgccgctaaatgtaattatttccagcttatttagtagtaaagtttaatataaaagaaaaagatttcctttcagagtcatcaaatagtcaaaatcttaaatttcgaattacttagattccttctctaaacacctgattagtcaaaaatatttttgattcccatgcagtgaaaataacgttgtcccatagaaatactttatatcgtgtacaaaattttaatcctaaacactttttattttacaagggagtagtacgtagcaaagacagagaaacgcctagaaatcttccggctagcttcacaaaggtgatggcttatctggtataggtgaagtctcactcattaaatttatttgatattagatcattccctaatattcgccttccttttatgtatgtctagatttattaacatcaatataaatgtgagaaatgctagaatgatttacattatgaaacggaggaagtagcaatgatcaaccgtcagtgttagagcagccggccatgcaattaccgtgtgttgtgttgcgcccgagcgaacgatacggtggtggagtggaggacgtacgccgatgcaggatggaccagcattttcaagcgcaaacggcgacagccattggcattcgataaattcgatcgtggctaaccacactagagcaatagctgtggatatatctatataacattaacaggataggagatacgcgtgcgttccctccactcgcgcgggctgagcttagcttagctccccactcactcgccacttgctgcaattgcaatggctgctgctgctgctcgatgcgccggccatggcggcggcggcggcggcggcggtttcttactccggcgacggctgctcgccaccgcggcgttcctggcggcgtttgggctctgcactgctgctgctgatgacgctgccacggggagaggacaagggcatgatcatgtgatgctgagcgtggaggacatgttccctgactcgtcgtcgtcgtcgccgtcgtgcgacgcgccgccgcgaggtttgattcgttttgctcgccatggcatggcatggccacttcttgatcgagctctttccaagtctctgtctgtcatgtcagaatctcagtgtgagtgtgaggtgtgtctgctgctgttgcatttgcatatatcatgcattcattcatgcatggatagatgcttcagattgctctctgcatcagtgcttctttttctttttcttttcttggtttggtttggtttggttaatttgtttgcttattcaattgatctatcacccgtttgtttctggacttcaggtttctctggtttcagagctgcttttgtggttgttttgttgtgctttgaatttatatatacttacatacgagactggaaataattttgctgattccagtggattcacttacagctttgatattgcaaatgcttccaagtaagactctctctaaacaaaactaaataactgtagtaaatgtttctaaaataaaataaaaactaaatagatgtatgtaagactttgtgtcgttatctgctcaagtttttgtcttgtttgtccgttatcagaatactgtatcttccctgttttgtatggtacagtacacaacaagcgtaaggaaactgccatgaatttaaattgatggccacagtacacagggccatatacttgacagtgattttattacaaaaaaaaacaaatcacttttaaagattttgagtcggaattttttttggaagaccgaaagtatgacaaaaatggagctttggctctcacaggaaccccaaacatttgatactcgtaaaaaaaagggttaaatttgcattttaaaatatgttaggtgttaaaacaataaccctttttttaagtgcgagaaggacacacactcaaagcttgtgtgtcctaaaaacgctccaaaacataagaccttgcaaaacatggcacacacgtctgattttttccaccaaacaagcacacttgtatataaattttggtagataggcagatttacataaatctaaggatcggatatgtgcgtgaggaataagatgaaggcaatgatgtttctagagcataaatcaattaacaacgatggcacgttagtgaataaatgagtaacggttttgctagctatttgtggattatctaaacgtggtcaaaatacaaaattgtagctttcaaataactttattaacttttagcttgctctcttgggtttagctagctatatgcatgtgtttttatgttgctattgattatagggaaaattgcaaaaaccatctcataagtcaattgaagtttgacattttacccaataaatcactttgttgcaaatacttactcatctatttgttgcaaaaccacatgttttcataaagtgtgagccgtcaatgtattctttaccaaaattaaatattttcatagtatagtcttgacactttttttttgagattccacaaatagaattgctgatgagagcttaaatgttgatgcattgagtttctctatatgaacaaaaaaaagttcaatcaaacatgaaaaataagtgtaatgcaagcacttggagaagattgatttcgctaacttagcatgtggtgactctacatcagcgataatgggccaatttggttaagcacgtgcgcactgggtggtttttgcaataaaactgagtaggtgatgggtattagcaataaaataacttatgggatgaaatgttaaaattcaagtgacttatggggtggtttttgtaattttccctatagtctctttgttttactagcgaaccaaccgttcgttgttacaggaattagaaaaatcgcattggcatattacaaggaagaaatctattttttaattttagaattaaatttgagttttatttatctttttgtgttttagccataaaaatatttctagcggactacgttgacttcctgtcactaaataaatgctcctcccttcaaaacgttgcatcatagataatctatgaattctaccatatatgcgttttgtttgaggaggggcactgatttcacatatgttttggaggttaatggtgggtggtgaaagatgcaccaccgctcccttttataagaatatagatactggtaagtggtaaagaagttgaccattttttttgttagttaatttcaagcattatatgtttcaccctaataaaaagaggtacgtagtaaatatgtgagttgttttgtgttgacacttgatacaatatttcaaccaaaaagaaaggtgattgacaaataagttacccactcagtgaatagatgcatggtccaacaaatgtctagtttatatgagaggaacgtattttcaacgaagaaatccgggtctatcatattcctgatgaaaaatatgtaatactctgtccgtccctaaatataagggattttgaacggatgcgatatttcctagttatatgaatttagacaaggaatatattcaaattcgtattactaagaaatgtctcatctgcctaaaatctcttatattttgcgatggagggagtagttcactactgcacaaataaacaattataacctccctaaaaaaaaccctctcgtgctttggttgggccaagtgtactttttttttcatttatgctgcattattgttcagacacaactgaatgtactagaaaaatataaagagtaaaatccatcaccggtccctaaacttgtaccgttgtgtcatcccggttcctaaactcgcaaatcgaccgttcaggttctcaaacttgtttgactgtgttatcccggtccctaaacttgcatatcactcatttagatcctccaacttattcagttgtgtcaccccggtccctaaacttggatttgaatatcatctgggtcaaataggacggtttaaagactttatatttaaaaataattcataactttttcatgtgaactataatgaagacaaactttatatgaaacttgtagccctcgacgcgatctacaattttgttgttgaatttttttattttaagtcattttttcccaaaatgtaattttaaaattaaaatttcaaaatctataaacatgcaacaatattttgggaccctaaaaagtttaattcaaaaacttttcaactacaaagttctaggtcgcgtcgagggctacaattttgatataaaatttgtcttcattagagtgcacatgaaaaagttatgaattattttttaatataaagtttttagaccgtcctatttagggtccgggatgacacaactgaacaagttagaggacctaaacgagtgatctgcaagtttagggaccgggatgacacatgtcgaacaagtttgagaacctgaatagtcgatttgcgagtttagggaccgggatgacacagtggtacaagtttagagaccggtgatgaactttactctaagtaaaatatagacataaagtgatagaaaaaattctgaatttcattttctgaaataattccgattgatccaagctgaacatctccctggaaattcagatcacagacatgacgccacgtcatcaaccactaggatgacgatcgtccaccggcacggcccgtgctcgccgctagccgccgcgcacggcgagccgccgtcccacggcgagatcctcgccgccgaccagagccgcgccgagtcgatccaacaccgggtgtccaccaccaccaccggccgggtgaatccaaagcgcagacgccaccggcagcagcagccgccgtcggcgccggcgccggcggcgtcgctgtcgtcgtccaccgcgtcgctcccggcgtcgccggggcgcgcgctgggcacaggcaactacgtggtgaccgtgggcctcggcacgccggcgtcgcggtacacggtggtgttcgacaccggcagcgacacgacgtgggtgcagtgccagccgtgcgtggtggcgtgctacgagcagcgggagaagctgttcgacccggcgagctcgtccacctacgccaacgtctcctgcgccgcgccggcctgctccgacctcgacgtcagcggctgctccggcggccactgcctctacggcgtccagtacggcgacggctcgtactccattggcttcttcgccatggacaccctcaccctctcctcctacgacgccgtcaaggggttccggttcggctgcggcgagaggaacgacggcttgttcggcgaggcggcggggctcctcggcctcggccgcggcaagacgtcgctgccggtgcagacgtacggcaagtacggcggcgtgttcgcgcactgcctcccggcgaggtcgaccggcacggggtacctcgacttcggcgcgggctcgccgccggcgacgacgacgacgccgatgctgacgggcaacgggccgacgttctactacgtcggcatgacgggcatccgcgtcggcgggcggctgctgcccatcgcgccgtcggtgttcgccgccgccggcacgatcgtcgactccggcacggtgatcacgcgcctcccgccggcggcgtactcgtcgctccgctccgcgttcgccgccgccatggcggcgcgcgggtacaggaaggcggcggcggtgtcgctgctggacacgtgctacgacttcaccgggatgagccaggtggcgatcccgacggtgtcgctgctgttccagggcggcgcggcgctggacgtcgacgcgtcggggatcatgtacacggtgagcgcgtcgcaggtgtgcctcgcgttcgccggcaacgaggacggcggcgacgtcggcatcgtcgggaacacgcagctcaagacgttcggcgtcgcctacgacatcgggaagaaggtggtcggcttctcccccggagcttgctgatgaaatgtgccacgcgtcacccccagcaaacgtacacgtcagcacgcagaatgaattaactgtctgcactctgcagtgtaatgctgcaatccaccaggtggtcagcgactggttttattaccatgatttctgaagatatataatcatatgattacaaatatgctaatattattttctcttcttacatttatgatttgcttgaaagaagggaaaagcgaagattgatagaaaaaaaatatgtaaaacaaaatgagctattggcgcatgattaattgagtattaattattttaaatttaaaaaatagattaatatgatttttaaagtagcttttgtatatatatatttttaataaaaacgcaccgtttaggacgggggagtttttctccgaatccactgctgtagaacacaaacttgtggtccgatgatttctggcaagcccaaaaaaatcattagacgttttatgtaaccatctatactatgaataaatttgatcgggttaattggatcatgccattaaaatatactggttttgaaatatgatattagtattcgcatatctgaaaccataccattataattttccacatatttgagatataccactacttacccattggatgcatttttttttaaaaaaataaggaccaaactatccctttttccccttagtccttctcccttcttccatggcgtgacctgaccaccggcctcctcctgcacgtcatctccctccacctcggcccgccgctggcctcctcttgcatgccagcgtgtcccagatccagctgcctttcctcgctccgagctcccgcggtggacatcgccggcgacaggatttaggaatcaatggcggtggtggtcgctgagatcaatggcagtggtggcgccgccgttgcgtgagcagcacgacgacaacacaacgatctccctaacgttgaccgctgcccggagcctactctgtaggtcgccgtgcttggcaacgttggcgagcagcgccaccgacgcggtcgaggagccgatggcctcctcgtcgagcggcatgacaagcacccgtgccgccaggacgtcgtcgagcaagaccgacgacgctgacgaatcagcctgccacagcgaactacacgatcgccgtggcgagtgcgcgcgccacgccggccgacgcgaggcaccgccgatcctggttggactcccgcgcgaggcgcccgacctcgcacaccaccgcaccgcgcctcgccgcgtcacttgcccatgcagcggaccttggccaacacacgtcggtggcactgctgtagggaagagagaggtagaagatgagggtattttcgtctgatacatgcaaaatacgtatcttagtggcaccattgagattacatacaagtagcagtatcatcgttataaatacgtaaatagtattggtacatttcaaaaccggcaaatttttaatggcacgtatctaattaacccaatttgatatggtacaaaacattgattcttggttactggtacatattcatgttcttttattatttttcaacctatcaatatttgaacaatagagattcaatatgactataaaattatcattttttgtggtttcaacctaatgttcgacctgaattgattttatcagtaagaaactctccatctatcttaaaaaagaatccattcctaaatatgaatctaggtgccagtctatatttatttttttggattggacttttctaaagcaggagtaattcagttcatataaacaccgggtgcggtgatgagcgacgagcgacgagcgtggcggccagtgtgagaagggggcacggcggcggcgggaagaggcgatggcggcaagtccaaaggccggaggcggtgacgacagcgggaagaggcgatagcggcgagcccgcaggccagaggcgaggaggcggcagcgggagagggcgccggatctggatgggacggatccggtgaggcggtagggggttccgtcgtcatcgtcgtcgaccggcgagtgaaacaggagatagggtggtggccggcaaatgaggaggtgaggcggtggcccggagacttggcgatggccggcgaacaaggaggcgaggcggtggcctgaagacgaggcaacggtcggcgagcgaggaggccagcccggaggcggcggccggcgagaagagcgcgaatgacctttttttttatttttttcatttttctcctttcccccttctatttctttgtgatttcttatatttcctttaagattcttttgtttgtagtaattgatattttggtggttttgatgaatttgaagggggtatactcgtcgccttaaatgtaggggtgattgtatccactcatttatcctactcttcctaaccaaaaaaaatggatcactaaatccaccttcatccctacaaccaaataaaaataattggatcgccatattcactccaccaaacaaaaaactggatcgccatattcagtaaaatatggaccgccgtatcccatccaactttgactgtgaaccaaacgcaccctaaaacaaccaatctggatggtcctatgacatttaggttggatcttttttattgagggagtggttgggactagagctgtcaaaaaagcttgaggctcgactcatcctaggctcgattcaaactcggctcgacctccaaacgagccgagcccgagcctagctcgagcttccaacgagcctagtaatatattatttttattgttattcaataatttaggatatcaaatatattatttacatgcattgtattaacatcatatatttattttattctttttcctcttctattaatatgatgaactaggaacaatctcggtagtcaagcttgagcttcatctagctcaaaccaaatctatctgaaagctcgaacattttatgggctcgagtttcgagctcgctcattgacagccctagttagagcaagtttaataatataaccaactattgtttctaaatcatccatagtcaatttagtagccaattcatacacatatgtatcttggagtctgtgctccagctacagcaaatctgtagccaactactcttctgtctcctcttttatcttcttgctggtttatagtccgatattgtagtcatcttaggacgggaggtttttgtaaatcctatcttacaataaatttatcccccactaactccttaaacttaacatgcaaagatgccacatcatcattgacggagcgtggggctcctcaccgggagaccgagcaggcccccctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggatttacagagagccggagagccagagagttcaggctccagaaccccactcgccccctctctcctttttttttttggtgggcaaggtcctccttttatatctcaaggggatactacatgcaccacttctacctacttttcttctgggtggggacctactctatcttgaccaaaacttggcttgcaccttcgcctggaagctaaatcacaacttgtccttgagtgaggctcagcgccgtctctcgcctgacaccggggatctccctgttactccctcattaatgggcgaagatttgccatggctgctttccaaatgaccatccgacgagatgggtcatacctacctccactccaccggaggcagatgcatcgtgggagcacggttgtctgccgatgacgcgaccggcgtcagaccagtcacagaccggtcattcttgtccacaacgtgtcagttcagcatgctacacgtctgcccttcttcatacaatgacttccttgcaatggttgcgatgaagcctggaatgtatctggccggggctgacgtgccaactccaggagttcccacgccggctccggctagggacgagtgcctggaggccctcatcattcagacgggacggggcgaggcgtgtgtcaggccgcctgttgccacctaacccgcgatctgaccggtctgtgaccggtcacacactgtgacctgtcacggaccgaacgagtgtgctgcactgcattaaatgcggcgtggggcgctcgtccaacccgcaataaacgcggttaggtgagcgccgctgtgctcacctaacccacacacgtggcgccaaacccacagggggccggggcgccccagccctcggggccgaaacgggagcggcccgacccctcggggagacagagggaggggcggccacatcaccctcgggcccgacccccccgagggggtcaggccacgtgggtgactgcagctgccccaaacctctagtcaagataccctcggtcccatgtcaccgacaatcatccactaacaagatgccacatcatcatccactaattaataagatgccacatcatcatccactaattaacaagatgccacatcatcatccactaacaataatcacatttaaacatcatgcaaacatgctatatctttatagtttttataatttaagagcttttcaaatacaatcatgttaaattattatccaacataattcacataatgttttaatgtatatctttattatattttatgatatcctatctacttatatagcttatcctcacttagttagtgcttaaatgattaatctatggtccaaattatatttctcattttttcctctaattaagtcatatcacatcaattgtttttagcctttagatgattaatctacggtccaaactatctccctacttttcttcttccgtaaattcataccaccttacattttacgtttgaatcaccattctacatactatttaaatttaaattatcataaatcatattaatttacttaatctgatattatctagctattttacatgttattttttcattgttatcgtactaaatttccgaaacagggtttaacttagttccaagaaaaatggaagcctagcaagcggccactgtttcctcagttgtcaccagacgtctgactcttatgagttctgacacagcgagaccgggacgcatagccctctctcactgaaagtgggcccggataggggacagctctccagaacccaagtgcactgcaacccctgcaaagaccctagtactagtactactctactaccgagtaccgacaaacatacgctccgtaggaatgccaccggaagtactcctacgccctaactttacgtataccgtatcttgtcagagaaaaaaacggacggcccagatgcactgcacgcgccacaccggtcccaaaccttcccaacgcgcgcggcgcatcggacggccaggattcgccgcggatggaccaccgtccgatcttactccccaccctgtcgctgtgtgcctctctctctctctctcccgtgtctctcgccgcggcgtcctccggccaccaccccgcgccgcgccgccgtctacggatccccgctcctcgctcgagcgagcacgaaagccctagcgcgccgccccctgcaccgggtgggttccccaggtgagcactccattcgcgccgcggcgccctctctctctctcgttttgttcccacggatttctgcgggggatctcgttcttgggtggaaatgggaggagggggttggggttctagttcgtttcgaggtggttgttgacttgttgtggcggattgggtgggttttgggagggttttgtgtaggattggggggggggtgaggtgaggttaggttggtggcgattcttgatttgttcttgcgcggcggcgatcgggctgggttgcgtctgtcctctcctaggttttttttttctctttttcgctcgtgtagttggattctttggtgggttcttagcggaagtttactgttttttgacggagcggtccgcaggaatgggggccaatgttttgattttggggtatctctgcacgccctaaaaacaaaagagatttgaagggagagacttccctccaaacatttttttaagaagaaattgtgagcgttgttggggattgaacacatctttgtagcgagatgtcggcttttatgttgaaagtctgaatggtacatttttttgtatgagcatacatggtttattgtggggaagtataagtgtgtttctagtatatgtttcttttttatttcaccattctgatttaggtggtatggtggatggatttttttgctacccttatagggtcttaaatgactattccgtagaagaaagttaagttttttttttccatatacttttgtttgtctctttatttaggttttttttttggggggtgggggggggctctactagggagtttagttcatataactgttggtgcactagttcctcatttatgaaggaactgctgaatttcatcctttcaggtgtgggcacctatatgtgcgttatattttactttatcgcaatttatttatcaaccagcattgactttgattcagagatcatgtcggctttgcaggtttacttgtttttatttttaaaaataatccaagggttttcagaatataaataattgaatacggtcaaatgtgcagctaactaattatcatgaaatgccatcaatatgtttaaagacttacatagttacgtttagcaggttgttgagctagaatgggagtggcagggcacaatgatcctttgataggtgaaacgacatgtggatctttgctgcagcaacttcaggtgcctttgtctcttccaatgttcttttgtatgtgtgctttataatgactggaactaaggatagcagcaagccattttagttccctatctacaccatagcatctgtgcaacgaaaagttatatgagtagtgcataggattggacaagtgactgactagtgtcatttcagttgatatgggatgaggttggtgaaagcgatgaagaccgtgacaagatgttacttcagctagaacaagaatgcttggatgtttacaggagaaaggttgatcaggcatctaattccagggcacgcctccttcaacagcttgctaacgccaagtctgagctttctagactcctttgtgcactaggcgagctgtctatttctggcattgtaagtatcttgataaatattttcatgaatataattccttattttccccaaaagtacacacacacctacaatatgctgcatctggctcattactgctgacttttgcagcctgacaagacaaccggtactatcaaggagcaactagaagcaatatcacctttcttggagaaactctgcagggaaaaagataagagggttagagagtttgctggtgtacaacttcaaattcaaactatacgtggtgaaatcgctgggagtctgcaagttggtgaccacatggaaacaccccgtgttaatgaggatgatctttcaacgaagaaattaaatgaatttctttctgaattgcaagctctacaaaaggaaaaggttggcactttgtttttcattttcacaatctgccaactgcctttttctggacctgcttatggaataatcttccaaatttcatagcccaaccatgctaaagagattctttgttttgcataataaataataatttcacataatatctgctggtcaaattctcttgataagcattgtataacatcaaacatccctatgatggatgatctctaaattttgacgtaccatattagtaccacagaagcaggcatacggccactgatatagctgatgataatctttgcattatacacacattttcgactatttaaaatttattgacttgaaatcgtatttctttccattttcttgcattgcagagcaatagactgcacaagattcttgacttcgtgagttcagtgcatgatctctgttctgtccttgggatggatttcctgagcactgttactgaagttcatcctagtctcaatgactcggttggtgccgagttcaagagcattagtgacgcaacattatccaagctgtctaagatggtaattcaacttaaagaagagaaatcaaagagacttgaaagggtaattctacaacgagcctcttgttcttactcatccaaccctttttgtatctctgtaacatagtacatcctggatattatttatgattaaatgctatgtttctcagattcaagctctagcttcccagctaactgatctttggaacctaatggacacctctgctgatgagcgacaactttttgaccatgtcacatgcaacatttcctcaacattggatgaagtaacagcaccaggagctcttgatattgatttgatcgaacaggttaggagattttcttctcaaagtgctcctaggagaatagcataatattttgtctgacatgttttgcgctccaaaggctgaacttgaagttgaaaggctggatcagctcaaagctagtaggatgaaggatattgcgttcaaaaggcagactgaacttgaagatatatatgcccaggctcacattacgatagataccagtgctgcaagagatagaatactgactgttattgattctagtatcttcgagccttcggaacta

SEQ ID NO: 76937 - DNA, 702 bp, Oryza sativa
attaccgcggggccgatgttgacattaggcacttcctttaagagttttaagtggttcgggcactcttaccgtggtggatatcgaggtcaggttcaccccgggtcatcaggtcaatgcaatataagatagtcggattctctatacttcatcaaggtagcttaggttcagggtaaagcttgagagcgtgttggggccagtgagtccagagaactctattagtgcccgttgaaagttgccaataggtgtcggtattctgtctgacaacaattggtcggcacatatgggggttttccgtcagacaccaattgggcggcacttatgcctggggctggcccctataggttacatagtcccggcacttttatgtctgctcgagccaaaaaaaattcccccggctctatccgagctgaatccagaaccatacacatccttacatccaaaagtaggatcctgacgtccaaaatcaagatcctagtcacacatcaataccgttcaccaatgcatggaggagctcccgatttcacccaagaatatcaagatctctatgagcatcaagagctcaagaacatgagcatcatcaaggcatccacacagcctcatacaggtacacgttgacacgctgtggccgccgccgcacgccgctgcctccccgtcccgctgccgcatgccgggcacccgtatctggcagagggtaggtctcga

SEQ ID NO: 76938 - DNA, 39599 bp, Oryza sativa
cactgcctgccttagacctatgctacatctggcataatatgacatggaaaattaattctattcctaatctgacttttgggttcatctgtgactgttacgagtgtagtcattgttgatacactgatggcaaagacccgggcatgggaacaagagcatggtatgccgttcagctatgacggtgttcatcttctcgcaatgctggatgagtacaaagtactaaggcagcagaaggaagaagagaagcgacgaatgagggtacccttctgtccaatccccattaatctttcgcatgtctggctctaaaaccatatctcattccatttgctttcttccaaaactcatttcaggaccagaagaagataaacgaccagctagctgcagagcaggagaagctcttcggctcgaaaccgagcccagcccggccccaatcctcaaggaaggcgcctggcccgcgggccaacggtggcgcagtcaatggcacaccgaaccggaggctctcggcccaccagaacggcggcggcaggtcggtgagccgggacgggcggagggacagtggccggccggctgctccggtgaactacgtcgccatctgcaaggaagagtccagcaacaacaacccggcggcgtcctccccctgacgatcatcctcgccatgattgaccgtacatttcttggtgccagtggtagagagatactccatatctgtgcagtagcaggaaaaaaagaaaaactatagcaagatactagtaggacaagtgattcgaatgatagtagcagtattttggctgtatttgaatcgatttgttgctgtccatttgctggtagtggatcgaatggatcgagtgggtgcagccgtgcaggtgcatccgccatggaagctgagctcatgtcgtcgtgtcccgttggagtttctttcgcctgtcactgtcggttgttgggcttgagcttggcgggacggcgaaaaacgcaatccgtcagttacagtggttatcgcttgaatttcgtcgaatcctatcaaagtttaccgagctgttatcggcagttttgcggttactgggctatcagctgttaggctatgaatttaaatttgaaaatttcatgccagtaatccaaaatttcaagttttggatgatgtatatcaattccgtacattatttaagcactaataacaacttggagtagattacaacgcgacatacatgcaacagcagcgaaacattcgtcagtctttcagacttccgcactcaatcaccaatcacttcatcggtttaggaggtggtttctcgttttggatggataatcaactaaaacaaagcaatcaaaagaagaaaaaaaaggggccaaatttcatagcaatttgattacacaacacagcacagcaattcggtggaggctccacgcaaattgaagaagcatatgtacatcatcgatctgctccttccccggtcagcttttgtctcagtaatccgtcggtggttggttgccgtcgtaggcctccgccgcggcttcttccctctcctgctcctgatctcgccggtgcaccttcttgctcaccttgatccagattgcaaaatgttatagcatcggtgagtggaggagagatttttgcaaagattttgattcttggttgtaaaatgtttcatcagtggagggatttgcaaggattgattgattgatttaccttgtgtgatcttgcgtggaggcggtggtcggaggaagccaccttccggcgaggcaggctccggccgccgcccctgaggcggctcttgctgccgggcttgtagcagctgaggctgccgctggagccgtcgaagctgacgacggacacgtcgttggacccgcagctctccttctcctcgccggcgccggcgccgaggtcgtgccgccgccgcaccacgatcacccgccgccctccggccgccgccgccgtcgagccagcgtccgccgcgttcttgctcatgcagtcgtcggccgacgcctccgacgacgcctgccgcgtcgccatccaccgctccagccagctccaccccacgttgtactccgcctggtccgaccgcgccgcccgcttcttcgtcgtcccgccgccgccgccgccgcagctccgcagctgctgcgagaacgcgtaggccagcgcgcgctcccgccgcgtcgtcgcctcgatcctgctctgcatccgcatcctcgacacgttcgagctcaccgtgctgtcgtcccactcctcctgccacgcacgcatcatcatcagttcatcacatccaaaatctcgcgacacaactcgccgatcacatcactgttccatcatcggttgcagagatttgatcgagatcgaagtctacattgcattgcggacatgttcttgcatggtctgtatataccttcactctgaacgcctgtggccgcgaccgctggctgctccggtgctgcgccgacgtcgccgcggcggcggcgctgtcgtcgctgaggcggaggttgctcagcgactcgccgacctggacctccaccgacgccgcgatggacgccgtagtagggctcctcggctcgtcggtggtgcagcagccgttttctgagcatttgagcttctgcaactgcctcctcgcctgcaacaccagtggatctgcatgatcgatcttttttttctaacctccaatttttgaatttggatcaagaacgcaccatgaatcccctgaacacggattggatcatcgtcgccgcttcgacttggctgtcggtggccggctcggccgccgtcggaggcgcgatgtctttgatggggatgctcatgctcccatgttcttcagggtggccgccggcgtcggcgacgccatccacgccattcgccggtcgagcaaccgtcagcgccgccgcctgcggttcctgcggcattgcgcaggtctcgaagctcttgacggagaccgtcccatcatcgtcgtcgtcgttctcgtcctcggcggccgcgctgatctcgtcgccgcagaggtagagccggagagagctccatctcctcttgtgatcagcagagcccctctcctgcaaaccaaaaatcagaacaatcttcttcactcgattaatcaaactccattttctgttcagattgtttatgtcgcaggcaggcaaaagcatctgcaattgtgaagatccatgaaccgaggtgccacgacaaagtacagaatcgaaagtacattggcctcatcgccggttactgattggtgtaccgagagatcttcactttttctcgtactgaacctgaacccgaacccaacaccgactgcacagttgcactgcaccaccacaaacgtatgccctacacaaaaacagtggacgcaacaccaaaagagcacctacattgtggcaaccacggccgccaccgccggccgacgagcaggggctcttggagaagactcgccggacaatgccgccggcgaggcccatccccaccgtcgccggaacagaagaaaagcctctctcaactatctaggactaggaggcttcacatgtcagtgtagtagaacgacggcgatcttggttggcatcgccatgagccggcggtgctgagctagctgagctctcactccacagtgatggctggcgcgcgcaggcgaggctgcaatggctggcttccccttatagtagcaagggagaggccaacgaccgtgcagtggtggtggtggctaaaatccacaagaccaccagaaccagtttggcttgggttaaaataaaaagaaaggcggtgtgcgagatgcgctttggtgcaagtagtaagctttgtgtaaaggcgccggtggcgggaggcatctcattggtggatccatggaggaaatgtggagtacactgcacaactgtggtggcactaatgatttagagcgagagtgaggaagaggacccatgtgttaggttattttttggtctggcagaggaggggactttagagctggaggctggaggagttgggcacttgggcatcttgttttttacactgttggtggaaggagtgtgggggaaaaaaatggtgtgctgctaggctcacagtcacacacagctgggattgtttttgttgcaacaaggtattgtgttgaaggtttcctagtcttattgtagtaatctgtttatatttttggggtaatgtaagtttcacctttttacaagccaagtctaatgcatttttactgtgttactacagtgagaaaagtgaaaaaaaaagagagaaaaaaaggatagcactaagggcaattttgaaggatgagtagaggttatcttttagtgtcctcttgtcaataaaagagagcactaaagacaacgcatacaagaaagccaagcatggctcaattggctagtttgttgtggaggaaaaagttggcatccatggattggatcgaacctatgtgcctcactggaaattttttccctagctccatgatctttgcctttgcccaaggggttaacctcaagtagatgtattcagtgtgaatgtgtgtttccatacattggagccctacacttcgtgtgaagtgagtatggtgttgtgtccttgtgcgcatcgtgttcattcttggctacccttaaaaaaaattttgtgtcatggtcgacacatttcgttcattaccttatctctcatccacctcaaccattctcaagattatgacgatggctgaggtgttctattacgttggtgtggttgtccacaagtagacatcccattagttggttgattgggtgctagggcagccgtactgtacatagtacagattttggttgttagaccagactgcagtgtgtcggcgagagatagcagtggtttactggcttgtgtgagcttagcatttcgagagggaaaaaaatgtcagcaggaaagaatgttggaagggtccggaaataaaggttctagacgtgcacccttttttttttttactgaagggtcacatggcttgcttcatcccagcctaaaatgttggttttgcttgctcttgggtgtaagcatcatattcctcccctcaactttctaattccacgccaatccttatcctcacttgttaatcttccctaactatactttgtcagatgccactttttcatcatttctattcgcaagtaataaatactactctttcgggtgtgttcggcagctattttttggctgcagctgtagctgtggctagggctatttggctgtgcgccgcagccgcatacacgcagtgcagcagcagcagctgttagaaacttgcagccgaacacacccttcatctcagaatatagcttagttctaaaatttttagaacagactaaggattatgatgaaaagactaaaatgctcttcaccaatggtggtcgtttcgagagggtgctggggatgagtggaaaagaagtgtattataggccttgcaccactaaaaacaccccatagtatattctaggataaaatttgaacgttagaaatagttatattttgagattaggaattagttattatcccatataaataacaccccatagtatattctaggacaaaatttgaacgttagaaatagttatattttaggatggaagaattagttattatcccatataaataacaaacatcatataaaaaaaaatcctcactaatttcccctggcccctctctctccacaacaaagtttgtgagcacgtgcttaacagattttagtggctcgctaaagacatttgaccatcacctgagtgtgcatatcttgcgaaaacggtacacataacaaataaacaaagcacgtcaggttcggtacccagctaacgctaggtttccgcatcaaggcccacaaagaaaccgtcctgagaggcgacacaagtactgtgccggtctccatttcccaacggcaatggtgcaagccgtgtcgactggcctttctggcctatcatggtagaaaccccatgccgacacgatttgcacacagtgacacagggaatcaccacgtacggaagctcatgagatcactagctcaagtaggtattatgtgagaataacatgcaaacacttgcacgagccaatgaaccatcaccccaaaagaacaaattattaacaaggcaagcctattgacataaagatgtaactatcaaatcatcctggctgctttagttcagtatcatcatagaacaaaccaagcaagcaaagcctaattaaccgcagtattttattcgtactacagtgaagaatttttttaatctgtgcaaaaagggtcagaggtaaaatactttaggagcattatttttttactctgatgcaatgtctgcccgcacatgttaaacaaagcttcaaggtctcaaattcatagctacatgtacttaaatgcgtgcaaatgcaatgcgactgctgattgctgtggaagtgtcggttcatccaccagcacaacagcatggcctcagatcaagatctgttgaaggtggaaatttcgacctgttctaaatttatgggtttaagtaggggaccgaaaatagaggggcagagctcttaccggtttgactccgcttcatccaattctggcagatggaatttcctcgtggcgcgcctaagatcaatcaatccagcacatatggtaataccggctgatcaaatggagaaaaccaaatgacaaaaacaggttagcgtgtaaaagagcatgggaatgtaggattacaggtaaaagttacaattgtggtagcaggagaaccaagggtaaacctaggagaagtctaacagatggaagcatgcactcctgcaccaagatggcaagatctaagatgaaggtatgaagcatcattgacataggtaggccagacgtgtgtctccactgtttcttcaagtaccaacatgccaatcaacagataaaaggaaatggcaatcggagatcttggggaaaatccattaaggccaactgcatctgaatatgattacatgaatacttccaaggctagatcttgcaagacagtatcattgtcattgttagtacgtactaccaacagatcctcttgttattgtgctacatcatttggtcacaggattcacagccacgcaacgagagagtgtcatatcaaattatcaacatcatccactactccttagtcaaatatgttgagtataagctccttatcagcaattcggtagtggattgtgatcaggtcaagctcacaacagatttcccttaaaaggttattttgttgaccatgagccaaatatcaactccttgatggtttcatggatcctgacaagaaacaagtaattcagataggtacccctgaacttacaaatatcatcattagcaattaagtgtggaaatcatgagatgagcacgtgctaaaccaagaaatgagtgtatagtatggacatctacatcatgtcatatcagtgtctaaggagaaaaaaaaacagatgtcctatttgtgtcataaagcaagtgaatggagaaaaactgtgatccttaatattcggcacaaaagggaattatgtactaattgttgcaacaaccaataatgtttggttccatgagaataaaagaaacgattgaaagaactggccaatatatccctgttatcaagacaaacatatgccatggaacatagtagtatataaagctatcctaaaaatacaccaaaaggtctttgcaacggggtaactaaaactagttaacttagcctcacatttttaaatagctttggatcctaagacatcaaatttcttcgcaactgttatgctaaatacctgtaattcaggctagtatttcagattgataaggccagaaaaaagggaaacataaaaaacagatcatcaagccaagtacagcaatacttacccgtggaagaagccaatagttgtggacagcttgtctgacagttccatctccatggtagttgaggtcatcctgtcctagcctaccacatctacaaagtctatggtgttggaccagcattaaccaacgctgtaaactggattatactgttttttctgaggtgattattcctgtttcctaccaattgatgggatgaattttgcactgtgcaagctggtgtcagttttcagtggcagatcatgcaggaccttttcttagagtaatacatgatagtattcatccaggctcccagcagttcagatttcagaaatggcacatgaatattaactcagagctcagaatcactaagaaaagcaaaaccatgaaaactatacaggctgtcttattctctatccatctcattggaaactaagcagaaccgtgaaaattatatggactgtcctaagaaatatccatctcaatagaagttacaagttccgaaacttcctcattactattgcatacatgcagtttgcttctgttagcatcaacccaactcattccaggttcctttttcacctttctcgattccatcagccttctaatctctaaagcatcttcccatcgtcctactgttctgtacacattttcaagaagaatgtagctcaaatgatactgcggttccaattccatcattttctttgaaaccctttctgctacatctgggttagaatgtgttgcagaagcaccaaggatatcggcccacaaagaagaatcattcctaaaaggtgacttgtttatcaaatcttcagcctcttcaagaagctctactctgctgaaaaggtcaaccatacaattgtagtgttcaattccaggggcaatgccatagtccttgcacatagagttaaagtagtttcttccttgctcaaccattccagtatgactacaggcaaaaagaacaccaataaaactgatatagtcaggcctgggcccttccctgaccatccgattgaacaaattgatagctcgttcaccatggccattctgcgcgaaaccacctatcatggcattccaagtaattgtgttacggacagtgcttgcttcaaaaacactatatgcatagtccactgcgccacattttgcatataggtccacaagtgcagattcaacaaccacatctctccaccctgccatcctcagaaaccgacaatggatctctttacctggctttactgaagataggccagcacatgcccgcagaacagtccccaagctataccagtcaccgtcctccttatccatctccctgaacaatgcaatgaccttctcgtactccccattctggcaataccctccgagcagcgcgcaccgtgaaacttcattcctaacttgcatcctgtcaaacaccttgcgagcctccaccatcaacccacacttggcgtacatgtccagcgtactgctttccacgatcacattcccacacagaccacgggtcaccacctgagcatgtgcctgcctcccctgactccccctcttcgagttccccagtgctgtcatcatcgaaccaaaagtgcagccatctggcctaaccccattcatcattagcatagatcggaaccacctcacggcctcctcaaaccaatcattccgcacaaatgcggatatcaacgacgtgtagcatatcccgtccggtgcacgcatttcctcgaacaccttccgcgcgtcaccgggcgcggccacatgaccgtacatgtcgaccagagagcttagcacgacgccatcgtcgccgaatccccgaacgaggacgctcccgtggaggcacgcgccggcattgcggtcccggagcacggcgcaggccttgacggcggcggagagcgcgtgggcgttgggcgagacgtcgtcgtcggcgccggcgagcatgtccctgagggaggcgagcgcgcggcggggcatccccgcgcggaggaacgcggcgaggatcgacgagtgcgcgacgacgtcgcggcggggcaggtcgtcgaacgccctgagcgcgtgcgggaggtggcgcgggaggcggacgtagaaggcgaggagggcgttggcgaggtaccggtccgcgaggaggcccgcccgggccgcgcggccgtggaggcagcagccgaggcgcggtggcgggtggcggaggagcacggcggcgagggagaccggggacggggaggaggaggaggagggccccgctcctgccgccgccaggcgcgccgcggccgcgaggtccccggagtcaaggaggcggaggacggcgaggtgcgccggcgcggacgggggcatcgtggcccgaggatgccgcggcgcgggcgcgagagtggcgcgccgcgcgcgccgtcgccccttctccgagtccgagcttggcgtcgcgtcgaatgcccgtgtgcgcaaagggtttcctttccgtgaggagacctttttgtggcggcccatgggccatgtttgcacttagcccacgtcttccctcttttttgtaaggcccaagcccgttggattttcggcccacatcacccgttaaacaatggtaatttttagcaaaaggcgaagttattgtaagccactttagcatgaagaattcaatttctaagattatcaaatgaagcatcccatgataatcatcacatagtatataagtaagattgtaacattaggtaaaacatcataatggtgtttgaaatagcttcgtagatagtactgcaagaacgctaatgatcccttttactagtaaacacgagtacacaacatagttgacactaagacgcgtatatatcaacgttactatagttaacttcatcgaattacttaaacttaatgactttagcagattaactgccttattaattaacttagctactactataacgataatatgcatattgtgcgtgcaaagcatttcgacaagtactaagataacaaaggacacgtacgtacgcgcgtgcacaccatacgataaaaaacccaagcgatctactcctcatgaaccttgctcttctcacacgcatcctcctccttgtcctccggcgcttcctcctcctcgccggccgccgccgccgccgcctccgccgtctcctgatgctcagcagccaccggcgcagcgacgacgacatcctcgtgagcctgatcatcgtcgtcgtcgtcgttgacggggacgatcgccgccttggacgccgctttctcggtcgtcttctttgcctgcacacggcgtcgtcctcctcctccttcttcctcgggctccgcctccttcgcgtcagcagcagcaggaggggtctcgacggcgagcttggcttctacctcatgcgcgatatcatggccgccgccgtcgccgtcgccgtcgccgtctgcggtgtcgtcaacgacgacggtgatggcggcggcttcctgctccttggtgatcacgacgatctcctgttccttggagttggggccgccattgttgtgcagctcgtcctctgcaactgcaagaggtgctccttcttcttcctctcctgctaccttggtgttgggcgtgtcgtggacgtcgcggccgttgttgtcgtcgtgcacggcggctgctggaaccacttgctgaacctacacatcgacaggaaattaggagatggaatttcacgtgattttgctagggacatttcaatcagtggcggacacacccgttgggcagggtgagtcggccggcccaactatggtccgtgtcgccccacacccctaaacctcattttagtcctatttctaacatattagtcatcagtatactgttgaattaataatcagataaatcaagtattttaagtagggacaaaaacttttatgaaaattcgtgtataagtaataccattgtgaccgtttatgattttggccatacataaaatttaattttctttctatttctttagcatataatacagtcaacagtaaatagttaaattggtaaatatataaaaaaatccattttactcacttgaactattttggcgaagcacttaaacccctaaataatttttcatcttgtttcatacccccaaactattgaaattggttccctttgttgtctaaccacatttctcattttttttcatctctctacatacaagtcatatacgtttgttcgactacccatattcgttgttaactttctcgatgttcgtgccatacgctattgcgccaatgtcgtgaaccattgactatggtttgtgtgcgttgtgctatcacttaattagggctagctctgttgccccatctatattttaaagctgcttctgccacttatttcaattccggcattaacagaggccggtgttgacgtgttgttctcttacagagttctggccggataactgttctaatttcttctcactagttaactgagtaatataccccttttccttttttcccgaaaagattttttttcatgttccaaataatgacctaatttaaagacaaaacaggtatgatacatctagcttttttgactgacatatatatgttcgtgattggcacgcatgtaatatcatgtatgctgattgctgacagtaaaaaggaaaatttagggaagagatattcaaacctcagcggttgccattgtgcagctgcaaaatttagtgctaatgtgtgtgaggaacaagagcagtaggtcgaagtaggctagctggctaagattgctctgatacgcaaagtgcatttgccacggttcccttttatagctggtgagagggcgatgaggaagtactaaattaggctcccaaatgatggatcaatcaataatcgatcaaagagctgatctagttagctagagagatcagctcatgacttgttggatcgatcgagtttgggaggaggagatcagaggagttgggatgatgaacgcctgctgcctctgtctcactgatggcactgaggtcaagtcccgaatgccgggaggtgtgtcctgccaggaggcgacatggggatccaactcgggatcagattcagatcatatattcagatcggagccgccattcagacgccacgtactacatacctgcctactcacccatctcggcgaggccacagctgcatgccggcgtcgatccgatgcgcatgatgcaccggcgcgccattttgaggccggcctcgtgctacgcggtgtcgggaatgtacgaggcagctagcgcctttcgttggctctcccaacccaatgcacatgccaggacgtcgtcgtcgtcgatcgcctacctctccgcccgcacaccgccgccgctttgggcaattggcagccgcgcgaggatactgccgtgcagggctaaatatttcgattttggcatttgtatcgggtgtgccgatatactgaaattttaaaaatttcggtccgaaattatttgaatgttaaacaaaatctatcaaatttgaataaaagattaccaaattaacaaataaagaattagacatttcagccgaaatgatatcgtattggaggtccgatagaaccaaaatttcggaaatctcgctctggaatttcgaaccatactgccatgtcgccccacgcccttgtacgggccaggaacaggtggacctccaatagaagagaacagaaataaagattttaggtgcattggaaatttcggaaaactttggcccggagtttttgatattttttttcttaacaagctttggcaagcttgaataagttgtgctaagtagaaaaacacaaaacatagcttttcggtcaaaatatttccccattttctttgttaaatttgggtcaccttgaataagtttcgccaagtaggaaaacacacagacacacgaagattttttttttatcgaaatagtttcccaatttacctccaaatattcagtcgcttatggctcagattgtatcaagatttatatatcacatgaatcttacctttctctagcccctctcctccccacaacacatgtgaggcgagccccctctccgcctgtggccccactaacactggtgaggccttcacaaataaatcttttgtcttttcatgatgtctacttgtggtaagaacttcaccaaatccattagatttagatcatgccaagtattcttttgaaaaaaacttcagagctctttcgaattatcgaatgaaccttatggctcagattgtatcaagatttaatatatcacatgaaccttacctttctctagcccctctcttcggtttcttcggtttaccagaatctcggtttctcaaaactggcagccaaattacccttttaaaaaataaaaaccgaggaaaatcgagaatgcttgatgtcaggcgcccagcgcggggggagccggatcgggcgctccccccgtgcccctccctccacgggcctatacagggcccactcacttctctctccccttttttcacaaaaatgtttcatctattgtatttgcaatgtttcactatttataaatctaatgttgcagtgaattaaaatactcttttgcaacaaaaaacctacatattttagaaactctctattacgggaatttggtttattttttgttccaccaaaaatgtttcacccactgtactcacaatgtttcattatgtatagatctaatgttgcagtgaacgaaacattctattgcaacaaaaaacccacatattttggaaaccccctattaagggaatttggtttattttttgtttaaccgaaaaatgtttcacccagtgtactcacaatgtttcactatgtatagatctaatgttgcagtgaattgaaacattctttcgttatttactaaaacattgtttttatataaggtgaaacaacacccgatttaaacgagtgaaacattttcaatctacttagtgaaacaattccaatatacctagtggaacattgtgcaaacaattttaaaataatacaataataagctaaaaaaaattcgtcggaatatatccatgtgtggtcttgttttgaagatttaattgtaacgagtttaatggtacaatcggattatgatttggacaaataatttaagaaaaaaatcagtttaaaataattttgcacgtaaatcgggcgctgacgtcaatttttgaagttttcgatcggatgaccgatccctagtcactcccgaggaaaataaaccaaaaacaattcgatgcggtttattcggttaccggtatacaccgaagttgattttgatccattcatcagttcatatcgcactaggagatttagccaggaagcaacaacagtgacgttgttcgtgaacgtagtccttcccatggcaataccaatacatggcttaattgccatcggacaacaaaaagaaaaagaaatcaacagcaaagactagaaacgccaaatcaaagactactcaaagcatgtgcttgccggtgagattgctcgatcgccaagacttctgtcccaagcagtggtatccatctgattaattagagccgccgcggtgattcactggtggagactggagaccaacggggatgcttcgtatcatacgagtcgtcgtatgcaacgagcgcgttcggcacttcgtcgctgatacgcgatcagccgcgcgcgcgcggaggcgcgcggtcagtcaccccctctagtctctcctaggtacggtatacatcttttgtgtgtgtgtacgaatatattttaatgcataaaaaatatatacacacatacacaaagtttgtatgcgcgtatagaaagttctatacgtacgaatacaaacttggtatatatgcgaatacaaactttgtatttatacatcttaaaaaaaaagagaaaaaaccgaaagaagataaaccgggaaaaaacaaaccgaccagaaaaaaccggagaaaaaaatccaaacagaaaagaaaaaaccggagaaaaaaacaaaacaaacataaacgaaaaaaaagggaaaaaacaaaaaaaaacgaaaaactcgctcgcggcgcgtcgccgccccctctccgcgcgcgacacgtgtccagtcgcgtggggagggaggcgcgcgactgatcgcccaatagcaatctcgccatggccagtgcggcagtgcgtctagcggcgcaagggttaggagcaacaggggtaagagtggagtaacaaaggactggatggataaggtaaagttgggccttatgagtgtatgttgggccatgggttcacaggagaaaacaaatgagtacttgtctgctcggttttggtgtgtacggttttcggccttcggtttttgaccttaaaaaaaagagaaaatcaaaggccgaaaaaaccgataatttggtgtggttcggccttcaattttaggtattttttcccacccctattccccacaacacgtgtgaggcgagctcctcacaaagcactgccacctccgcctccccgatcgagcgctccacctgtggtcccactaacactgctaaggctttcacaaaataaaccttttgtctttttatgatgtctacttgtggcaagaacttcaccaaaaccattagatttagatcatgccaagtattcttttgaaaaaacttcagagctctttcgaattatcgaattcgaaatggatgaacaagaaaaacatataaatagattgccacattttttttagataatgaatagattaccacatgctatggctatgcatgtactacatgattttaaaacaaagaaatacaagaaataatgtttgaatgattcaccggcctgtggaaacagagagaagaaatctagggaattgaacgttggacttatagcaaagaaaagtaaaataagaggcatgagctcacgctagaattattgtagaatgaggatacaggaaagcaattattaggcctgttcctttattcgaaaggatgtcatacggtttttgcagaagattttagtccttcgaaaatcctatgtttttcctctgttctaaagagccctcaaaatgtggcaaattaatgtgaaaaatctttggcagttatgatcaccatcagacagcattgctgtgtttctacctgcctgacaaagtgaccaccatcatggtgtgttaactaactgctagcccctgctagaagttggcagtgtgtgagacaatctagccatgaaagaaggttaaaaacccataaaaacttggggatcatggcaagagcagtagcctaacaaacactagtattcaatcacccagttccaagaatgcgttacagggaaggccatcataatgcatgacaagttcctcaccggccttgcaaatatatattactagctgttagctagattagccctgttaattagatgctcatataaatatggtgaaacctgcatgcagaaacctttgcttctcagttttgacacacaaacagtatgacacctctgttacaaattaccatgtcttctctgatcatcactagctggtggtggctacaggctacttgtactgctcgccaattagtcttcgatgtcagagacttcggcgctgtcgccgacggacagacagataattccaaggtaattaatcgctgcaacttggttactaatttgctcaaattgttcaaatcaaatctgaattgtcaacattttgaaagatttcattaattttgtgttttttttttgtgtaggcgtttgagagggcgtgggcgaaggcgtgcgcggcgccggggagggcggcggtcgtcgtgcccgccgccggcggcggcggcggtggcggcggtggctacctgctccacccggtggtgttccggggaccctgcaaggggttcgtcgaggtgcgggtcgccggcgtcgtccgcgcgccggccggcctcgacgcgttccgggggtatcacgagtggatcaacttcgccggcatcgacggcctgctcgtcaccggcggcggcacgttcgacggccgcggcgcgtcgtcgtggcacctcaatgactgtccctggaaaccggactgcgtgcctcctccctcagtaagttttgaagttacgcggtgccgggtgtcgaaaattcaatctgaacaatgcaataagaacctcgtgtttcaaacaggttttgacggatcatataagtacacaatgaaattatcatgtacgtgtaaatttttttcttttcaaattatattaaaatggattatttgctttatgcttcaaaaaatatatttttttaaaataaaactttcttctattgtattacttacaacacttgttttattatttatgaaaaaaattaatttatctttatggtgtagataatccataacaacgatccgctgaataaatcagacaagacgcgcgcactcactcacacaccacatatatggttttatttatttttctttcgagtattgtgagcgtttggcttaaaatatttttttttatgactcaaatttactatgtgtgtgcttagtccatcaagctggggagcgtgaggaacgcgaccatcacgggtgtgacgtcactggacagcaagttcttccacgtcaccatcgtcgggagccacgacgtggaggtgagccacgtcagcatccgggccccgcgcgacagccccaacacggacggcgtccacatccagggctccacgggcgtccggatcaccgacacggcggtcgccaccggcgacgactgcgtctccgtcggccccggcagcgccgacgtgacggtgtccggcgtgtcgtgcggccccgggcacggcatcagcgtggggagcctcggccggagccccggcgaggccgacgtgcggcggctgcgcgtgtccaactgcaccatcgccggcacggccaacggcgtgcggatcaagacgtggcgcggcggccagcggagctccgccgccgccgcggccgccgccgccgtttccggcctcgtcttcgaggacatcgtcatgaggagagtccgcaaccccatcatcatcgaccaggagtactgcccctatctctcctgccaccatcaatcggtcagagcacacacacaaagatctttttaaatactccctccgtttcatgttataaacgttttgactttggttaaaatcaaactattttaattttgacttagtttgtaggaaaaaaatagtaaaattttcgacccaaaaaaatttagtatggaaatatatttaattattgatttaatgaaactaatttaatattataaatattactatacttatctataaatttagttaaatttgaaacaatttgacttcgactaaagtcaaaataacctgaaatggagggagtaaatcttaagtttttgtctatggctgggctcaccggaggaattcattgacatgcacaggagcggcggccgtcggtggtgaggatcagcgacgtgaagttcaggaacatcaggggggtgtcggcgacgcaggtggcggtgaagctgtcgtgcagcgcggcgagcccgtgccgaggggtggagctcagggacatcgacctcagatacgtcaggcgaggggtggccaccgtgtcgcggtgcgccaacgtcgccggaggcgtcgccggcgggacgcttgtgccgcccccttgcatatgaaaatctgttttctgtttttttttcttttttcactttcttgttttctttctatatagcgtacagtcacagagagttggcgtggacgaaattttggttcttgtaaacgaccgatgacgagattgatccttaattatggggacatcttgttctcccctgtaatggaacatatgaagtactccatccatcttaaaaaacgaaccaaaaacataacatattgggttggttttttaatgacgaagggattttgctattcccctcaccttctgttttttcttgacaaatctgcattgatgttctcaacagtgtcatggaaatatatcatatgtgcacataagctttgggtgtactcactgttcacaccaataaataaatatcacaagaattctataaattcctacataatttttttaacatagtgtacatataattttataaaattatgtacttttaacataacatgcacgtacatataaagttttcacttcagatacattatacatattgtacaaagtaggggaaaaatgattagtacccccatctgtcaaaaaagatctattcctagatccccgaggcaagtttagtattaacgtgaaattaccaaagtaccatccttaactgcattcatccatcaacactgccattctctgcacacacattaaaattgagttgcatttgcccaagaaaagattacatttgccgttagaaagggaacaacctacaagaactacaccaagaacaaagaacagagaagaaccaagaatagaggggaaaaaatggaatcaagttcttgaatcagatctgccacatataggcttgcaaactttcaccttcacctcctgcatcacaacaatatgcccctaccatcgccgccgcatccatccgccaccgcatccatctcccattgttgccgctgcatcgatctgccaccgtcgtcaccgcggcatcgatctgccaccgtcgtcaccacggcattgatctgccaccgccttcaccgccaccatcatcgccgcatccatctcctgtcgtcgccgccatccctgcagagaggagtggaaagaggggcaaatttgaagggagagattgagttgaacaactgaggaggcagagggagagagaagccaaatgagagggaggggaaaagattgccgtgtgaaccggagaaaagaaaagttgaggccctctgactccttctcgagcacccatgcggtattgaatgtgtatcttttttttacaggaattagttttttgggacaaccacaccccaccccaggaatcgatttttttgcggacagagagagtagtatactagtatgggaagtaattgtacaatttttaaaataatttttaatagttgattgtatagcgagatcatccaaaactttatatgtataagttgtgtttttgttgtcggccctagttttctgaaagttgcaaagagttctaataacttattcattgatatttccttaacatcaacttttcatactagaatgctaacgatcttcatcccccaatttgaattccagcacatcttcaaggtccggaggccacaagagatctacaccctacaacacatttattaatagtgcgaaattgaaccgagtctttttttctctaaaactaaaatcaggtataaattgaaatagcatgctataaatacaatctttaaataccaatttgcataaattgatgagccacaccttttgagtggactgaaactaagattaggcaacatggggacgccaacagacgaaattcctctgaagtaaagtaaaaaaaaacgtggatccctgataggtggacctcaccttcatgaacgtcagtggctcatatccctctaacgtatgtaagaggagcctcttccgatatggggaaccatagcaatgctcaaccgccagccaaccaagccatggcctgaaaatagcaaaaggccaacacatgcctgcatgccacagacatagcaaaatcttgttgtcgccaccaccactatatatatgtgcatgccggccggcgttcaagttcgccggagagagaagcaccggcggtcaataattaaaaaaaaagaaaaaaatggctttcagaaaccatgacgctgccatggtcctcttcttcttcctcctcatggtgactacctacgccaacgcgcacggacacagcaagaagcccgaggagatcactcagggcgtttacggggcggcggcggcggtggcggccggccccggcggcacgttcgacatcaccaagctcggcgccgtcggcaacggcagggcggacagcaccggcgcggtgatggcggcgtggaggtcggcgtgcgccggcgccgggaagcagacgatcctgatccccaagggggatttcatgacgggggcgatggagctcaggggcccctgcaatggcgccgtgaccatccagctcgacggcaacctgctgggctccaacgacctcagcaagtacccgggcaagaagatgcccaactgggtcgaggtccgccatgtcgacaacttcgtcatctccggcaagggcaagctcgacggccagggccccggcgtctggagcaagaactcctgcgccaagaactacaactgcaagctcctccccaacgtacgtgttacaccatgcatatggatcaatagatcatgaaacatataataggccttgtcttttctgatcatgatacacatttcggttacctcggtttccattagcacactttttaaattgctaaacggtactccctctgtttcagattatacgtcgttttgactttggacaaagtcaaactgctctaagtttaaccaagtttatagaaaaaaaaagtagtagcattttcaactcaggacaaatatattatgaaaatatattcaattattgatttaatgaaactaatttagtattataaatattgttatatttgtctataaactcaatcaaatttaaagtagtttggctttgaccaaagtcaaaacgacttataatctgaaattgagggagtaatatatttttcgtacgaaaactttcgaatattgacgttgctttaaaataccaggtaaagccattttaaaactcaattaatcatgcgctaatgatttctcattttacgtgcccttgaaccatttttggtgcgtttgatggatgcagacgctggtgctgaacacggtgaacgacggggtggtgagcgggatcacgctgctgaacgccaagttcttccacatgaacatctaccggtgcaaggacataaagatcagcggcgtgaccatcaacgccccgggggacagccccaacaccgacggcatccacatgggcgactcctccaagatcaccatcgccgccaccaccatcggcaccggcgacgactgcatctccatcggccccggcaccgacggcgtcaacatcaccggcgtcacctgcggccccggccacggcatcagcatcggcagcctcggccggtacaaggacgagcgggacgtccgggacgtctccgtcacccgctgcgtcctccgcaagaccaccaatggcctccggatcaagtcgtacgaggactccgtgtcgccggtgaccgtgtccaaggtgtcctacgacggcgtcgtcatggaccacgtcgacaaccccatcatcatcgaccagaagtactgccccaacagcatctgcaccagcaagggcgactccaaggtgtccgtcagggacgtcaccttcaggaacatcaccgggtcgtccaacacgccggcggtcgtccagctgctctgctccggcaagctgccgtgcagcggcgtcgcgatgcaggacgtcagggtgctgtacggcggcagcgacaagaagaccacggccgtctgcgaccacgcgctggggaagtccaccgggtgcctcaaggagctcgcttgcctctaatggattattaattcgatcatcatcgatctctttgtgtgtgttcatcgtgtttaagagacagatcgaggtttggagagcatatggatgtatccgcgtgtgttccttgattttgatcttccaagttaatgtccatatcctttctttctgtaaaattaagacccaaagctgcctcctcgattcgccacgtcatcaacattatatcagccgttagattctctgtaggtctctggattgacggttcggtaatattaggccatcgcattctactcatgcgcctctcataaatccttccttctgttggcccaagcccatagcaatagtctatgatcaaagcgatcatcgctccttctccgtatttattgccgcttcagcttggcctcctttcaccaacggaggaattacgagtaataaaaagaattataagctaccaaaggaggaattacgagcaataaaagagatagtacatgaagggtcatcccaaatgatttatactactccctcttaagtttcatccgcgatttaaccataatcggtcacaacccatggtctttcatctcgtcggacagcgtaatgcaagaagcacaccagccatggatgatgggggtgaaaacggagcggatattatccgatccgatccgctccgaatccgatcggagtaaggatacggtaagagtttttagatatccgtcggatacggatgcggatgtggtatcatcgatatccgacggatgcggattatccgattttttaattggattatccgatagacgattggcggataatctgcatatttcaggccacacaactacacaattgagcctattttacatcggccggcctatctagcccatttctgttaacctaaaccctcaatcttctgatctcttcacctcctatccagctatccctatccctttgattaatcccttcggctctcccactcacgtgcgccggcgccgccacaggcccgtccactgtcgatcgactaccatccaccgtcactattgttttgccatcatgttcagatgttgttttgccatcgtattgctgcttattgtattgttgtcctcttgttgtatggattgaatacaaacttaacatctgataattttgttccgtttccgaaccgaatccaacgttcgaaataatccgcttcgtatccgcatctgcacgtcatccgcacctgctcggcatccactttgaaaaaatggtatatgatatggtatgaccactatccatccgaatccgctccgttttcaccctaatggatgatcttataatttttcaggtttggagttttgtaatcattttcttcagtgcctctaagaaacacaggtctgctccccattcatatgctgcatgatcttcttctttcctgattttttatttcaaatactctttcccgtgtagtatttgttcctattatggtttggtgctgctaaatccatctctcgtaatatgtacgattcggataacttttttgttatttgatttatcatcattatcctgattgttgcatacatatgatatataacatatgtttgatctctcgataaagaaaatgacattttccgaccacgggaggaaggagaggagatattaggaccagaatatccctatctcagtgttattggagcacttatataccttgcaaatagtaccaggccagatattgcaattgcgataaatctattggcaagatatagtgctgctccaactaagcgtcattggaccggaggaaaacaaatcctcaggtacctaaatggcattaaggatcttggcttattctttcagaaaactgttgatcctagcttgtacctatcctagcttggttgggtacactgatgctggctacatgtctgatccccacaacgccagattacaaacaagttttgtattcctccatggaggaacggccatattgtggaagtcatctaaacaaacattagtggctacctccacaaatcattctgaaatcaccgcattgtttgaggcatcacgtgaatgcgtgtggctccgcaggatgataaaccacattgaacaatcttgtggtattggttcctcagaatcacctaccattatctatgaagacaatgctgcttgtatcacatagatgcaaacaggttacatcaagagcaatatcaccaagcatattgcccctaagttgttttatccccatgagcttcagcaaagtggagaaataaacatcttaccgacaaaatcttatgataatctgttagatatcttcactaaatccctacctacttcctcattcgagagatgtgttaagggaattggtatgaaactgctcagagacttgcaagcttcaggatgagactctctgaatgatggaccctgttaaaacgcttcacattgcttgtcccttctgcgatgcggcgcgcgcgggtcccgatctcacggttccccgtgggtgccgtgggtctcggcatgagtggctgcatctacgccagcgtcaacctcgagttccggggcctcccgctgtcccattctatccacgccgagcagttcctcgtcgtcaacgctgccgccgtggggaagtcgaagctttgcgccatcgccatctcccacatgccctgcggccactgccgccagttcctccaggagatccgcggcgctggtgggatccgcatcattgtcacctcctccgacgccaagtggcgcacggtgtcgtccctcctcccgcgtccctttgggccccatgatctcctccccaagcacgtccctctcgtcctcaaaccacacgacagccctctcgtcggcaaccccgctaccgctgtcatcaccaatggcttcgccaacggtgacctagaggcacgcttgagggaggcagcagaggcggccgcgcgggcggcgcacacgccatacagcgagtgcccgtctagattcgccgtggcggatggcgaaggtagggtgtacgccggaggatatgcctggagtccgcggcgtataatccgacactaggccccatgcaggcggccatcatagggatggtggccgctgggggcgccgccgccgccgaagacgtggtggcagcggcgcttgttgagaaggaagcggcgttggtgtcacaggaagcgatggccaggatcttcctggccgcggtggccccacaggccagctttcacgtgtacaattttggactgtccgatgcatgatgcgcatccctgatcctcgtggtgggtggggagggagggtaggaggtgagatttggaacgagataatgtttataaaacaaagatgttaagaataaaacgagaagaaaataacctttgtgtattagttggtggacgctgacatcagacccacttgttcagagtgattaatactcttctgttctcatgtgtatttaagtggaaaaataaaagaggatctaaattgccaatgtacaagtagaactgtactagagtgacgcatgcatttatcttggaagcaatttgtttgtctttcgccgtctcttgctagaagtttacatatttttttctgcatgaattacacaagataggctaataattatcatgagaaaaaatggctggacctatattgggacatgctgtggtcactactgattattcaatcatgcaagctggttcttctttcttacaagcctcaaacacacatcagtgatagctttatgaacttttctagtgtggctgaatttaaagtagtcagttgcccacggaataaagcaatggtggacatttaacctattctggacaagatattgcccctaaaaaatcatttagtcaaaaacaatgaaacctattcttctcttttaattagataatgcaagtgcaattacgaaattatggtcaagactgtctaatataagcattttcttgcgttattttcttggcaggaaatttcttgtgcatgccaaccttgatttatgctggccctcttgcttcttaaatgaagagtaccagggaaaacaacaatctagacatagaaaataaaaaagcacatagaaaagttgaaaaatcaacttttagtattctttaaaagaaaatcaacttttagtagttacatatccttcactccatctgacttcggagtactaagattaaaaaaaaagaaaaagaaaaactactgctgcttgcactccgcaggtcgctcaccctgctgtccagcaactctgctagccttccgttcaaaatagagggataacaatggagataaaagcatctaaagttctaataccccagtagaacaaacgacaattgaatgtcttatgcttcttcatcactatattcatcattattgtcatcctcttcttcatcatccacccaagaagctccataatcctcgtcttgaacagcctctctagtaaaccaagaaacagcgtgtggtataatcttatccctgagagtagatctggcaacatgggcaagctaatttataaccaggtaatatatacatgaagtatgttgttcataaataatttaaagaattgtgtgtttcagtatacatcatgcataataacacaatagtaatcgcttctcctttccaaaaataaaaaaaccaattctaatcggttaagaatgcaatggagcataatagcttacgcgatgtcataatctcgttccatttggttctgcaattcttcagcctgttaagaagcaacaaccaaaaaggccataagttgggcataatgttttaggaatcaatgtatatagaataattacttgttcaacttacggtattttcatctatttttgcatcatcatctggaacttgaggggggctaaagaaattaaagaagctctcacattcttcagtctttgttataggtttagtgctctctgaactctcctttgttagcacctcttgtgtcaaacaatatcctggatgccattcgatttcagtcctaaaaaataaagcagtcagggaataattcaaataggaaatgcaagagagatttttttcatcctaacaaatacacaaatttgcaggaacaaaatgatatatacccaattgctttctctaggatgggttcatcatcttcatcgatcatgtggtatgttttagtcagcacttgatttttaaagaagggatttgtatagaagaagaattcgaacttaaaaccctttggatcatcaattctacaccatttgatgtccttaaggtactttagagcttcctcatcgctctcatggatctgtggcagcggaaaaggaaaaaatattcattacaaaaatcatcagcactaagcaaatcgggacactgaacaaataaattagctcaagttctaatgacagcataaaaacattgataactttggaaagtgggaatttacaaactagaaaagcctctcacctcctcagcaagaatctcattgttcttcattgcattgagccagaaatctggaacacccttttcctctgcatggaagcatcgtgacaagattatagaaaaaactaaaagggtacccaatctatcaataacccaaaacgtgcccagaacacctatagtatgaacaagaatgatatatcacctctttcttcggtctcgccttgtacttcaagaacaccactcacaattttagaacgttggaaatttgcaagcacaaaaaaggtcactagaacagcacatcatattgaaaactcataaacataattcaagatatgtttcttagaggagagttgcctgtacataaaacatgcatctctttttgaaaagaaagataggtgaggtaaggccagattgcattacattgcaacaaaaagtatgtgttacctttgagtacaatggtccataaagcttctgatatttagcttctagagcagctttttcctcgaagaacttcacttctagttcatcatgttggctctgaaacatttaacatgttttagaaacttttaagtatgtggaataaagtttgtagcaaatataacacaatcaataacattaaaaggctaaggtaaaaaaaaatctatttacgaaatcaatggataccgctggcatacgagagcataatttgtaatttcttagagtatctttacttatactaattgggtacattttagaagctcttatgttaaccagaagctcttatgttaaccagaaatatctgaccattgattagacgggtcgtaaaattagaaccgtagatctacaatgatatttagcatggtgggctctaaagatttaattaacgtggtgggctaatcttccttccaaagcccatcaaaactacctccagctgtagtagtctatcacgcaaacggcagatcgaatacaatctagactccaccaacacgatcaagcggagagattaatgcagcatccacgccacaactccattgagatatcccctgctcgctatattttctcggtcaaaagactgattgcttatctcaatgagaaataattagaggaagctgtactaaaccaatatcgccaagcgtgctgtcaggccattggcacgtcgatgcaaccgcgcaaccccgcaagtctggtatagctttccaaatttgttagtgttctaatcatgaacactcgattgattaattatttgttgaacttgcctgctattgcaggagctttttggtgtactgttaaactactgctagcatataatttaataaaaagactaaattgtgactctaagatgaattaaaattccaggagattaaaattatagtgtttataatatcagtcctaacattacaggggctgatgattcgtgggtctcaaggaactcccgccttaattaatcagaatgacatagatcatctcaagtgtttgtgttaataaaacaagccataggtgatagcatggactctttagaaacattttccccaaaatatggcattattcacatattgatttcttaatttatccctttatatacctcagtatgagatatatcatttttataaatggggttaccgaaactaattctaaaggttacaaggttgaaaactcatgtctgtaaatattctttaatttttatttttgtttttaagatataagcacatgtattatccaggaggtatatacctcgtaacaaacaatattggcatgtataccctatatatatacttcccgagattcacgagattcaaaaaagtttcatcattgtcaatcataaatttatttatcttataatcagttcaatcaatttattctttaaggaggtacatacctctccaaggaaatataggagaacctctataagggtctttacttgggtacagttaatacgtgcacaacgctcagtatatcgtagtttaaataatcatacaattttaatatttagagcgtcattaaaaataacccgtgcaacgcacaggttggcgactagtagaagcaactatggataataaagtacggataataaaggataaagcatataatccaaccgttttatactcacgaacataacaatactaaaatatggataaggaaacctctggaaaagagggaattaaaccatgcaaaaacttgtagtcaatctcacgtttcattgacgatattgtcactatgtgcgccacaatgggtttgcataataaacagtacgatgaacgaaaatatgccgcgaattgaagctctctctagttttagcagttttgtctttacctgaatctccatgagcacatcgacgcgcttcctgaccgagggtgccaggctctcgagcacgtcaacatgttgctccgccaacgcctgcagcttgttctgcacaagcacatcactgaatcaacaaaacatcattgcacgatcgctccaattgaagcaatcatcacagcgagagaggaagaggttataccttgagcgtctccacgaggatagccttgtcctccgatgagagctctgcataagaaacccgccgccgcaaacagtaagccataaacccaatcacagaatcacccaaaaaaaacagcaagagcgcgacaaaaaagcgaagtaggggagaggcgaatgctcaccgatcccgttcatggtgctgcggtgggagatggtggcgatgatactctccggcgtgatgaggcggcaagttttcgagcaaggagaacttgggcttcggattaggcgagcaagacggggaggacggaagccgcggaaggtgatggtaatgtaggatcgaacaagaacaaacgaacctacaaaagtcgatatgcttctcacctcaacatatcatctatttatacccaaaaatctcctattcaagctaggagtagagctcctattttcaataggattcgcccctcgatttccaaaaccaaaattgggcccgtatctgttagcagcgttaattgaacccgttacatttgtttgttttgggtggcctggaatcgaatactccagatccgggcccagtacaaatccgttaccgctccaaatcgaatacggagcggaagtagcgcttgtgttgtcgtggctcgtgagtcttgtcgtgacctagcctaagcgccgccgccgccgcttcgccttctcctcacccaggcgggtcgccggcgccgctcgccctatcctgcgcgccccaccaccgctgttccccagcctcaccggtgttgctccctctccacgcgctggccaccaccgccgctccccgagccccgtgtcgacaccggagcttggccacctctccaggagtttcgtccatggattcgaccctacccagcggcttgacttcgccatcttcaacctcttcgttcatcgacatctcttcaaggaggtcccgctcccctagccgaagatcctgaggttctctcaccattttctcgtttccacggtcaagcactactccttgttggtgagaacccccgctgaaaccatctttttttttccaactctgcaacctctctgaaattttctaataacatcttgggccaatccattcttttaatcagtagtgctcaagatttgtgatgatatgctttaatttgatgcaattttcttgtgattgatcttgaagtaagaattaaggaaaaaggaaaaagaaaaaaaactacggccgcaaataaaaaataaatctgtccgatttcacaaaaataagaaacaaactcccgtccgtttccgtttgggccgaataagagttggtttgaattataccaagtcctattcggttagcatcatcaggagaacaaatgcatatatatatatatatatatatatatatatatatatatatatacatctctactacttaaaaaattaaaaaaaaaattccgtcggccgtaaaaagaaagtctgactcaaaataaaaagcaagaaaaaaaactacggtcacaaataaaaaaagaaaaaaaagtacagtccgttcaaagaaagggtctgtttagtttgatgctaaaaaaaaccttactaaattttagcattgtcgaaattttggcaactatgctaaaattttggcaggatttgttatatacttaccaaaatttggcagcagccactttttcggcaactttaccaaaatttagtaaggttgaaaatggcatcaaagtgaacaggcaaaaaaaacgtctgactcctttaaaataggaaaaacaaagtccggccgttaaaaaaagtccggctgctgttaaaaaaaaacttctcacgtcgactccctaaagaaaggaaaatattcgtccgtaaaaaaaaattgactcccataaaataagagataaaatttcgtccgtaaaaattttttttgactcccgtaagataagagatagagaacttctcacgtctgactttaaaaaaaagaaaacattgcttcatctgtaaaaaacaaaaaaagcccaactcccataaaaaataataaatgagaaaaaaaatccggttcgagaaaccatccaaactcaacacgagaaaataatataccacccgacacaacacgagaaaaaataaccgtcgtttgtaaaaaatggtttgaaaaaggtccgacttaatgcgagataaaaaaccactccaaaataaaccgttgaaaaatgttgtttgtaaaaaaggtgaatcggaaaaaactgactgaatccatgcgagaaaaaccggatcgaaaaaattgtccgactctacccaaaaaaaaaacaccgttattataaaaagtattgctccgaaaaaattgtccaacccaacgcaagaaaatacgtgcatttataaaaaaattcggttcggcaccgtgcaatgcgaaaaaaatttgtccaatttcagaaaaaaaatcctattccatgagaaagattcatatcatttgtatcatctaccacgttggtttggtttttccaaagcatttgttgaatatttttatgtgcggatgcatgggcttgggcttggttttatcggaacaagatcaaattgatctgaggcttgggtaggataggatcttttttttccatctcctatgtacatggcttgttgctcctgtactggtgaccccgcacgactctgtatgcaattatcagactactttgataagtatagctaatagtcttgatagcgtatcatataaaaataataataataaataatttttaattgttgttaagagaagagtgcacgatgactatattttgtctagacttgaccatgcgagacagtgtaggatttgattgatcctattattagttgcaagaatgagattaaaagagtatttcagattatatgtgtacaaccacataaataatacaactctttttggtaaagcatgcattggtaggttgccatcgttgaggttaaaccattatattgaagatgttccaattttccttagggtatgtcttagttacaacgatcgataccaacattatcatcgagatgattatacatgaaaagcgtatattgtaattgaaaatttttcacccattgcaatacacggacatttttactagtacatgcatatatatgcttcctggaccatgtcgacaagcacctgcagtacacatgtacaacacatacgtgcatactacatactacacactacagtacctcgagtactgtagcaaccatatgcttcgctccaattcttcttccaattttcttcgcaaacactaacgcttgcacacatacctcgtgaagtccgttgcaaagatctctcccacaccgttacacagtgtccattcaccgtgtgccatcttgtatccaacttcgtcacccggtattcttgactgtctggacctcaactcatccctgagtctagtcccgatccccatcgttggccgaagttgaccttcaagaatctagactctagttaccttctcacatgatatctcgaccgcactaaacctctgctcctccctaagcatagttctggtgctcaccattgaccaaaactgacctcaagtcacctgcacacaatcagacaaaacaaccgttctaagcacagatatcacaacatatgaacccaattagtcacacaaactcacaccaacatccacacatcttttcaaaccaattcattaattaaatcatttgcaaatcaaatttgtccatcacaaatattaattatgacgaaaaagggtgggggaagcgatagagcggacggcccaggtttcacgggagggagacgtggccgaacaggatgcgggttcgcgctcgtgtggagtttggacttgccccgctggtcgccgcgagtccgattcagacttcagggccgtgatcggctcctctgctctgtttttttttcttttttcacgggagaacttgtgctcgaaacttctcatgcccagttgcagagcgtcgtcccaggatattgccgttactgcttcagcatgcttgcacgaccgctcacatacatgtgtcgcgagattaacaggaaagcaacactagtcaatagaaaaaaaaaagaacatactgcgtgtcaagaaaactaacatatttgaaaggaaactactatttttttaatgaaatgacaattgacaagaagtttatttatggattaagacgatacaaaatcatcttatgcaacttcagcacatatttgacgtttttgacaagttatttataaataacacactaacactgctatcattaaatgaacattggaattgatcaacagattttcatgagcaaacgctagtaatattcagcctctgcccaattgtccttcttctagccgtgtactgtcatgatcagtctgtgatagctggatctggcggaagccccaggttcagtgtccccaactcataatatttatttttctttcacttttttctcaaacatggaaattttaaaacatgttttatcattacttaaatagcacactgtttaaagaattctatatttaggaattagcttggaaaatgttctctttaaagagcagtaagatcatgaaaaattgtttcatgcaacttaagtagagaggaaggaagttcggaatgttttctggcagcagcaacacaaatcattttaaagctattgacacagaaagtaaatgtaaaaataacatactaatagttttttcctaagtcaacaaggatttataccagtttcatcgatcctatagctatgagggtggccattttggatgaataaactactattgagtcgaatcagaaagaggatgtggatgctcaccaggataccctcccctgctctgcttgagatcggcagccgcgacgcgactcgtcttggcggcggcgcgaggagcggaggagacaacggggggcgcgctattacgattgatgcacctgcccgccgtctctcttcctctacagcttccccgcgtggacgacaccgacatccctttgccggcgctggggaggagaactgtgaatccgtcgatacttgggggcaatccgagcatttcaaaaaaaaatctcaccactttcatcccaaaaatgaaaaaaataatactttcggtgtgctactgccaattacacaacttttgcagtgtccatagacagtgtcacgtttttttttatccatcagccaattacatgttttttgtgtatcctattgtaaattttaccataatatttaatgaacttttcacctctggcgcatttccatcttttgtgtgcctagatttaatgaacttttcacctctgtttcaggttacaaaactttctagtattgcccacatttatatagatgttaatgaatctagtcacatatatgtgtgcctagattcataacatctatataaatatgagcaatactagaaagtcttataatatgaaacggaataagtattaccaagtttaaatctcaaaacatatgaaacgtcttaaatcagattgtaggtgataggagacgtctagtgctatcactgtacacaactactcagtaacacaatcctgctgtttcgtactaacacttctgcttcttctgtgaagatgaagcataaataggcccatttgacagaactgcctcaactggtgccactcattctccgttcaaaatgaaatgtcatcactcatccctgaatattcataaatattcttatgtatgaatacaaaagctaatagagtgtgaaagggcatgtaatctagtagttgcaatgacctgaatagcatcccaagatcctgagttcaaatatctatatgagcaaattttagattaagttatttgttgagggctaagtttcctgtttgataggctaagttcctaatttaaaaaggttgcatatatccggttggacgtaaagatcaggtaaaaaatacccttctctaaataaaacaatactcctagctaatagagtaatagctaccattttctttcctatttttctttttatttccctatatggatagagcgcatgcgcaagatgaatcataacttcttttcctgtactcagcagtgtagcaatgctagtcaataaagctaatttcacctttgaacgggaatggggaagcaatggagtagagaattacaggagaaggtggcagctgaggagagaatcaggagctgtcacaaagctatatacaagttgggaagctgaacgagaagagagcatatgcttccctcctacaggaagcattatgacttgttggtgctgttttacaaatctgggtgattatcggaagatcgtcatgcggtagcagctgcagcttcttctgcgacttgggatccctgttgcagagtgcagatgaggttgcgatccccgtacacattgtccacgcgacctggtaagagcacacagacacggcagaatacagattaggttggtgtcaaattgtgttgagcaaattaagagcgatcttttggagacacagaaagcaagcaagtaggtacatgttgttggccagaacttggcgccccgaagccacgctgcagggaacgcagcatactccctggagtacggcttagtccatgagtcgctcatcagaagttggggcgggtgaggagcactctgcacaacaacggaacaaaacaagaatcacatgtcaacatcctggtgatgcaagagctatgcagccgcctcatgtttgaacttttgagtttggaccatgctaatgtatctccaaaattgcatacagcatgaggactaggattgaacggggtctactaacatcttatataacctataagaattgggggtaagaacataattgcccgtatatagatagataggtgttacgaacttacaatctaatatatgaaaacagatagcggtatagtagtattttaccttgaggacgttgttgttcacatctgctttgccactttctatctctgcaatttcttccctgattgagattagagcatcacagaacctatctagttcggcctgcgagataattgatgtgacattaagctcatataaaagaatggttggtacaatgctaaggaatatagtatgtgttttagtgttttaccttgctttcactttcagttggttcaatcataagtgtgcctggaacaggccatgacatagtaggtgcatggaatccatagtccatcaaacgctttgcaacatcctctggctctataccagcagtcgtctgcaaaaggttgcgatatccaattaagaaaattgaaatgcataactcaaggtccaaatgccaaaataactatgatagataccttaaatcctcttaaatcaataatgaactcatgggcaacagttccattgactccacggaaaagaactgggtagtgtttctgtacaggtaacatggtaaaacttagaaaactagttcaaacacaatcaaactaggtagcaataggtgatcacgagtaacaaatatacctccagacgctttgtcatgtagtttgcattcaagattgcaatctttgaagcatcagtgagacccttagaacccatcatggctatgtatgtgtaggaaattggtagaatcaacgctgatccccatggggcagcagaaatggtaccaagagggtcggttttctcagggagagggaagccaccggtggtgatctgataattacagaattaatctagttaatgaagtagcatctgcttttttttgttaaaaagaatgatggaattatgaacgaacacttctggttttagtaccgaatgtggtttagtagttttatcatcaacaaaaacttctacagcatttttttacataatatcaccgtactatgcttttgatatgaaaaatgatgcaggcaagtcttgcttcaggagtttaggttaatataaaatgaaaataaggtgtcacttagcatacccacctaagctaatgtggcaccaagaaagcgagaaaataaaaccagcaatagttctcgagttgaaggagttaggattacaaggaaactagtttttaaaaatcaacacagcattgttgatgacatagagaaatgtatgtttgtgtggaatcctctgaaatatactcagtccaacacatcataaaagactagttatagagtgtaacatgatttcgtataatttgcctaattctgtaaaagagtaaagatggaatttttctaaggtcgtctagcattctgtgttatatcaatcttgtctaatatttcaaggtaagtgttgggcattgagcattaatctgtttagattatcagcacattgaattcagagcacctaccactggatgagatggtaaaaatggtgctaagtgcttcttaacaccaataggacccattccaggaccacccccaccatgtggaatgcagaatgtcttgtgaaggttaaggtggcaaacatctgctccaataaagccagggcttgtcaatccgacctgtaaaaagacaacttctgttagttagggagtgtattgaatatttttggctcgacagatggggttttttgaaattacgataacagaagttctcaattgggatcagatgaacttggagaaagcttatcatattttattgaagatagcatatctcagcataattaattggataagggtcattgaaagataaacatgcaaatgaaagttggtacttctgtgtttgtttcaaaacaaggtatacttgtgtttggaactgaattaaaatagacttgttacataaacatgtttagtataattcataggcacaactaattgtttttttaatcatcgccatgccaaaagccatctgtacgatttatagagcctcaccccaatgcgtt

SEQ ID NO: 76939 - DNA, 592 bp, Oryza sativa
gtcttcttattatagtagtaccttaaaaaggagagaaatagagaaagcaaccaaataagaataaaggtgaaaacttgcaacacaacaaaagatactgagcaccaccagaaagttaataacaaaaggtaagtaggtaaaatgattcaacttactttttcccatcagctgaagtgtgctcttgccagtctgaagagctagtttcgctggaattgatctgttcatttgcaaactcaattattgcaaggtaaggatgtcatatttgataaagcacagtagtaaacttaatacagaaaaataaactgattcagaagagatcagtgatatttactgaaggcattgtagcggaagatgacatcggctgatgcccaggctgcacaagaggtacattctgacctggagctgtaccccaagattgcactatgggaggaggaacagatgatggttgatactgcagtgtagcctatactagtatcagtaacttatcggcaaggggtggcattcaagatccggcaatagctttgtgaaattaaatacatatatcaaatgaacaaattgaattcacaaagtgcaaggaaaaataggacttgccgta

SEQ ID NO: 76940 - DNA, 622 bp, Oryza sativa
tcggctccatcatggagaccagcgccatgaagaagagctcgcagtgctcctgctcgtgagcgacacacagagactggatgttcgctcgtgtaatgtttttgtttcgacatatcgattattacacattcacatcatttcacctcgcgttcttgtcaattatagagaaggattaggcatgtaaaacattgtaaatttggtgattgacaagaaatggtttagattcttcatctgtgactgtgattatctacgcgtgcgtgatgctatgattcgtcgcttagctaacagagcaagctagctcggtttttctaatgccacataagcgcaacgtggactttttcctatttcatatacaaaccattcaggcgcacctgtgagtgggccgcgtggcctcgtgatgccatatttgggccgtttcttcactgtatgggctagaaagctaggcccaacaccagaattcggcccagagaaagttggagatgaccaggttgtgcaggtcaaagggttcggagttactaatcaactccaaacgctggcgccggagttttcatttctgaccccgttggcctttttaaagatcgaactggtgattgagtgtctccgacgagcatagcaccgagcacgt

SEQ ID NO: 76941 - DNA, 64356 bp, Oryza sativa
tatattatgtattgttagaggaaaagagagagcaatagtacactagtaccaatcagcagcccgatggatcggtagatagatttggggcattctcccttttttatggccttggccctacatatgtacattgttagaactacttgtgcaacagctattatgacttgcctctccctccaatgactcttactataaagttatagcctacatcatgattcactaacaattattacatttatattttttaaatagtacagatacatacatagtttccgtgtacgacagaaaactcgaatggcataagatatttcggcttaacccccaagcaatcccatgcgagtctaatcttgagaacagatccaaaccaaaattatatttatactgcaatggtatgaaaagaaacaaaaaataacttaccctctcaaggcagaaaaagtaaaaccaggtgaatcatacaaaaaaatttgaatcaaaactgccaaccaattctcctttttttttactgaatattgcaagttagtattgtgcaatgctttcgaaggtctgaaaagtaatgagatatttatcttctcaaaaattagaatagctatttttctttgacaaatacaattatgctagtactagatttaaagagtgtacaactagatagcataatacatggaatatatcttcgatcgctctcgttccgtctcaaagaatcagatatgttccaattcgcatgaactgtcgttgctaatttaatactctatctcttttattataagtcttagtcctatttctttaagtttaaccaaatttatagaaaaatatagtagtattttccaccaaaaaatatattatcaaaatatattcaatgttactaatttttttataaacttagtcaaacttaataaagtttaattagaaaaaaaaaccagacaacttataatatgaaacaaaagggaatataatccagcgtcttgaaagctatctgatcagaaatgcaaaaaaagcttcacctgattaacatgtacatctgacttaatttggaccaaactaattgtgacgactgtacagataggttcggtacggccaatgtctccaacaacatatattcccaatggctaatgtatatcacaagcaatgtctttattgttataaggtgtatcactagggattgatttgcctggatgattcacaatttctgctttgatctaattgcagagacgcattatgtggatttgtggtggataaactcctggagagtggagatctaaggaattgaattgtctttccatccaaaaaaaaaggtattgaattgcctgtttttctggagatcactaagcaattaaattgtctcgatgaaaagccctggttgtagatctttctatccctttgcacacatggccattaaacacaatacctcgccatgaaacacaataccatgcatttgattcttcttcccgaagccctacagtacaccaagcattccttcatgttttctcccacagttactaggtgattcgtagcaagataatgcccaaccccagccagcaataataatgaagggaaacatatgcagagactgtaatctctccacagagcacacttgatcaacttatcatcggaaattgcaggaaataagcaatgcaatccagtttatcttcagattaactgaatatataaccaaattaattaagtattctgtattgaactttccagattaacataattaaaaatgttttagttcaagaggcaattgaggatttaaaatacaaggctacaagttccttcctacatggaggtaacaataactgcaattgcccggccgggcatctagatcacgagaaacaagatgagatcttcataaatcaacccataattctgaacttgtcgagattgttaaaaagtgcatctaaagcactactctctcaactcacaaactaagattgaaaccttaaaacaaaccctaaaatttttctcccaaaaggtaaatgtacttttagcctcaatccctcttctattacccataacatggttgctcctagccacgaatccaagcaaaactaggacacctaatcacatagaaaacctaccaaatcagggaaacagcatcccatacaactccgcactccaaacttttcaaatttggactctaatccaaacttcacttatctttccatatgcacacaacaccatgtgtatgccataaaaaaaacttcacctccacatgcattgttttcaagcctgagcgcctcgcgtagacctcaacttctcctaagcccaatctctatccatcaccgactatactctcatggtctcaagcaacacctgcacatgaacaacaaagttggaacatcacacagatcaaaaccagattaactacaactactcaaaacctgattaactacaagtacttaatgatgatctaacatatatcaacatatgtcagcaccttaccatttgatgacaccgcaagatttgtaatcttattctggaacttgtttaacacgcatggtaggcatatcaggcctttattgagagaaaatcccttgcagcagcctgaattttgaaccaataccttatgtgtttatgattttttttctcacacccttgtatgcccctaaattctgatttttttttatctcttccatacaaatcatgtcgattgaccgctttaagagctattgaaaacaattatgtccttaggccctgtttgattcagcttaggattattataatctggattattaggagtaagctgaaacaaacagatagcttattatgataaattattataatctataagccagattactataatctggtaagccactctaaaggtgcttattttagattattgggtggctaacaactaacaaacagataataatccagagaaacaaacagctagcagcttattctatatcggcttattataatccagcttatagtaatctagttttataatctagattacaataatcttaagctgaaacaaacagggccttagatgtgaggaatcatctcacctgctataccatttggcgattggtgaagttggaacataacccgtatgtggtctgagataagcttgaacttgtgacgttgttgatcgaggagcatatataacagaaggccacttggttggccgaaggagaaaaacttggttgtctagatctctacaagttggaaggcactggttgtatttgtgcctttcttggaactcacttggttcttctatcacggtatatggaacagatagggtgtaagggagatcctgctggctctcaaacctaatacgcattgttagtttgagaagcaaattgttggcatctgcttgccaggttattccttgccttctgctatgcatgagctgctctcattattgtccttgtgttgctctctctctctctctctctctctctctctcatatacaacactatacaagcatacatacatacatacatacatacatacatacatacatacatatatatatatgtatatatatgcttgtatagtgttgtgaacggtaggacaaaatgtgggactgtagacctggttaaaagaaaatgggccagaaccgatgaacgtttggttcgtttcaaaaactgtcaatgcaattagacataatatagagattactacaaaaccagagggtttggtatgaaatgaaacctttgctagctacgaagtggggtgggttagatttagagtaatttattttccttttgctgctctgttttaattttctactccattttttagatggcctccaatttactgacttgatatagtagcaccaacccaacataacataaggcagttattagattcaatagctttgtatcaaaactatctaaaatatatttccatgaggattcatgtttatgttgcatccagacggtggtctcttttgatgctaattaacaagcacacttctactaagtatattaaaatattgttgaagctttcatctcagcagtggccaaaaacaataatcgttaagttgagcaatccccaactaagctcgacatgccagggcagtgtacatttgagaaaactcgtcgccgagccaatgctagggcttacatatcctgggcatcgtcgtagcgacgtagcgtgcttgcggtgtgtgctcgtcatagctaacgaccggatcacttgaaggctgcatcgtgttgcagcggagggcctctggtgcacgatgcttgagcaagacggtgatccaccggcttcgtataggaaaaacagtggcaatcgaactcgctgcactgccgctgaaattgctagttcgatcgtagttaagcatagaatcacccagcaaagggatccgaggcggctgaatagtttccagtgcctcccatacctagttagcagagcgagctaggaggagactacatcgatttttacctcctaaaaggagtactgcaccagtaggagactaacagctctcaaagtggcacgccatgaaaattcgatcgagtgtctttatttatagatagcattacgtctcgagtgaataactattactagctagtatgtacctcagccctgagtggtcatcattacgattcgatatggtggagaaaaacgtcccatcgtttcacttattcgggcatatttaccaacgaaaaataatttgtaaataaaacttttatatgcgtgttcttagggtcttaaagcgaaggctggaaaataaacttcgatgaaaaaactccaaaatcaactctaaatttaaggttaaaaatttaaattttggctgataaacaaaagcataagcgaaaagatgaggttgtttaccgtaagttttgatacaaccactgctttgattctctgttattactactacatgctcacttgcagtttacaggaatagaaaaggcgaggctctctgtttatgttggcccagggttggtgtctgtcaacagttggcccagactctattatctctgttaacattttcattttctgatgagtttaactgcaagcacttaatgatgatctaacagatatcaacatgtgtcagcacttccctagtgatagtgacaccaatagatgtgtagttaatctggataatttatttaactttgcatacatatgagttcattagatactaactttgcatcgtgaacggccatcacagatgtgctcactggtgacagaccgaaaaaaatccacgttgaagattggtcctcaccgccgtacccgttacctgtggcaggctaaatatgcggcccaacacgggtcatctgtgatgggccacaagcacaccggatgatatgaaagaggatagtgcccaacaaagaggactatagtcatttttacggggtcctgttaacagactatcaatgatataagtgactatatatataccccgatacttggtgaaatagttatcacaacccagcgtactgttcctacttcgggtgctacttcgggtgggagggctagtggggcaaatatttgctcctcaatgaccactcatcaattaccaggccctctgtcaacacagttgagggttatcgcctggcacaaatgaccggttccccactagtgggaatttttcagttgatctattgtgtctgagtttttctcactctcttctatgcccatatattttgattttaatatcatttatacctgttttgtcagtagactgtttaataattattaaaaaagtcaattatgtatttgacatggaagtggacgttaatgttggatgtatagggatttgtgtatgatattaagtagccaactacaacaacccttgaaatgtaggtatggataacaggactcacaattcaatgttgagagcacaactattttctaggatacagtcattgaggcaatagatattccatttttgctttgatcctgaattgtggcttatggtgttgagaagtgaacggaattcagacatgtcatcaatgtttggaacttggaagttctagcaccaatatagaagacagttagtgaaaacatgctaggataggatgggtcaatgaattattctctcgtacggttgcctgattggtcattctgagttttgtagctaaaaggtttttgaacattgtaaaaggatcaagtactaactaaccaaagcaaaagccaaactgaagtcatgtttcttgtagtatgtaaagaagcaaaactagttcgtcctttgttcacatttcccttggtcttgcctaaagtcgttatgcatggaagttgatgcatatagctgagacagaaatgtacaggaagtatatatactgagtttacgaaactttgtcagccctcgattttattctgcttcattggtcttattcaagaattagtgaattcattgtatcagacacaatctctgaaactttgttccttccttaacttatgatccatttgttgtgactaatttttcttttcaaccaagagctttctacttgattcgcacttatgtttctgtgctagagtctgacggaaagctatcctctcttgtgaaagaattcgacaccgctatcacgtgaagaccacatcagaagtttctcccaaagacctcgacccagtgcagttatctggtgagatatggtggcagtacatttcatgttgcatcccatttctattgcatgtaactttttcccaagaaatatttagagagttcagacgcatacagtggttgttgctagtcagttataccaaagtgtagaacactaatgttggttgttgtgatgaaagttacacgtatggttctacgtagatcaagagtgcaaggatgggataccctataataaattggtagtaggtgagtctatattgcgttcaagaaaaagaacagagaagcacagcaattagaatacattagtaataattttactattagtacattcccagaatggaaacagaacattattaggcacttttgaccagcaggagaattggaggctttcaatcttaatagaaaaagttcctcacaaagaattttcaaaaaatttgagaagttcctataggatttctattaattttcaaaaaaaataacaattgttatctctgacggcatctttagatagccgccttttcacaagcagttagttaggttgtccgtatatgtaagtatatctaactatccacgggacaagtgggcccacacctttacccaggcatattttcaaagacatccacatgtgtaaaccgttctcgcaagcagattctaaagactactgcatgtgtaaacatattcacatattaaaaagttggatccgagtagttgaaatctttaagtttaggagtggttgagtatttccgaaatagctagcaccaacgcaattttttggcttattcacctccttcccccactagatttgtctcgccgactttgccccacttcctccaccttcactaaggctcaccacaaacaccacaagattttccactttctggtcacatatcatctaagtgtgccatccctgcaccacggctatcaacggctattaccgaagctgcatgcttgcgtgtatgataaaagttgcttgctttctgacttctttgtgcttgctactacagcatgtgaatggggtggcagtagatctactcattcacttgctcctttgcttgtttatgttgattgcatgagagatatggggaaatcacggaggaaatcagcctatggaaaatgtgtgcaaccaaaactctagcgagattaatggtgcatcagtcaaacagcttggtgaggcacagtgcgttgtatttttcttgttgttttgtgtcaacatctaggcactttttaaacatactccctctctccgttccaggttataagacgttttttactttggttaaagtcaaattgttttaagtttgactaagtttacagacaaatatagtaatatttaaaattagtttcatcaaatcaataattaattatatttttataataaatttttcatgggttgaaaatgttactacttttttctataaacttggtcaaacttaaaatattttgactttgaccaaaatcaaaacggcttataacctgaaacggagggagtatatgctatgtaaactcaatgcatctatgcacgtgtaatggcatgagccagatggttagtgcattaagtcatcaaattaacatataatggcgaatgagtgacattcaatgttggtttggtatgaaaagttactttaaaaaagtatttcaggaaaattatatatagaaaatgtttgcgcgaaatgcactgtttgaattagattgttgtgaagattattgtcacatgctatttacttgattatagggatggcttaaatatgttataaaataaattgaataaataacttaaaataagttgtctaacaatgcaattgaaaaatgttttctttcaaaggcatattttgcgaagcatggagcaattaatccattacaacaattcgatgaatatggtgaaaagaacaaggaagtatggtcgatgcttgactacagggtgctctgatcttttgcttacctacgtatttgttacaatgctctaagcctttgcctcctcttgaccgttagtccacaagtgaaattgaggaagagattgaccgctaaaagcaaatttgtaaaaacttatccagtaacaggggacagagattaagatattgaagcctaaagtactctgctgccattcctcgatcctttgccagaggtatcatctcgcctgtcataccatgtggcaattggaagttgggacataacccatatgcgacctgatatgcttgaatttgtgaccttgttgatcgaggagcagaaaggaaggctttttagttggccgaaggagcaaaacttggctgcctagctctcatcgaactagaagggccaggttgtatttgtgcctctcccggcactcccttgatttttctatcatggtacatgcaacaggtagattgtaatggagctcctgatgcctcttagacctaatatgcatgtaagttttttgaggagcaaattgttgtcatctgcttggcatgttattccttgccttctgctatgtctgagctgctctcgttcttgttcctgtgttttcttctctctttctttctcttatggtcatttatatggactcttcgagacttgtagtgttgtgaatggcagtacaaaatgtgggaccgtagagctatttaaaagaaaatgagccacaattgatgaacatttggtttattttaaaaacagtaaatgcaaatggacagaacatggagattactatgaaagcaggcgatttggtatgaaatgaaatctttactgtgatgtggggtttgtcaaatttaattgccttttacctctctgtttaattttctgatctattccatttttgagatggcctcaaatttactcacttgatatagtagcaccgcatagaaagcagttattaggttcaatggctttgtatcaaaaactatgtaaaacatatttccacgacggtctatgtttattgtcatattaactgtagtctctttcctgccagcaaacacagttctactaattacactgaaaaatttattgaagccttaaacttagcagtggcaagaaaaactccttaagctcagcaatccaactaagctcgagacggcagctgcatccactctagggatgaaaacaaaatggattcggatagataatgttcataccagtatagaaagtagatatccaatcgggctatgatcatgtgagagagaccgccaagccaggccacgaagggcagccggtaccaaggggaaccaccggctacatctacgatttctatatgagtcaccattagcttagattatgtgcaaccatgttatcagtttttccttagaagttgacccataatatcaactgcagtattagatcttaattagcagaagaaacgataggattggtggccttgatggcccatcctttttctctttcaatgtcaccatatatgtcattaataccattagttgttcttttaaatcttttttatatccttagacattctccttattatttttttaatgttctgttatatattgctcgctatattttcatgcagtttctttcatcaaagagcaaatcacgctttcttagtatgggttgaattaatcatataatacaaagacttattttcatgctatcagttgtactggttactaggtccaattatagatatgttctttttagttctttaaaaatgcatcttaaccgctgacaaacactggtaagagagattgtagcttgaaacgatatttttaggtatttctccaatgcccaccttaacacgtggggtatcatcttgtataggaaatacacaatggcaatcagacctgctgtgctgcctctgagattacctgctcgatgctcgttaagcatagcatgacccagcagatagattcgtggcttccgatgcctcccatacatacttacatagcacatagcagtagaagactaacatcgatttctgcattaacaaaaaggaccgcatgtagctcactacttaaaaaaagcatttttttccgacgtggggtctttttttcgcaggcggacatgacccttggagccaaatgaccgcctacaaaaatataaatcgggtgaagttcgttatccacctacgaaaatctattttcgcagacggaccacttaagcggcgtctaaaaaatgtttttttgcaggcggaccacttaaacggcgcctgcttggcgaaccttatgtggtccgcctgcaaaaatcctacctacccaaataaaatcagtcatccttatcttctcctccttcatccttatcctctcctctccaccaccatcccctcctctctctctcttcccttcccatcatatcctctgctccctcccctccccttccttccttcctccgtgagagagagagagcttcggcggcggcgcgggcaaagggggccgccggcggcgcgaacggagggcggcggcagaggcacgagtggagggggccggcggtggcgtgggcgaagggattcggcggcggcggcgcggggcggagggcgtcggcgatgatgactaccgcacaacgacgatgactaccgagcgacgatgactactaccgccggccacgtcgctgcccctccccgcgacccctcctctcatagatccggcggaggggatgggtgtcggcagcggcgcaaggcgtatgggtcggcggcggcgcgaacggaaggcgtcggccggcggccctaccgcaagacgacgacggcccaccgcgcgacgacgacgactagcaccggccgcgtcgccggccctcccctcccagatccggtcggaggggggagggaggcggcggcggccaccccatgcaacggaggagttcgccggcgacgacgactcagagacgacaacgtggtttttttagtttacatgtacattgatgttaacttgatgtgaatttgaatccaatgcttttgtgatgtgaatgtctgtgattggattttgtttcttggatgagatttgtgaatattagtgatttgtgatttgtgatttgaaaccctagggaggggtggggctggcgggaaatatttttggtgccgagggtatttttgtaggtggggctagtgtagcatttgaggtgcctgggaagatgcctgggaagattcgaacggctgccttcgaaatcattttcgcaggtggtgctttggtccgcctgcaaaaattgaagatttttagcgtcgtttggatacaggcggaaagttttgccgcctgcgaaaatgtgttttgaccacctgcgaaaaccttttttctagtagtggctgctgcagcttcactagttcactatgtgcactatcagcgctgctctcaatgtgtcaagccatacgcatattggagtatcgtctttatttatgctatctatgcacttcgttttatatcgtctcaagagtataactattgctagtatatggttgacactaccatccaatatggtggagatagaaaaaaattgtggttgcagactgtaagttttgaaatttcagcctgaaattgttcttttatggtctagcaagctctacatatatacgtcacagggtgtctttgtgctatgtttatgcaaacaaaaaatcttaaaagaacgtgaaaattcaggtaggagaggaagaaaagaaagtctcaaaagtattgagatcctctgctgtattgcaaagaacatgcgttcgtcccaaaaacttgtaaaatcattaaaaactcttctcttattcaacgctttcagcaaagttcactctcctcaattctgcagtatgtgatatgaggagcttcatagactgctttgtatgaacgttttctgccaattttataattctgataacatcgggcagcctttatacatagatacatatagcacccaataaacagtgagtaaattcacaaaattacatatactatgataaatctatcacaaaactatagatttaaccacgtgtatcataaaactatagctttcttcacaatactagaaatttaaggtatcaaaaaaactacaaattaaacatcagttttattataaaactactttgtaagctcactagtgctatggatatgaactttaaagtctgtagttatttgataatttcatcactacatctgtagttgtgtgatacgatgctttgtaaaatataataattttggtgttaaatctgtgattttatgaaacacatctttaaatatgtagtttggtgatagtttggtcaaagtatatgtagttttgtaaaaagaaaaaatactcgtaaacagtagtggagatatcatcttatagtttcatgcattgttggttcgagacaaatagccttactggcataaatggggccattgttggtgcacctcctggttgcactcatgatgctatcggggaagactatgcaaccatggacttgactctcctcaaatgaccactctcgatgttagggcttccacaatgtacttcaaaattagtccatagtcaataaaataagtaaaaaagtactaattacccccctaactatcgcggtcgtccgaattactccctaaacccaaaaaccagacatcattcacccttaacttttaataccggacaaattacccccctcgacccaatttagagctgttttgcctacgtggcgtatatgtggcaatccagtcagcattttcttattaaaaaaatggtggggtccacctatcatctaccctcttcctcttctcttctctctctctcatccacaagttgacaagcgtggacgacggggatgagcggcagctggaggaggcgtggcacgcggaggcggcggcgctggcgatggccgagatggagaagacaagtgccgcccggccatggaggcggctgaggcggcgcagcatggcatggcgcatggcggtgcggggaaggcagcggagggcggtgcggccgacggtgggcgcgggcgatcggcgcggaacggcacggacaggcaggaggcggcggagaggcggggacaaatggggatgggcggtagactcgtcgccggagtagacgagtggctgacgagtccgtcggcggcggactcgtcagcaccttcagcaggatgttgcggtcgagcaggatgttggccggcttgaggtcgcggcgcacgagcgactccggcttggtctgatggaggaacagcagcgccgtggttatctccgccgagatcctgaaccgctggctcctcgggatcgacgggcgacggcgtgccggaatcttttttctttttatttttgtctctgcccgcttctgaattttctgatctgatttggcgccgcgttttggactttgggaatgtggttatgtgctgcatatgtagtatattggtttctctttggaatgttgggtaaagaattttgtcgagagctaacttgcacacttgtatatatgcatggccttaatttgcagtcgatggcttgcatcatcagtgattttgcagccgtccaccgaggcgcggcggtaccagcagccgccgccggcgtagctagacacgtacgtggtgcagatgcccaaggtcaaggtgttccgcgtcccgccgccggagaacgcgcacctcttccagcactacacccgccgcgcgcgccaggcgccacgcccgctgctcctgcgtccgcgtctgctcctggctcctcctcatgctcgtcttgctcatcgtcgcgctcacggccttcgcccccgtcgtctacctcgtgtttaagcccaggcagtcggactacacgctccagagcgcgaaccttctcgtcggcctctcggcgttgcgccgccgctgcgcctccaggtcggccagctgttgcgccgcctctccgccgctgcccgcctatccgcgccgttccgcgccgaccgccctcgcccaccgtcggccgcaccgccgtgcgcgccgaccgcgccgtccactgccttccccgcaccgccgtgcgccatgccatgctgcgccgcctcggccgcctccatgaccgggcggcacttgtcttctccatctcggccatcgccagcgcgcctgctccgcgtgctgcgcctcctccagccgccgcccatccccgtcgtccccgcttgtcagcttgtggatgagagagagaggagaagaggaagagggaagatgacaggtggaccccaccatttttttaataagaaaatgctgactggattgccacgcgtacgccacgtaggacaaaaccgctctgaattgggtcgaggggggtaatttgtccggaattgaaagttgaggggggtaattcagacgccgcgatagtttggggggtaattcatactttttctataaaataatacattcagctacctaaccacattgtggaagtagttcataggagaaaaatagccaaagtcatccataagcatatgagctgcccatatagaataaaatatgtcatttgtctctatttcctctctcctcttcctactacttactgcctgtatacattgtgaatattgcaatagttaaagtgtcccatctatatgtactactttagctatatgcattgatgttgcctttagcacgtcaacacggataaattattctgatggttgtgtgcatcatcactcgtactcaaccgaacaggcttatatcggaaaggacgcggcggattgccactacttaaaaaaaagcacatagagatcggcactataggtaccgaaagtgctaaaaatcggcatctatattttttttctcacctctgtggattgaaaatacaaaaactgacacatttaaataattatatgtattggttctaaagaaaaactggcatctgagataatggtttttaaaaaatagaacctttaatatattataggtgaccattaattaaaaactgacaaccctaatatattataggtgttggaatttttttttaaaaaaaaggcactcctaaaatcgagtcgagccgaacaccggtggcctcccgtccttctcctcttctcatctctctcttctgtcattattctctcctcctttttcctccactgcaccctctcctctctctctctctcttggctctctctctttatctctctctcagtccccctccccccctctctctctctccatcggtccccaccgacccggcgtaagtagcctgacgcggcgccatccactccgccattcagagttctgaactctgaactccattttagtttttcgctcctaacactggctccgtccctagccacgccgctcgctactttcctccaccgccgatgtctctatccccacccaccccgtagcttcggtagcctcatcagggacagaagggcacgagaaagacggtgaggagaggaggcagatgaggccagcgacgctgccgccgccgctcaaagtatccagatccgagatgtcctcttcgattcctcctgctttctctcggccagcatcaccttgtggctatcagatctagcgacagtgagttcggaggtgcctaatccagcagcccaccctgtagccactgaagaagagggtgaagtccctcaggcggctagaggtagagcaaatattgttttcttatgaaatttttgggtttgttttcttaagcttcggttcttgtttttggcttatggtgttatccgatttggtcatattgaagctatgaaactttacgaggattttgttgtattaacggatacaacttggtttccttttctcctattctgagttggttttcttttctccgattctgagtatgcaaagaacaactgggattcaaggaggatggcatgacacgctcgatggagaaagacgtacacgacagatgaaaacatattagtggattcagggacaagacaacggcgtgatgcgctcaacgaacaaagacgtaccacaacagatgaaaacatcggcatgacgcgctcaatagacaaaggcgtaccgcaacaggcgaaagcgtattagtaccattggaaagttacaaatgtttttagtagttaagataagaaattgaggttcggttggcagacgaacctcagatttatgctccaacggacacttatttgtcacctattgaggcttatttcaactccttccctcattttcactcaagttagtaacagaaaagatatccgttgtttgagtaatttccgcgctcaactactccctttctctgcaacaagttataagcttatcattcttacatggcaacaagccaacagcaaaatcgctgaggatgaataccaatgtcatacaaaaaattgtgttggaattgacagcaagtgagaccaatcgaatggagaatatatccacatctacaaaattgttactctaaagtgaaagcccttctgggttgtgtgcttcaatgtcaacatgtttaatcccaggcacaatcttttggatctctgactccagccgatccacttcatacccaagagcttcgactacatcctcacctgtacaagcagtgtttttcagatagagataacaagcataaatcccttattagagcaacatatatatattgcataccgtagttagacatgacccttattaactccgtatcatccttggacaatgaagcctcccggaactgtaaaacggaaaaagcaagaagctcagggatgtagaaataatgcaaaaccaaaactgggtgatcataatgtcctatgtccaaaacagcacactctcctgacaaggtagagtattctgtctcgcctgtcctctcctcctcaaaattgatttaggacatgaggcttcgaatgatcattcgtttcctctacatgtgtgtgcagaacacaagaaaatctcacgacaaaatgaggacttttcattcattatacatctttaaattatttaaatactagtttaagagttttaaacactgaattacataattcaagtgattttgacactgcaaagaaaaggcgagggaaaacaagtcaggtgttaagacttgaactcacaactaccatagacataaggtctaccattagggcacttgagtacctaaaatctcattaaaatcttgtgctacaagtacaaaaatcacttatattgctagcatgaatattgaaatcttgaaagtaattattaaaatcatcaaaaacaagtaccagagataattaaaaccatgagaaatagcttttaagtgtacttggggattcgggttgtataatgttcactaaactcatgtgtggcaaagtaagcaagtaaaaggcatcgggggcaatttgaaaaagcagtgacttatggagggttttatatttttcttccaatttcctattaaggctaaacagcagtagaaaaatatcagtaacaaatatctagtatagttgtaacttgtaggtgctagaataatatttgtgttgagcacgcaagttaaacccaaacactaacttatagctgaaaatttagctagcatttgaatatatcagctacaaggcattacgtacaatttaaacaaatatagctgatgaatgagcagttgtttcactaaattagcaactgagatataccccgtacaaaaaacagcggccagcaaccactaacactaatcaaactaattttcagaggagaagagcacctgttttgcccattctccacgtccagtcctttccaaataattctgcaccaggactactccattgaaatctatgagaagattaggccagaaaattgtcaagaaaagagccgtaagggagtatgcgaggtaaacaaaataagaaagtaacaggactgatgttatagatgagttcaacaaatcaataagcaatgttaatgggaatagtcacttgcagacacattacaccagctcacatgaggaaaaatccctgtgggcacttgctatcatgggaatttcagatagttctagactcaagtaacacaacactacaacagtacattaatttatcatctgaattggagccaagtcatgagttagattaacgaagaagtataccatattagtagtaagaaatacagtaaatggttaatagaaggtacaacaggtctctgcacatgaataaaaccatcttgatcatttacagatcaccagttcatctcacagaaacaagattgactgtaataagtgctctagtatgactcttttaaacaaaaggtaggcttaagaacaatggatataatcataaatgaagacgtctcaaactaaaaatgacatgcatcacaagtactaactgaaaatgacgacaaaaataaaataactgccttaaatttggagaaagccagattataagagctgtaccaatttcagctttgaatctaaagaatcctggtccaatcacctcacttttgcaatcataaagagcatctacaacctgcatgatgcaagaaaatcagctccataacatagatccagtgtgcgatatggaataaggatatccacaaattttcaccggatcagccttcagaaactcaagaacacgctgcatgtcatgatcatcaatagcccttccaattaaagcatgcctgtttctctggattagaaaaatagcaacctacagagagcacaatagtttaatttggaacaaggcatggacagggatgagaaaattggagaagcaaatcatcagcaaactcatatgagtacaccttttgcactgtgcacaattttggtgattctttggcaatagacttttaaagttcttgttcaatttgggtggcatttcatgaaaacaagattggctaaagctggttttcagtcattagtgtttatgttttgacttttctgaaaatcaggaaaaggtggtcttacagaaaagaatgcaattatatgcttttagagatctccatgttgccccaaaccaatggagacaagatttaaggtggttcaagctagaaacatgtttaaccaaatctagtattatcagaactgtctatccaaaatctcctttaagactacagctctgtatggtaaaccataaattgttccaggcaaacaacagccacatgcatatctgacctgcttactttttagagagaacttccttgggaattggacacgtcatttttaagtttaggaggagttgggtactactgcagattataagcagtaagtgttacctaacagtatcgactgtatacgtgatacctgagtacccgacaacccatttatggttccaattatgtaacaatatacaaatgaattaggcttttttagattttagaaacacacaaaaacatggatagcatccacaattttagtatgagcagaatacagaatatctgaataaaatatacttcagaatagatgtagtcaacatacaagaaatacacatcaataaacaaatctttactggtagctatgaatcttttggtcttggggtttcacaaactgctgatatctgaacatagtgctcatctgttatgatagccaaaatactgttttatcttgcatagaaataaaaaatgaacaaagcaccatttggcccttcctagcatagttgatgggcattcgatgaagtgtagacagcaacaatagaaatgcaagaaataagaagtttaacaagataagtgggataaaagatttagattgtcatagtttatttaattataaagaaacgaggacatgatatttgtgtcagactaaggggtatacatgtatccaataccaaatgaccattcaataaggcagaaaacaattgaacaaatattccgttacatcaattagtcacacatagcaacagaatataagccaagaaagataatagaataatatgaaccgactatgttaacataccattcccagtaagttgccaacaatgatggagccaattggatcatacatagcattgcctgtggtttgaacagccaccaaagatgctccagcaattgcaagacctgtaacagcagcaccatcctgtaggacattatcagggcatgagaaggaaatcaagtagaggaatagcaggtgagtggtaaatgaacaaaacatttattgatatggcatcaccatatgatacttatgagcaactgaagcagtcatcaactgttttagaaacaaaatttcatttcgacatgaaaaaaaaaagtattgaggtagtctagaacacatcactcacttcagtcatgacagcaactgaagttggatcatgaccacgccagatgtagtccctgatactcattccttctgctgctgcacccttcctaacagcctttatagcaaccagcagtgaagcacctaagaggcaatagggtgactcaattataacaaagtaaagacatggttagaatgtcatgtagcaagcatgtaataccttcaattaggaaggacccaccaatcactaatgcagcatagtggatgttctcagggggctgtcaaataaatgtgtcacgatataacaactgtagttaggtaacaaagattttctaataagatggagtgcatgtgtaaaatcttttggtgaatcaaatgatacatttgcatcatacttgcgaattccataagttttgaactccatgcacaatggtagcacctgaacccaaacaaaatattccaactgcagatatcaaggaccatacaaatctttcttttgaataaccatagctgcagaaagagaaattaagacatggggcaggcagcatgtcagtttatggcatatcacaaatagccttaccactgattctattgtgagtagcatttagtggtatactggcatgacaatgaataacaggattccctgtttatcttcaattcaagacaattttactctggtgaaaataactgattttccatgcagaaatgggactaaatttatggtacagagaaaataacagtaatgaaagaaagtgatatttatatgtcaacaaagcagcatttccaaattgacaatcgatacatacgggtgtagagcatctggagcacgtcttgagctgctcaagccatatgcaagaagagcctgatgtttaatcaacaattaagccctggacatgaaccttcaacaaagcttacaaaaaaagatagcaaaagtagaagcatcaactacctggttagcgaagtctgcaactgagtgcactagctcagctagcataacatgactagatgttgaaagccatacaccaaacttcaacgaaaagacaagaaaattacaccacagtgctgtgttaaccgctcgatggctgagatcacattccattagcatcaacatgaaacaaaatgtaataggtaagcttgtgaacaatccaaatatgtaatgattaactaatcgtaatattggacataaatctggcaacatatgcaatgaagaactaaaatcgaatactcttcttgccgttgttttattttaccacatggacaaaaacataaagggttatgtgcaacatgtttttatcagtaagcatcaggaaacatatttcacttgaaccgtacagaataggtaaagtactccacaatcctttcctctcaagcttacaatagtgctacatccaatccccctcccattgctatcaatgtcattgtgtaggacgatcacgaataacatttatgtccaatcacattatagagccaaaagcatttctgacgcatatattccttgaacactcaccccttcaacttcaatcagatagaaggtatcaagtaaccagagcacacctttttattgcaatgcttccaatatattaaaagtaaactaacaagatcatacctttaacccgaaaatcaatacgactgcaggactgaaagaaggtaacacgctaagttgcttgcacattgcaaatagaagacgtactacacacgaagcttagcacgccatacaaaggttctaacttgagcgggggaaaaaatggggcatatccgtctcacctgtgctcatcgtcaaagtgcgccttcttcttcgccttggcgacacgaagagaataacctgcgccacaacaacaagaagaatacgcaaagagagaacctaagaagcccgcaacaacgaggtgagagaggaaagagggaaggtgagcgaggcacccagtcttactgcgggagagggtgagccgtacgggaggcgcgtcggcgacggggccgcgcggcggcgacggggccggggggagggcccgcgcccgcgcccgccaccggcttagccctaggacccccgaggcgaggagcgggcggggcgagaagggaggagggggcgacgggtggtcgtggtcgtggtggtcgccgctgcggcgggagaggaggaggaggtggtggaaagggtatggcaaggaggggaggcgggggagggaggaagaggatgaggaggaggagctagaccaagagaggaggcggaggcggagggccgcggcggcggcgaatgggcggcgcatttaggggtaggggtgacggcggcggcggcgaggctgctgctgcggcggccgcgggcggggcgcggcttccatgcgagggaagcgatagaaaaaggaagcggggggagtttgggcttggttggggcgtggagagtggagacggcgatggagtggacggtgggagagagcgatggacccgacggtggggtggagctcgtggacgctagggttgggccaatctctgtcacgacttctcttcccggacaacagctgccatttcttgccgagggcctatttggagagcctccttctctcggaatcaaaactctagattttttttagaagttaatacttatagaatccaggaaatgaaattaagatttttttattctcagaagcttaagctcctccaaaccggccataaaacttataactagtgttttactacgtatttatttaccctgtgataaaatctgatttatcctgaaacgtgatattcctaaaagttttatcttgcgtgataaatacgtgactcttaaataaacacatgtactaattgcatgtttgttcggatactaactttaccataatccccctgaaaaaaaaaacataatccaacttaccaaagataaaagatgggacaaacccacacaaattgtgaccaacgacaaatgtagcaatgtttggctaagaaatgagcctatgacatgtgggccagtaagttagtaaagtatggtttgtcacagatatagcagttagtaaagtatggcttgtcaaagatataacaaccaaccaaatacttactttaactaaagtgtgtggtacgtctaatgtgtgacgtgacaaactatggcaacaaaaccaaataggtcctaagcagggttggccctgcacttaggcgagttgtgagaccgtctagggcccagagcggagggggggcatcaccaaccccatcccacccccatcctagcctaattgatacgggtaaggcttcctctttcacgtcgcttcctttttatccccgatttgctccttgaccgtgacttcgctttgcacccatttgcaccatctctccatctctatgcgataagcaggcaacatcagtgagagtcggcagcagcgaccatcaggaaacccacaacttgccccttgcatcatggtgactgcactaggtattctcattggcatctatagtccaaaatttaggttagttttattttgttcttgatgattaatctactatgtaattttaggtgttagaatatttcataaggagcatctttcagtactcacaaaagggaaaaaaattgcatcaagaaatgagacattggatatctgttatccccaattcaaggtatttgtactatttggtttatttttcatgttatactatcaatattaattatagagaacggaatattgtattgcaattatttggtttatcatgtagtaatattgattttgtcactttgtagaggatgtatggcttataaaatatatttacaagtacaagaatatttagccctaaaggccttaacgttgggttcaccgttcgcctaggaccctccaaactatagagtcgccctggtcctaaggtccacatatcatcctctcatgttttatagatcacatccaagcaatgattatcgcgtaaaacccttcgacacccacgtacaagattccaatcacatagtggattaccaagtcattgatgatttgtatgttacatgtgttgatttctatggagtaatattaagaaatttacaaaacccaatgtttttatgctgctaatgtcctagtccctacatataagtatttgtgaatttttctctgattaacataacaagaggaggtagcgctgaaagttaataaaaatatgtgtgttgcaaaaaaaaatatacctaacaaaatggtaacagatgaggacagtggagaagcaaatgttgctatgaagaaagcaaataaaggttgcaacaaaagtaaaaacaacaaagtatagtacttactttacctttatcaaagctacttttttttttgaaaggaatcagcacgagactgtgctatttcattagatataggcgtaaaaaaatacaacccctaggggcaaaaaaaagagctgtacaaattacataagcactatgattaagctggtaagaattcttcaagtcgccttgcgcctgctattatccaggttcttgcctcttcctttatttttgccataaggttgggggccgccgtttccttgtgctcgaagattctttggttcctttctttccagatttcccaggctatgagtaggattaaggatcgcagccctttcttgggcacttcccttttgttggctaacatttcccaccattcgtgtatgctttagcatggctcccaattgctcggatccaattgttgataagccacccagttggccgtcagtctccagatccttctggtgtatctacaggaagctaaaaggtggcatgccgtctcgttcgtcatacggcatagggggcacactccgctatttggccatcctcttgtagctatgtcacatcctgattttcgttttaggatttataaattatttaataaattattaatagaatttatattaaatgttctttaatttacaagtgaagttaaatgtgggaaataaaatttcctaaatataaagcatggatggatttaatttttattaaattctccatgattaagtcaattctctgaaattttctcggatttttcggagctcaattcctaaatgctacaaagaacagttcagtaattacttgatcaataatgatctaattataattgttaagtgcttttcttgtttaaaatccttaaattataaattgttgtttaaaaggaattattagaaatgatcttaaaagcctaaaagagaagatctaatttttaatttgttaaatctcaatataaaattgggctagataaaattttgttaaatactttgcttaattctataattcctagatttttctgggatttatttgagctaaggaagtatttttaataaatggaattgcatttcatgaataatttaaattgaaaaaggtttttaaaagtctcttttggctttgggccgaaagccggcccaaaacctctctctttctctctccctcggcccagtccggcccagtccgccgagccgccgctctcttctctctctctgtcgctgacaggtgggccccacctgtcggagccgtcttcctccttcggccgccgccgcccgaaaccctagccgagccgcgccgccgccgctttccaatttggccgcgcctttccttctccggtgaaatcgattgaagggaaataatctcctcgatctcctcttccttttctcttatagaaactccggtcaatttcctttggaaataggcggattcgagtttaattcggattcgtttttccccaacctttccatcccgccgccggtcgccgtgggcctccgccgccgcctccttgcccctttaaaagcacccccggtgtctccgctacccgccgcctctctcgccttcgcccgccgtcgtgtgtagcgccctagcctcgtgagcttttgcgccgccgtcgccgccgttcgttcagccgtgcgccgccgtcgctacggtcgtcgtcgtcactcgggaaggccaccgtcgggatcgccaagtcgtcgccgtccccgtccaccgcttcgccgccgctagagaccgccggagcaccgtcgccgccgttgacccgatcttctccgctgcttcgacctcatcgccgacgccgtccgttgctcctccgccgttgctttggtcaccggtgagttcgccgtgccgtccgctacccgtgggtgctctccgttcgtgccgtcgtgccgtcgttcgccggcgagcatgtgcgcttgagccgccgagttgccgccggtgctgacgtcattgctgacgtcatcgctgacgtcatcgttgccgttccccgtggcccggtcgtggaccgtttgatctcggccgtccgttttggatcaagtcgatctcggccgtccgttcccgtaaaccgttgccgtgcactcggtccaccgcaaaccctagccgctgacgcaataatccttcttttccttttcaaaaataattcattattgcgtcataattcaataaaaatccatataagtgttttaatccgatttaatctttaaaaattcataactaattcatcttaactcagtttaatgtggttcaagttgcaaaagttgtataaaataaagatctacatattaaaattgtccataaattgaattaaatttatttaattctttttaaatgggctttaaatagatttaatcttgtaaaattcataataaattcagttgaagtcagaatgaggccgttcaagtctcataattcatctaaaattataatctacatgtttgtttactttttatgtattgtttatttggtttttattagtcttttccttgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggtgattataattggactagttgagctttatatatattggttctactagatattagatataattgcttagccatgcttagaaacattagcacactattgggataacttatgactcactgttatttaatgatggcttaatggtagctcacgatggttaatcgtgttatgataattaattggtaattaaaatatgattaatggtgggttgtgagcacatggttttgagagtcgtgctcatgacaattaaggaccggttcgcgagctactattgtgaaacattaaccgtgccaaccacaagccagcgtgggcaacggctttaccttttgtataacatgattcattgcggagcaccagactaagaagtggcggagataagcccacgggggtcgctggggagtccatgcctctggtttttgagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgttataactggtaataatttgcttagctcctggtttggagttagatctgtacagccgggtatggttgttcaggatggttgggcctgtgcagcatgggtgtgttgttcagtgttgattaaaatttctgattaactactccactattttatttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagacaagttgcgaaggagaagacgtttggcttataccccagttgagctgcctgtgggagtggagccggagcttcgctagattttatttttccgctgcagttttcttcatggtgaggactaagtgcctcttaagtaagtacttattattttagttaatttgatgaatctgcatattaaattgtcagtttgtgtacctcggctgattcctggacgaggattttatgcacaaataagtttggaaattacttgtgaatttccgggcatgacaagctagtcgatcggaagtccagactctattttgaatcacaagccatgcataaaatttgcattttgcaggggcccaagatttccaaattaggggattgaagttggtgccgactgttcctagacactgagccttgtatgccgaagaggccgagtattctccatgattcgagagcttccagacgatgtgatccgacttattttggtttagcatgatgtcctgggttgcgctccatagggacacaagctggctaatcagttccactgtaaaagtagtgttcccatttagctctaggtcatcgatccaggtgtcattttcaatgccttcacgtagcgatttgcttcttttcttggaaattgcatagacgagcggcatgctgtcctttggtctttgcccgtccagccaggcggactcccaaaagcggatcgtgtttccatcccctattgttattttggtagctgcggtgaagagaagtttgtccgtttcatcacacggtgtatctagtcccacccacggcttggtggggtctttccattcatgccagagccatctcagtcgcaaggccctcgtaaatatctccatgttcagaacccctagtcctcctagtgcggttgggaggcacgtccttttccagttcaccttgcatttccctcctgtaatgtcccccgtccctgcccagaggaattttcttctctttgcatctagaacgcccaaggcttccttagagatcttaagggcagtgagcaaatagataggctgcgcagtcagtaccgacttgactagagttgatcgccctgccggcccgatgttttttcccctccagccggtgacccggtttgctattttatcaaagatcggttggacgtccgtcttgcgcagccttccaagtagaagcggcaatcctaagtattttatggggaattgggcccgtaacgctgggacgccatcaaggatggagtctagatcaatgcttgcacatctgattgccgccacctgtgatttttgcatgtttgtgaccagtcctgtcgcacgtccaaaacgcatgaaaatgtcggtgaaagccttgacatcctctctaaggctgtgttcgcatgcaccttttcccatcccctctccttcgttttccgcgcgcacgcttttcaaactactaaacggtgtgttttttgcaaaaagtttctattcgaaagttgcttaaaaaaaatcaaattaatccatttttgaaaaaaaatttagctaatacttaattaatcacgtgttaatggaccgctccgttttccgtgcacaggagttaggttccccatctcccccatccgaactcagcctaacagggtttatgaaaaccactgcgtcattagcgtacatggagattctgaggcgagccgctctacctcttagcttggttatggcgtttagttccgttgctttggagaggatccattgtagggggtcaattgccaatatgaagagaagcggtgatagcgggtccccttgtctgagtcctctgccatgcactatcttttctcctggtatcccgttgagcagtacttgcgaggtggaggtagtgagtatggtcgtcacccagtctccatttctgcgggaacccatgatgttgcatcatggctaaaaggtaatcccaacgcaccgaatcgaaggctttggtgatgtcaagcttgaagagaagcattggccgccttgttctatggtatcttcttgccaaatttctaacatagaggaagttgtcgtggatgctcctgcctttgatgaaggcgctttgattgactgtgacgagggttcgcatgtgtaatcgtagtcgcaaagccaaggttttggagagggtctttgctatactgtggattaggctaatgggcctgtagtccgtcacctcatccgcgccttccttttttggaatcaggacgatgttagctgagttcagaaggttcatgttcgcacatctcagattattaagcgattcgaagaccgccataatgtcccccttgataatgtcccagcaaactttaaagaagttccctgtgtagccatctggccctggtgccttgtcagctggcatctccttgattgcccgatgaatctcctgttccgtgaaaggatcgtccagatgcgagaggtccgtcgttggggcatgcaaggcttgccagttaatatcgcatgttctcggttctggcctcctcatcatcctagaaaaatgttcgaagataacatcatctttgtcttggtggctcaccgcccagccacctccactgcgaagtctttggatgtaattctttcttcttcgagcattgactttgaggtggaaaaattttgtatttgcatctccctccttgatgtgcattacgcgggaagcttgcctcttccttgcgcgttcaagcgttgccaggccaagtaggcggcgtttaagtcctgctctcagccggtgctctagcgttgtgagctctctttgctcctatgcggagtctagccgctggatgacgtcaagcgccatgtggaattggattttcgcctcagtgcagattcccctggaccactctcgcagactttttccggtaatttgcagcttatgatttaaccgatgcatgggttctgtgtgagttgtctgcttgctccaagccaccgcaacaacgtccttgaatcctggtatccttgtccaaaaactctcgaacttgaagggacatggtttccgtggtcctgaagtattgtaaaggagtagcgaacagtggtcagaagggcctgacggtagagcatttaggatgtgctgggggaaagctaggtcccaagcctcattacaaaagcatcggtccagtttcaccatgatcggccgtcgcctctcattactccaagtgaactttctgttctgtaagtggatttcttttagctcacaatggtcaagggctaagcggaagcgggtcatacgcgcaaggttaatgttctcattgctcttgtctctagccctgtaaatcatgttgaaatctcccaggagcagccagctctctcccgagtttggcttgagtcttcttatatgccgaaggaaggcatcttttagccggtgccttgtaggcccatatactccggttagcatgaaggtagtgtttaattggatgactgtgacatctgctgagatagagaagcgaccgactcggacgttttgcacatttaatgtgtcactatcccaaagtagcaggattcctccctttgtccctctagctggtttgaagtcgaagcgatccagtttgtatcctcctaggaacctggcgagtgaatcatccatgttttggagttttgtttcctgaaaacatgccatgttgcatttcgtgtccagcatgagctcatgcactgtgttgcaccgcacagcggaattcaacccccgcacattccagttaactatttgcaagttttgtgacatttggaatgatggttgcttcactgattctgctcggcccaaacagccagagtttggtctagcttaaaagggcccaacttgctagaagtgatggccatgtggtttcccggcccaacccgcaaggcccatggggcacggtggcgcagtactcgtgtaagtgcgaaggtgggctttgtgttgggccggtggcattagaggaggagtaggaaggcttttttcctttttctagcggcccatgcactctgtcgtcgtagattttttggtgatgcactcggtcgtcgttttggcgatcgctgaggctgttgatgccctgagtgcactgcctcgttaccacgctcttttcgcgattctgcgtcgtagaaatcacagttgaaaacgaagaatgtaggaggttcaaatcaggcttatgcccgtgccgacatcggcgatacatgcaacacaaatgaaggaagtctcgatcggctggaatgggcgcgcgcaggctgccgagagtccagctacaaaagagtagtctggcatgacgatacatggagattgcaatctccagcttcccctttttggtagaagcatcaagcgatgatctccttaatctccgcggcagcttcatccaccccttctcccaccatctcgacaagggagtccgtggggttgtcgtcgtcttcaatgtcgatgccgaacaccgccgtgagcgccgcgatggtgtgctgcaggagcggtccctcgaacattgcgacatattgagcaagcacctcctccatcgaagcggcgccgtcaccgccaggcagccatcccattcgcttgaagaggacgcgctggcatcgttccatcgtcggcaatgccggctgcttagcgatgcgggcactccgacgtttggcgccagtgttgtactgcttgcggagcttgacacggcggccgactgccacctttcttattggcggcggcatggggatgaccgccattggtggtgttgcaaacaggctgtccagggcgagctgtgctggcgtcactgacgtcgttgttgtcgtcgtcgcaccgcttggcgtgttcgtcacggcggccttacccacgacattctgtttcggcgactacagggcgagaatgtctgccttgttcgcaacagggagggcaagctgtgtcggggtcactgacgtcattgctgttcttgttacgcctcttggcgtgttcgtcgcggcggcttcagccacgatattctggcccggcgactgcaggacgatggtgtctgccttgttcgcagcagggagatgcaccgccgtccaacacggtgattgcgggctcagcaacggctcctcagtcgccgccgccaccgccacttccattctggcaagtgcttcttcaatctcctgccgtgtggtctcctgtggggagacgtttgccggcaggtcacacttgatacgcgccaaaacccggctcaccgggattggttctagcagggaccaggcttcatccccttccctcgccggttcttgaatcttctccatcagagtggtggtctggttgaactcctcagccgccaggttgtccttcaagacaggggaatgcatggctaggagaaattgaaatttgcttaccatagcgtcattttccctctggtgcggcaatgtcagctcaggttctgtaggctcgccatcgccttccacacctcggttgcgccaccccctgtagcggttgctgttctccttatcgcgtggccgcggtgagcgcgtgcgctcacggcgatacttcgcttctccgtgcttccaagactcgcggccacgcgcgaggtcacggcgtccacggccgtcgttgtcgtcgtcgccatcgtggtcccgccggcgctggttgtcgaagaagctagggtggtcgtcgttgtactcgcggcgtcgccatggccgctcgttacgacgccccccacggcctcgcctgccatctcggacgcttcgttcaccgcgttcatcgcggtcgccgcggtcatcgcggccgccgcggtcatcattttcgtcgcgtccgttgcgctcctcgcggctgcgatcgcgaccgcccttgccgcggttatcgcggctcctcctgtcatctcgaccgacacggtcgtcatcatctcgctccttgttgcggcccaagcgttcatggaccgagcgtggcggctgcgggtgatgcgggaacgtctcgaaggcgcgagctggcaccggctcaccatcgagcacccccaggttccagggtggaagtcggcgccgcgtcggctggcaagtggtttcatccgtgaggataacacccgccgacgtgtagtcgtggatctcctcgaggtggaaggggacagggtggtggacgcctttctgccaatgcttaggcggcttctcttccacgaacagaatctctgcttgcttgtcttttgcacgtttggtaaacccgagccacattcgcttggggattgtgctcggattcacagtccatgcccagagattgatcgtgcgggtgttgccggactccaccgggtgcacaaggtcagtctcgatttgctccagggcgcaggtgcgtccaatgagccgctcggtgatgtccgccgcccacgcatgcataggcatgccatccagacatagacgcactctgaacatcagagcaacgccaagggcgttttggaggctacgccacttgatgaagtgcacctcgatgccgcggcgcttggcgaagcccttcttcaccacgtcttcacagtggcggcgatgctggaacttgatcaagaaggcttctgggtggtgcagggagacagccacctcaccttgatgaagcttgaactcctcccggattacctcctcaatttccagggcccctgtggaaggtggcgcacggattgcccatgaaacagctgcagtgttcccccactctctcagctcctcgtcaatggcatatgacgtggggatgaagcagaaatcttcctcagggcgcgtggccggatcaccgagctgtgccattgtcgtggatgttgacctggtaggcggtggcgggatgacaacgccgacggcctggcgagtatggatggaaggtgtcggcgaagcagtgcggcgacggtgagttggtggcagggtagcagcagattggcgtgtcggggtggcgctgatgcgtgggcgtggcgaggcgacgttgctgcgcgttcgtggcgaggcgacgcttttgcgtgggcgcggtgaggcagctcggcgacggtcctactcttggacagcctgtcgcgagcgcgcgcgcgacgagagtgagtcagcgcggcggcattctctcgctctgtgccccgaccgacggcaggtgaagcagtggattggatcttggcactgggcggctcggtggtctttggcgaggcagatgaagcacttcccgctcgtctctgcccagaaggcgcagtgggccgcagagagggggaggtgtgatggacgttcaccttgacgcgatgaatgcggtcgttggccgcggcttgaaatctggagtcgttgggcctcacttgaatgctgctcccttcgccaccaatgccgccttctaaccggtgtccaaagcgaatcctctgctttgctggctccctgttcccggccggcgatgtgacgccgcggtagagtagactcgtaggcattactccggcgtgggggattggagttggccgggtggtagctgctccggacggggataataaatgaatatttcaatttggggcactgtctctgctcgaggggcaaattcaaatctggctccagatccgggcactatctctgctggggaggcaggaacgagacgcacccaaagcttccatctcgcccacgaaccacctcggcgaaggagcgtggtgccccagctgactcagatctgggcagaggtgagggctccaagcagtaacccagccatggtgaggcttgcgcggcgccggcggggtggccagggagtcaagaggatggccaggtagctgcagagacgtctggggacctacggaggaggcggacgggcgtgggcgacgccgacgggagtgtcggcgccggcggatggggtgggagcggcgttggcatgagcggcttcttttactactactaattcttgattaggagtactgtcatagtgttacacactcaaagctacttgcaactctaaggaaaagcctggagcaaattaagatcatatatgtatgccatagaaaatattgttaagtagagagtacgagcacacaataaggggttatgtgggaagaaagtaatagttcgttaactcataggtagacgcaagcattgaaataactagactataatttaatataatttgggtcaagatagtttactttggtttgggcttcgagctaaaagcttgttggttgaaattaattttgaaaattcaagcgccattaatttggttttggtgattaatgacaaatccaattccatgagactaatattgttgtaagcatttctttgtctagtctcatatggatatgaaagtggagtgtgtgagaggtgattcccggacttcatatgagttgagatagaaatgttcattgatggtggaactaaatcacaaggatgaaatgcatggagatcaagctatatgtatcacactttctctccatgtacatattgatatgttcatatataatatttccacgtgattgacatatgcatatgagactaatgttttatttgagtcttatctcttatttagtctatttacattgagaacgtggagatgatgaaggtatggttttattttaatgtctatatttgagaaatgccttctattcttgtattggataagctctcaatgtggcatatcttgttatgcatactcttgcttcacacaaatattttgtatgcatacatttagggggagcaaatcctatactttagttatgcatgaaatcgatccaagttattcactttcatttaattgggatctttacatttgagcatatatttgagtatataacacttgtggtgttgattaatactcatcatttattcatatccttttatacatgcgattgattggtcaatgtgtgaaggttgacaaccgaatcattgggactaataatttcacttagttgaataagaaaaataggttccaaggattgaaaagatgttgacgctcaagtgatatgattacacctaaaataccaagaataacaaagcgaagatattgaagatgtgggatacgaagtggctactatggcaagacggtgaagggcaagcgatgctcggtcgcgatggaccatgcgacggtgaagggcaagcaaggggcttggctccgaagaaccaaatccggtggtaaagggcgagtgacggctttgtcatgatggactgtgcgagaccatttgaagctacaagtaactgcatcaatcatttgaagaatatacggtgaaatggttttggcgttggcgtcccttaagacaaaggaaggaaatggaaagaaggtattcctattggtataattctattcctatttatatttgagtatagaaatgccatactattaagagggatgcaacgtcgatgcgtttgtttatgtctcggtgctcaaagtaacctatcatagtactaccttgagagaaacccaagctttaacctatcctttgagtggttttagaccttgttattggttgagttgggtagtcctctaagtgagctttccatagagtccaagatcatcaaaagagactcccgagcaaaagttatggtcgttttactctgtgcttttcagaagttccgaaaatggatgcgaaactgagtttagcttctggaaattttaggaagttctgaaaattcctgtctttgcctccaacagctagtttttgagaggctcgggtatataaactcctctacccctcctttgagtggctgctgttcttggggagtattagacacatccaaagcccaatagccatccccatttccctacctttgtggtgtctctttgtgagggggatttgagaagagaagagagttggattgagagagtgaggagtttagagctagtgagcttcactccatcctttgtggtgcttctttgtgagagggatttgagaaggggagagagttggattgagagattgagaagttgagagcttgtgagcttcactccatactttgagcactcgagttcatagcaagcaaatcttcgattgtgtttgttactcttggggactaaggtctcctaaacggctaggcgtcgccggtgagtacccaagcttgtggtgtgccacggaaagtttatgaaggcttcgatttcgcctccgcaagggaagaaatcaagagtgaaaccgaggagtgcatttgtgcaacctcgtgaggaaatggttgaaatagacccggcccttgtggcccctcaacggagacgtaggatccgtggatccgaacttcgggaaacaaatcaacgtgtctcctctcttggtttgctcgttcttgccatctctcatattgtgcttgagcttgttttgacccgatctacttgcatgcttaattaatattgttggtgaccttatatcttgtttagattccttgtttgtcaccttttgattcatatacattttgctggtggctggttgatggagcaatgaagggactatgggaatggataggacttagggtttagtattttcatgggccttttaccactgggcattttcttaggccatttcagtcttgttggtctgctatgaaatggtatgattgggcctgtgagctaggcatatttggctcatgagtcagctcgagctggctcgttatctctaacaagctaaaacatcagctcggatcattacaaaagtgcaacgagccaagccgagtcaagccgagctaacgagccacgagctttttgttcacccctaaacatggggcatgggccctaaggcattctctctctctctctcttcatgtatatatgcaattttcactattaaagtatacctttaatccattcatatgttaatcacaatgaaaataaacattgatagcatcacgtgtatggcatacccatatacatgcacttactattactagaaaataccacatggataatagactaatagtattacttatgtttatatgtatatatggtgtatcacattgtgggtaatagtcctagttaggttccttaggtttatcccattgtaattacattatagagttattgggcaaattacattctcaaatactgtggttgggtagcactcgtagaaatatcaaataacaaagaacataaacaatggaattgatatcatgatatgtggatcaaactttggctattctatcaattactttcaagagataacaaacattacaatacctaattacaatgggaaatgataaacaagaacccatctacatatccacaatcttaatgcttgactaattagcagttcaatacataccagcggccatgtggcttcgtcaacagtgaatgtggggaacagtcggatgatgatacaattgcttataacagttaccactcaatagttcgttttcagtaataatgaacactttaacatctaataatttagcacatttgaggaaggaacccaactttttttttggaaacaaaggccaactgaaaggtcagctagatttgtacatatgcccctaaagaaaggacatattacaacttgagcacagcgtatgcagatgaggaatttaaaaagataagaaaaaagcaaccaggtccttattagtcttgcttcttcccctgcatcagtaccatgatcgatgatggcaacgatggggagctcgcaaaaaccatggcaagctgcataaggttccgccaaacaataaatttgaatgggccttctagagatgaaggttacaacttggaaccatgggagaacttcagctgtcgttttaagacccgtacgggaggcaaagaagaggaccaaatgcaaagcaggaagatcgctggagaaggggctgtcgaccagcgctacctggttgatgtttagattgaggacgaagccaccaacccaagcagatatgttgttccttcagctgccgacgtcttggagagacccgacaactcatagatagaaggatctcgtcggcaagttcctccatcaccggagtttcttgggacaagtaaggccagacactgacgacctccttgaactgcacaaaagaaacgggatgaacctgaaaaggggaaaacctaactacacctactactaagcagagaaggaaggtctgacccctcccctcccctcccctcactggtggggaaccaccggatttgaggagaaagaggggttgaagagaataagtgatttactgtgttttgcgagagatttccggatcattggattgtatccaactcattttcaatactaatagatattgaattatactccctccagtgtgaaatttgttgacgttttagctcttgaagaattatatgatatttcttgatgttttagcttttttttttcatcttggaccttcttgcccctgcatgcagccggccattacacccattatttccaacgtcatgcatgcatgctgcgcaggcgctgttgacttctcatttcctgttcaaccattactctcgcgcgagcggagtaatttccttcttctatggctgtttgttggctctttgccttctactctcctccttgcactactttcgccatggagcaggtcgtgcaggacacagccaccgtcgccgccgtggagcaggttgacgctggcgatgtggtggtgaagctcgcacaacaggtggacgtcgccgccgttgtgcagaagtgcaggacatcgacgctgcggctgtggtggtgaagctcgcacaacaggtggacatcgccgccgttgtgctgaagtgcaggacatcgacgccgccgctattgtccaagagtcgacgccgccgttgtggtcgacgctgccaacagtcacacgtccacaatgccatgcaaaaatatatggccactaagaatcaaactcaagactaatagcttcagttttgcatgcgatggccactcaaatcaagagcaagttgtggtttggtgtgcctcgaaaccgtatttattaggggtaaaataggaagtaggaacactaattaatcactcattgatatgtgtaatcctgtctagaacgttaacaaattaggaactcgagggagtagtcacttagtacttcctattcatcaattaactcccatgacacatgtctcgttatctcctaaacatgtcattacactggaaacatcttgtacacctcctttcccataaaacaaagatggaacacaacatttctatgccagctcacccgtgacatggccctctcctattattatagcaaccgaaaacccggtcatttgcatcatctcctcaacagcgtgttacaccacagcaaaaaccgccgagttaacaacggacagattcgctcgcagctcgaataggaaaacccgcaacgtcggcgtcgctttgcctgtgtgctcggcggcccatatttacgcacgcaagcacgcacactaggcgccagcgcgaccaaaaaaaaaaaaagaaaaaaaaagagcgacgcgacgcgacgcccaaacgagaagcaaccgggcgcacgcacggcgatacgagacgatacgccgccccaaacccaacccggaggaggaatagaaggggaaaaaaaaagaaaaaaaaaccccacgaaaaaaaggtgagagtccgaccgatcgccggcgacctccgccccgcgttcgcggatgcgatgcgccgcgcgccccaccaccaccaccaccactgcgccaccgtggtgggccgccgccgccgacgacgcgcagggctgccccgccaccgccgctgctgctgaggagatccgtcccgccccgccccgccaccggctcgcgccgacgaccgccgtctcgcgcctccgccgccgccgccgggtggcgcggcgggcgtgtccccgccgacatgtggctgttctggcgcagcaggaaccgcttctccctcgaagagctccggtgcgtgccccccccctacctacctgccctccctccccgtcccgttaggtcttcgtggggagccgccgcgcgcagatctgcgccgcgctgtaggctgtagccggaatcagcgcgcaatttcgtttcggttgcgtccaactaaaacctcgtctccgcccgattccaatccaatcgcttcttaattttgtgctaagtaggccttcatgtctgtgttatctcttgttgtcgacttctctatgaactgtacaactattaagcttggtttagaattgaggagtcatggaagtggtaaaccaaccagaaccgaggcatatgtaaatctacagtacaagagaggggattcttcttcctctcctgtcccctgatggcatgatgtaatgtcctcaactgcttaatactgtttgcatttgctgttgttgagtacaaagtttgtaatacggaggagataaattggagaacaactgtttttgagattggatatgcaggattagtcatgatcaaagtagttcaccttggaagtattatttacttctgtgggggtttgtctgtgcgatatatattaaaatcaagaatcacatgagctgtgatggttgagcagcataattacactaagaaggttgcacaagctacaacgtgcatttttataccataaccttgtggaaatatcactttgtggtttgtgcctgcttccttgcaattagaagcacacagcacaaaaggggcattttaactaatataaactttttattatagtttatttgctagtaaaaaaagaaaatgcctgcctgttaagaaccctcaatttgtaagttcattattattctaatgaatgataaagtaatccatagctgtttgggacacatatttccatcgtgaaccatctttccttaatttagtttgtagtaagtgttgaaataccccaggtatttttgtgtgtgtgtgtgtgtttaggggggggggggggggggaggcataaacaacgcaaagccacgaggcatgatttttcttgtgtttagttacaattgttatgctcaatttaattttgatatttgttcaaagttacatttctcattccttttctaatgtttgctaaatcaaaagttgttgcatactcatatgttaatgctctatgtaagtttcatccttggtttttattcctatacttgttgcatatcttatgctgagacaggtcctttgctgcaggtatctaacagatcagctacagaaggttcatattgtttatgaagctaataaggtatagttgatgttcctggttatcgccagaatttttgtgacaattttaagttgattggcctgacgatctttcttttgaaggattttgttgttgaagcattgagatcaattgcagaattgatgatctatggagatcagcatgatccgtcatacttcgagtaagtatttaatgggatggtatcttggaggtattatcagttgatctatttgtttaattggtatctctttcagatttttcatggagaaacagattatgggtgaatttgctcgtattttgagaatttctaagctctcaagagtgtctctacagttactacagacaatgagcatcatgatccagaatttgcggaatgaacattcaatttgtaagtcactacagacaatgaatattcactcaataatgcggtatctatcctgtgtctacactattttgtttttgaaggttctaatctgtaagcaattatattttctgcagactatattttcagcaatgagcacatcaacttcttgataacgtatccatttgattttcaaatcgatgagatgctatcatattacatttcctttctacggtttgtaaaccagtccgaacgtcactgacatcattcattttttttatatatattggcttacttgatttttgtttcatgaagggcaataagtgggaagttgaacaagaatacaatttctttgctcgtgaagacaaaaaatgtactcatccaatccctttttatgcactttcggtattgttttccttgcttcttttgtttggataaataaactaggattctattctgtatttactgatttgtgtgtgtatacaataggagtagctcacgacaaattcctagctgccaattacaaacagaccttcagattgaatccgacaatataattcgccattattgttatgtcattcttgacaccccatcgaggccagcaatattatacgcatgcatttccttccagtgccatagtttctcttagctccacttagttctgaagacagatctattggatctatttttctggtctatttacattatttgctacattattttttttggatcagttgagctgtacatgttatatgaaacacagtcttgtaacagattttctctatactatatgcaggatgaggtcatttcctttccgctgtatgttgaggccttaaagtttgcttttcatgaggacagcatgattagagttgctatacgtactttgacgcttaatgtgtaccatggtaggttggatagccttgatggccattgtatgtctgttatgcaagttcttaatttgcatttgtgctgtttcttaccagatcgttcttttctttcagttggagatgaatctgttaacagatttgtctcacgtgcaccactgtcagactatttttcagacatggtcaatcattttcagaaacaatgtattgacttggataagttggttgttcgttctgttcggtaagtgtgccactcatttcgccattcatggataaatccagaacatgtcactaaggtccatctgcatccagaatatgccactcatttgatgataacacgttggcctgtgtcctcgtgctgttaagacatcgatgtcataaaaacggcttccttctgcattgacagttatagtaaatgtgcaaaaataatttattttcttccgtctgtgttctattctacagaaatgcagattctgctgtgccaacagcctctgttgaggatgcaattgtgcaaattgaagatacactctattatttcagtgacgttatgtcttctgggattcctgatcttggaagattcatcactgaaaatatcttgcaacttttggtgtttcggttcttactcccatcgttgcaaaggcagagcactgtaagtttagcgagaaatattttttgcatcctatttttgatacctaagcttcctatttgttaaaatttattatgttcatgttcttttgtctaggatttgggtataagtgtcactacttccatgtacttgatttgctgtatacttcacatttttaagaacaaggatatggcaagcactgttgctgctgcccttttccatcaacctgattgccatgataggaagcaaggaactccaaacggttatacctctgagcatgagaatggcatatctgacaatcagggcactagcacctcagatatagaccagtcaaatgaagacaaatcggatatcttgtcttcatcaaacacgcattgcttgcctgatgatccatcatcaagtgattgttgccaaggcaatacgcttaggtatgctgctcttgctttgtttgagtttccattatgcaaactccttgattgtagttcttactagtactaatttgtaaactatagatggtaatttccactggaaatggggataaggcagtagtctgtagtatgttatatatttctaaacatggtacgtggtattgttaggcatataatggttgcgaagtacattttatatgctaaaatcgttagggatttattggcatgatcttccttgctaggtacattttatcttagaaattctggtagatttggtatattctgattaaaaggttcattgggatcttattcacgcatttattgatattttataatttgttatagttatgctttagttgtagaattagtagttcaaacttgttagtaagaatgtctatcatgtgccaagcaccactccattgctcatgtgcgcaccacaaacatgtatgcagaatgatcttgttttaccactccattgttcgatatttacactaactgtgttcttgaaggcttgaacccatttgtatcctgataaatttgtaagtttaggggcataagtggcacaaagattatttttagggacctactaaaatgatttttaagtttaggaatccaaatgacagcactaagtccttgtttgggaggcccaatttcttggctcattcacatccaatggccaggttttagttcatataccctgcccatccccatggataccccaggtttttttaacatcccaagcatgccctaagcaagtggggggctagtaatgctccaggcatccacatattttgagagcttccaaaccacacaaaaaaaaaaaaccccaccaagttcaaagttcaataaaaaatgcatgggagggtagtagcacccattaccttcatccttccacgcacacttcaactagaatgttaattttatattaatagattagcgaatttcatggttagacttggcatgttttcgatctgttgggttctctggtttctttggagatgttcatgatatcaggtgcgtggatgatagtgtggtcattattatcgtaagttgcctgtcgtggttgtccataaatataagggagatcttgctgcaattttcctgctgatttttcttttttaaaaaaactggactcaaatatcttgtgtatgcggtttggtagacctatgtttatgtggatattcaggacgttacagaaccttagtgcaattctcttctcttcatgcattctgctccccgtggctatgaaaaaaatattattgggacactgacatggtctccagaatgcatttgtaatgaccaatttgcactgttgtgacgtactttattttgcagataaactcaataaaattttatgaaattacagaatattgcatgagatatatctactcattccttagtatggccaatataaatattccctaatactttggtaagttaaaatagtttgattaaatgattctaggataaccttaggcactatatttatcataggtgatacagtagatagtgacatagacctttcttatgcatatgcctatatttacacagctatgaagatatttgtttttaattgatgtttttaatgttgctttgtggtatgttaaggttggatgttaagtagtacgtgcataattttacatattttgtcattctatatggtaaaatatgaatccatttccttatttgcagggaacatttgctgtcttatataataagtggggatgacttccaagctttaggttctttgtgcttattttctacattgttgcagacaaaaggtacttttactgtcctcatttaactaatattttcactgtggaatttccaaaaatagtaattatttgagtccatattgtctttctagaacttgatgaatcaatgctagatgcacttggaattctgcctcaaagaaagcagcataagaagcttctattagtaagtgctattcttcttcttcttcttcttcttcttcttcttcttcttcttcttcttctgcaacattagtacacttctgctattatcacacccagaattctgatttacatgtttgttagatgggccttgtaaattaatcatgctgtggtaatggtatctatgttgttttgcttgtgcaaaatgatgcatctgtttgtatgcttgaaggaactaattttgtgaacttttattattaatatagtacataaactcccttttttctatgtgacatttgttgctatagcttaacattcaatattgaaatgacataagtacataacaactggagccatgattaacttatgttaatcatgttaacttatgttatattgtacctttgttaagatcatgtgagctgtcttaggcacactaattttctgacacctgtattgtgaacctgcagcaagctttggtaggagaagatctagctgaaaggcaattattttcatccagtagcggtctagcagatgacagcatctgcagtgattttgatatgtatgtaaggaagcttcaggtatactgctggttctttcacacacacttggcaggatgcaattatacttggtgccgtctactactttccaaaactttctatgacatagtggggtccacaattaagtcctttactatcttataatatataagagaaacccacacgtggcctggtatctgactgcaaatattgtctcctgttatctcattgtataatatggaagacatgcaatggggcttagagccttgtacatgtaaaagaaaaatatcaagaaacacaagtagtccctgtagtatgttacctactgacattgcaacttcaagttggcccccacctgtgtgtactgagaaacaaaaagaaagtttatagtgctaacttttgtttataactttttaatttatgacttaaatgaatttactcttgttttcccaagcccctctttagttgagcctgaattttaaatctataagtttaatttggtgatagactattacaagatcacctacatgtttgttttgtcttttggtgttaatttcgtgctcgaaggggtgttatttgaactcgttgccctgcgcttcatcaacaaatatcatttatgattcttttcatgatcataatttgtcatgtactccctccatcccaaaatataacaacttttagagttcaagttttgtccggaatataacaaactaatacttgtaaaaggtgatttttactactaaacttcccatactaccccttggttttattatcaccccaactagtctgggcccaccagcccacacttcacccaccccaaggagacaaacaagtccttttacccctctccttaatagccgtgccaagggctaaaacttggtatattcttggtatgttttgggatggagggagtagaagataattttgaacttgccatcctagaatcagacagatttttaggacaaattgtccgcaggtccatgcttattaaattgagatacaaataaaactatcttgtttctttcttgttcgtgtgtttgtcaattattctctagtaaatttgttatcactatgctatatctatgcattttgtcttctttccacaggataaatacggtttaaagtgtcatcatccacggcaaatgacctctaaattccacagatatcaggtttgttttaattttgaaccatatggacattaccagtagatcctcatgttcgtaatataggtttaggttatttttccctcaaaaatggcatcattttttaaatttattttgattgtaaacttactgtcattaactaaaattgttgttccatcagtacatggctaatcattggtgcacactttattttgttatataagtatgggctacaacctgtagacacctcaataaactgtattatagatttaatgatttattattaactgagtaactgatacagtcatcctgatgtctctccaaaaatctatgaattttcttattcaagatgatctttttatcttgcttgcatctacatcaggttattttgaaagaatatatttgcaacttaaaaatatccacacctacatgaatcatgaacgcctgtttccgtattaatattcattcattaattttcgctgtagtatacacttagaggttgatgtgctacatatttgaatatgacttccaatattcaagcattttattttattatcatacttcatatattaagggacgtttctatcgtttgcactttgattttttgcaggtgctcgatgcattagttgcccttttctgcagatctaatgtatctgcagatgttcgcttagttggtggctggcttttcaggcaactgctaccccatggagaagaagagttcactgcttttcatctaaaatggctaaaggtatgttttgatgcattttagtcctgtgatgtttcaaaggagatacagcaatacatgatccctcaccagatcactattcactgggaacttggcagttctttcttgttgtttctagtcctgactttgaagcaagtgtcatctcctaatcctaatgtttgaaacttccccatatatgtcacagtacgcttggttgtggctagttaactagttgaatcactaaatgaaaggtacaaagatgtagtgatagagagaatatctgtatatgggatactgtccaatgcctttctaagaggacaggcaggctaccaactgtcatatctcgtgctcaatgttgtcagatttcatgtactctgtactgatcatggatgtgaaggttaaatcaagcatttatgtatccctccacccccaccctcttctttttctcttccacattgtcactaccctttcgtgtcagagatgaatccatgctgcccatgtatctggtacaattagcctaaatttctcaatgttgtcacaatgttttaatcgcgcaggattcgcataaggattacagtataaaacttttggacgaatctggaggatgctggcgggacttgcttgttcctattgttaaagaagcctggaagaattgcaagaaaggtagatttcaattttgaggtggaagatcttttttccacacgtactacaaatggttatctttgcttatacttttttaccttttccactggagttagcaatcgagacatcttcaccacctaaaggatccaagtctgctattttacccctggattcatgttcatttggaggtcagagctcgttgatcacatgccatgtgacctgtgttgtcctcaactgtactgtgttgaaccatgatgaaaacttgatgtactgaatcatatgcactgtatttcaggtgattcgtccattgccatcgcagagagaatctatgagatggtgaaggtatgtaaatattttcattttttttgactcatccataaaaattgaccgatctgaaatcataggtttgttccgttgatatgcatttctggattttattaccatcaatatgacagggcctgagtgcctgacacagaagtattgcctattttggttagaagtcctaatatccattggcaactgaataacatgtaagagagagaaccgaatggaaaaaccattgataaccatatccacaattctttgctggttgctgtgctggaatctgtagtaaatgtggccacaaagatttacttcagtcatcattgtgctcatggtcagtttttaaaaaattaaatggatgtacatgcatgataatcagctaattacaagatgataatttgtatttgttagtacaaagtttataattactttggagtctgcaaagttccttaccgtcctacttttgtttgtcatactggtagtataaggctatattttacattttataacttgtaatggttcgatagacatgctgtactgtgtgctcttgacacagaatatcaaacttcaaaatgttctctgaaatatttcgagcattaccagcagtgtaggtaatgaagtagattctgccacttttcagatgccatggatataaaaccatgaaaaatagcaattttgttgcacaggtcagaataaacacgaaacaagactgaaaaattctcctattaatggctcgaatacattaatctttacaattgatcatttagaagttgtttcttatttgctttataatcagatcacaatttgatttgcactgttacaatcagcaaaaactgttatttgaacacatacgcatgtcctgagttcttttatacatgcagttctatactcttgctagctgtagatctacaaaagatgcggaggactcccaaacacaatacccacccaaatgctgatgaaatcctctatcaatctccaagcatagaaatatccactgaccacaagcaaccaagggagagaactgagatgaatgctaacataaggcatgataaaacttgtgccatcacagagtccttgatgttgtcacggtaggatatgagagagcaaccaagggagagaaccgagatgaaagctaacgtaagagacgaagacttatgtggtcacacatagtcccagatgttgtcatcatagttgatgacaacttatgaaaggtgcactggtcgtaacaactgcttgtggttgactggttggggcgctgtaaagtccttgttgaggtatttggagttgcatgctaggtattttatggctgctggggttgcatgacaaagctatggaacttggctgtactggaatgagtttttagaagacaaatattatttgggttctttgaattcagttgaacgttttatgttgcatttaaatccaaatctactaagtggagtcccttattaacagaatctgaattaagtaattctttggatgtgaattaacataccaaataatggccctgtaaaatctacatcttggtgtttttgttgaataagtgtttattccctacctaccaatttttagtagtttattccccacgtaccaaacttttgtactagtttatttcccaactaccaccttttgtaccatgatttgttcttttgctactaacttaattttctttttgcaaaagatggcataatccattatattatgggacggaaggagtaaagtaacagactttgccctttaggctgtatcaaattcttatttgtatggttttaagatcccttatgttgcaaaatgggtaaagtgaaatgataagaacgattattggaatatgaccatgccttgttcaatattctatgagtgaaaatgaatgttttaagggatactctaattttaatggtgtaacagaagacataaatatagtagatatatgattgtaatagtgtatttttcttaatttgtcatcacaagtctaaaacaccattcatattatcaatggaggcagtaccaccataatacatatgttttgtgttatttttgacgtttagagagtttgtgttcaaggtttatctagttatctatctgatctttctgtaaatacaatgtaattatgagttgcacttgcatgcactggccagttcacccaaaggcttataagctcatggtgaaagtcagacaattcacttgcacatccagacctcacatgcaggatagaaactagcacagttcttttttttttttgaaaaaaaaaattaaattgcactgtattcaaattatagaacatttaattctgatgtcatattgagttgcatgcacctgacggttcactaaaaaacatagcctattgagaagggttggcaattgtcttatatttcaacagtaataatgccaacaagaagccctactaaaaatgcctctaagttatatgcagagtgaatgtcctgctaggttttattttttgtttgggaactcttgtccaacatggtaaaagctgatgcactaagataaaatttctaatcgccatttccgaaatgaaaattttaaagctgaatgctagttcagtgttcttgtcctatgaattttatcgagctgttggtagatcttggctagcaaggtggactgtgaatggtgcgcgatatgaatcaccaagacaggtactcagtcatggtggcatggtctcatggcaagtaagctgaggtggatggattaactgatgcagtgagagcgttgcgacacacagatgacagatcgggagcatagcagttgatgtcatactcatgttggcatgtgacagtaatggcctatgtttggtgaagtgctgtggagcagtgtggtgtggcttgtcagtaatggtgcctactcatgctgccagcaggcatatatggcttggccccagtggtacagcaataaggatttcacagtggccatggcaaccttggtgacatgacgacaacagtagctctatggtgacataagtggagatagtggcatggttaggaaggacagtaattcttattagaagcaagcagggccactctgggatttaggaaaataaattaccctgtctggtgtccaccttgcggagtggcctttgataagaatatataaaaacaatatgcatagtctgcattgtgcatttgtcgctttcagcagttttgaggtcactgaatttatctcatgttgagtccaatgatcaggtaagcaacatttgttgctcaggctataaaaagctctctccttttttttttcctcgaaataaaaaactctctcctaacaaatgtgataatcactgaagttgagaaacctagtgtttacatcattacaattactactcttaacttacatatgttctgacctgtatgctggtggaagaaacatcatgctgcttttgagtgaatttagatcttttgtaccctctgtgttttgctgctagagtcacaaattgaaacatgaaactaaatttctgagctttattttcaatgcgctatgctttattttttccttcgaaggtaaggaaagcaataaatttggaacatatgacttgttctgtcatagttgactatgcctctgcttaatttattggtgaaatggctggcctattaatttacatattttattaggaattaatgttactgagatatgtgatgattttttccagggttttgtgctacagcgtcaagttatcctcttctgccttggagaaactctcaccgaccagcctcctattttttccccaactgatttgcctgtaaataatcgagcaactttagcaggtttcgatggctcagtacccaaacctggacttgaagttaacttaggtctgagtttacctggaaatttaaactttttcatgcttaaatcatcacaagtgcaaaattgtcttaattctttcctgcacttactgatacttcgatttgccgcattgttgttgcagttgatgcggtcccttgtcgaatagcatttgagaggggcaaagaacgccacttctgctttttggctctatctaatggaacttctgggtggattcttcttttagaagaattacctctcaaggaaaaacgtggaattgttcgtgtcacagctcccttggctgggtctgatgtatgtattatcattacatggcaaatcttttgtttttttcatgcatgatgaaatcatattcattgaaaatatctagcttgtaaaagtatctttatttgtgagtaatctaatgtgaacattttcactttatttcagccaagaatagatgaaaagcatgcaaaatggttacatttacgtatccgtccttctacagttccctttttggacacagaaaaatacaaagggaagacaagaaagtaccttgttgatggaagatggacccttgcttttagagatgagcaatcatgtaaggaagcagagactatggttatagaggagatgaagctccaacaaggtgctgttggagaacagttgaagctattgcttgaatttgacatgcctgaggatggattacagcatccttgctcctctcatgaaaccacttcggatgatgggtcatgacttgctagaacatcatcgatgatcgctcatgccttactggaggtttcatcatgtgcagtgttcgagctttgaaaacatggtggcaggaaaaccccgtcgctgccatctccgacgagcaagtcggtcacgctctgtacattacatcggcagatttagggaggtccccttgttgacacactgtagagtttcgagttttgactgtttttgagttaagttagctcgataggattctttgtacaatagtttgtacctgtcctttgtaatgtcatacaaatcacattccattctttcataagcttcagggcagagttgggctgtgtacactaattgtttgaagaaatgtgcaggcaatcatatctgttgtcaaaaggatgccctgactatagtaataaaatatgaattttgagctcctccatgatttttctttgtagaccactgcttatgtatgaactatttgttttgtttgctttttcagagaagaactgttagctttgacaagcaggatgctcagctaaacaagacaaccagatgagcatcggttgtgcttgttgaattctaccctttgaactgacgcttggaattgagtttgatgttcaattgattgatgcaacactggatgtctgcttcacaatgcagggtcttggtaagatgatagtcttctgtagaccgagtgtttggactttggagcaggtgagcagccggttcatccataaaatactgccgttcatcgatcacttgtgcagaaaaatcttttctgatattattcaagatttgttctttggatcatgtctaacaagtagaggtacgttcatttcaccagagaaaaagaagatcgaatctgaatcattcaggttatactctcggtagtttggaacactcaaggttacattgtcctaaattaataagtactttggagcacccaagaaaatttttttaatcaaggttaaggtgaaatttaaatgaaaaataattgcgattggtcaagactattaaacgggtgaagaaatgaagtgagagagagttgcgatatgggattagatggagaggtagctatatttcagggcaaaattgaaatgctaaatttagttatatttaaagattggcatctgtcggcacagtttggttcaaatcttccgtatattttttttttcttccttgcctatccctactgataagtgtccatccatctcccttcacctctttttactgcctctccaaaggcaaaagtgggggttaaagctttttttttttttttgggggggggggggggtaattacaggaaaaagggagctttctgattggcctctttctgcaccgagttgccggtaaatttatgcacgcgataaaatggactgcaaaaaggaaaagcttcctctttcccgtgcttagcaacgacgacgaccatatagcatgcccgaccgaccgagagtgatctgatcttccttaaaagtgccacaaaaagggctgaaagatggggggcaaggacaccacaatgccatgagaattcagaagctatgcaggggttgagataggaatggataacccttctttttcccaaaaggaaaagcaaagaaagggattagcaggttatgtgtgcattgtgcaatgaggtttttgattttcttttttaaaattctcattcagttttctacagtttgcatcaaacatagttgcgacattacatagttggcatctatcaaaacatacaacagggtcatatagcctatttactgcagataaaaagtcgtggcctttccttttaccaaacaacaggctgtcccaaggccttttgcaaggagcatgcgaccaaagcagcgctctgcagctgagctgcatgcaggggaatggcaaaagcaaagcagagcagagggcagaggaagaggggatgcgtcgtcggtctggccggcaaccggcgacagagaggggagaggtgaataatgtgaatccaatccaatgagagacaaagtgaggtaaaaaatatgaaaagagaaaagcttggaggggaggggccacggaatttgtttgtttgttcgtccaattgtccctctcaagcccttggcatccaacacatgtacttcatccacagtctcaaaatttaagttgggttagcccctatgtactttgactgttgattttttttctccataatgtattatcaataactacgaaatttagcatcgtacagaagtattgcaaatataaatataagatataacatgacactaaacatgtaccctattagtttaattattagtaaaaaaatgaattttgactttttttctggtaatataggtggcctcatatttatattttagtatggagggagtagtatttacatgtagaatctactggctgcttcttagaaaaaatgattgagatttacacaaagagaaatcaagcaaccgataaataggccatccatttcactacggttagatatacgccacatttgtcaattgtattcacttacagtaggcaaccatatgccttacatcttattaaggataagtacatgtgatgtatatatatttaaggcggaaatcctaatggacgggtgatcgctcccccatccgcccagcgatcaccccctgcccctcccctatactcagatatactcctccctcttctcccccttcctcctccccttcttctctttctactacagtacaccacacaatttttttaaaaaaacaaaagttagaaaaatttatgtatagaaatactatatataaaaattttgaattcaaattcaaatttgaatcgggtaggtaaacttttgacttataaactttgggtctataaactttaggtgtataaactttagatgtatagaaatactatatatagaaaatatttgaattcaaattcaaatttaaatcgagtatataaactttaggtgtataaacttttagatgtatagaaatactatatatgaaaaatatttgaattcaaattcaaatttgaatcagatataattcaaattcaaatttgaatcgggtatgtaaacttttgacttataaacttttgttctctaaactttagctgtgtaaacttgagttgtataaactttaggtgcataaatttactaaaataggaaagtaatgcggtgccaaaaaaaggaaaccagttaggagggtaaaaatatacttcccatccattggcccgtataattttcatctctcgacttcatgtagagcctttccatcaattattaaaactatgtagaattcatttttatgttcttttatcagtataacatataaggcactgcattgaagagctaatgcatgacagatgaaattgagtttagtacgattattcgaagacagaaacaaataaaataaatattaaaagtttttttttaagaatgctgatgaacaaagttttttttttctaaatcttactccctctgtttcaggttataagacgttttgactttgataaaagttaaactactttaagttgattaagtttgtagaaaaaaagtattaacatttttaattcaagacaaatttattatgaaaatatattcaattattgaattgatgaaactaatgtataaacttagtcaaacttaaaacagtttgacttagtaaaagtcttataacctaaaacggagggagcgtttctagggatttccacctctgatacgtgagagtgggatccagacatccagtcagtttagattttttttaaaggaaagtttagatccaatttttacactacatgagtcaagaccatagacgaaatgggcagagcaaagtcttacccggttttaagacttgaggacgaattctaaggttgtatcatttctctgagatgtgaattgggtgtgataatcatctgaccaatttcaaatcaaacttccattttacctatcaatctcaacgacatgtttgcaaacaaaaaataatttatctataaaacttttatatacgtgttcttaacgatctaaaaacaaaagctaaaaaaaactacgatgaaaagacctacaaattaactctaaatttatgattgaaaatttaacttttggctgataagcataaacataagccaaaagatgaggcctaccaaaatttatcttcacatgtgagttgtgacagaaaaaaaaaacatttcacatctagtgatttagggggtgtttagttgtaggggtgtaaagttttggcgtgtcacgtcggatattatatagggtgttacatgggatgttcgggcactataaaaaaaactaattacagattccatcagtaaaccgcgagagaagtttattaaacctaattaatccataattagcaaatgttcactgggcagcacgttataaaatcatggagaaattaggcttaaaagattcgtctcgcaaattagtcacaatctgtgcaattagttattttttagcctatatttaatacttcatgtatgtgtttaaaccgatgtgactgggtgtaaaaatttggggtgggatctaaacatgaccttactctttgcatcacagagattgcattttgtttctgacttaagacatgaatataattaaaccccagataccctaacacaaaccaatttcaattgaaaaggaatttatataaattaaacccccccccccccccaattctccatttcctagttcacaattttttacatgcaaagaaactaaaactaaggacactagtagtctagtctagtacaccaaaaggggagcaaaaattgggtgggctcagtccacatggaccctactcggaaggaccgagcccatgaaccctactgactcgtgggccccacctccactgggccccacccccaacactacagccttcccgccatttttgaccgttgccgccgccggttcaaacacctccgccacccaccgctccatcacctcgtcgacgaagtgccccgacgccgccgccagcgccgccgccgcctcgccgtcgacgcgcagctcccgcccgccgccgtcgagccgccccgacagcctctcgcggacggcggccgcggcgccgtggtggtcgccgtcgagggtgaccacgcgcgtggcgatggactcgaggaggaggcggtggtgcgagtggccgtgctcgccggagtcgtcgccgccgccttcgtgggttatgtcgctcgggacgccgtcgtcgtcgtcgtcaacgtctccggcgtcgttgtcgtcgtcgtcgtgggcgaagaggttgaggttgaggtcgaggctgtggccattgccggcgctgcgccgtgcccgtgcgcgcttgcggtcgcttgttggtggtgaactggtgggcgtcttcctcttgaggtccccggacggcggcgactgctccgacgtgtacagccgtaggctgatgacgccgctgaccgctgcatcggcgagcttcgatgtcgtcatgaccactacggagcccgagagatcgagctcttggccgccgaacttgtccttcagagctccgctcctcgacgccgccacgagacattccacgacgtgctgcggcgcgcgctcgacgtcgtcaacgacgagcacgagtttgttgccgccggcggccgccgccatggacgctctcgcgacgacgtcggagcggaaatcgtcggcgcacccgaacttgttgggatcggcggagacgacgacgacccgatcagctgagccgcaatgcgtctcggcgatcaccgccgccacccggcgcacggcggcgtggtcgctccccttcaagagcagccagacgcccgcgcccttcgtcccgttcccgctccgggcgccggcggccaccgcgtcggcgatctccgccacggcggcgcgctgccacggcacgttcttgcgcagcctccgctccagctcgcgcgccgccgcgccgtcgccaccgccgccaccggaggacgacgccgagtccgagagcgggaggctgccgagcgcgagcgccgtcgtcacgtcctggcactccggctccctcagagaactcagggacggcagcgccgccgccgccggcggcgaccaccgcaacgcctccatgcccaagaaccccgcaatgctcggcttgccgccgccgttcggcagcaagcaagaagctgaccaccatgggaggaggctgcttggtccattgccataagctccagctccaaacgactgacctgagcatggatcgccgccgccgcagagatgaagctttctgcatagcctactccatttcctcttcagctcgatcaaatagttctcctaaaatcacacaaccaaaatatctcaaacatgaattcccctcactttcacaatgcaaattccaagaactctaaatcaaaacctcttctgatcgattcacatctctgtttctttctcctaccttgggtggctccggcacgagccagccggggagattaccggcggcgcgtgggccctcctcgtcggcggccgcctccgccttcaccgccgacgcctccctctcgtagttgtggctgcactcggtgcagagtaccagcagcttgtcatccagctcgttcctcgctgccggctcggcggccatggcgacgaaagggctagcaagctgctgctgctgctgctggtggttggtcgccaccatggcctgctgcacaggctctccattgctggacacatgaacagtatcagttagtcttaacagtagtacaagaaagtgaaactcagtttgaaatttgtctcaaaattccccaaaaattggaaaatgatacagaacggtatcccgttcagacgggacgacctggtacctcttgataccctattcggacgggatgatacctctgagatatcgcctgatatatgaggcatcatctctttcgaacgggatgccgtccgtcctatagcattccgagactaggagtgcatataaaaataactatagcagcaggtaagaaatctagtgtgaatctttatctgaatcctttaccctgaaccaaatgtgacttgatcttgtgcatgagagacgcatcattgcaaggaaaagggcaaaagacagcagcagcagcagcactggaataaggctgtgatgccttcgactactaaattagtgtaacatttgtaccaaaaggggagtgtttgcgccactgtttgctgcatcagagaaaagccttttttgccgagcagaaactggccaggattcagatggaatctctgcaaccccagcagagccaaaaaaagccagtactaacactaccacctccccacattccccatgaacaaccatttttcttctccctctctgaagcctgaacctaagtttttactacaacaactactactactatcttccagcatgcagaatctgaatcttgaaagaatgaagaagcccccccccattaatgtgaaaaatatgcttcaggcatatttgtcaacctgtcataatagcttacaaaaagaaactgttccctaagtcctaaaaatatagcaagctctacccttcaaaatttggcccaaaatataaactcatgtaactattttctcatttcaacaaatcacaaccaccccgtatttttctgcacccactctcacctcgatcttaattggtactaaaactcggatgaatgcttatattttaggacagaagcagtaagccgtaatagtaaatggatggatgttcagagagatggttcttgcaacatcagatgacaaagtggtcctgctagctgttcctattccagacagcaacacatcacaagcagcaaagcaaatgctaagcatagctgcctgcatgcccaacagtgagctgaccactgactctgatcagcagcagcagcagcaagggaacaacaagctagcaagaagaggagccaacacaacaaaacaacaccaagcacaagcaggaggaatggacagcgagagtgtgacagtgccagaatcaggctgctgggacacatgcagggacaaaggaatgaacagtaggtgttcgtgcaaatggcggacaaggcaagggcgtaagattcatgggggtgctcacgtacctcgtggtggtggcgacggcgtggaggttgttgagggccaggccggtgccggcgccggtggggacgacgacggcctggagcgcccacgcggactccagcgacgggcggcggcggcggcatcgcatgtatgtctggtagctcgccgtggcgacgagccagacgcgcccgcgcggcggcgcgctggctcggaggtcgccgaggaggcggccgagctcggcgaccatgtgttcgacggggctgtaggacgaggcggtgttgtggtggtccgcgccggggtggtggtggtggtggtggtcctcgtcgagcgcccagcggaggtcgccgacgtagacgaccaggccgccgcgcttgacggcgtcgacgctgcggcggagctcggcggccttggcgtccacgtcggcgcggctcatgaggcggacgtggacgtaggagagctggagcttgaggaggtgcgcgccggcgagctcgtccgggacgtcgccgccctccagccgccgcaggagctcgccggcgacggcttccgccattgacaccgagtcgccgaccaccacggggttggtccgcctcccctgcttccgcaccatcacctccaataccgccctcacgtcctccttgcacgacggcaccgccatgcccggcgagctcaagaacggcgccggccacagcatgaagccgccgccgccgccgccaccgttgccgccgacgccaatgctggggtcgaggaagaagtgaggtgggatggccggcggcggaggggacgatgaggtggacatcatgagcgcgctctccccctcgaggttgctcttgacggtggagctggagaagccggcctcgcgcatcacccggctcacgctgggatcgtcgaggatggagatgatgagctggtccagctcgaccttgatggcgagcaacggctgctgctgctgcgccgtggcagccaccggcggcggcggcggcggtggcggaggaggaggctgctgctggagcttgacgcaccgcggcgctggttggcctgcgcgcgcttgagcgcggcgacgagcgcgttggagagcgtcgggttaggctggatgagcgacgacgcg

SEQ ID NO: 76942 - DNA, 21832 bp, Oryza sativa
  unsure (1)..(21832): unsure at all n locations
agatgaagaccgagtcaaattagccacgtaggcgccacgtcagccaaaaccgccatctaaaccgccgagggatctcatctgcaccggttttgatagttgagggatctgttttttctgttgaaggataaaaatcggattcgttgataagggaccttagatgaacttattctggctgtcaaacgcggaggtgtccctagcacgcgctgcctccgacgaacgcgcgccacctgttcgacgaattgctgctccgagacagccacggcctcgacccccgtgggcaccctcaacacgctcctcgccgtcgagctgttgaagcggatggacagaagggcgagggcctgtccacagactgttgctcccaccatctacacctacagcatcctcgtcgactgcttaccgtcgcgccgcgcgtacccccaccccccgacctaaatcaaagtttactaggatatttagacttttccattttttatggctttgtttcaaattctctttcccttgcgggactactttcacataaataatcgccatgggtatctaactaccagggtttctccccttaacatccaaacaacctgtaatatactcaacgccccttatgcatatgcatatccgaatcccctattatcaacctaaaaatgagcaaaacttttacgtatgtgtccttagcaattcaaatccaaatgttgtaaaataaactacaatgaacaaaactacaaaatcaactccaaaattaaaatttaaaattcaaaagttaccttataagtataaacataagcaaaatgatgcagctgctagtctaaaacaacaaaatttgaatggagtaaaatgattcccacaaaatcttcgtgttaatatttcccttgaaaatttcacatgaaaaatgaggagattaatgaaacaacctttgctagaaagtacagagcaaaagcagcacgttcagttcacccgaccttgctggcaagtggcatcacaagagtgcacatctcatgattcatgatggcattccaacttagcttaaggtgtcaactgtcaacaacccattgcataaagctgttctacaatatataactgctacattttagtcaacctatactacagaagtatcagagtgagacatcagctgctgattatgtacacgtttcaggcatccagtacaacagtagcctgatttccagtaccagtgcagtctagatataaaaggtttgtgtgcaaaagaactcctaggttatacagaacattatccaccattcatcctgcacttgatgtctggtagcgttctccaatactgattcaaagattggggcagtactgcagccaaagtaccccacgattcaggcagaatgctcaagatctcttcctcttttcgctctttcgcagacgtcctcttcttcctgtcaagagtgtgtttttccatgtaagtttctcatttcaagaagaaacaaagtctcacacatttttttcctaaactgaaaatgtgtttccagattccttttctttcccctcaaaacagacacatcaggaaccagaagatgaattgacgaagacaaaaggtgtttccaggtttcatttttgtcgaaatggttacatcagagcattgaactcccaagtacaaagacagataacgatcttttatggagtaattgtaactaagatgccaggcaacaaattagacaaagcattcaactaacctttacggggcgtatcatgtatttgcagcttagcagcagcagtcacagcaactgagccaacctacaatgggtgacaacgtacatggtttagtaaagatgcagtagaaggtaaaaaaaaaaaagaccctcaacaaagcggcgtgtttggtttagaacattgaaccctggacgttcatggccaaaactaaaagtccataggtgcttactaaaagctgggcatgttacgggctactatgctaatgcatcctcattagaatatttagtaacatggaagtccacataagagatcctagaaaataagcttcaatattttgtccagaacgaaaggaatcaaatagccaccaattgatatgatctacagatagcctttttaaagtaactaaaacgactatttagttatattacatggatctataggatatgtaataacatgtggcttatctacatatattatttaagcagcagcatttcatcagtcaaattgcatcatgatcattgtagacatacattgcacaacgtattgtggtgaaaagtggaattaaagcttaaatgatttgcatttaattagctatttctattttttcttcaaggagcaaaactcaacatacattttcctgagaaataaggcctgtgggacatgtgacatttttatttggtataacgttctcagagaatgtattgtcttgcatcctcgccctcttgtagaccttttttgttgaagcactagttgaaattacgatcactttgccattccgtaatcgcctgactgtactgccttctgagccttgaggaacaccaaactgtggattcatcccttcatttgtttctaatgcatccttagtacccaggtgtgttaaggatttgccacattttggtgttgcacaatctcctaagacagaggatacatgacttgtactatcattatctaatacagcatcccgtttagcgttactcttcgcatattataggcagaactacagatggtcctacacttgatgttccatgctgaactttattcccattctcacatgtattcatgagcatacataaatgctggttattttcttgatcattaccacatgtttcactaggggttgcacgaggttcttcaggcatgtccattctgccagtgcaaaactcctcagaagtggccaatgtgcccatgaaattaacattacaatctgtatttgcagtaggatcctcaacagtaggtcttccattagaagaattagaaagcctctcgctaggaaatctgtctgcatcacttctagacccctgatatatgttgagaccatcccaagagaaaagtcccattgaatattttaagtttccccgcaaaaacttttctatataatattcagtagattttagtggagattgcggctgcttgttcatctctgccatgtttgcattaataatattctcccattgaaccggaaagccaagtgagaagtgtttggacacctgcatgaatttgatgagatagatcatatattcatatatgctgaactcactgagccatcagtttaggatctcttccagatattagattggcagagtatacaaggcatgtcaagcaaaactgtctaaattatgcagcagaaacaagaacaaaatcactcaattgttttaacagcagataatgttacaaaacactggtcattgaagacagaggcagaactagaaacaccttttttttttttaggtggggtgcccacgaaatgattagtaatttctactacataattttctaaagctacagtcatttgaatggaatttgtatgctgttgggggaggtgaagcccctgctccctccccacccctatccagcactgatcaaggaccgataaataaagacagaaactaaatacctcgtcaggaaatccattcagatgcattttagaaatgttcggtggacgtgcaatcattatgatgataccatcttcagtctcaaggtcaccactagcatgccgtgttttaatggaagcagaagtgaatcttctaccagctcgactcctgttggaagagtgaccaatttgtcaataaaaaatgtttgttcatccataaaaggtctgcaaatggtttaatattgtatttacagaagataatactgttgtcacaagttgcaaaccaaaagatgagaaataatacccaagctaagataaatgctatgccagaacctgcagatatttagcaaaagaaatccagagacaatattataacataaattagagaaatgaagtcaccagtttctagaatgaaatttaaaagagtcacataattagtctcttcatatttattttggagttataggttagaagcatttttgtttgtaataaaatagaaaaatcatactagatttagtaaatacatttcccctaagtaacaagatagtatcaaattccagcacagcacagcagccacaaaagacaagcatttttgtttgtaataaaatagaaaaatcatactagatttagtaaatacatttcccctaagtaacgagatagtatcaaattacagcacagcacagcagccacaaaccattcctaaaccaagcacctctaatcttcgaatcccactgactagtttttcacatagtccgtatgttactactaagacgccatttcagacatcctaattatctctggtacacacctctatatgtacaaaacaaaatgttaaaaatgtaaatgaccctgaggtgctttcaatgatgaatctaccggtaacattggcatgtgtatatcagtggacaaagctcaatttgcacacaagcggagtaaaacacctaaaattcacaaatatgctaaaccttcagtaacggcggttaacaatagctactcagcaaaagtgaactctatgaaggtaggtaaccaccaccatcttacagatttttttttttttggtttttggaaattgaagcatagcgagcatcattacactaaaaacacacagatgctatgaatgattaaacaaaaaaaatcgacaggaggatacagtaacaggaacaagaagggaagggaagagagcggcttattacgtcgtggtgttggagccgacgacgcggaccttgccttcctcgccttcaaccctctccagccaccagtcgtcgagctcgacctagatgaacacacacacggaaagagaagcgggatgagatccagagcccaccaacgccccccgcgccgacgcgcttacgacgatagagggaggggcggatcttacgcaggcctgcaagtaggacacggcgggggcctccttcgccgccgccgccgccgccgcgccgtcgccggctcggggttgggtcgccatctccggcggtggagaggggaacgagttttccccgctttttctttttaaacctttttttttaggagtcggagggttttggaagggttcggaatttgctgggaagacttgtcggcccaattgggccttttcagctggagtagattgtatgggctgggccttagttgatgattggcactattttaacttggaataagttcattttaggtctcttaacttgacagcgagttcgattttcgttctttaacccaaataccatatacaacatgaccccaacttacaaaatcagtgcaaacgagatctctcgtagtattttccctggttttggttgatgtggtgcctatgtggcttcattgactaggtcttcgttctacatggcattgatgtgacgcttacaaggcggtttgataaaaaaagctgtggggcccatgtgtcacttacataaaaaaataataataacatggtgggacccatatgtcaaccggcttccttcccttcttcaccatcgcggccacgccctcttccaggtgccactccctgctgcagtgctgcagccgcccccactcgttgtcatcgacacgagtgctaaccagtccagcagcgtcaccagcagcttcccctctaatcgcacatcgacgtggcgcaacaactcgttcgtggtgctgcagagctccgggtcaaacatggagaggccgagcatggggcgaccgagatggcaatcccgacggcaatgtcaggtggcctcggcggcggctatacctcaaggcatcgctatcggcgaagaagaggagtggcttcatcttcccaccatggtcggggtgcggggggctgttcagggtgctcaccggcctccccgcccccccctcaccgtcctccccgcctcctccctctctgtgcggtggaggtggtgtctccaacggcggatttggacttgggaggagcttgtcggcctccccacctcgtccctctccacacgcgcgggtgtccgccgcacctccgctgattcgacctctactgcgcctctgctcttgctcactggcttcctcgcctcaacctcttgtcatctgcagcttaagtccaccagagccacctcctcgccgattgcccacagtagccaccgctggcgactaccaccaccagagcaatgccaaccgcatctgggaaagcttaaggggaggaggggagaaggagaatggaaagagatagagaagagaggatgaggtaaagaagtggggctcactgatatatgggtctccactatttttaatcttattatttgactgacatgtgggcccacatattttgttttattttttaaattgttaaagtttgctttatgtgccacgtcaaataaagaccgagtcaaattaaccatgtaggtgccacgtcagctgaaaccaccgtccaaactgccatgggacctatatagcaccggttttgacagttgagggacccattgtatctggtattacggttcaaggatgaaaatcgaactcgctatcaatataagcgacctcagatgaacttatttcattaaactttgacaactatatactaatatatatatatatatatatatatatatatatatatatatatatatatatatatatatatatagttcattccaaattaactccccactaaggcttcgtttgttcctttcatactggatttttggcgcacgtgaaatgagaaaactcattagtacactattaattaagtattaactattataaatttaataaatggatttatttctttttaaaacaacttctctattcaaaattattttcaaaacacaccatttaacagtttgaaaaagtgctaacgaaaaatgaggaagttgaagtttgaagaggagggaaagaacggggcctaagtatagtttatgttatttctcaattctctcgtgaagccatatcattccaattatttttagcatttggatgatagatctatggtacaaaatatctcttctatcttctctcataaaatcatgcaatttcagttattctaggttcaaaattcataagtaaaaattacataaaatatattcaccttgcactatatttttgaccatctgtaaattatacatagaacataggaagtcatttttttttaaaaaaatatatattgcggcttatttgtacaaattatgcaatgtaattttccgcagcaacacaacggcgtattcatctagtaataactctgaaatggttacattgcaatggacgaaagtttaatgcatatatttaggaggctaacacattaataacatatggtatccttttaagcactttgggcatgttcaaaggtagagactggtttgggctcttagtctagttagaatgttagatactatcctcctacaacaattgggacgacaaaagactctaacaattagtacaccaaaacggttttttattatctttctttcctgttctctatcctcatgcagcaaagttttctttaagaaatgctaagagtcaatgttaaatcattgtcatgcataacaatgatctttctctcttccatatcaacaaacttacctaagaccctgttattaattaccattatacatgcccttatactatttctctacaaaactatgttaaggtttaaatataaatggtgtctggtgtcatttgttactaaaaatgcatctaggacctctaatttattttggtgttaatgacaacacaaatacgaatgttctattgttttttgttgagatggttgcaagggtcaaagtggtgttgaagttgaataaatattagcgtcattttgaatgtggtaattccttgtaaatcttgtttaattgtgtttaggatgtcatactattaagagggataccacgtgcatataattggttgaatactagtgctcaaaatcatttgttttaagtgttcctgttgtttaaatcagactatccgatgtgacagacaatccgaaatttcaccgaaagtcactttgtctctggactgagtgttggcttaaaatcatcggactatctatattcccaactatatgaattttcatgaaacttcactctgtcttaaattgaaaattcttcttgagtaatgtaatttttctaagtgtaaaacgaagcgtcctattatggaacagacagttcgatgacacggagactccgaaatttcatgaaatttgagtctctgtttgaggatgaaattttgctcctaaaatatcagactatctgagataaaatcggactatccaaaatttctaagaacttggttctctatctctcacttctttgggggctaaaaatgtcggtttgtccgatgttacatcagactgtctgacgtgggctgaaagattccccttcaaggaccacattttggggatctatttatacgctccacctaacccttctctagggtcacccattctcattcactttgggttgaggttggtgctaaggcgctttggatctttgagctctttctccctctctcaaatccctctttgctctttgtatatttcactcaatcctaagcactaggatttgtctaacggttggatggtgtttggtactcctagatgttgaggactcctagacagctaggcgttgctcttgagccaccgatcttcttgtggttggccaagggaagtttgtaaaggccacatctcaccctcgcaaggaaagacataccaccagtgggaggagtgcatttatgcaacttcaagagaaaagggttggaaaagatcctgttctttgtgagctcctcaatggagaatagaatcccctcaaggatttgaactccgggaaatacattgacgaaaaatcttggtgatattctctctctgtctctctctctctctctctttacttacttgttgcataatccatttgccaagtttgtaataattaaaacttaattagtcatgtgctaatgactttctcattgtacatacgttaacttaactctatcgtacgttgctactgatactgtctcatgtctgcatgcctatggctctactggtagtagaatgtaatctgaactgttgatcttatttgatcgaagagtttagatttatttatactaccacttcagttagtggtagtagaaacgtggagtggcattattgtaaaaaaaaggtgcggagaggtataatcatcatttagtagtaactaaacatttttttttcttttttggatccttttatggaatatgagtgatgccagcacaatggatgattatggatcgatttaaccggtattatagtaaattactaatttaccctaataatattggtagtataatactactagtagagagtaccggagcatcacttgaccaattaaggcctaagcatgacaattaagtattaatctaccatctagtggtgcatggagcagggcaattgcccacactagccaggccttggcacagccactgagttaccttgtccttgccggagcaggacaagtgcttgggttctctgttgcgcgcccatccctactgttgttgttgctagatttcatgctagtgtggcgactgatgagagagaagcccaagtagggtaaggccattcgcagcgcaagacaacatatgaggaaactcgaagtgccaaataggatggagcactttgaaacaactctctctacaatgcaagcaacttatgatgggacccacctaccctccatagtccccacctcagtccctctcccctccccctctcctttcatagtctcacgtctctgaattttgcagatgagtggttcccttcaactgtagctttgcaggccaagcaccagggtctctaggaagactcgatcttcctcacaaggatggatatgagccctacctccacatcagtagctatcatacatggagggagaaggaaacttgccacataggagcattgtgaagggcctaagtgcatgggttttctaccggtgaatccaaggtcggacaagcaggacaagtgcatgggttctctgtagcgctcgtccccattgttgtcgttgctagtggtcattaaaaacaaggaatattggaaaataaatctagagtctatataggaatataacatagaaataactaaaaattaggatttaaaaataagaaatattgaaatacgggtttagagaccaggtttcagttaagttggcaaaaagaaaaccacacttcattcactactagaaaaatgatttttagcaatgttagccttttatttttccaggtggatatgaccattggagccaaatggctgcctacaaaaatgcaaacccggttgaaactcgctgtccacctgcgaaggcgaaccacttaagcggtccgcctgcaaaaatacctttatttttgcaggcggaccgcttaagcggtccgcctgcgcagatgggcatggatataaatagacaccaccacacatggattttttataagtgtcatagctctcctctcccttaggcctcaccactcctctcagctctcctctcccacagcttcctcagcaccggtgatgggagcggcggaaaccgacgacggcgaggcgctgaggcggcggggtcggcggcgacaatgacaaggcggtggggtcgacggcggcaacggcgaggcagcggggtcggcgcggctcccctcccctctctcccagatccggccgaaggggggaggggggcgagaggtggcggcggcggcgcttcccctccctcccagattcggccggagggaggctggggaagggcggcagcggcggcggtgacagtccccctccctcccagatccagccggagggagaccgggggagggcggcgacagcggcgacagtccccctccctcccagatccgaccggagggaggccagggaagggcgacagcggtggcgacagttcccatccctcctagatccggccggagggaggccgggggagagcggcagcggtggtagttcccctccctcccagatctggtcggagggagggggagggcggcggtggcggcggatgtgggtagaggcgcgggtggggtgcggcgaattttttttgttcgtcaagatgattttcacaggcgggtgactgggtcgcaggcgatggcatacagacggatcattcatccgcatgagaggttcctttttggccacctgaaaaaactatttttctagtagtgagtgtaacgatgtttactcagatgacactccggaaaatactctgtcggtgcctaagtgtacttattatagtaactccaaattccaattaatcatgagaggccgcagctagcttatcgatcggtggtttactcgtccgaacgatgctactcttttcctatgcacgtaaacctaactaattacgttcttggcttcacagatttgctttgtcatcgtcccattttaccattttgatgcaggggaattgagtggtgaggagccaaacttaactgctaaaacctgtactatcttaccacagtccacaagtgttggtctgaaaactgtgatgagctgaagtgatgccgggacttcgataaaagaggttggaggtggcaactagttctcttttaatattgtcgatttaacgagtaacgttggaattttgcaaaactgttgcgcaaaatttttaacaaggaactgtcaagcttatcagtttatcctgtgagcagtggtgcgggtgtcaccctggaattagcccgggcgattgatcgaataaaagtacgtgtgattaatggtaaaaaaaaccgcacgtgtgaatgcgatccaacaacacctggttccaccacacatgcagttagttaaactgataatcggaagaccgattccattcaaaagagatcaggtagttaaatatttcagttgatcattgctaaaacattatgtcatacatgggtgaaaaaagatcactaatagaaatatgaaccatgccaccctatatttacaaaatttgagatatgccacccgtatctcaaagacatgtaggaaccacatgagtcaatgacatgtgggtcagggtggcatatcacaaattttgtaaaatttgtgtggcatggttcaaattgtccctagaaagatttaattttttttgaagcatgtcgctatagtgtatgaaacattaagtttaacggtttgaaacatatattttctttcatcagaatataatcgtatgatatcttgctataaagatttaattacgacgaatacaatgatgtaatcgaatcatagatcggataaataatttgggagaaaaattattttaaatgtcactacatgcatgcatgcaggaatggaatgcagagagagaaaatagtttgggtagagagagtaagagcaggtgcttgtgtaagttttgtgaaacattatgaaaacacacgctaaagcatatcgctatagcttatgaaacacagagttttaatggttcgaaatatatgtttttctttcaatggaatataatcatgcgatatctactttgtaaagatttaattacaatgaatatattgatgcaatcggattataaatcagataaatagtttatgagaattttttttaaaaaaattgataatatatatgtgtgatagagtgaagagagaagcatgtatagttggttgggaaattggaacgttcgatatttttttttatcatgtaccgataggtgtataacaaaagtggccacgcctattgaatgggcagcgtaatacgtgtacacaaatatgcccgtacagatggaaattgcgacaacgacgagcggcgcatcgcgcgcgccgtggatgggatgagagctcgcgatctcgcaccgtcacacgctcgtggaaccaccacgcgtgcgcgacgctccacgaccaatccactggtcggcgtaaggggtagtactcctcagtttcaaaatatctgacgtcgttgactttttagcacatgtttgaccgtttgtcttatttaaaaaatttaagtaattattaattcttttcctatcatttgatttattgttaagtatattttgatgtaggcatataattttacatattttataaaagtttttgaataagacgaagtgtcaaacatgtactaaacagtcaatggtgtcaaatattttgaaacggagagagtagtagctgggcgtcaacaccacactgcttacgctttcagcacaccacactgctgctgtttgcgctttcgcctgccacgatttgtttccggccggctggccttggtgctctcgcggcctcgcctacacagtttgctggcttgtcggttttctaggccggcccggttgttgacttgcacccatttgggcccatttgcctttagcctgagcctgtggaggtcccgcgcctcgagcggcctgagccgctcgccgtggaccacaggagtcaggacgtacgagtatgcaaagccgtacgacaacgggtatttgacactccgtgaaaggcaggatgccaccatccttgctcctaaccaatattgcacccatgtcggcacgtcggtatggccacatcacgcatcatatactacttatgttttttagaagattagaaaaggtgtccttgcattgcaatggaaaaactaaatcgtgacacattttatgtgcagcatttgagtgttatgaattgtgaaattgtctctcatgtgactggttattgcattgcgatcgcttcacccctgattacggaaatctcacaaaaaaaagaatagaaatattccaaattcggagatgatagaaataactggaagatgcacatgactatatgggtgtttatgcaacaggctttaaaaaaagagaatcccttatatgccattataaattggccaattctcttatatgccactcaaaattggcttctcccttatatgccactggttcaaaattttccacccttttataccactcatagtactatagtgttagttgactgttagccaaacgttagttttttcgtaaatgaccaatataccctctcaactaaaaaaatgtgtaaacttcaaaaaaatcataactaatttattttaattcctttttgagtgaacaaaattttgtcagaaccagtgaaaaatgctatttgtattaaaaatactgttggaaaactgcatgtttcatacttttattgaaaatttatttgtgatggtaatggctaaaattgcatgtgatgaaaaaaaaatcaattttcatatgttgtatccagtagctataagtagtgaaatacttatttattggttgtatatcaactctcaaggacaaatgcgtctttttactatgaagttaacggtcaactgatagtgaagtgacgacaatggcataaaagggaggataaacttgaactggtggcatataagggagaagccaatttaaagtgacatataagggaaccggttaatttagagtggtatataagggattctctcttgaaaaatagccaagacgtatcatctcgtccatatctcaatcggatcaggattacattgcagttgacctatagttagatattataaaatttttatatgtataaatctaatttggtcatgcatgctaaaaagtaatatatgtatcatatccatcccgttgaattgttatataatttttcatgactttggaaggatgtcttcaactttatggtacaattggcatttagccaaaattaatacaggaggatctcatgcctttggtctatgcaatctcgaagaagaaaggaaagtccctgcttcaagtaaaggaaaacgatgcttggatcgacaacttataccttgaagccaacccctcaatctcagtggaccttattggtcagctagtcgccttatggactactgtgcgggacatccaactaaactaggagaagcctaatcaaattatctggaagttcacaaaccatgggcaatattcaacgtcgtcggtttatcaggcacaataccttagggcaccaaacactatatgtgattcgctcatttggagagcttgggcgtcaggaaaatgcaaattccacgcatggctaatgattcaaaatagggtctggatctctgaccgactcgcgacctgaggatggaaaaataatgggctttgccccctctgccatagagaagacgaaacagctctatgtctccttgccagctgtagatacacaaaaaaaaatatggagcctggtagccacctggtggcttaccagcagcttgatcttggataatgggaggccacccagaccgtaaaagcatagtggaaagctctagcaaacataatagggattcccaaaaggggattgcgcactctcatcctccttatcgtttggtcttcgtacacattttatatacgaattttatctatacaaagtttaaatacactaatagaaagtttctatatactaatgaaaagtttatacacctatatgtatatacatatgtatctacccgtatgtgtgtgtctatatatatatatatatgtatatatacatatgtatatatgtatatatgtatatatacatatgtatatatacatatgtacatgtatacatgtatgtacatatgtacatgtatatatatacatatatgtgtgcgcgtgcgcgcacacaaaagtatatacatgagtatgtcatgtattgaactgagcgcacgcgaccagtgtccctacgatgacggaccatttttttggatgacgattgaatatgatacgaatttgaagtcggacaacgtatcgtactcgaatcgaacaatgtatcaaacaatcgataaaaatatttttattttttataatagtagagataatattgttgacttttgtacacatatttgactatttattttatataaaaactacgtaattatcatttattttgttataagttgttttatcactaaatattttaagtatgatttatatcttatgcaattacataaaaaagctaaaataaaacgactgatcaaaatctatattccaatatcaacggtgctatctacgaagtatttttttaaaaaaagaatacctgataacccacggtgttcgctggtgccgtggaggacccgcgcggccgtgccgctggagccattgtgctactgtcgtgctggattggtagctcatgacccatgagcccatttatcgtagagcccggccggccggccaatttaacgcctacgcggccactggcgtgcgtggtctccggccagcccgtgcaagcgggtcgagcgagcttgcgaccgtggacaacaacaacacgtgacaaatcaaggtgcaggtgcatagtactcgtacgtagtactatctccgtctcaaaataagtgcagccataattttcagcgcccaactttaaccattcattttatttgaatttttttaagaaaattaaaaacataagtaacgagtaaagtattatttatgttttatcatcttataacaacaaaaatgttaattataaaaaaatttcaaataaaacggacgatcaaagttggacgcgaaaactcatgactgtattattttgggacggaggtagtagtaggcagcagctgacacagatgaattattttactagcacgtgccggcagcttcaggagtacgtgttggtacgtcttttcacaatttcactgcaccagcgctgcgcacttgtacgtccaccaccgcgtaccggcgtactcctacgtacgtaataaaagtgatggtgttagtgttgaattgactcatcagttcgtccaatgaaaacatactcaacctagtaccaccgatacgatatgttctattattataaatctaaatatatatctattcagatttattttactagaatatatcatatttaatatattcggtttttatggagcggatcggatggagtaactatgagcagggtgctacggcactgagcaacagtacgtgatgccggtcgttaccctgatctgtggcacccaatcacgaaaacgttttacatattcgccggtactgaacagccgtggtacagagtatacgtacccaagtgactcaaaagttttcccttaaaaaatgactgattcttgtattatagtatatttattgttctgttgcgataatttatagggattggttttagggaagcacagtgtaagactccaccatcagtcacacaggtggtgttcatttctaatgaatgaagataaatttaaggtatgaaaaataaaagtaatcattagcgcatgatttttttaagttttaattattacaaacttgttaatttttaaagtaacttttatattgaaaatttttgtataaatacaccgtttatcagtttaaaaacatgttcatggacaccgaggtaaaatctttatcttaattagaaaagaaggaaccatttagtggtttgctggtggcttccaggcctccaacgggttggttgtacggccatccaagtccaatcttatccgctagaatctcttttgagggaaaatgcttgtaaatatacattgtcgtcggtctcgttggctttgctactacgcattgatataagtttttgttaagttcacagattttacacgagaagaatatgtactatgatcataaactaggcatcatgtacgcgactaactcaaactgacaacgtggtgcgcaaccactatggtttatggatagtataaaggacgctggccactgcaaaaggcatatagaaaaaagggtgcacagtcccatccttctcatggtatgagatatttggaagaaagaaattaaatagtatttcaacacaagaaactcatggcaatagctctgaacgcaaagacaaaaaaaaaatgtactttggcaggagcaaaacatctttctaagcttttagcttaaccctctgtgtaaagtatttttcttcttatttacctgcacattaactattttactcctactctattcaatttaaattgacatatctcgaaagggctgaatatatgtgtgtagttttttttaattttttttagagaaaataattttactcagcctctaaatctaatcggatatatgcagcctttttaaattagaaacttagtctcaaacagggaacttcgccatcaaataacccaatctaatattcgctcgtatgaagatttgaactcagaacttggggtgctattcagatcactgcaaccactagactagtgctttttcatgcgtgcatatcttctttaattccacgaagttggaaaataaaaccaatagcttttctccacatgtatatttgacgtttaggcagcattttgtgctctgatctatgacaaatccaagaacattaagaagcacaaaattacagttttaaccgtacgtttcgttgattaccacggcgagcaaaaatgcactctgtgcgcccacagacagagaggactgacggcccaaaaacagccgcgcacgcggccggggtttgcctggtgcctagctaacgacggtggtgcggattgccctagtgcggtaccacactagttaatgaaacgcgacagcagtacgtgctgctactccgtttactccaggcaggtcattacagtacatgaatatgaatgttgatcgatctgatcacaaaagcctgaatacggaacacgacagtctgacagcgcctgtgcattaatgcgagctgtaactgcctcagataatttacagtgaactttgtattctctctgtcctaaaatataaaaatattagcacttaaaatttgtattaaaatataacaacttattcactaatattctcttctcaatcaattacgggcctcatcttttcacttatactttatcaaatcaataattgaatatattttcaaaataaatttatcttgggttaaaaatattacaaatttttttttacaaatttagtcaaacttaaaattgtttgactttgaccaaagtcaaaacatcttataacttaaaacggagggagtacatgatagttcaaaacaatcgatcacaaagggtgtataattaacaaaatttatacacgaattaacttataacttaaacaagtatgtagacacgttaagcgtgtgttgttgggatacgcgtaggctacgatagcataaattaaaattttctatcgcttaaaccaggaaccatgcaagtactagagcatagatcgttaccactcgacgcgctgcgcagcggaagaagacgctgagaagtcgaaggaattctcgtgaagtagcgcgcgtcgatgtagaggaagtagtcgatcgcaccggctcgaccttctcctccttgtgcgttctcctcgccgtactcccacgccgattagcaccgcaaaccagcgttgcctctaccggtatccatacgtacagggacggaacgccacgcgcagatgtgctagcacccgcgcgcggctagggttttgctcggggagggaagtgacggctagggtttctcacgtgatgcaatgcctccgccggtcacacccctcacgaatatataggatccatcactcgggtctccaaggcccgtaggactcctattcggatccctatccgaattaagctcatattggatctctatccaatccccttattccggcccattaagcgtgcgaccctataggttcatatatactcggctgtaacccgaaaactcctttttggtccacgcgtcaacagcggcccctagcagaacgtattgacccaccgggcatacataaagatcatatcggctgaacctctagtgtatccttgtatgaatccctttgcctcacgatatcgattaagctcaaggctagatatgtgccatcctctaatagctcaatcattcactcgaatctgttgatagattatataacttatgattgactcctcaatcacctttggcatggccatgcacttctataatctacaacatcgaggggcccagagatatctctccataggaggggcaaatctcatcttgattattcatatcccactacatgtttcatagcatacccgaaatctacttttataactacctaattacggagtagcgtttagtagtccctaagtaagctactacacatgttgagaactatgataatctcatgtctaagtattcaacaccaacactcaatgagatcactgatgacacaacacatatggctcttgcagtgtctcatgttgggtctatccaacaacatgttcaccaacatgtgtccacattattaatttggtatctctataccatgatccatgagacatgatcatcaattaatacatgtgctgatcatataaacatatttgttccacacatgatatttgatcagggatcctttagaaatagtaacaaacaacataaagagtctcatgaaagaatcacatattcattaactaataaggagttatctatttcaaggaataatgtcggaaaaatatgtaaacatagtatgtgatacaatcatctctatgattgcctctagggcatatcactaacagtctcccacttgcactagagtcaatcatgaatgtatcttacaccctgccctagtgtgtgcctcatgcttaggctgagggagtggctttgtcacggattctgcaccattcaatccggtatgtatnntgcatatcttcacatctcttctacccactttctcgcgaatgaggtgataccgtcgtaaaatgtgtttggacttttgatgcgatctaggctccttggcttgcgcaatggcaccactattatcgcaatagaggtccatagggctagaggcactagtcatcacacctagttgagaaacgaatttctttatccaaacagtctcctttgctgcttcagaagcggcaatgtatttggcttctgttgtagaatcagccactgtatcttgcttgggactcttccaactcacagcgcctccattcaggcagaacacaaatccagactgcgatctaaaatcatctttgtcggtttggaagcttgcgtcagtgtaccatttacaacgagctcttcctgtcctccatagactaggaacatatctttagttcttctcaagtactttaggatattctttatagctatccagtgactctcacctggatctgattggtatcggcttgttgcactaagtgcatatgaaacatctggacgtgtacatagcatagcatacataatggatccgattgccgaggcatatggaatcacactcatcttgtttcgctcattagtcgtttgaggacactgattcttgccaagattaatgccatgtgacatcggtaagaaacctttcttagaatcttgcatgttgaacctcttcaacaccttgttaatgtatgtactctggcttaatccaattagcctctttgatctatctctatagatccttatgcccagaatatatgctgcttcccctaagtccttcattgaaaaactatttttcaacgatgtcttaacggattcaagcataggaatatcattcccaatcaataatatgtcatctacatataggattagaaacaccaatgcgctcccactaatcttcttgtatacacaaggctcttcttcgtttttgacaaagcccaacgccttgactactttgtcaaaacgaatattctaactccgagatgcttgcttcaacccataaatggatttctgcaatttgcatatacttttagctgattgtggatcaacaaatcccttgggttgtgtcatgtacacatcctcatcgagatttccattaaggaaagctgttttgacatccatttgccatatctcataatcgaaataggcagcaatcgctaaaacaatccgaatagattgtagcatggtgactggcgagaaagtttcatcataatcaacaccttgaatttgtctaaaacctttcgccaccaatcgtgccttgtagatgtgaacatttccatctacatctgtctttttcttaaagacccatttgcactcaatggcttttacaccatcaggtggatcaaccaagttccaaacttgattgacatgtatggattctattt

SEQ ID NO: 76943 - DNA, 718 bp, Oryza sativa
cgaaatatgcgctaagatcatccgtacgtgcgtcagcggcaggagaccacgggatgcaagttctgattggttatttggcttcgacttcgaggaaacgttcttcagagattatacaatatacgcgcttagttggttggatgccgcgggttcgttacggatttgttcgtcgattttgcatatcatcactgcctcttgagtcttgacttcgttttgcgcgagctcatcgccgtcggttggtttcgatttcttccttgaattaaagttccgaagaaacggcccgatcaagagtacttttactattcttttcaagaaaacaaatacttttacaacaatatctacaaataacgagatgttttatgatgacctctactaatagtagtaagcggtttttcaatggtctttactagtagtaaggtgcttctataatgttatagtaaggtgttttccatcacaggcgtgtattaggaaggtgaatcaatgtgatgtttggactggaatactgcattttctttttttttcttttttttgtgggaaactgtatggttccatggcagatgcaaatggacacatgggtgtgttggcccgtgctctgattctgcagtctctaccgtgccaaatcacgcatgaaaagaatcctcgtcgttgtactcatagctactacctccgttttcagattataagattttctagcattatctatattcatacatatatatga

SEQ ID NO: 76944 - DNA, 4838 bp, Oryza sativa
ccagactaatgtttaaagctcacgtgacaaaaatggcgtactatatcttcttcatgatgattcgttttgttcacgcttttgtgcaatatcaccaagcacatccttaagctgacccttctgaagaaaattacacaaataaggaatcaattactgagttaagaattaagaaagtagatggatacacatggttatgaaaaccggggacaataagctcacttgcctgatgcatatctaatatgatatcagatcccccaacaaactctcctttgataaatatttgtggaaatgtaggccagttgctgcacaagcaaagtagaataagtagtgaatttatcgaagaataaacagttgcctgtttctgagaaccagctgaagggcacatgacaacccatgtgttgtatgatacacaatacttaaagtcaataaaaaacgaaaccttctaacagtaaacatgacaagtggagctccattatattgtatatagaacacaggctggtgcctctaataatatgttgtcgaagagaatgatgtaaagcatcaaaggacaaactatgccaatctaaactcatcttgcttgggctgtcattagcttaagattctttttaattgtaaccatttcttcaagatgctttcataacctaaagttaaaaggtcaaaacaattgccttaaacctttatgatataatatcatacaatattcatgccatgaataatttaacctaccagtctagtttgttcccctgttgaaaaacaagtactctatctacataacacaagattatgaaggaatgaccaggagccacttacgtgtgggctttgacactctctttgagcttgaggtctcccaaaatatccctagcactgatagggacatctgcaatagattatgatatagtttaagaatctttggagtgtattatcaaccatatttcaaacaaatcagaactcagtgataatttaccatattgcttgaggactctaactgccaacgcactgaacccacacctaggagcatcaggataacccttcatgtagatcaggactgggttctccttgatatcctgcccaacaattatgaggcagcattaacaaatggcagaaatacatcatgaaactttaagacatgcctagctttgccacaaaataagttcttcaatttaaatgtccaaaaagctcatttagaaatgttaatacctgagaaacaatgtcatcaaaagacatgttggaacttttggttgtaggctggaaatcttgatgtgtatcaggatcagcagcaactcgtgttgaacttgagtccccagttgcagtagaatcgccaccaagtcctgatgagtagttcctaaactgatggatagttggttgggccacagcctatctcccggttatcatggaaaacaagtatgccgcagaaacatgagatcaacagggatatattacctgagcataatataagactgatagaacatggctaacaataaacgcttgtatgggaaaaattatgaccccgtatcagataattgcataacaggtaaagctatacaatttgcttacaaaactttagcagtgcaagattggtcacttctctaatacattggaagtgtaagaaaacctgatacttgcataacccaaggatagaaggttaacaacataggcaagagcgccataagcgctgcaccaaatttaagcattaattcacaagagagcaacatatgcagaagcatcataagcattgcaccaaatttaaacattaaaaggagaaaccgtgggaagaatagcacaggtactatgtggaaactaaacagaagttagtagttttgcaagtatcgtgtttattagatacttcctccgtgcacagtataagtcattctagcattgtccacattcatatagatgttaatgaatctaggcacacatacatgtctagattcattaacatcaatatgaatgtgagaaatgctagaatgacttacattgtgaaacggagggagtagaagccatccacatatacagaatacagttactaaataaagctaatgacgcacaaaaggtcaggtcacagtaatccatatttcaaaccctaggcctagatagagggttctcataaaggaaaaaaaaatggtgggcacaaaatctatcgaatatttcgtaacagaatcactttgatgacaagcaaaggcggataaaatgaacaaaacttcacttcgatgacaagcgaaggcggataaaatgaacaaaactatcaaggagagggacggcaagagagccttacagctacggtcggcgagcagctcgatctcacgagacccctgatgagggcggacgacatcaatctcgccatgactaccctgcagcgacggcgaagaaatcattcatcaaacgccaagagcccccagcgatctaccaaacagaaggtcgcagcaactgctaacccgcgcctacggcctgaaggccgcagcaagtacctgggaggcggcgggacggagccctgcggtggtcggaggcgccgccggcgacagaggagaaggagcggctagctagggagagcgccgccgccgaccttggagcagagttcttgatgtggttttcctttttttttttttccagaaaactccagatgatgttttacccactgggctaggccttacgttgggccttctcaaagccaacttgacgcccaagtgcattcctagggactggggcccatttgtagcccacattgagcccgtttcaaggcctggtaaaactactcagatttggtttgggcaggaagaccagccgagactgcgtgcaagtaccgagctattcgtggtttgcctcgcaggtacagaatatgtattatgtgctgaccgaaaaaaaaaattcttcgtcttgcgtgtgtatacttctccaacgattaaatggtgagtctttttaaaaattaatagataaaaaggttgttttaaaaaattataataatctatttatcaagtctaaaataatgaatactcaattaatcatccggttcaccttgtcctgcatgtcttctctcttcccctgcttccaaacacactctttagtgttgccaaattacttatacaacctgaacctggtgcagtggtgcgcacaaagcacatagcaatgtagattagatagggagagacactacagtttttttatagcgtgattagttatttttgtaatatctggttgctgtaactgggatttcttatgtggtttccagatgagaccgtttgtaaagaccatgtaagtttcacttgttaagatagtaaagaaggtaaatcattagcacattattggttaagaattattgttttaaacttgaaaatagaataatataatattttaaaacaatttttctatagagattttttagaaaaaatgtcatttagcagtttaggaagcgtccatgtgaaaacaagaatattttcttctcttttagcttttttttcaaacggacatgctttttttttccatttgcctcatgcgtggctctgcaacctttgtttctcgtctattgttattcgttctttttggaaggaactgtaggggtacctgttttctccaaacatatcgttcatctaactaatgaattgtttcatcatggttcaactccatattgcaacagtaagccaatctttacgcaacaaatttcaaaaaaaaagaaaaagaaaagaaaacatcggatgaaacaaaacgatgagaacaaaaaatctcactggagagatatgacaacaaaataagaactgtacaacatccattttacaagaggacgcaacattttgcgacacatgttgcagggagttgataatcgtattaaattcaaaagaactacaaatttaatacgactatcaacttcctgcaacattttgcgacacatttgagatggctacaaaatttgaaataatcgtaaaacaatgagaacaaaaatctcactggagagatatgacaacaaaataagaacaatgagaactaaaatctcactggagagatatgacaacaaaataagaactgcaaattggcaagagaagactaaatttaaaagaaccgcaaatttaatacgactatctacttccggcaacattttacgacacatttcagatggttacaaaatttgaaattatcgtaaaaccgcatctccatttgatcgccgggcacttgacacaaagaataattgaacaaatagcagatcaataaccaattgaggcagcacgttgctgctcgttggcaactgcaataaaactatgcatttgatttcaagatctcaggcaatataagcgtggcatcaccttaaatttctcaaatctcaaaacacagctcggatttaaccacttctatcgaaagtccaatggccatacgggcctacaactgaataccatacagttccactaacatacttttgaggggtcactcattacattgctttagaaagactgatgccttcccttatcttcagcgtgcttcatattgaacaactgcaaacacaagacacttgatcaaaaaattgctcatactatccaagacaagcaatctgtggtggtgacggatgacgttgaacttggtttagctatagcattttcaatttgagcatagcgtactttgcttgtcagaccatatgagaacacaaacaagatgccaagctgataatcagttttcagttttcaaattgacggcaacaattaaatgcagttggtgtgatgaacatttcactaattataagcattactttctaaatgcaacaggaccacaaccagctataaaacaaagcacagagcagtgttataagcacaaaatgcttcatttttagtgttataagcacaatcatttcaaaatgaaaagga

SEQ ID NO: 76945 - DNA, 33036 bp, Oryza sativa
  unsure (1)..(33036): unsure at all n locations
tgtattgtgccataatatcgtagctcttgccgttgccgctctcaacaaattctctgtcagaaacgtacgtcaaagttgtgtcggtgtcattgtaagtactacgatttgtcaatccgcagtcgacgtttaaaaaccctgcacagacacacatccctgtaataacagcctaaaacagacaccagatactgaccgatgctcatgtcgtgtgtttcaactgtttcaagttaaggttcatgcgagttcatcatacaatcatgcagctagatatttggtcgctaagtatacggggagtgcttacatatttattcttgggaggaagtatatgagagtgtttaattagctctcaagtattatgcactgatttctacttttctagagctgcatataatgaagtgatctgaactgtgcagatggagcatggattacaaagaagcaggctcgcagaggaaacagctctgataattaccaggaggagacacgccatggacttgtgtcgccgcgaccaggatgagcagcaacgacaatatccatgtcagcttggtaccagccgagcagctgtagctgatcaccatcaaatccttctgttttagcattggacgacggggccttcagccattttacaaattaatgaagtgtgttctatgcttgtatctgctacagatgactttatagctagcactgcaaagcagaaacaagctttagtaatatgtacattgacttgaccttgacggcttgatcgtacgttcagagataatcagctcggggtttgcagccacccgcaagaagaatctgtaacaaaatcttaaaacaaatgcaacttgccgtggaatttgcatgtcaatgatcttctcgccctataatttacggttgcgacgagaacgtaatcctaaccgcagtgatgacgaaattgcaaccggcgaaatacatgatgcaggtcaccttttctctggttatcgatcgccaatagtatattaacgcattgctgaaatgcatgttgatgtttctctgaataagtctgatcctgtcaaccatgccaaattaaataaaatagggacaaacaaaccgttgcgttcacaccatatgagatgatgagatggagaacatctgcaaattgcgaaggtgaaaatccagataaccccttacaagccattggtattttgaatcttcctctacaacttactacccctttcgggtctatcctatcctagataaccacattttgagaaagagaaggtaatttcttacaaaacactatccacaagtccattttcttttcaacttcccccctgtgtctagttttttaagtaattctcactacattcatcggtgatttctcacatcgtatggacctccagcatggtgagcgaagttaacacttatattctctgttattgggcataagatttaatacaacttatttaataatatggggtcatcttcgtgttttatcgccacacctttgataaattaaagcatacaaaagcaaaagcaaaaggagaactgcctttgatgacaagggtagcaatatagtgcaggcccataaggcacgagaaaataccggaaactgatagaaataggaagttggaagagaaaatgaatttgcgagaagtgttttgcacgaaattaatttgtaggggagagattagaaagatgagtgatttttaggagggggggggggcattaggattttttcctcccaattgcgaaatattaatcagagtgtagaaccccggaatgcgccaagttggatgacataagaggcaggggaagcaacgtatgcttccctgtcgcgatcaggtgtctgcatacagttttttcaaacgtgcactgtttgctttgtttggtcgcatgtcgaattctgacaaaacaaccgcgggccggcatcgtcgattatcctatggcgaaatatgcgctaagatcatccgtacgtgcgtcagcggcaggagaccacgggatgcaagttctgattggttatttggcttcgacttcgaggaaacgttcttcagagattatacaatatacgcgcttagttggttggatgccgcgggttcgttacggatttgttcgtcgattttgcatatcatcactgcctcttgagtcttgacttcgttttgcgcgagctcatcgccgtcggttggtttcgatttcttccttgaattaaagttccgaagaaacggcccgatcaagagtacttttactattcttttcaagaaaacaaatacttttacaacaatatctacaaataacgagatgttttatgatgacctctactaatagtagtaagcggtttttcaatggtctttactagtagtaaggtgcttctataatgttatagtaaggtgttttccatcacaggcgtgtattaggaaggtgaatcaatgtgatgtttggactggaatactgcattttctttttttttcttttttttgtgggaaactgtatggttccatggcagatgcaaatggacacatgggtgtgttggcccgtgctctgattctgcagtctctaccgtgccaaatcacgcatgaaaagaatcctcgtcgttgactcatagctactacctccgttttcagattataagattttctagcattatctatattcatacatatatatgaatgttagtaatgctagaatgtttataatatgaaacgaaagaagtggctaatttggagagcaagcggaacgacgcaatgtttggttgcacgaccagnnnnnnnnnnnnnnnnnnnnnnnncagagtcaagtgtgcatgccaatcatatacgaagtagctcggattggattagaggaaggcttcaacgatcgcgtctgtgagcgatcacgtatgcacgcgcttggcccagaacagtaggtaccacggcttcggtacggtctttttgctactaattattttttttctgtgttcgtgtcaccactcttgactttctctggcacgagcacgactgcactgagagctcatcggtttttttaagggagagctaatccgttggttagtttggaggaaactaccggcccaaacaacatatttaaaaaatatatgaaattttttttatatgtgttcttagtgatctaaaagcgaaatctgaaaaataaactttgataagaaaaaccttaaaattaattaaatttaagattgaaaattaaaatttcaaatacttatgtttatcagttaaaacttaaattttcaaccttaaatttgaagctgattttaagattttttttccatcgaagtttatttttcagcctttgctttttggacgctaagaacacgcatgtaaaagtttattcacagattatttcttatttacaaatatgccgtttcacttatgcttaaattcagccaaccgatgggtgcgacggattgatcgttcaatttctctataaaaattcggacggtcaaatattacacttagtccaacaagtaaaacactaaattatatacagacacagtcacataagtaatttatttttttaaaaaaagttttgcttctcgcagaaaagaaaacatgagtagttttccgttgctcggttgctcctccacccaagcgaagatcccgctccctgggccgagcaacatagaggcccgcgtgagccacgggagggcacgtggcgggctcttgcatgatgatggggccacgacgccagcacatgggccggagacgcgccgtgctagtatgcttttgctctgagtcgcacctggcccaaaccgcaaaacagtcgcttcgtccctctctgctcggccgcgagtgaaacgaaagccggaaaaagggaaaaaaatgtactaaaaactctgtagtacagtactgaaactaccgttttaaatggatgtagctcacgttatttatttctcaagttaaatttttatttttgtgacgtgaataaatctaaaatattcattttaaaagtttcaatgtatacatgatttacactacatattttctaaaaaaaaagttccggacaaaaataaaaccacacaaaacatatattccctccgtcctaaaatataacaacatgtagcctctataatttgtcttaaaatatagtaacttctacgccaatattctcttatcaaccaatcgtaactctttaccatttaaattcttcacctaccctcacttctcatccaatcacaaccctcctcacatatagttttacataatttcttaataaccgtgtccaactctaaaaatacttatattctgaagcacagtgacaagtcaaatatttttaactttcattattagtaataaaaagataaaaaagatgaatcatataaaattaatgttactagatttattattaaataaactattataatataattttttatttaaaacatctcttggatagttcgatctcgccagtctctagtctctaccagcgttcgagccctcatgtcagaactcagaaccccgggatctgacacctcagccgtcgccgtcgccgccgccgccggcggcacatgcgtcggcaccgccgctgaagcttctctctcctccctctccgggattggtgcggaatggatcggggatatacgggtttcttctcttcgtaaggtatgccctagctctttcctagtatcgatttcactcctgaactagttcgttctgcgttaaactacgggaatctattccaaatcgaaatgttccgattagtgtacatgcgcccatggtttaggcgtggacctctgtatagaatgcccatattaactcttgcgtaggatgcatttgatgcatatgaagcccttaatgcatttccggatgacatatgggataataaacaacgatatttccattatcttgaaaagatatgggataattaacaagtaacaacgacattttcttttacggacaagtcataggagcgagcaaatgatcaaaccatctccaaaacagatgcagtaaaatagcatttcctttcaccgtccagaaatgtagcttatttctgacatcccaccggtaggaccagactgtgaggaactgccctcgttgtcgtagcttgttgttgtagctccagaaatcatcaagtggaactgccgtggaatgtctgcatccatgacgttcttctcttgaggggttgatgtaaccgatcgtttctcacttgaaatagccaccgtaaacaacaccttaagcacagaaacaacctcagtcatgcttggcctgtcaattgatgtgttttcaaggcagttcattgcaaggtctatcacagtttgcaggtgagtggcatcgtattgatctaacagtttcttgtccacaacatcgtggatgcttcccttatcaatcttttgccgcacccaatttggcaagtggacggtttggggatccataaatactgggggttgaccagtgacaatctccaagaggacaattccaaaactgtaaacgtctgtcttaacggtaagttggaaagtagcatgatactcagggtcaaggtaaccaagggtgccggcaacaacagtagatatatgcgtgtgagctgcattaaaagcccgtgaaagcccaaaatcagatatcttggccaccagattcttgtccagaaggatgttgggtgtcttcacatctctgtgaactattgacgggctgcatgattcatgtagatactccagtcctatatccattgaaattcatgttttaaacacagtgcacacacatatgtgctaaaaaagttggatgtgtatttcaaaatacagaccttgtgcagcatcaagtgcaatgtgaagtcgttcttcccaattcaaactactatcatatcctgcatcaaagtgtgcgaaattagtactatagaaggccattcaatatgtgtatggttgtgcaaatactgctatatgtcatttggataatttgaggttatcaagggatgactatattgaaaaaaagaatagcagcacttggtgtaataatattccaatctatatttgtatgtatataagcagtcactttgacctttaaaaggataccaggtttccttctctttcgtagagcacctttttataaatttcaattaacaaggttaccaatcaactgatggaaaattaagaatatgtagctttaagagtacaacgccttacgattgtcgttttattagtcagctgtctatatatgtattgactggtaccaatagctgtctaggcaaccagacctttacattctatgctcacctacgtgctgtccatccagttttgtagaattagcagaagtttgcctcttacatgatactaacttacgagaatcttgcttactacttcgcaattccctatatctatgaccatacgtccatacattctctatatctacgaccatacaggttcaaagtttaaacaaactagcagtaatagactagtcacctgcaacaagaatatcccgttgacactggatttgaaaccctaactacttttatcgcatagtttttctttttcccctgtgtcaaatatgctttagctgattattcccaattaagcgttatgagcttgacatgatttattgttttattgttgaaaatttgaaaactactttgttcccagtaattagcgaaatctgttgatggctatgagttgttccgcaatgtgaaccttgaattgtccgacctcttttctgtttgaactgatttcaggtttgaatgattcagttttgttgagtcagaagtatgactgatcacagtagaaaattaaaataaaattggtgatcataacaatgtgcaattcagacctgtatgacttaactacttgagtcaactcttcttgatagaaatttcaagaaattgaaagaggaaaaaggcaaaaacctcctcttaaaagctgctgatgtcacgagctccggcgtaagaacgtatgggatatgaatgtgtgattggcggacgtggacgagggggtttggaggaacggcgacccgtgatgaacagcaagggatgagcaaatagagaataggaggtgagagaattagagattgaatctgcttgattaactcctccgaattgtgcctctaaataggcttacaactgattaaccaaattactgaaaacaagctaacaaactgataaggaaactggctaacagaacctatcctatcgcaatactgttgccgtccggcacggcggattacgtgcgctgcgctgcatctcctgacgccgtatcctgcagccctgtgcggcttctgcgttgatatgttatcccgaccatgacagctgaagatttcctctaggcatgaaatcataaacaagcgcaaggcacttcctgttttggcaatatcccaccaaagtgacaagattcttatgatgaactttggacaaggtttgcacctgcagcaggatatgccattcagggctgaagttagatacatatctttcttgaatatagactatatgggaattgctttagatggccttcgatctacttttgtgctgttaaatacctcagggaggaagtcttttgactctgctatagatgtctccacaagcaccttaacagctacttcatcgttattttccagtatgccatgataaacagtgccaaaacctccttttccaatgattgattggaagttgttagttatgagcttcagctctgcatatgtgaaccgtttgatgtcgatatgtaatggagcttcctcttcataaatagaataatcttcttgttctgctgattttcctgcaaactccaacctttatttacatgaaagtacagctattactaatgtacaccaaacaagcaatcattaaaccacccattgcattgattcaaaaggacttcagagactaatgttttattttacctttccagcacagcctccagaggatacaaaccagtacaaggagtaggagggataccacaggaactatcactgcgatgagcaagataggtgtgctgttcttatttgcgcagtacctatctttgacttttgagcatatgggattgccttctagtctaatatgccattatacaagttattagtcagataaaaaacaaatagaatcagctgaggaaagaaaaacttagctatatcaaccttttcaaatcatgattgtaacatgcttctgaattttagtgcttctgaacaaccatttctctaaaggcagaactattacatgctttataaagtgcatgccttcgctaatagatctattttgtccctgttttgttggaaatcatgtagatgctaaagcatttataatcactagagtctactacgtgcaatttacctttttcagttgtttttcgataatgtggtcgttgtttatgaacctttaattgattgatactgttgttctgtgataaccagtgttggttttagtcttttccttttggagtagttattttgttagattctttttttaatatcaatgaggagccatgcaactatgcaagggagtgttcccaaacctcaattcaagctgtcctgccttaaacctttgaagaatagaatccgggattggtccatcaagttggttatttgataggttgctgaaaagagtagtttaaatgattcatccatctaaaattctatatcaactaaagattaatttgaagcttacagcactctgagtgaattgagttgatagtctggaattgcgcctgtcaagttgttgtgcgataaatccctatatatgtttttgtgttcagtgtccacataatttcatttagctctggatgcaatgtggtaagaagaagcacttacaagttctccagtgatgccattttcatgaatgctatgtgtaatccacctattaatccgctggctgacagattactgcgaatgaacacatcgtaatacttgtcagataatttagtcatggcatcttaagacaataatacacatgactaggtatacatataatgactgtaatagtacatttaaaggcaaatatatttggatcagcatatattgactccaaaggttaaaatcatgatgacattatgaggttcggatttcagaatagatatgtactttacggttttgtcatgtacttacattcgggtgatccttggatttttgtttccattagcgtagtcgcaagccagaccttgccaggaatactctcttggggagcatggatctccattccagtttcttgtgtaactgtagtacttcttcacttctttcatgtaatcaactacagcaacagaaggataattaaatcaaacatgaatggaataaaggaattgctgcgtttgttgaacctgtgggcttgcatgattagttgatcagtaagttgtagacattcacttattgagtcgctagataattttatgatttaaatgttatctttaacttgtaattattcatttctctactttttcttaagaaaaaaattcatttatctgtttttagattaaattcatttctctgctagtagtctttgctctcaataaagctaatggattcttttgtagaccacatgctgccgtgcacgatgatcgtatgaacctgcgccataaatagcacacgtctaatttgtaccccaatctgttactgatcgtaatcgtaccgtcgtctggagaagtggtgaggttgtctgtatgaacaagcgagtacacctcgaatgcgttgatgagcggctggagctccgagctgggcgtcttgcgcagggtgaagttgaggcccctcttgcgcaagaacttaccactctgatatgtgctctccgctcggaacaggggtggtatgtagttgggaaacatcaggtttccatcgttatagatatcaaacgttctattctggttgttgcctccaatatcggcaaagtggaagattggtagcagctccaagctcctgtagtcgatgttgttgatgttgtcgatgtttttcatgttgtccggaaatatcacgctgacgttaaactctgagaaattgctgcttatggttgaggccttctgaaggatgggcatcggcacctgaaagtcgtcatttccaggaagctttgtcacgtcttggttggtggtcatgttgaggaagggaaatttgtagcgtagggctgcctcccagaaacgatcgaagggatcagttggatatcttgatcaccacaggagatacatggaaatgattgaaattgtgaggaagactatgattacaacgtcaatgattgaaaccgaaaaaaaaaacttttgaatcacctcgtgatgtaatcatcgaccgagccatatctttgtcgagccaaatggctgattgaaacagaaagattcagaaatgggaacattgcaccatccaattccctcaagtctaatgtagatacgaagggagttcctgatcccaagtttatcagacagacggatatgaatttgtctggagcaactgtgatcacctctttatacatcgtatctgatgaaccccagtttgtcaagttcaccgttgcccagaagttgacgccgatgtggagtccaaagagaaacagagaacccttctctgacgagttgagcccatcgtagtttccataagtgaaggtggctctgatgagatacttcttgctactgttggttggtaatgtataacagttccgttggccatcagggaagcttctcaacgttttttcttgttcatttgtagcatctgcgatgtattgtgccataatatcgtagctcttgccgttgccgccctcaacaaattctctgtcagaaacgtacgtcaaagttgtgtcggtgtcattataagtactacgatttgtcaatccgcagtcgatgtttaaaaaccctgcacagacacacttccctgtaagtaacagttttctgaaataaaaagtaataacagcctaaaacatatacaccagatactgaccgatgcttggtggagaagaaaattggtactacgagtgtttattcatgtcgtgtgcttcaagttaaggttcatgcgagttcgggcttgttcagattgaaaccgttttaaatcaaaccatcttttttttagagttaccaaatatatgtatccatttattttttttaccacacttcgataaatacataagaaatcatgtcataattttgaaaatattgccaaattactaaattttggtaagatttattttagttacaatcttaacaactccttagttcgatcatgcaactagatatttggtcgctaagtatatggggagtgtttacgtatttattcttgagaggaataaaacagtgttgtggaaaacggttgatacggccgtataaacggccgttcaatcggagacgatgagttgtctgtcacatttttacaaaacggttttcattagtcgtttgagaacgtctaattaccatcattgcccgattaatcaaccgtttctgactaatcggccgcataatctactgtgatcacaagacccagtacacagaacaactatccggcccattaactatattctgaacttagtagtatatagctagttgtgcagcctatatgtttgttttcttttctttccctttaattctctttcaaatctaaaaatttcttatgtattattgatcttattttaatcttttgtttaaatcttaaacagatgtgcacgcttgaagttcttttagtaggtgtacacctatgcgttatgaacgttatggatgtcctatttaaaaaatattataggaatatggtcaaacataagttgttgtatgcatttacatcttaaaaaggcaaactattataaactacatacatatatttacataacgttaaatatccgtcaaattccgataaatcgtccgtattccgattaatcgtttggcggtaccctctccgtccgtcaaccatattccgtctttcacaacactcaataaatatcaacttgattgttcttgctatgattatattaacttgatgatcagaaataataaacggcctgaagttttcatagtatggttctatatcaatttgatgtaatcgtttgagattaataaaagctttctttattaaaaaaacatatttattcttgagaggaagtactccctccgtcccattcggtaccaggttggttttttatgggacggagggagtatatgatagtaagtgtttagctatcaagtactactatgcacagatttctagagctgcatataatgaagtaatctgaactgtacagatggagcatggattacaaagaagcaggctcgcaaagaaacagctctgataattaccaccaggagacacgccatggacttgtgtcgccgcgaccaggatgagcagcaacgacaatatccatgccagcttggtaccagccgtgcagctgtagctgaccaccatcaaatccttctgttttagcagtggacgggaccttcagccattttacaaattaatgaagagtgttctacagtatgcctgtatctgctagatgactttatagctagcactgcaaagcagaaacaggtttagttatatgtatattgacttggccttgactttcatagttaatcagctcgggccctgcagccacccgcaagaagaatctgtaacacaatcttaaaacaaatgcaacttgctgtggaagtgtggaatttgcatgtcaatgatctcgctctataatttacggttgcaactagagtgtaatcctaaccgcagtgatgacgaaattgcaatcggcgaaatacatgatccaggtcacctttttctggttatcgatcgcgcgagtacttttgagtacagcaaatagtatagatcactgctagtctactaaatttttactaacaattatcttaaccgtttcatttagatacatataagttataaaaaatctaaatatggtcatagcatgacacatcagtgatagtaagaaaaagttagtacgtatagctttttctaatattatattagcacaatgctgaaatgcatgccgatgtttctctgaataagtatgatcctataaaaccaagccataaaatagtggcaaacaaaccatcgcggtcaaaccatatatgagatgagatgaagaacatctgcaaattgtgaaatattaatctgagtccgctatgatagaaccccagaacgagccaagttggatgatatatataagaagcatgggggaatcgaacgtatgcttccctgtcacgcactactagaaaaccatttttctagacgatgacattttttttcctaggcgggtatgcctcgtggagctaaatggccgtctgcgaaaatgacaaccgtgaggcgagattgttgtccgcacaggcggaccagatccgcctgcaaaaataaattttcgtagatggtaccttaagaggtatacctgcaaaaaggttaaatatgttaaaaacaccatctacccaccaaaatactaagtcagaacactttgccctcacacctttcccctccaacctctccctcggtagtccctcccctcccctctcacctctcctctcctagcacggggtctggtcggagggaggtggcggctacaggcagtggcggcgcggagggtggaggaggaggtggcggctccgccgggagggggagggtggtgacggtggcggttcccttccctcctcccagatctgacaggagagggtagaggagagaatggcggtggctaccggcggtggcgacacggagggtggaggagacggcggcttcctcctagatctggtggaggcgacggcagctccagacggtggcagcgtggctccaggcgatggcggttcccggtggcggatccactccctctctcctagatctggacggagaggggaggggcgatggcggtggtgggggcggaggtgggtacggtgaggaggctgggtgtggcgaggggggtgacgtttttttttattcacccaaaatattttcgcaggtgggtggatacgacgcctacgaagatagaggtgctgcctgtgaaaatcaactattttcacaggcttatgcgtacaggcgagccttcccccgtctgagaaaatgatttttagctgtctgggaaaacgatttttctagccgtggcaatcatgtgtctcaatgcggtttttttagacgtgcactgtttgcgttttgtgtttggtcgcatgtcgaattctgacaaaaacaaccgcgggccggcatggcaacgacatggtcgattatcctatggggatatgagcatcagcggcaggagaccacgggatgcaagtctcagattggttttaattcgaggaaatcttcagagatcatcgctgttagttcgttaccgcgggttcggtacggatttgttcgtcgattttgcatcatcactgcctctcgagacttgacttcgtttgtttgagctcatcgccgccggttgggccctatgtttaagcaaaaataattataaaacatcatatcaatattatttataggtatttttcagagcaacatattgactttcatcatgagctcttctacaaaagtgtgatgaagacattaagttaataaaagttgcatgtcgtaaactggagttaacggttatgcaacttttcgctaattttgtttggaggttcacaaatatgatttaataagttagtgctttattttttctattggtgttagtgccgatgtgtgcctctgtcagtttgaatgtgtcccttatatctttatgtcttattttgaggtgtgattgtatttggaactcttttctttttaataattggctatagttctatgagtaaagaccaagattctattccactatctaaaaaaaatcactattgattgctctgaggttaagatctggatttcttccttaaggctttgtttagccaatggagttggaaaataatatcccacctttcaaagggtaatattatatcctagccatcaattcttcatacctcatttaatccgccatgcatccatttttcatcccaatcccacctctccttaccaatggcggagccaacatcatcatcaagcccagacgacttaatagtatttttcagctctcgattaaattttatgagtgtcaataagtcaatggctatcaatagaggtgacggcaatggcagagcccaggcggccacttgacctgcccaggaggtggatccgccgctgctccttaccaatttgtcaaacacaccctaaagacttgaagttgcgaagaacggcttaattaaagtgtactcctatgttctttttccaaaaaaaatgaacttttattttagagtggtggtctctgctcctgccaacacaaaaaaaaaacaagatttgaagagagagagagagacactattaacatgttggggattgaacacggggtcttatggttgaaaccatacaccacttaccactacactatcaagtgtatctcaaataagaaatattataatactatgattctagtagttgttatattacgatgagacataggtagaaatagtagcaaagcacttttacggtctgtgtgttggtgctacgcgcgcatgtatttagcaaagcgccgctcaggaggcgaattggaagaagcgcgtttgctgggccaatcaaaattaattgaggctgccacgggagatcaacgttatatataagggcaatttcatttttgcccccactttcatctctaatattgattttgcccgttttcgtttttgcccccacttttttgaaccgaaaaatacttttgcccctgttttggatggagaagttaacggtgttaaataggacatttataccctctcccataactaatcattaatttcattaattgtgttttgcccccattatgcatggctttggaaaagtttttaaatatgtttaaaattaaatgacagattttgacattacaatttggacaaaatttgaatttgatggaattttgacaaaattttggcagcattttgacagaaattgaggaaaaaaatgacaaaattttaacaacattttacacaaccatatgaagtcaaaattacccaaattatgaaatggtgcatcagtaagaaaacaacaagatgcaaggtaaaatcaacattatgcagtacagtatatctttgctatgacttaggggtcggaaagagcagatgcaaagactcaccaggaaatgaaatatataggtcatcacaaatgcttaaaaaagatcatataagtaatatggatatgaagctcctggatggggtgttactggctcactgctttcgctgattgcaatacgtatccacccagaatggatggttaacacttaggtgcacaacaacacaagagattaccattacatgcattgttcaaactaaccaaaattgatggttctcataacatgacacccacttttttttccctatatatatatatatgttggattggaaaactgcatggtttcatggcagagcaaaatggatacagggatgttggcccggcccggtgctctcatctctgctgtctctaccgtgccaaatcacgcatgaaaagaatcattgtcaggctgtgtttagttgctgaaattggggagaagtttaagagaaagttggtagtttggaaaaaaaaagttaggagtttatgtgaataggaaagttttagatgtgatgtgatgtgatggaaatttaggagtttgagagaagtttggtgtgaaataaacatgaccatatactccagtttggaaagcaagtggagaacgacggcaatgtttgcttgcacgaccagttcgatccgatgcgtttcgtcccggtcgcaatcagagtcaagtgtgaatgccaatcatagctcgatcggattggattcgaggaagccttcgacggtcgcgtctgcgagcgatcacgtatgcacgcgcttggcccataacagtaggtaccacggacttcggtacggttttttgctatttttttcatgtgttcgcatcaccgctcttgagtcttgactttctctgccacgagagctcatcggttggtgcagcggtaaccagctctcggataggtcgggtagtcgtccgggcaccgtcatagacgtcttcaccgtagataaaatcgattttttagttttcagtttttctcttttttatcattttaaatcaaacaaccacgtaaatgtcacatcgatgtcacgtggaaataatatctagttaaaggagccacgtaggtgttatatgtcagctacttcgtttgcacttttttctaaagttggggaatgtgatccggacatccggtttgacgttcagcgacaaatttgagggaccgaaagagaacttattccccgtgtagcgcgcgtgtagtgggctcttgcatggtgggccgcgctccgtgatggtagctttgagcccgactcgtttatgggctcgtggaccaaatcgcatcgcgccgcttttgctcctccgtctctctctcggcttggaccgtaagaaaaagcaaaaaaaggaaaaaaatagggagtgaaaaaaaaaaaccccaaaagaaagaaatctccttctctctctcgatcccgtctcgtctcgtcagtctgcacccggttgcctccccgccgctctcctctccggtctactcctccgccgtcgccgtcggcaccgccgccggagctcctccctgctccctctactgggttggcggggagtggatcggggatctgcacgcaggggccgatttcttctcttcgtaaggtatgccctagctcttccctgggatcgatttcgctcctgatctagttcgttctggtctccgctgtgaatttcaggaaatctgttccaaatataggtgtttctaggggaattattccgtccaattagtgtacatgccctgcccatggtttaggcgtggagccccgtagatgaagaaccccctcttgactattttgtaggatgtttttttagttaagaatttagttcatttgatgcgcagtaagatcttctttcatgcattgctgagcgcagtatggggtgatcttctgttttgattgattgtgtggatgtggattatagacagctaatccttagggttttttcgtgttttcttcaggagtagataacacagaatagttgaagatgagcagcataggcacaggatacgatctgtccgttaccaccttctctccggatggtcgcgtcttccaggttgagtatgccacgaaggctgtcgacaacagcgggttcggtttaactgctcccctttctttccttccttttgctaccgcttcttcctttctgtgtgcaattatgtaatgacgttctaatatttgttaacaggactgttgttggaatcaaatgcaaagatggaatcgtcctggtaatgtctgcaaactgatagataaatttcaaagaggtgtattttttgtgctcgattgacatttgtttgttggttctttagggtgtggagaagctagtaacttcgaagatgatgctggagggatctaataggaggatccattcagtgcactggcactctggcttggtaacatcttgcttccctgtacatagatcctcaaatgtattacgatttcagtgtaaaaaaagtacaattgatgaagaataaagcaaggatgttgtttatatattttaatttctacctctatattctaggatataattctcattaatgttatggtaaaagaagttgttctctgtcggggcttcttttccccatctttgtcttccactcaccccataacacatcgtgtcctttaactataaaatattttttccaggctgttgctggtttagctgcagatggcaggcaaattgtttcaagagcaaaatcggaagcggccagttatgagaagtacgcacataaacttgtaggccatgtagacataattttatgattatcctctaatgctgtgatgtactagggtctatggtgaacccatttctgtaaaagaattggctgatcgtgtggctagctacgttcatctttgtacactctactggtggctcaggtaagacgttggcataattgttgcattattactggagacatggcttacatgatttaataaaataattattgttcggttagttgattctaactatatttacatgtatcaggccttttggttgtggagttattcttggaggttatgatagggatgggccacagctctacatgatcgaaccctcaggagtctcatacgtaagctaacactacagtacacaagaagtcaaactcgtcttaggctcttggtttttgtttttttcatctctatgtgaaccattattagcaattaaattgttcaatggatgcatataggagcattccacaccatatttttatcatagatatttttatagttccttctgggatctgagcatattattcactgagctgaatcctgaacagaaatactttggtgctgctctgggtaaaggaagacaggctgcaaaaacgtaagtttatcagcttcaaattgtattgggtgctctctttgtcagcactaatatcttctgttttaaaacaaagttggtgcaattatgaaaattaactatttcatattttccaagagaacacaggtattgttaattcatcgcaacccagcttgctgataattggaatatgagggagggtagttcctccattgtccataatccatataccatcttagcatttgtaatcatcagatccttacaatgtccatccatgttttgtttggttttaacatagaagtatgaaacgaccaaaccacattaacatactgatacaattacatgtttaacggttgttatgccttttgttgtattgacccatcacttaatttgtgtgaatcactggagtgttaatgtggatccaatgatccatgtacagatgggtgggattggtttaaaacccacttttcatgaaatttcaatatgtggttttggtcatctttacccttctcatagaggaaagagaatatgtgtttttggtcatcattacccttctcatagaggaaagaggtaccattaagccatatagcttatgcaaattaggacttgtttgatgagaactctcagcaatcattttagatcgacctctacagaacaagcctgtcaattctgtaattgtctatctgtgtgtggatctgatgtcttgttggtagctactgttgagcatccaacattagcttttgcttcgatttgcaccatcttggtcatcagaatagttctgattccaacttttcaaatgctgtctttcagtgaaatagagaagttgaagctttccgagcttacctgccgggaaggcattgtggaggttgcaaagatgtatgtattgaacaccctttctccaacaataataatataattgtgttcatgaattttgcactttgttttgactgaatgcatatcatctacagtttttttcattcatatttttctatatattatttgatttcacatatgtttgatgccattcttcgttctagtggttatacctgcaacatcatgcataagatttatttgctactcccagtaaatggcgttctagaacatgtgcagttaaaccttgaaatctttactcactaattaatgcaaaaagggtcagatttcatatgtggaaagtgacattaatagatttatcatcaaaaataaattcatgtagttgtatttttaataatatttaaaggtatgactagaaaggaacaatgatcaaacatgtgaatcggaaattgtgttgatgtcctagacatcatctaaaatataacagaggtagtaataatcatttagttatttctgctttaaaataaaagtactccctctgtcccaaaataagtgcgccttctagcattggaaagccaaattatgaggggagggaaatgacctagatacctcttagagtatgtacaatagcaagctgtaagccagctgcaaacatattttaaagagataaataaggagagagaaaagcagcgggctacagatttgtagccagctgtaacacggactacaagacgcagtgtgtgtatgacaggtgggaccaggtattaatagtgtagtatgtaactattgtatagatgagctattagattggctatagatgaattggagctagtggttggctatactattaaacttgctcttattaaacgagggatagttaggagtgggaagacgtggaggaatttgaatgggtggtgattgataggataagtagtactctaaaagagcacttttttgggacaaattttaatccttaaggagcacttattttggcatagtgggagtagttggctacataatcatattggaacattttattgtaggtagattcttcttttaaaggtaggttctagctcgcatgaactgtcgatgtcaactgatggtaatgaacaaagcagactaacaaaatagtttgggatgttttttctctaataatatttagaaatcctttttgaataaagctacttgtctgacaaaaaaaaaacagttctcactttcttataatttgttctgtgcagcatttatggagtacatgatgaagctaaggacaaagcttttgagttggaattaagctggatatgtgatgaatcaaatcgccagcatcagaaggtgttctgttgttatttaaaaataaataaactctgtccatatttttgtgaactttgctcacttggcatactgcatacaggttcctgctgatcttttggagcaggccaaggttgcagctcaggcagcgcttgaggagatggatgctgattaagaggagacccgactatgttctacgtttggccactgatgaaatctttgatgtcattactggcacacagggacatggccattctgtcggattttaaaacttcgcatgtacttatggtactaaattcatggaaagtttgatgctggacagtgaatggatatctgacttttgactgaacttgtcccttaaatcttgatgaattgctcgtttcgcgtttgccttttttggtgttcacccaagattgaacgactcaatgatgtttttcctgcagtatcttgacatttgaatcgcattttagcgaccttgcctccaaaactattaactgcaaccttacctgatgatatatttgtccgtcacattgcaaaattctcagcttgcaaagtaacttgtgaaaaatgaatacggttgcctgcataactatgtaacacatgttggctggacggcgacttagcaccgcaagagaagaatcgaatcgggaaataatttgtggcacgccatcagaagattgctgaatgaaaataggtatctgaaaaatcaaatgttccgatatacctgatcgcttttttttgaacggggattatcgctaatgaaacttgtgtgaagaatgaaagagagtaattttattaccaaaatgatagactaaaatttggtaatgtcaaattagtttgatgtcttcctaagttttgatagtatttttatgaaaggaaatttttagaactaccaaattctggaaaattgtatttagcaaggttatatttagttcgttaccaacctaaaatctctgaaactatcaaaaggtaagattttatgttataagatcatgtttagtttattgctgatccataatttggtaacactaaattttaatactagtgcttttctcaaatccagtttaatagtgttaattaaaatgataataaagtaaacacttccaaaaacaaaactgagtagacggccaacccaacggcggccggtctcgccaagtcgccaacgcgatccagccagccaagtccaaccaaacgcgcacccaccaacgccacccgaagcttcggcccctgtctaaactccgacccgttccaccgcctcgccgtccacttccaaacccaaccacccccaccaccgccgtgatcccctccaatcccttcgccggcgaccaccggccgccggcgactccgcctccgccgccatgccgccctcctacaccccgaccgcccgcctccgcctcctcgtcctcttcctcgcgtccctctcgctcctcttcgcccaaaccctagcctcgtcctccgcggaggccgaggtctccgacccctgcgccgcccccgtgtcggacgggggcagcgaggcccagctttgccccgtgcggtgcttccggccggacccggtctgcggcgccgacggggtcacgtactggtgcgggtgccccgaggccgcctgcgccggcgcgcgcgtggcgcggcgcgggtactgcgaggtcggggccggctccgcgcccgtctccgggcaggcgctgctgctcgtccacatcgtctggctcttcgtgctcggcgccgccgtcctccttggcttcctctgatgtgcgcgcgccacccgctacacctcctccctcccccctctgtagttgatttctccacatttatccgtttcgcgattatttttctaggttggtattagtgcgctgttatatgatctgagggatgttgctgcaacaatttgttgtaaacttgtaagtttggaggatttcgtcgagagatgtcacacgatttcgtcgagagatgtcacacaattctttcatagatctgtttgattggcctgggctctcatttcagagctgagctgtgcagatgggtcgtgatctgtagttgagatcatgttttgacagtttgtaaatgtatgctaacaattgcagcgatcagtttcatggttttgtacaaaatcgagcttcatggtttaccatttttaatgtgctctgttcgttttgttctatgtgtggtagttgtgtacatgcatgtgaattgtgatgtctggattgcttaaagcacttgagcaaatgaatgtttaattgaaataactttaaagtctcatctcttatctgccatagtgttgtgatggagccaactgttccatttttttctgaaagattaaagatggcagtagaagcaattacaactatcatttgattagtcattatatttggttcatatttctcatgtgaacatcagggggtaaactccatacttaaggacttggggttcatgcgacatggagggaagtgaactgatatagtatatctgatccccattagctgattatattgttcttgttttatgctttggcatcatggcatgattttagcagttatccgtagaatcctatgaaatactcaatgatttgtggtgttagatacagcacgattctcagttctctgtattatcatgtggatagaatgaatgtataactgcatactgtgggtctggctatgcggtaagaagtccaatttttgaaacattcattcctctatttgatacatagtttatggtttcctatcttgaataaaaggtcccagttcctttctgttccatgtgcatgagaagacgtgtgataatgagagaagaagaaagatgtgtggagtatttgcatacatgaactacaatttgcccagattgaagcagtatatatatcctagagctgcagaggacagtaagacagtactgcccatatggccctgcaacttatgatggacaactacctcttgtgttctgccatgaagggaagattgtctgtttactctggtgagtcatgtgcatctgattagctgctggcttgatgcaccttctgttatgccatttttgcttcttttttttgtgactcaaaatttagcgcctcacttcattcttatccaataaacattactcctatgcatgggtttgggaagattattgaagttgttgagcctgaaagagtaactaaatgacaaaaatattagatgtcttaaggtccacatgttatattatatagtgtttcaaatcatattatgcttttacccacgttacatatattgaggattgttctttattttttggctccgataataaatagagcttattctggtacttgaagttcttctttctacagccgttttgattctatggatttgaacctgagtactgtggaagtaagcaataattctctctatcagcaacagcttcttataaaatctaagtatcttatcattgttaataccttctagactgcgatcttcataggagagcaaggttggaagatcaagtgttattctcactagtctcaaggatcacctgagagatattcagcactgtagaaaaaattttgtttccgttggttttcatgcagctctggtgcattttaacttttccttgagtcagaacatctcctgcctaaatattttcctgtctcgccctagatatgattgtcatggtggaagttgcaagcgacattttagtgtttcacagttaaaattgtacattacgttatcgtttatagtaaatccaggcatacaaaagtcaaattacagcgataattatgatgacattaggattgaagatgtatgaaacttaaaattattgacactgaagatacatgcttaaaggaagccctttctgtatgtccatcctatctaccctgtttctctcggcaaagccagtgaggccttgaaacttgttgctcatccaaggcatcttgcaacatcagttacatcatcagtataaaatatggagatgtagagacggagatgtaatagttgcagcggttcatggtgacgtgttgtaatgatggtgccatgtgacggcagacaacgatgttatattagctatcagaatcgtgttttgttcagtctcactttgctcgagccgtttagccctttatattaaaagatcaataaaaagataatatcgttttctcatttggataacctcaaaagattttgagggcgaaggatgtagaaagacaatttatcgtcttcacatgtatgcatgtcttattacgaaacatcgaaaaaaaatagttatcctatattttacaatggaagtagcatcaagaagtaaaatggatcttgatcgcaagacgttcattgagaagagagaaaaatagacttgatgatccaatggtgcttaatgaaaaggttggcactctatggattagagataataaattgatcttccaggtacattaatgccaaccctttgtcatttagagctcttaacgcatctccaacagtatgactatcacactctctaagctaaaatttggtaactgtgaactataaatgatagcagacccgctaaccggatttctagctagccaaacttagacatctggactagctggctaaacctggttgccaatcgtgggccccacaccgctcctccttccactttccgtcctcgcaaagatcgagcaccttctcatcgtcgtcgccatcacccgtcgccgcctggatccatcggcctccatatgcatctacatgttgtttcaatgattggttgttcacccaacccaagtacccagcacttactatgtgaactagatttcgaaaatattgtgaaaacacatactatatagcaagcttttgatttttttaaaatacataggtgatccagatcataaaatgctttattacttctttagaaatgtgatgcataatctggatatagaatgtcgtgaaaacgttttattaacccagtaggctaataattctttagaaatattgcacgcgaactggatttagaatatagtggaaacattttattgcttacctagttacctgacatgctattgattcttcataaatacgataaaccatgtggatctagaatgttgtaaaattaatttattacttacctataatgctttacgccaattagatttagaatttcgtggatctctagaaatactttacgcaaaatagatttagaatatcgtgaagacattctattacttatttgacaggctattgaaaaacataatatgtggtttggattagaatatcgtgaaaacgttctattgctttccaatagatgctactactaattctttaggaatgaaattaattccaacaaaaaaatatgcaaaatttcttcaaagcattcctttccactcctgcggatggaaacgaggagggattttaattttgaataaaaaaaccgagaaaaaaaataaagaatgaccagaatgccctcttgatgttctctcctctcctccattgaccattgccttcttttctctctctcgctcgcttcctcggttgctcactctgtgtgtgttccctccttgtgctgagccgcggccgcggccggccttccgcctcctcctcgcctcctcgcgcgcgccgctggcgagcggcctcggagtgcgcggcgtgtgcaagtgctcctactctccttcgcgatcccactctcctcctccgcacctcagctttgctctcgcgcagggccagcgagctggttcggagagggcggtgtggctggcctccccttccactgacctccgtctcgtctcttctcgaatcgaatcgaacgaactgaaggtattcattcttctctctacctcctcttccgcgatgattcgtggggcggcgtaggtagggtatccatcctgacctgggattgatttctttccctccacttaacacacacagagtttttattttattttattttggggtgggaggggttctttgatgcatgttgcagtactgatctctattcgtttccgaaagaaataaaaatgaaaactttggggtttgagctgaacccccatgccccgtgttagtgttggcccctgcatctgtcaagtgtcaaagttgtctctcttttttttttttttgaagtgaattgtgcgaatagaggttagagaagtcgcatgcagatgctaaaggttgttcctttttttgttcattttggcaaacagtgatgtgccgggattaacctgtgatttgttaatgcagatagtcagctgatactagtgaagatgaaccgggaatcaaatttcatgcctactcctgatcaggatgttctggaagtcaagcccctgaggactttggctccaatgttccctgcaccattggggatcgatgtgcttaaccggttgacagccccaccgttggtatttgtcgcaccagctgggcagtttcctgggggttttggatctttgaacattcctgcggtcagatcgtttgccgctttcggtggtcaggatgctagtggaggcaagactgctggtggtggtgatcaggatgctagtggaggcaagactgccgctggcggtgatcaggatgctggtagaggcgagactgctgcttttggtggtcaggaaactgtcagaggtgaatttgttgcaaatgggactccaaatgtaggtgctagtgcaactgggccaattgacgccactcctatctcagcttgcaaatcaacacaaccaagtgtgatatcactggatgatgatgacaatgatgatgatgagccttacggtggtaaccaaacatcagcatctggacggaagatcaagaggccatcccatctcaaaggatataatgtaagtgatggtttgggcaccgacagctccaacggaacaaagaaacgccctaagacctctaataggaaggctgctactgacaatgagatttccttgatgcctccatccagcgatcccagggaggttgtggaagtgcttctcatgaccttcgaggcactgcggcgtaggcatcttcaattggatgagacacaagagactagcaaacgtgcagacctgaaggctggtgccatcatgttggccagtaatctgagggctaacattgggaagaggattggagctgtccctggagttgaagtaggggatattttctacttcaggatggagctatgcattatcggcttgcatgcacctagcatgggtggaattgattatatgaataagtttggtgatgaggatgactctgtagcaatatgtattgttgctgcaggtgtttatgagaatgatgatgatgatacagatacactggtctacagtggttctggaggtataagcaggaacagtgaggagaagcaggaccagaagcttgagaggggtaaccttgctcttgagaggagcctgtccagaaagaacgtgatccgggttgtacgtggttacaaggatccagcttgcttgactgggaaagtttatatctatgatggtctttataagattcatgagtcctggaaagaaagaacaaagactgggatcaattgtttcaagtacaagttgcagcgagagccaggacagcctgatgcagttgcaatctggaagatgtgccagagatgggtagaaaatccagctgctagaggcaaagttttgcaccctgatctatcatcaggtgctgaaaatctcccagtgtgtcttatcaatgatgttaacagtgagaaaggaccagggcacttcaactatattactcaggtcaagtacttgaagccactccgctctatgaagccatttcagggttgcagatgcactagtgtttgtctgcctggtgataccagttgtgattgtgcacagcataatggaggtgacttaccgtacagttcatccggattgcttgtatgtcgcaagcttatggtatatgaatgtggtgaatcttgccgatgttcaatcaactgtcgtaatagggtagcccaaaagggagtaaggatccaccttgaggtcttcaggacaacaaatcgaggctggggtcttcgttcatgggatcctatacgggctgggtcatttatttgtgagtatgttggtgaggttgttgatgatactaaagttaatttggatggtgaagatgattatctttttcgaactgtctgtcctggcgagaagacattaaaatggaattatgggcctgaattgataggggaacacagcataaatatttcagctgatacttttgagccgctgcccatcaagataagtgcaatgaaaatgggaaatgttgcacgtttcatgaaccatagttgcaaccctaacaccttctggcaaccagttcaatttgaccatggagaggatggttatccacacatcatgttcttcgcactgaagcatattcctcccatgacagaactgacttatgactatggcgacatcggatgtgaatctaggggtgtaggttctagagctaagaactgcctttgtggatcctcaaattgccggggcttttttagctgactgttgaagatgtgcattatcttatcaacatgcaaatatatttacctggtaaaaaaattcaccttattgatgttttcaactttgaccaccgtgcatactaataatttctctgctgttagaaattcctgcttgtcctgctcatgcattcttgttctcacctgatttccattctgcatgcaattatttctatgtccattcttgctgccatgcatgcttatgctgcgctgcctttcatatggacttctgacttggtcctaaaattaaaaataataagctgttaggctactacccctgtaggctgtagtaggtcaaccatcataattaactcaaaactaatctcttttattttggacgttttgtatcactcctcatgtcattgtgagtggcaacaatctgcagtgaatttcttttatgcagtaaggcaactatttgctgtaggcagctatatcctccatacagaattttgcccctgtaattaaaagctaggatttgacatttgagaacacccccccccccacccaaaaaaaaaaaccaaacccccttctccctataggtcttctatcatagcttgtttgcagttgaataattcgtacttccacataactgtgttctaggaatgcattgcaacttgcaaggatatggttactcatgtgaccctgtcattggagattctttattttcaagaccattattgagacatattacagcacagccacagtagttgttgatcgtttatttcaaatgactaatttgttttacttcattggttatctcacttatctgtcaacgtaattactgtcctgccaagttgatgtgagattcaaacttagaactttgctgttgcttctgattgtttaattactttgaatacaagaatatcatatctgaggttcactgtctctttcaaaacactgcattgcatttggcagcgtttacatgacaccagaaaggggcttgtgaatattgttaagtataccaacttgtcatttagcatctcagattgttaagaagggtgtacttagtacttactatgatttttaaactagctccttgttttcctctatttgtggaaaacttatcttgggataagctctcactggttgtcttgcttttgcagatccttttgcttttttggtggtactaggaagtggactatgttcaagactttagaagtatggagaagctggttacttcaaatggctaacctcgtttgccgctgtggaagtagtaatagtaaattagtgcaacatttgcaatgcccattctcgtggtgtctcttgcgatgtgtgattgtaggccttgcaagatcaattttgtaaaattatgtggggggggtgggggggggatgtgatgctgctgatctgactacagtcgatgatgtttgggtaggcaaagttgggactgaacccctcgcggtcagctgtgaattcagaagctgagatatttggatgaatgctgatatggtggcatatggttcttcgaaagtctctggatttgtcttgatttttctctataattggttcaaagctaggtacacaatgcggttgcaaactttcgagtagttgcagatcttttcgttgaattaactataaaaatacgatgcgccggtaatgctcgcttttacctacgacgtgactttggatttctcaaccatcacaagatcaggcaaaaagctactacctactttagcgatgaagagtaaagttcaagcaagtagaactgctagtcattccacaatatcactgaagcatgtgccaaataataaaaccttgattacatcagaggacatcttgttccttaacattgggtgtcatgcaatctgagtataaagtttctatcatcacaggatttggcacactgcatatctgcaagtcttcaaccgaagtattgttacaccccaattacacatgttacgggcaaaatggatcaaaactatgatgtgttttttcaagaacaatttacacaagcgccttagtgatcagaagcccgggcaagtaataactaaagaatcgctaagctatggaagtaggaaagacaaaacagaaggtagattcaaaacatcttcgtgctgttccccactctgcagtcgcatgtacatacgctccttgactctctgaccacgcgttgagaccgtcgaatatgcaacttgatgtttaccagcttaccagcaatctgcatttcaggttccataagtgggcatatgaattcattgaggggatttacataaataaaaatgcaactgcaaatgaaacaccttagctctttaaagcatgatgtgcatagagtgatgggaatgcttgtggtgttaacaaaagttgttgcaagaaaatctctcttttcatggcacagctacttaagtatctagggatgctacaaaggtttgaatagaattaccattctccatgtaagatcttcaggtccaagaggtcgagcaggacttgaatatagaaaatgtctagagtactgtaaatgaatcacaagtaaaattgctgtccacaaaattgaagcttccgaaaaacttcatgcaatatatgttaaaataccaagctaaccttcagaagatttgattgcatttgtctgatccttttggcatcaatgcttctcaggtacttcaccagccaaccaggttgaacagcgtcatttgacgaaacgaacaaagctatctgcagaacaaatcaatcattgcacactgcagttcattatagaaaatatgtgctttaaattgcagcaacacaaatgcaaatgcgaaatacatgaaaaaaccatcatgctaccataaaagactcgagtaaacatgttggttattcaagacatgaagtatccacagattgtgaagtatatgcagaatagcaaccaactgctctttagtttatagtggatcaatcaccgagggcctttatttaatttataatggaaaatcactgaggtagtttctctccttgttttttatcacaagcataagcacatggtgcaagtacacaaagtaaaaaaactcctgaagtatactgaactaataggcatgtcaaatttcacagaccccccccccaaaaaaaaaaaaaaaaggaaatcacagaaacttcagagacttaactggtgcagaaaagtagggttgctacaaatagcctttgtagaattgaatccagacctgtcaaactagctgacaacatggccattgagctaccctaagtctctgactattgacatatacatggccatttgttgattgtttggggcatgcaaatagaaagtagcacagcatcccgttcttcaagcaagacatcaatttttggagctccacgcagatatactccctccgtttcaggttataagacgttttg

SEQ ID NO: 76946 - DNA, 15551 bp, Oryza sativa
cccctcattctctccccctcccctcccctctggctcccctccggcggcgggaggcggccgggcggcggcggcggcctcccctccgtcagatccgggaggggaggcggttgggccgcgccggcggcctccccttcgtcagatccgggaggggagcggatcccggaggggaggaggctgggcggcggtggcggagggcggcggccggcgcgcacggagggccgtccccagtggtggcggcggaggccagcacggagggctggccgcaaggcggcaggcggtggtggccgggcgcaaggcggtgggtggcggccgggcggcggtgacccgcgcggcggtcgggcgcaaggcggccggcggcccacggccgggcggcggcgactgcgaatttttttgaatgatttgtatattttggtggagcattttgttggttgatttagggatgattttgtgattaatttgtggattgtgattgatttgtggattgtggatgtggatgtattttgttgtgcttgatgtaatttttttttgagattttgtgatgtatttgagtatttgagatgatcgattgtggatttggagacaatttgaggatgattgatttgggattttggggacgggatgggatgaaatcaatatatattaaaaacaatgaagaaaagaaaataataaagagcaatcggatctagtctttttagtcctggttgtatctttagtcccggttggtaacaccaaccgggactaaaaatggatttttactcccggttttttcacccgggactaaagatagcgatctttagtcccggattcgtagtcccggttggaaaaccaggactacatgggggttacgaaccgggagtaaaaaccctttctccaccagtgtatatatgctactataggatatgtaaatccaacttatgtaaactctgggataattctacaacattacaccaagagacataggcctttactaatcggtcgactaaggtattacatatatatcatatctctatagctcccgatatacatgtgatgcaaaagtcccacctattaattaggcaaaattttgatacagggcacctaaatgctacgtaatttgttaatagatatcgtaaaaatgtgtcatggttaacaccatcaaaaatcggtaattgctaaaggaaacttttggtccaattgaagggagagcttcttcgaatagacaagaatgtccctagagccacaagcttctaacatgatgttgcagtgaagattttgaaatatgcaactctagatctaccatcggtccaaatacattgctaggatgcatcatattccttctccattctagcactatagattagaaacatttggacctaggggcattcttgtcttttgcaaaaatttctctttttaattgggctaaaaatgtcctctagtcaattataagttttttgggtatcctgcaaccgtgacatgtttttaccatgtccaccagcaattacacaaactttgagtgtactctaaaaatttgcctattaattatgtatattaaagtaaagaagcaacctcccttatgtattaatccaagactactcacatgcattacaaattaaaacaatacataggaacatcataatttagctatattactattcggtcgacatgatatatgtatggcccacaagtttgagttttgcacatttaatttccatgtttttgtctgtattaacctggtcaacccctcataaaaattactccctccataccaaaataagcgcaaccatgagttttgtgtctaactttgatcgtccgttttattttaaattttttatgattaatatttttattgttattagattataaaacacaaatagtactttatgtgtgacttatgttctttagttttttcaaaaaaaattaaataaaacggatgattaaagttggacacggaaattcatggctatgcttattttgggacggaattcttgtagctttgggtgtggattgatcgggacatgttatacagtagtggcacaaatgtttgttctcgaactgagatcttacttgaaacctgtttgacttgcttgtacttttggtgatcatcacgattcatgtgcactacagtgtacaacaacgcccttttccatttggtttgttttgcatgggtgaatcttttccgtgtgattgatgtggatgttgtaagttgaccgtgaatttacatgttcctgctgcctcgtgcttccaatgtacttggtgccatcttctccagtctctttctagatcggcatgtggttgactaaacttcgaattataatcaaggtgtgcgtaccttggagagaataattcaaatggacaattatgctaaggctgaaaatcatcaagaaacttcattatacatggcatgaacatgaatgtagctataatatggttacctcatatatataggtcgcgtccattctatgtcaccaaaagattcaaagaaatgttaagagagaagtgatagatgtctcttactcaaggacaaaaagaggctaataggagaagatgctctgaaataaaataaaataaaatattatgtaaatatgagaggaataaatggtgtaatcactgccagaaaccgtagtacaccagatggctaaaaactattatgaataaaatgaaataccgtcatgaaaatagttcctgacatgttaattcaggactcatgtacgtgtctacgaaatagtgggcaaattaagggcttgtttagtttatggcttgaacaaaccacaaatagaaaaaaaaccaatgccaatagaatgatcatgcatttggtttgtttcaaaaaaaaaaagctattgccaatgttttggcaagaacaatataatacatttataagaagttatgttaccaaaattttgcccacagccaaattttgggcattgccaatgtttagtgagattaaaaatggctacaaactaattaacgagccctaaaactttgaattaaaaaccagacagtggcctctgtccctcccttctggctcgtcgtcttcgtcttcttcttctttttttttcaaagaattatccaaatgtttttttaattatgataattaagtggattatgtatatggtgcaggtttgtaccccttttctgaatctaagcgtttcaatagataaaggaatgacaagggaaaaatagattttaagagcaaatagataggttatgtgtttaattaatttggcatgacatcttttatttccttcagacagtggaacgttcggggtaaaccaacatatatatgcaccagcgcacaataacacaatcaatgttaattgcacatccatatccatacttatatagtttctttatccagaaacagttacgaaaaaaaatgattgatgatcagctcaccacctcttatgatgattcgagaaaccactgtacaataactgatataaagccacagaaaattgcagcacacacgtacaccaatcaatttacatccctgaatctgtctctcaactgccctacatctcctgccaaaccaaaaaaaaaaaaagaccaagaaaagaaacgaaaaggaaaaaagaaatgttgaatcccgagatctcagctagctaggaggacaataaaacctgacctgaccacagctgaatgcaccagctagcttagctatatagctacatacgcacttatacacgcatagataggctggaccctgcatccaaacgtactacgtagtacatgcccttcacggttcacgctcacattccatgagagcaaccaagaaacggccatggcgatcgatcgatcgatccatcgacattgatcgatagagatggccatggccctcctcctgctggacgccgtcgtcgctttcgtcgtcgcgtggtacgtgagagcgacgagtgatcgatcgatccccgagaagatacatatggtatgtttcaatgtttgggaggagcttctgacagacatagtttatcctaaaatttaaaactagccctaccaaataggcaaaattgattatatagtatcgaaagttcacgtttttggttttatagcaccgaaagttaccggttcactttaatagcatccaaagttcaccctgttcccatttttagcacttccgtcaatttttccgtccgtcttaatcgttattgatccagccacacacatgatatgacatttctacccctcattgacatgcattatacttgtacttgtgaggggtagaaacgtcatatcgtgtgtgtggctggatcaagacggacggaaaactatcgagaattgacggaagtgttaaaaatgggaacatggtgaactttgggtgctattatagtgaaccggtaactttcggtgctataaaaccaaaaacgtgaactttcgatgctatataaccaattttgcctaccaaataacgatctagctccatggatttatcgagataataagtagatgtagttacaaaattaatccagaaaataaactagaaactgagtttaccagagtctacacatgattgattgtaaattagatgcgtttaggcgcagcgggcatctcggaggcgagggggaaacgccacggagatagcggccatgcaatggcaggctttcgatcagcaattctcgcgagacccaaggcgatggcatggcatgcatggtagtgttcatatgcgatgccgtgctgctgccgctgctgctagtgctgctagctactagctgccgggttgcaattctctctagcttgacacaagctgcaggtcaccatcgatcgatctgggtctcgattaccatgcagagagagctacatgtacaagctaggatgctgctggaagcaggcagcagggtcgagttgggagaggaccagcagcagcagcaggcagagagaaccctatttgcaggaaccatcggcttgagtttaggctttggctctggactgggccgaggaacgtgcagtagctaccaagctagggggtaaaaatgagagagagagaattttccatgtacttgcagtggtaaaagtttgctctcgttgtctactgtaacgggctgattgatataagttacttgagattggtaccatttcttacctatattatttatagaatggagaagtatttcataactttaaactttggttgaagtacaaaaattaagtataaacattaaaatgggacaacactattcgcccattagctcctatcatttgatctatggctgataatccgtgaaaacatgaaaccgtgctcttagcggtttaaaagatcataccgaaaagtaaactgcaataaaaaaaactttaaaatcaaataatcataacccttaaactttgagagagatcgagagatgggaagaaagaaagaagaggaggacaagtgaatgacagttaatgcccaccaatttttaaaattcttttactgactgtaagatatcttgcagtctaattgtagttgatgcatgagtatattcatactataacttaacttccacatattgcacaggtggttttccttttaatttgtacagcttgtgcagtttaggtggtggtgccaatgagaatcaattttatagtatactagaaaaaatactcatccgtttcaacagggaaaaccgtctttccagtgatacaatagctactaggagctgatgaataaatttaaacattacaatcactatacattaaaattggaaaggcattgcctcctacgtacctacctcccttaactttcgcaagacagttttgtgcccgtatgatgccggagccgatcgtccccatcaaatctaggatctctcaaaattgattgagcgcttttgatccacccgatctcctctgtctgttttttttcctgaaatcggagtgaatccgcaaaattcaggcggggaagatagctgtttggcaatcattgacaagcattaaacaaacattaaatctggcgaattaaatctgaattgaaagagaaaatcatgggggaaaggatgagggaggagtgcagaattgattttttgcaattaagtataataaaaaacacatgggaagacagatcatgtgatggcggcattaggtgcccatgtggagccacagacgactcgagcatgagaaggagtcggaccaggaggtccaacggacgaacaatttttttttggaagcatagttcgttttttaagtacataaagataaagtgaaagatatttcagtcatataaaactattttatatacttactggacattgttttaggagaaaatatcttgtgtatccctgaaatttcacctaatcccttctacgcccttgaattttgctcattcctttacatacccatgaatttgcatgccattttcgctagttgaccgttaaattcttatgaaaaaacccattttgccttttgctgtggagaagcatataaattaatagagtgtattgttggagcgtaaaatttgttagatgggactattatatttatgagttaattatacaccatcttattttcgataaatatacttttagatacgacataaaaaattaatacttatttattatttattagttattaaaagttgtttatgtagcatataaatatatttgtcttatacaacaaatttgttgtattactatcaaaacacatatgctacataaaaaaacttttaataaataataaataaatattaactttttatgtcatatctaaaagtaaatgtgtcacaaataatatggtgcataacaaactcataaatataatagtctcatccaacaattttctacagtccaacaatgtactctatttatttattatgtttcttcatagcaaagggcaaaatagactttttcataaaaatttaacggtcaactagtgaaaagggtgtggaagggatcaaagaaaaacaaaaattcaggagtacataagggaatgagtaaacttcagagacataaaaggaattaggtgaactttcgtgggtacatagggatttctcttgttttagttactactactttttttccatatggcattttggaaccaataactgggctcctgtgtggatcggaataccaaaatgtcctagatattcggcaaaattaattttacaattatttcatagaaaaccgatcaatttgccacatagaaattaattcgcaacattccaaacgggccgtggagctatatataattggtcactcacgaaccggccggcctcttggctatattggtcactcacgaagctcgaggccggcctgcgtacacagctcttccctgcatgcaaatccttcacaaattgcaggtaaattgaagcttgtgctcacgtcgtacgtgttgcacgcatcattctgattcctgacgccctgcctatatgcgtacgtacgtgccctgtacccagatggcatatatgcatgcattcagtcgtatacttgcttagtttcaaaatatatgacatatatacatgggacatatccggtgaaaatcatcaaataaataaaaacccgtgaaaaccatatctatatctgaatagcgtgagagtgttttatccggcaggaaacaaatcattaacactgcattttatcaaaccggtactagtgatggtgacactgatgtgattttctataatagtgtccattctgaaatataagactttatatatattttttaagtgaataccgtggttaggtcaaaagattcctttttgtcacttttgttgttatttgtttaattttgaattgtttacattctcataccaaccatctgattagtttggaatcaatgtttaataatgataaaaatcacgagaaccagtacatcaatgcttatattgtgatataaaatttgaatccagaagaatccatagaaccgaaggtgtatatatagctttatatactcgtcttcatggttcgtttggaccagctatatgtagtatatatatgtatggggacaaaaacggcgacacacactgcaaggctacatatcgcatgtagatgtagccagtagcatgcatgcattagtctgatgggcatggatttaggctttacttctgaattctgatcagttgttgggcagagaagcatgcagtgaaaaaaggaatcgtttttttaacacagtgcatttttgtagctgcatgcaaatgtacaatggtgaaaggtgaaaacctcgatctgcatgcatgatggatacatagatactagatagatagatcatgctgtacacagtagaaaagagtatatcaaagctactcctcacatgcatttcttctcatcagaagctaggcatagcgtacggttaaatttgcttttctgaggcaacatatatgtactgtgtgtgtgtgcagaaagttcaaagcaaggaatatatgaacgggcaaacggacatgttgtacattcagttgcagtgcgcaggcaaaagattggactactcgcatatagtactgttaccgtgtaaagtttacagaaagatatatactcgtggtagaaaagattcagccgagataagatgaacatttactgtttggcatgtagcacttttcccctttccttgatggaggaaaagtgtatcgttatatatgcacgtttcagttcagatacactcatttctacacaccaaatcactagatggtacaaccatggttactgtagtcgtatgcgggtgatagcacatatatgcatggcattgcatcgtaggatattagtagagatgttgctaagctgcggtgctgattggcgcactattgtagaaaacggtttttcgatataagaagggtagtaggatgcaggtgagccataagtggctatgcttgcaaaaaccggtccccggaggccttatgtcggtcgcatgcgacaacatcgattttccaaggtcttttcgtgcatgctggctagccatctgcaaaaaccatttatgtagtagtactgtggggacaaataaataattgcacgaggaaggtcttttcgtgcatgctggctagccatctgcaaaaaccatttatgtagtagtactgtggggacaaataaataattgcacgaggaaggagatgaccgcacggggatgagacggtcgacttcatgagatcgagtacttcctctatatcagtgggtgcgcacacttccgttgggcaaatcttttcttactttattttattgctttacgtgttgagtggtaacgatttatgcttatttatgtgtttcctggtatgtgcagaaagtatgcatcagtgtcactcttcttcacatgtgtaagtatttatgagtattcacgtataagaaaatttcatgaccacctaatgccgagtagttgcacacttgcaaacagttgagagcatgaagatcaatggtaggccgtgtttggaaaaaaaaaaggacgccctgaatcgatagtccctttggtttgcaagctagctaatttacatgttaattacttcgtgaataaaaaacttattatgggcctccaagatgccaaaggagactgcagactccattcattcttcacatctcattctcttcgatcctaatcattccccagccctgtcttctcctttccatttattcaagattgtgctctagctagcttaccacgctctgcggaacaataactagttttgtcatgaatatatatatgttgccatccatcttgatttaattaatttatatttatacatgggaaatgaaaaactgtaagcgtgaagcatcgccaatttgaagatcgctcgattggtcagtttggggctttttgctggcttgggctttggagggaggagatgcgcggcccaggaggctgctgtatttctagcatcgtccgatcgtcagcttttaagaacattcatcttcaatcgtttctcttctctgcatctaaacacactactatagagacgattttcctgaacgctggccccttttggttccagacaggccaaaagcggctccgcctggtaccaggcgaatgccggcgccgggctgtgggctgcacgggataatcgattatcccgtgtggcccacgtaaggcgaccgcttgcgatggtcggtgggcatataatccccagcccgaccgttggcataaaattccggcggtttctctctcataaacattcacaaaattagggggaaggttttcgacctcaaatctttgattgggttccatataaaaggtgtagagcttgttctcctccttcatttgcttacatttttgtcagttttcatcggtgaaatacgatgaaacttgcacttttataaatggaatagtgtaggcacttttttgtttttttattttttttagcaaacacataatgattccattacatgtttataaaagtatttagtacttaaattgaaaagttgggtttgcctctattaaatttattttcattaggatgaaaggacgattttttttttcaattttttagaaatggacaatattttattaatgcttaaaattgttatgcagctgtttaaatagtccgtaaaactttaaattactatgtgattagttccctctaatttaaatacatcagtgtttgaatcgggcatggatgtattaattacaagctttattgtaggtcattgatcggacatggatgtacaacacgaaaagagctcatccaacgttctcgaaggaagcagccaaatttgttgagctcgcaaaggcacatgctgtgagggagaatttgaggagcattttttgcccatgcaaagtttgtaagaacgaaattttgctgcaagatccgaataaagtattgtcgcacatcgtagaacgaggatttaagaagggctacgagatatggacttttcatgggaaagtcggtggtcgtaacgaagagttagatgatttctgttttgatgatgcatacaattttataatcgaagacatgtcacagggacacatcccgaaatacagtctctggtatagagaaaacatttgtgctcactggtggagaaaacatttgtgctccctgtactcccggttttgtaaccgggaatataaatccaagactaaagatggatatctttagtcccggatgaaataaccgggaataaaaatctatctttagtcccggctggtaatggactaaagatggatagggccacatcactattgtttttttctttatattgtttttttctgcttgtatctattccccacccaaatccaaccaaaccattcacaaattatgcacaataaaatcatccacaaatcatacatatccacaatctgcaaatcatacacatccacaaatcatatacatcatccacaaatcatacacatccacaatacacaaatcaatcacaaaatcatccccaaatcaacaagaaaaatttccaccaaaatatacaaatcattcactacaagagatacagataaaaaaaatcactagctgccgactggccgtgcgccgcattgtgcctagctgccgcgcgggctgccgccgcccggccgtgcgaggcccggcgcacgctgccgccaggaacggccctaccttcgtgctcgccgctgttgggggcagccctccctccacgcgctctggccgccaccatctgccatctgccgcctgccgcgcgctggctcacttagtcaccaccgccggccgcagcccctcctggatccggtggaggggacgccaccgccgccgcatgcgagccacggcccaccggaggggaggggaagagggggattcggaggagaggggtgagatttgtgcggagaggaggaggaggaggagaagaggatttgtggatgaggggagagaaggaagagaagagaaaagacataaggttggggcggaggaccaggcgtgctcggcagatttttttttcgccgatttatttatctggttgtttaacaaccaggattaaaaatagatttttagtcccgatcagtaataccaaccgggactaaagatagaggaggggtctgacaaagtctgctttcttttaaaccgggactaaaaaaattttagtcctggttggtaactccaaccgggactaaagatcaaaaggtgacgtcagttctttaaaccagactaaaaatattgtttagtcccggttcttatttaaaccggaccaattgtggattttggacaaccgaccaaagatgatttctccagtagtatctgtttctcaatgtggcactaatcacctcagctacacatgaattggcgcatcgcatggaggcatggccaatgttgcagtatctacggctgatcacacctcggcatgcaagaccaattgtaggtggacacggtgacgacacacacaatgacgtatttggtcgcatcaacggctcctgataccttccaagcctagatagtttgagtctacatacatgcatgtattatgtggggaggagcacacaccaacttatagagaggaaataatttattgatgcataacatcgatcatctctctgcttcgcatgtgtaagggtatttatgggcattcacggtgaaaaaaaaatataaccatctagttgttgaacgcaagcaacagttgggaatgtttcaaccacaagctgcttcatgagtattcattactttcttccctttaaaaattggtaatcactttggatttaaaacttgtatcaaaatatataagtgacgattttaaagtattgtttgtttcatcaattacttcttattcaatttttcttctcgtctaacatccaacaaccctcccaccgacatatatacatccctcattttatctcccgtcataatttagcccattagtcataaagtaaccgcctatatgatgggaaggagtaataacaatccatctcaattttttggaagagagcaaaaataagtacaagaattaagtatcacaatttatttgataaaaagaatcaaagagccatctggtttatagatcagtccacttgactgctcaaaatggactgatcgaatctatcaatttcataatgcatatgcacgccccaagtccggccttgctatttgtactgcaacatggatcacacgatcagctcatcacttcatcagcattctgctccaggagcacagatcaccaagaaaaatatgttttggccaagatcgccatgacgaccgtgtcgaggcaggctacacacgaccaacagttgcctcatgcattaagggtaagaatgggaatgtggcatgtccagtgatcacaatgccttccatgccccattcaacgtacatgtactcaatccaccactactactaccatgcatgggcacatgtactgattgctatcttcttaccttgggacactcgatcaactagctagttaccaatccggtagaggttaccatatatacctttgttgactggactcattttagatacattatactggtaatatatactgctagtacaataagtgtaacttagaaactgttcataaaatttaaaaccaatattttagtaaattcgtgttttggtgactaaagtcatcccattgtggtggttggttgtggcgcgcatggactgtatacatgatataaatgtggagccatgtgtgttgtcaatattcccacgtttattatatatacacatgcagatgcatttgtaaaatgcaacgaaaatttagaagcagccaaatgaaattcaataattagaaacccacacatgcattgttaagactatgttcattgcttcaagttaggtatgagagagtggagtggaagcagatttcgtatgtgttgcatagttggttttaaagataggctaacttgatctaactgacataaaacccatatttaaaagggttaattggaaccatgccgctataaatatgatatttgagataaatgccactactattcacaatatcggtaacgtgccaccataatttagggaaattggaaccgtgccactatgtcgctttttccgctaaaaatctccgttagcctcaattgcacgtggggaagaaattaataagaggtaggatggaggaagatggaactgatatgtggttcccatgtataggggtctaacggaaaacatgacagagtggcataactctattttccttaaattccagtggcacgtaaccgacatcgtgaatagtagtgacattttttaaaaatggcatatttgtagtggcatggaaccaattaacattttttttgtggggaactgactaaaaaacttaattgtaggctcttggtaacactttgtcttccctacgacctctcctcgattttgtctttcatggttactctgaaataaggatggaaagtttgctagttcaattctaaaattgatgaaatgtattctgttggtcagttttgaccttgatggtttggtagcatgtttggaaatgctacatgcatgtatgtggtctgtacctaatttagtagcatatttactactaatattgcaccttcacctaatatagtagaaagccggccacattcaaatatttaatctgcttagttgtataacttgttgtcggattcttctaatgcacagagaatgttacttaatttatgaggcttgttccggtccagcgaaatgtaccgcctagtacaagtacctgtaggtaccattgcaatctgaccgttcaatacatgggggtacgatggggtcgacatagttcttcctcgtggtcgtggccattccatcccctccagctgcaggcatcctccatctcttccctgcgggtacaacttttctccttccatcccctctcgcgcagctgtcctggtctcacccccacctcgatctgcggtcgctcggcggatatgacgtcgcaaagctacgcggcggcgtcgtggaggtctcacccctctcaatccaaggctgcgcgccggcggcggtggccagggcaagcatggtcgcaaaggatgcgcccaactgtgtcgccgctgcggcggcgtagtctcctctgccaaaacggctcggcaactctcaactgcgaacttgctctgcagcattgagaatgcgagaacacggcaccctatctttgttcctctgcatctgatttctattgtgtgttatgttgtgcagtacccataaatctgttcaatcaacttatcctgggatttgttgattgtccaatgaaagatccagtggaaaagaaccgctatacctgtgacacggcaatattatgagttttcttttttgacagagcacccaattacttgttaccgctggcagcctagccctgctgtatttttttctcctccactaacaattttgaagtaacatttgataacttgatatactattttttttagataatgaatttgataacttgatatactatatatacatataatgttcaaaggggatttgacagatttaataacttgctatctaccttcacgatgaaacagagcagtgagcacacttctctgcatcatgttccaggcactagaatttggcacctgttaaattagtgaaatcggtgaatagatgatttatgcagcttacatcgaatcagtttgtgtctataccaaatggatgagaaaagctcactgacttttactaaataagagatgccatcgaattctctgaactttgctaaacaggagtactgcggatgcctaaaatttcagtgaagttttctgaacaggaggaagcagcagcctctgttgccgcatcagcccgaggtcgccgctgcctagaagtccgtcacgct

SEQ ID NO: 76947 - DNA, 2435 bp, Oryza sativa
tgaccggcgggaggacgcattgaccaaggtgagggagaaagagcccagaggacggtaggggaggagggatagacccatggaagggggtgtataatagagctatatatatatatatatatatatatatatagtgaatctattctacaccccctcccatgggtcaaacccacctcccctaccgtccctagggcacaaacccccccacctcggtcaaagcgtcctcccgccggtcaaacccgcccaccaatccctcccccgcccaccactttactgctctcgtcttgtaggaatcatgcagtaacagaatggtcatcgtgcagtaacaagacaacgttctcgtagtaacaacgtcaaaaagtagccatgatggatctagtttcgttaagcgtttttttatgaatgtcatggtgcaaacggattagaaaaacaagatttgatgtgagagatattgctctctaaagattgagatttacctcgtttttgtcctcgtctaactagaaaggtgtagtaactagacggccaacgtgtttccacagtatcgacgtgaaaaaatagttatgatggttctagttttgttaagcacttttcttacgaacgtcatgatgcaaacgggttataaaaataagacatgacgtgtacgttgctgctatcaaaagattgagatttaaaatattttatctctaacaaacattactacaatagtgtcactgttactgtgcatgttctctgttagtgtaaatttcgtcatgtgttactgccaaaagagtctgtaacaatctataaattttgtagtaacaacctataaattgtgcagtatcgtatcttgttactactcttttgggataatgttactaagaaatcatagtaacaaagtatgattcttacagtaacataactaattttttttcacataattttttacaaacatacaaaacatgcaaacatcatatggtgaattggttaggagagcttgccatgaactatgagattatgggttcaaatcttgatttcatcaatcttttttatcttttctaaaaaaaattgatcgatcgagagagagagatcgaatcgagagatagagagtacatatatatacatatatatatatatatatatacatatatacatatatatatacatatatatatatatatatatatatatatatatatatatatatatcaaaatctccacaaaatttggacgaagctgaacatacatcacgctgatcgggagattatacagatatagagaagggaatggtcaagatatgttgccaacatctagtaacgtgtagagattgaatcaaggcggatgattaataaactcttacaaacaaatatcccaatcgttgaatttaattagtgatgaataattgtcagaaatcaaggctcaatagtaaacaacttttgtgcgtttatcattttcctaattaatttcatttggtagcgtgcgtaggaagaagtcaaataatatatctctgtaccggcatataaagtatgggcaaccaagcgactttagatgacagtatgcatgacatctaagaaacctttattatataccaaaaaatattcttattgcttacctctaagatcagataaagctccccagatccggttaattagtactatagtaatcaacaagcaagtaagtatccattacaggatccatcagctatgtaccgtatattggttccatttttttactggtattataattaataattgtttaattctcttccttgtcaacgcacttgtgcaatgaattagcgactaacctctatttttctaaacatagcgcgctgaccacacacacacttctagcttctagaagctcatctctcgggctggccatgacaagatgccctgccaacaacgaaaacagcgggactttttttattcccccaaaggacctaaacgtggtgacgcctcactgcagacgcaactgcctcattatgcaagcgagttcattaaaagagcctataattgatatgtgcatttttccaatattggtaggaatcttcccctaaaaaaatatagtacaaaagagcatggataattaaacacaacagcaacttacatgatattctaaatacgcgcgggagattgtgagtttatgacaattatttaagggcacacatataaaataaatgttaaaatgttggaaagtcatttaaaaataagagtaaaattcaccaacggttcttaaacttgtcaggagatttcacttaggtccacgaacttgcaaagcgcacatcgagatccctaaacttggtttattttatcatcccggtccaaaaccgcgtttgaccgtggtcttgcctacgtggcacgctacgtgaatgatgacatggatttttttaatttttttttctcccttcttccttcttttttttaccactgcaacaacccttccccccgtgccgcctctcacca

SEQ ID NO: 76948 - DNA, 2862 bp, Oryza sativa
aacgtgttcacgtgctagtcttttcgcccaatgggataatctttatattcggatgagatgggtctagaatgatgtgaataacctagcatagtcttcgtagatttgtgtggtatggttctctgaaaaatttttaacatcagcgccgtcccttttaactctgcttaattacacggacaaacttttgaaaagattggcccacgttggcggaaggaaaggggaaaaaagagtaaaaaggtgaaagaatagttcactttgtgctcacgttgctttggtagtttctgtaaaataaatgttttggtactgcaagaacttgtttggtgggtacaaattagtacacgaaattataaaacgctcgttttgatagatggagttctcatagtacatgctaaccaaaaccgaaatagcatggcaaggctaattttatcaacttggataatgattaggacgtgccgtgcacacttgcttgatattttatgtcttcttttctttgcaattattatacccttattctatcgtttactccttccatgcagaaatatagccacatttacttatctcaactaatcgcaatcatcattatttagtttctccacttattttctcatttcaactaattataaccgttcatcacttcacctacctattttcttaatatccgtgcatagcactgaagttaggacgaatggaatattaaatatactagataatgccctgtactttgctatggaatatttgatgaatatatgtaaaatattgtacaaaagatggatggatttgggttgaaatattgcgaaaataatatgaaaatgatgatttaatatgcttatatgtttagttttagatttacttgctatgtttgcatgttgaactttaaatgcttagcggattgatgtggtatgcttgtatattaggctttaggatatactaataattaaggcatgtttggtagagttccaactcctaaatttatctctaggagttaggtcttgagtggagttgtggagtagcctaaacacaactccacctctctaattcattttgtgagagtgctttacccagctccgctcctattttaggtggagctgaaactgtttagccaggctccagctccaggagagatggagctggagctgtgccaaactggtctttactatgcttgtatgttgagttttaggtgtagtgggttgtaactatatagaagatatgcgaagtgagcatcaactggttaggttccttatggtggaaccaacccacccgggttcaaatcctagatttgacacgggtgctcgcatttatggctaattattctttcagtggtaggcgatgtactcgtcgacagcgaggcgcctatggtgacttcgtcaatttcaagacatgccggcccagtcttccggaggtgttcataggggtagggtatgcgtgtgtgcgttcataggggtgagtgtgcgcacgttgtgagcgcctgcatttgtactgtgtttctaaaaaaaactatatagaagatacaaacatgtctagaagatacaaatatgttttgtttatatatagcatcctaatcaatacttcaatcagcgagattagcaataccatattcttttggtcttggttcatacatactagaaaacctttttgcaccaaaacaaacattttgtaagtttatgtgatagattacattcacttgataagtttgtatatatagcaccaatataatttactcagagagaaaaacatttaaagctagaccaacttcaacgtgcagagttaatatattgatagttgcttacaacgtcgttacaatacgcgtctttatctatcccaatgcatggaggtgctatatacatgtcggtctgcatcataaaccaactctctgcgtgcataggcatgctcggaaattccatagcacctctgaggtaacaacgcccatggcagcccacttaccttttcttttagaaacgaaaaaaattccgagggcgcgtacaggattagcgcctcctcgaaccaagttggaaaaaacgtcagtaagcagttaattaagcacccatcgaagtaccccgggccagttgaaatttttagtaaattcgtcctcaacgtatacagggtgaggttttgtgaaacattgtaataattatatatacttgtagttatatgtcacaagtcataatacctatgattttctgcaacttttattataaaacgtgggattttcaaattttactctatttttaagtaaattttaccacatgttttatgatcagagttttaaaaaaatgatatttattataacttgataagcataaccatatgtatggcttgttcacttgttatatgaaacccttatatatatataccataaatcatgtgctataagtcatgttatatgtggatatacctgtaattttgacttaaaacttgaggttttctgaaactttctcttgttttttaatcccaaaaaatgcgggagaaacttgtcaacggaattaacagttgcgatagtacctatatcatgtattctatatacaaaataaaaaatgtactgctgcatgatattcttaagtattaattgtacttattatatcattttttatgcatttatgaccataaattcccttgttctgactgaatatgcatgatatacgactataaagacacacacgagcatcatatcacgtttctaattgtacatttgtacttgatataaatcgtgcatatatatgactataaagctaaactacaccaccatcctagctatcccatcactaaattgtactccctccatcttataatatagaacttagtaacacaaagtatacaagatttaactgattttatgagagagcatcttgctcaatgtggctgcaggaa

SEQ ID NO: 76949 - DNA, 10144 bp, Oryza sativa
acttgagcagtttaactttgaccaaagtcaaaacgtcttataacctgaaacagagggagtacgtagtaaaacctttactaagatatgtggtatgagaaaacagtgcattaatactgcgataaatcaagtttaccttcctgtagtcaagtattccttcaaaaggaagctctagttcatcactgactataactggtatgcaaccactaacaattgcatcaaacagacgagcagaagatggagtatccccagccggattcaagcaaaagagagacctgccagtcaaatatattcagtaacagctacaatacaaataaaatagaattgtatatttacttgcgcatgccgttctgagctgctgctttgccgtcagctccagcagtcccttcttctatgattatgccttctgcatcttttagttctgtcacaagtttactgcggatcttgcctccctaaacaaaaaacagaataaagaattaagattcacataagccaacttgaatttgaagtattgcgtgcatgtatttcatgctgtcgaaaactggaaaatgacaagaagaagcatacagcattccttctcagtcttcctcgaaagaatagcaatgtgcttcttctagattgagtttctgatacacacttagaatcacaaagatcaacatttggaacatatggaaggatgacatccttttccaaataaacttgccctggtttatacctgagaaaaggggcgaaactgagtttggtaacacaactattgcacgcagaagctatttaaggcaaagcagcagacaattaataccataccagttcccagtagaatccatgtcaggcagaagccatatagccttcttcacaaatctccgaactgacttaaacgaccatgggtgatgaacgggaattacatgatctctgccttctgaacgttgccaagcaggttgatcagtaacccatttcaaagcttcctaacaccaacaaaacaacaatatcaatactgtcctcttgcaaataaacttgggtgaagaaatttcatgacaatatccttctgtaaataaacctagccacctaggtgaacaaatttcaggacaaagtccacttgataataaacttaggtgaatatattgtgcaacatgtggagaaatagatgaaaatgatccctacagtcaagtgaaccaagaaaagccatcacaaaaaatggtaagaaaactgagctcaggtaaagccttgccctattccagttatgactagagaaaagttcaactctctttactactgagtattgaatgccagactgccagcaggaactatcaaaattttagttgtaaataaacactagctagtccatgtgcataccctacaacaaacactagctgaaaaataaaccttgagagatgctcccacaccctataaagtgccttgcattcttgtttctccagcaagaagtaactgattgttgtgaagaatggtacgtagaagatgtctgcttcttcttgccgccgaaccctgataacattcttcaaaagtctttgtgattcgggcgcaatgagatcagcccacagccaatagtcaatagaatgctgcatatgtgagcagataacaaatcagagattggaaaaaaagaaaaacatactgccgacaagtgaaacctggttaattatatccttccaaattgagatagttattccaggatcttaaagagaacatcagaagctcgattgacacatgatgtacatcactaagtacggaatctgtaatgttaaaacaaaattgagcattgttcaaacttcaaccgctgtcttgaaacacaaatgactaccaatttgtacagactaaatagcaaatgtaacaggaatcacaaagatgtctagcatcaaaaactacatgtggtcactggtcaggaatatccagagctcacttctcacaaaacttgccacaaaaatcaaaatctaaaactactctatgaattggatccaacccagaagcacatgcacctcacaagatagcatcggatcccaaatacatcacacggtcgtatctaatcaatcgccaatttttttagaaaagaaaaactatggtaacaagtccttaatgggatcagaatatatcaacccactaagatctaatgtatacacaagcttgtagcagtaacatctccaaaccttccaaagcatcagagaatacttgcaatgtcgcatcatacagtagcacaatgcttctcaccccaaaacagcaagcaatccacatcaattttctcaatcttgtcaccatttgcgaacaaaaaaaattcaaacccaagcacgctccactctccacgactatgcagaaagcagttcgatctgacctgctcgacgagccggtgcacggggctcccattggaggtcaggttggaggtctcgcggtacgagtccctgaacagccgcagcagatcgtacgtgaacctgctcggcatctcgtacacgtagaccctgagaggcgccggggccgccggccaggcgccgcccccgtagagcctttcctcctcctcggcccggatcgcggcgtcgaggtcgccgggggccgcggcgggggccgcggagcggcggggcgaggcgaggaagcggtcgagggaggcgaggaaggcggtgtcggcggcggagccggggccggagctagggctagcgaggccaccgggcgaggagggagagaggaggagggagtaggaggcggcgaggaggaggaggaggaggagggcggcggcggcgaggaggccgcgcggggaggcggcgcgcgcgcgcgcgagggaggaggggagctgcttccccgccatggcggaggcacactggaacactggaagcccaagacgctggtgtgtttagcgttttgtggtagttaaaggtccccatcgtttggcttatttcctaataagtcaaaacggcttattaggaaataaaaatgaatttgtgagtacaacttttataatgtgttctttgtgacttaaaagccaatgttgaaaaagaaactatgttgaaaatatgtcaaaatcaatcttaaaattaagcttgaaaatttaaaatttggctttttctttggcttattaggccatccgatggggctgtaagtagagaggctctgaatttttcatttttttcgagacacagatgcaagcgctcgtaaaaatgcgcatataccctctaatcctctattaatacacattacccattacccacccattacccatataaatagcttcgaagatttagccgatatatcttgatatttaaaaaataatcttagaaatctaattaattgagttacgtttacttcaagactcaaagatcagaaccaaattgcattgcacatttgcagttcagaactccatatttcagaattcattcagacaataagccaaaccatattgcagttcagaacttcatatttcagaaattcattcagtccgtcatgtgtgcaggaaaaaaaattccatttgcgcgttcgaaaaaaaaaagaaaagaaaattaaaggactccagcagaatgattattttttctatccaccaaataaaactgtcataatctgatttattgagttaactaaaaagtttattcgttctatccttaaatccactagagattgtagtcccagttaataaacatctcatatcgtatagccaaaatagcctaccgtacaatctatcacaaaagcctgtcacgaaacttacagtataaaagactgtactcaaatttacagaaagataaaaaaaacgccaaaaattaaactgttgcacagaacagaagccattgccatcttcagtggtagaagatgttcttctggaaattaacggtggtagaagatgttcctctggaaattaagagcaccagcaccatctacacaaccatatgaatcgactcccgtactgtcatccataacaataccatctgcagtaactcccgtgctgaaataattccatgaagaaggaggaatcatatgcaatggcataggatccaccaccgccgccgccgtcgccgccgcggccgcggcgtctcctccggctccgggaagagaagagccagggatttcttggtgcgacgaggaggccgagccggattctgacggctgcctgatcacaatgccttggttttgtggctgttcctcctgctgtagcttcttcggcttcttcggcttcttgctgcgttgtggtttgaacttcttggtggtaactttgttgtccttgttggtaactttgcacaacacccagtcgttgagctatttataaacaggagaaaaagaaaaaaaaaacacacagtagaattactatactcctactaatcgtcacaacaactattttatcaaactttttaaacctctggctgctcatcagtttcataaaatacaaatgtgggtacatttgttttaaaagtgattctataagcttattctaaatagaaaatatatatatagtcatgcgattgatatgatagtagctaacccgcatgggctcctcctccgcgtcgaacggccggttggagttggaacacacgaactcccacatcttccacggcgtcttgatcgcgttctctttcttcaactttggcgtcggcatgctctcatcgtattcgtgataggtgaggcatgccttgtatccaatcaacatgttatcgctgagggcgtcaaggacggcctcgttcttggtagtcgacttccaaaaacccaattgaccggtgcttcggctaggccttttgcctttgttgtatttccggtttctaggtgaaaacatgtaccagtttccttcgcggctgggacccagcttactcgctagaacaaaaaaaaaagtgtgatgtgttaataaagtgtgatatatgttaaccaagaacatggaaagatgcataaattaagcggcaaacttaaaaaaaatagtgtgataggttaacactaaaaaataatgtgatatgttaataaacagaaatagtgtgatgtgttaacacagtgtgaaatatgctaaccaagaatagagaaaggtgcataaaattaagcagcaaactcgaaaaatagtgtgatatatagcaggttaattaacacaaaaataataatgtgatatgttaatatagtgtgatatatattaacaaagaacagataaagatgcacagtttaagaaaaaaacaaaactaaaatatcatagttatgttaatactaaaaatagtgatatgttaatatagtgtgatatacatatatatgttaacaaagaaaaaaatgtacaaattgaacacagcaaacctactaagttctttaggatggtcggagtagacgtcgcagacatgcatgtagctgtagctgggcagctgctcgccgcgtagtttcggccggaggaagtcaaggataagttctatatccgacggcacgaaccggattccgggcacgcccaaatatctacgcgtctcctcctgatcctgcagaggttgctgatcctgaagctgctcctgattctgatttttgaggggaagaaactgctcctgctcatgccactcctgatcctgatcctgctgcagccatggaacgggaacaagctgctgctcgcgatgatcctccgacgatggcatcagcaggggaagcggctgctcgagattctcgagattctcctcctccggccatgcagaaccggccggcattgtgctgctaatctgcagctgctgactctgctgcggccacgcagattcggaggattcagccattgccgtcgacggagattcaattcggacagcgaatttaccgcgatttaagcgatctgatgagtcggaggcctacaatttaagcgatctcacgcacgagatcgtatgatagtgcggcggggccgggggcattcaaaataaccttttaaacacgaacgaatagtgtccgtatttatcacgactgctgtaattacattattattattacgtaatactacaaggcatatgtgggactcgaataacccaagcacgcacgagtggagctttatttgtgagtttgatgggagtacgtatgatctgtcagccaatcagctcatgaccaggccccatatgtgtgttgggctgggccggatgtcaatgtgaattttacttgaaaataatattagttcacatgacatcccttaactttacatcaagtttgtctaaggtctctaaaccacaatacataaatctctacccctcaactattaaaagccgtgcaaagtaggtcctatggtagtatggaccaaaaattcctctgattttgctgacgtgcatatggtaggccccacttgtcagcaaattttcaacggagtgagctctctcattgttgtctggccagctctcggacaacagcgatgacatcggcggcactaacgcggaggttgataacggctccatcaccagtggcaagttcgtcacctcgaggcgccccccccccccgggcgacggctcggctttgtggcaaagcggcgtcggcccatcctcaaggcggagcgacgacgcgtctcaatagatccacatattctgtggtgtaaaatcttggtagtatttaattagcggttgtaatggatcaaggactatgggttttttcacaatcctatctactcctttaaatatattcctaagctaaaagtgtatagaaattaagctctcaaatttttttaggctaaaaagttaagtctattaccacccttatatttgagagatcatggacatatataagagtaaaaaagaagaaaaaaaccccaacctgtgagacatatatgcatgaatagatctcaccctttcgaaggccctatatggagcacactattttttccccttttctattgactaatcaccttgaaacgtaactaaagtgttagtatttcagtttgttcaatccagctcgcgcatgattatttctccctacttttgcactgctgcactcgtcacgtactcacgtagagtgttgtgtactgaatacgcgattggaggtgagctatatgagaggaaaacctgcatacatacatacgcatcggtgaccccgacctatgaaacgaacgaacgatcagccgccgccgcccaatgacgacgacgatcgatctcgcctcttgctgatgagacgaggtcgccatcggaggaaattattggtgcaatggggcatgcacggtatgtgcatgcaacaatcgaagagaagaagagttcccaattcgatcacgtacagcgaaagcagcacgcatatgcacgtaggcggcagcacgaacgcacgcaataagggtgtgtgtgtgtggatgggatatatatgcaggcatgcttgcgttgtgcaccgaaaattttgtagctagctcatcactttgggaggtcaccttcttttgttggctagtaacatcagcaaccaatgcattgttatttagggaaagcattttcatttctcgagagaatatataattataaaaaagtaacaatgtaaattaatacaaatgtatcgttacgcaaatatacaagttcaaatttcacaacaccaaacccttataactagagcccaggtgcaagatgttataggctttaatagatgagaccgttgattttttatatatatgttcaattatttatcatattaaaaacatatactctattgttatattaaggtgatgtgtatatatatatatatataagttaatattcgcgggaaataatcacgattttgcagatgtgccatccacatctaataattttgcagagaggtgcatagatacatatcaggccggatcgatcatctatatgtagagtttaccttgcttgtccatgtaagtactcatgtagggaaatcaagtagtagtaccataaaaaaagatcaggtccgcaaattgaatgaatcgaagaaactaagtggctacctagaatggctattttggttaggggttggattatcagctaccttacataacaaagagactgaggcttctctctctctcaaaaaaaaagagagagacagaggctccgtacatgtgatgcacgcgtagtacgtcgtcgtacgatgagggaaaaatacacacttagactttggtgcatacactgatctgtatatcaaagacaaatcaacatgatgatgcctctctttcaattcgctatgcaatgtactatatatatattcatgaactcatgcatgcaagatgcgtgtttcaacgcatcaaagcacacgcatcggccacaaaatgtcgcgtttgatattgagctatatatgacgagaggtgtgttttccttttaagatttgtcggttaacactggtgctggtacaattccttttggaactattgcgacgaaataaagtggacttcattaattaaaaggggtgggtaggactgtatacaatagagtaaccaacacaattgtgttggtatagtctttaggagtagtatttctgcacagttaacagctactagttagatgtccttttggtaaattatagtctgacttcacttgtaatgatgatgttcttttctcaagattttggtgccaaactaatgattatagtttgagtcctactcaatttgataattgtaatttgacgacactgaaagttgcttaattatatgtattgacgatttttatgcttaaaggtcatgtttgagttcacttaatataaagattaagtatggacatataaaatgagaaaaccattcacatatgattaattaagttttaattattttaaacaacttacctacatataatgtttttttaccagacgtatcatttagtgtgctaagttttttttaagataatggaatataaaatctcagtctttgctcaaaagagttatagtcaattattacatagtagcactcagagcgtaattccaaacaaataaaacataccacaaaggataacaaagaatccaaactaacgtaaggagatcacaatcattgaagtctatttgtaaatctctaaccataattgacaaaaagttgcataaccgtagtctataacttgcgacatgcaactttcagaaactcttcatcttcatcacacttttataattgtgccaaaaaccggagccaataaattgccctgaaaattacctgtatatagaaaaatgatggtgatttagtgtgctaatgaaaaccaaaataaaatttatatcttacttggaataagaaggaccaaataattgctatttcttctcaaacatggtcgtaagcttctctcatctaacatgttcacaaaactcgatcgatgtgatgcattcatacaagagtttgagaaaagtttcatcgatgtgagccgcgtttgaatgatgcgcatgcggccatcgggccattgttcacaacagatcgcttgtcctgcccgctaacccacgtcagatcgaacgaataaacgcgtacgcctatctacgtaggttgatcgatctcgccggcgctgcgcctagctcaccagtcatcaacgcgcacaagctaagctagccaatgcaacgaccgacacggccgcccgcccacgcatgcatgccaccactagctagctagctgcttgacatcagtctttcataattagtacttcctccgtttcaaattacaacttttttttactttgattaatattaaactactttaaaatttaactaagtttatagataaatagtaatatttgtaacaccaaattagtttcactagatcaataattgaatatattttcataatattgtcttatagtagtttgaacgactataattttttataatacactggtggaaaaatcatctttcgtcggtccggcaaaatccacaatagtcccggatccaaaaagaaccgggactaaagattgtttttagtcccggttataaaaattttgatctaccaaccaggactaaagatgatctttagtcccggtttatcccttgtcagatgtatgtcaggggccgagaatctttagtcccggttggtgtcaataactgggactaaagatcaccactttagtcacggttggtactaccaaccggaactaaagattaagataatcttaccaaccgggactaaaattaaacacgtagtatataatccctatcccttatcctctcctccacacttatcccctctcctcagatctaactctcttcctcatcccctctccaactcctccccttcctcctctccttcccttctccccttcctcctcccccctcctccccttcccatccggccggccgg

SEQ ID NO: 76950 - DNA, 4894 bp, Oryza sativa
tcgttgtccaaggagacgaggcaggtcgggagcatggcggtgcggtggcgcagctcggcgaagaagaagcgcggagcagcctgatcatcggcgccggcggcggccctggcgaagaagttgacgtggtagtagaaggcgtcccagcagtccatgaagtcgctcgccgtggcggtggcggtggcggcgacgagctcgtacttgacctcgttggcggcgtcgccgttgtagtgctgcagcgcgcactccgcgagggactccgcctgctgcagcaccaccagcgggtccgggcgattctccggctcatctggctgctcctcatccatggcgtcggcgtcgtcgtccaagtagaagtagtccccgacgttggcgctcgtgatggtgtagctgtacgcgccgccggcgctcgtgaaggtgcagctgttcgtggtgtgatcggcatggtcgtcgtggtaggcgggagacgtgggcggcggcggcgactgtgccggagagtaaggcggcgacagtggcggaggacaataaggctcctcatcctcgaggtcgtggctcctgtcgtccgcttcttcgaacggcacgtagtacctcaccggcggtagcagcggcatgacggcggcgggcagtcgatcgacgatgagagtgagacggatcgattcgattgtctcggaggaagagaggaaatcgatcggtttgcgctataacgaatgcagcaagcggcgcacgcaccgtccgccgcctgattttatcgatgggcacgcctgtgattcgactccgactcggagtaacagctgtatcggccaatgcgcggtacacggatacgcctgacgtacgtacgtggtgccggcctcgactctccgctacgcatacgatgttttttttacgatttttgtacgatcaaacgaagacggctcttggcatcgtaacgctacgtggtgcacgcgcatgttgcagcccaagagctcatggatctgaagcccatacacgtatactcattattttcctttgcctttttttctctgtatccaaataaatacaaaccatgccaaacattggctcatacatgaagtttgctgcatcttatcctgatttgtgccattggaaatttagaatagttccaactaggggtgatgctaccagggtccgaggtgcaaggaacatatgtgtatgggtaatttacttaaactaggttcacatcaaaataatttacttaacttaagctgggtcacatgataagtgttgagcgacagcacgagtatataagattgattaggaaaaataaattactctggttagctgtgccaggaagcttaattataagatgtcgggacgatgatgtgattagcttgggtttttggatatgggctcaacgctagaaaaggtccagtgtgggaccagaacttacaatgttatgagcctagaagagaaacgtttgattgtacaactatcgtaacaaattagtcgtacgtatagcaacgccgtcgttataatgagtgggaataattcaactcggaataggaacgaatgtaataatgtgtgctaatccaaatatggttgggctagctagctaatcccattacatcctctaaaccccaagaccctaaaccccaagcaacttgcatgtttcacttatggcgccatactttttactaagaaaagttacacatttgaatgcccagcatcggtcgactgggggaggtgggaaaatcggtcgctcccccggcccttcccccatgtgcgcacctgtttgggcccacccacttctccctcccctttttcataaaagatgttttacctagtgtatttacaatattttactatttatagatctaatgttgcagtgtattaaaatattcttttgtaaaaaaaaacccaaactctctattaagggaatttggtttattttttgttctaccaaaaaatatttcaccttcacaatgtttcactatatatagatctaatgttgcaatgaacgaaacatttcattgcaacaaaaaacccacatattttggaaaccccatattaagggaatttggtttattttttgttccaccgaaaaatgtttcacgtagtgtactcacaatgtttcactatatatagatctaatgttgcagtgaactgaaacattctttcgctatttgctgaaacattgtttttatataaggtgaaacaacatccgatttaaacgagtgaaacattttcgatctatttagtgaaacaattccgatatacctagtgaaacatcgtgtaacatttaaaaataattcaataataagctaattttttttcgacgaaatatatccatgtgtggtcttctttgaagatttaattgcaacgaatttaatggtgcaatcggatcttgatttggataagtaatttaagagaaaaatctatttaaagtagttttgcacgtaaatcgggcgctaacgtcatgctgacatcagcgcccgattttaatctcctcccatcgaacgcccgagcgggagtcacgtccttattacattataaattatctatacttacatagtaattgctcgtaactttcaatatttacgttgtaatatttctaatacacaatgtataaaaataattaagattaaaagtaatttattatctatttaaaagatgatacgtgagagataagagcaatcatatagagaaaatagtgactaaaatctatacttcctataaagttataacccactagcaatatgcaaccgtgtcacatcatcacccactagcaataattacatattgaatcttatacgagcatagtgacatacaacattatctataatttatttaattacatataaatcaacatgcaaacttatccgatcatcaccctcatatcatttgcaatattttaacaaatatattatcatttttataatatttaacacatagttatcaatatgttgcacattaaagcgtgagtattatttgtttatttcatgataagtactaataaacactaatgttctattatttttttctttctattcctatttcctagcttgattgtcgaaaaatatatattgagagttctcgtagcaaattgcggggaatcacatagttaaaacaattactcttgccatttgttacttggtgtggtagaaatatttcgatatcaaccgatagtgtttctcgttggcaacattgtaaccgacccactgccaatagggaaacctacagtgataggccctacgaattggcagtgtagctggttctaggacggtgagaggtgacatcatggagttgaatatcgacctggagtggagatccaggcaatgatagtaagggagctggtggtgggctggccgacgaagaagaggcgagacacatgttggtatttgatacgatcacagataaatccataagcggaaggatagctgtagcacttcaccacagagtatttcaagggtatcgaatcacatggaacatgtgtgtataatacaagaataggattagaatagaaagaatttctatggattaataaacttgaccagggaggcatcgctctccctggtctaccatttgagtccgctctacggctttataatgtatccgaacatgaaggattacaaaggtcagacatagttgtcaccacttgccacctatctctacaacccatggaccacacatcaaacaaaaataacttctaacctagacacaacctttatgttattgattactactctagcctcgcacatgaactttcatttttatctagagttctagtactaaaacacttaatagaaatactaagcgataaacccgcaacgatgaaaatatatcttacttaataagaaaattaaataccaaaaggaaatctcgatcgaatactcactttattaaagaagcatttgccgaggtacacgagagaagggagtgccgacaactccgatacttctctagaactttccctcactctcactctattttctaatactctactagagagtagccttgaatgaaagtgagttgtactcaacttgagttgtgtgttgcaaatgaaatgaccccctggtttcatagtgtcaaatagcggttacagaggtcagtacacccacaaccatcattatcagccaatgggagattgccacatggaaaacgatggggcagagcgccacccctagcttggccgagaaaatggacatttagccactttcaaaaagcggtttcactggaatgccatcccgaaaacgcgtttcgctaaaatgccaatatgaagcgtgcactcacatccactttgccattttggctattttgtgtatttttgaaatcattttcactagaatgtcgggtgatgagacggaattacccctgttgggtgaggacgaagggaaggaggagaagccgctggtgtcggtggagcccgtgctcgccggcatcagggaaggcaagggagagaccacagcctccgttggcattggtgcccgtggtcgtcaccgcttgcttcggcgaggtgaagaatgagaaggcccctagagaggcaccaagaacgacaaggtgctgctgccgctagacccgtgggcgttgtcggtgtcctcgcctcgtcctccaagaacgcaaacatgttcccaccctcaccgcctccgccgcggccaccgcccttgtcccgccaaccaccggagcagaaggaggcatcttcttgtgcgggaacgagggcaggaggaagcatcgccgccgggtgcggcgcagcgcgtggagaaggcgaccgcggagtgcgcgtgctttatgcggagctcggcgaggtggtggcacgacgtcgccagcggcttatcgtgctctcttcaggcgctcgctgtccccgccgaccaccttatccttgccaccgtcgaggatcgtcatgccgcccctgccccagccgcatcaatcccctttcacccggctgccg

SEQ ID NO: 76951 - DNA, 21986 bp, Oryza sativa
ggcgggcggaggggccgcggccggcgggtccgcggcaggcggggccgcgctcggcggtcgtggcgagcggcggcagcagcggcattggttttttttaaaaaaatttgtgatgattcactgagatgtatttgactgagaagttataaatttgtgattcattgtttggatctgtgatgtatttgagtaatttcttaggatattgtgatgtatttgatttgtgtgtataagtaattttatgatttgtgatgtgggtttggtgatgtgaatttgggatgttattttgatttggggatttgcctacttgattcgggagaaaataaaaagggaaaaagaaaaagaaaatggggaacatctggtactgccgctattgtctctttagtcccggttggtaacatcaaccgggactaaagatcctctctctttagtcccggttggtggtaccaaccgggactaaagatgtatctttagtcccggttatttcaaccgggactaaagatctttagtcccggatccttactcccggttgaaaaaccgggactaaagggggttcccaaccgggagtaaagatggtttctccaccagtgatataagtcgtttgattttaatcaaagtcaaaacgacttataatctgaaacggatagagtagtaaaaaaagacatagtacatgagaattgcgcacaaatttaacagaatcaattaaactggtgtactagatcatttggaattaataacatggaaggaaaatgggcatgttaacctgttttgtggctggactgcagccgacaccaatcgtgccgcacgcacacggtgtagccacagccgcagctgcagccaccgcaaacagcttgccgaacaggccattgctgcagctactgcacgggctgcagttacaagccagcaacgttggtatgcagtgcctcgtcccacctgaaggctgcagcgcagctacaacaacacctgcttaacagacccaatagccgtgctctgagatgaataacctaactatgaggctggtcgggagagattgctacggtcgtgtagccgcggcagcagcaatcacaacacaattcaggagcattggctgcagctgctagccaaacagacccaattcgtgtagttgtagttttagagcagctagccgcagccgtgccgcaaagcagaacaaacgagcaaaagcctctatttagttgagtaaagaaagtgccgacttgggttggggcggcgcaaaccactattgtacgcacgtatacgctggatcgaccgaccgactatacgttgtgtatacggcacgcgcgccgctctccaggtacatccgtgctgacttccagtggtgaagccagtatacaattatagtaaagactaaactaaagtggccaataaaaattaaaacatgtctcatataaattggctatatttctaatacaaaatataaatatatgaagtaaaattttagggggtataacgggggctctaatagtctattagggggtaaggggcccctagcccccacgctgtcttcgccactactgactactgctcctttcatcttataaaaaactaaaccaacctaatacaaaatatgatacatcttagtattacgaatttaaatatatctttgtctgtattcgttatcctaaaatatgttacatctaattctagattcatgttttatggggagaagggagtacacagcacagcaggtcaagtgttccgccgcctgatgtactccagtcatcaggtcagcatgagcagctacgactgacgagatcgagcattcacacggtcacaccttaactttgcagttgcaggcacatacacataatttgcaccagaaccagatcgagcattgcacgcgttttcaaagtccaaacacgtacccaagtacgtatgccgcgccgctaccaaatactactagatgcatcgtgcatgcatgcacggtctctttgcgtttggtggattaattggatcggcaactgcacggcaatcatcggtaacacagatcggggcggtgaccggtgatgtgtgatttctctgtaccagtattgacttgcttggggggtttaccggtttactagcaccctgctcctgctgcatgtacgtacgtacattcgacagggcgaatctgaagacttcagcaggttaactaacaccgatctcagcatggcagtgaggcagtgagcctgctgatgcgcatgcacagtatttcctcttttccggccagccagctaggcgtcaagtcgtaatcgtagcacggcgaggcagagcagatccttgaccggtgcaacattcgaccgagtgtgttcagtctgcccacatgggaggtcggaaacacaccgatgtcgtcgaccatcgctcagctcaactgctaccaccaccaccacgcacaacgcactggcctgaacaaatagagaggccacaagtttcggaacataaaaaggatgttttttatagcttttaggaggcatttggagtttttttttaattcgtagtatcggaggtatcgaaagataccaaattttatatttaaaaaaactacttaagtactgtaaaatcacttataacacggtggatatcaccgtccgtgctacgttaaaagtccaaacagctgaagaaatcaaagaaaacagcatatcaaacatgcgtaatagaggtgggatttaagatcatggagttgaaagggaggtgaattcagaaagtgaaaagtgaattcatatcgatcgggcattcggcggcgcgagcgcgatggtcaggcgccacttgagcttgggagtttctacttgcgagagcttaggcggagagggagggtggtgggccccacacacccctggctccggtgggacccacgcctccctcccatgaggattgcatgttctggatttttcacaatttggttcttttgaaaaatttatttcgcaaatagacctctgaaaaaacttatcttgaaaatggttctttttgggcgccggcgccagtcactctggcaccgtcctactgccaccgtggtggggcggcgctgaggtggcagggggagcgcgccaatgtggctagcgccctccccccggattttttaatttttcttttatttttttgatttttttcactcttaagagcacacaagaactaaccataaaaaaagttaaactcaaatggacgaaatatgtgacatattttcgaaagctctatcgaaaagcttcttgcctcgaaaacataatcttgcaagcggaatttagaggttttaatttcaccgaacccgacaaagcggggaaaccaaccataaaaaaattaaactcaaatggacgaaatatgtgacctgtttaatttttgaaagctctaccgaaaagcttcttgcctcgaaaactttttctgtagatgtacatggatatattatttgcttaattccgagtccgtatgagaaagttacgcatgttttgtgaaattgacacctggatgtaaaaaaaacacaaaaccctaagttttttataggatgtaaaagatgtaaaaaaaaggctagaatgttcgaaatctaatctacttttttttattataggcaaaaccaaaacaacgaagagcaaagaggaggggggattttcggtatagcgttggaaaattgtacaagtcacatatttggtccatttgagtttaatttttctacagttagttcttgtgtgctactaagtctgaaaaaaaatataaaaaataatttaaaaaaagttgtacatttctctcctctaccggggggtgccagccacattggcgtgctctccctgccacctcagcgccgatctgccacgatggcaggaggacggcgccctagtagaaccattttcgggataagtttttaggaatctatttgtgaaattagtttttcaaaaatatcaaattgtgaaaaatccaggttgcatgttcgggtcggagccccgagttgcttgcttgcttcccgcttctcgcgaggagaggggatgtgggccccgctgcctcatctcctgcgtgagttcgcgacgagaaactctcatcctatacgccccaatatacgtacgtcgagcggggcggggcccaggtcgcgcccaagtggggcccacgctcgcatcgcgtggcgtgtattggcgtcgggcccaccccacgagcttttttcgtgtgccaaaactgcgtgcggtctcggtcggtcgatcggtcccggtccccggtccctgattgggtcggacgacatcggtgactcgcggaacgcgacgtgtccatgtctcaaaaaactttacagggattcatcaggtagacagggaaagtttcgaaaagaaatctgaacatatatataaacccgtcggtcttttctttaatcgaacttaaacccgtaatcaaattagtactcctcccgtttcaaaatataacaaattttagcctttataatttgtcttaaaatatacttcttccgtttcacaatgtaagttattctaacattttccacattaatattgatgttaatgaatctagacatacaatatgaatgtgggaaaatgtctagattcattaacatcaatatgaatatggaaaatgctagaataacttatattgtgaaataaagggagtaacaatttatccactagttattcaccattcaatttcctcacataccttcacttctcaactaatcacaatcttccaccatttaattctaggaaaagatacgaattaccccctctcctgaactatcgcggtcgaccgaattacctcatgaaccccaaaaccagacaccattcaccttgaactttcaataccgaacaaattacctacgcgatgtacgcgacatacacgtgacaatccagtcaacatattatttattaaaaaaatatggacccacctatcatactcctcttccccctcttcctctctctctctcgcgggtctcgcagcggcaggcgttcggcgacgcggtccgagagggagcagcgacggtgcgggacatggaggcggcggcggcggcgaactccgggagggagcggcggcggcgtcggacgtagaggtggcggcggcgaaatactcctctgggagggagcagcggcggcatgggacgccaccacctccttctcgacgccgtcctgcaggctcatgtcggcggcggctcggcgccaggcgcggggttggtggcaggggacagcagcgtgatggtctcgtcggagatcttctcctggtaggcgatgatggtggactcgcgtgcggcggcactggcgcagtcctacccatgcgcggcggcctcgcaacggttgcgtctgcggcggcttcttgctccctcctcccgccacctgctgctgctttgccagttgacgagatcaaagtggacggggaaaagcggcgaaggttgaggacgagatgcgtgatgcgccgaggcggtcgttcttcacgtgcgccgcggcggggaggtgggtgttcgtcgccggctggcatgacgaggagaggaaagcgctttagtcggcgggaacgacaccgaggccgacgcatgggtgccgctcccggacatggcgacggagcgggatgaagccagggggctttgcgtcgacggcatgttcgtcggcggtggagacggagctcgcttaggcagccacgacggcgccacctccgccgtgcacgccttgctcctcgctgcagcctccaccatgtacggcttcgccgacttcaacgcgccctccacggcatccgcctagcgacgcaacccggaggatgatgacgaagacgaggaggagaagtccggtgaggggcgtgtcctcgaggcctgggcgaggggcctagaggagtccgtctccgccgctggccacccgggggaggtccgcctccgccgtgcatgccttgcgcggttgcgcctgcgcgagagtgagagagagaagagagagaggaagtgaaggtatgacatatgggtcccactattattttaaaagaaaatgctaattgggttgccatgtgtacgccaggataaaactgttctggattcggtcgaggggttaattcatccggtataaaaagtttgggcgagtgatatctagtttccgggttcaagggtaattcggtcgaccacgatagtttgggcgggaggtaattcattctttttccttaattctacctactatcttaataattgtgtccaactttaatgtgcccatcggttggcttatttagcgaataagccaaacgatatatttgtaaatgaaaaataatttatgaataaaacttttatatacgtattcttagcgatctaaaagtaaaggctgaaaaataaatttcgatgaagaaaaacctcaaaatcaactccagatttaaggttgaaaaattcaaactttaggtaataagcataagcataagcaaaaatataaggtcttaaaacttcttatattatgggacggagatagtaatagactatagtacctgtttgaaacactgagatcctatatttttcttttcccgaatttctacagaacatagctgaatgtttaatatagtcctgcatgctgtttttttgagtcaatcgtgcacggctatagctgggatgtactactactacttaagtctggtttagttaccaaatttttttttcttaaatacgtcatattgaatctttagacgcatacatggattattaaatatagataaaagcaaaaactaattgtacaatttacatagcaatcgcgaaacgaatcttttgagtctaattagtctatgattagccataagtgctacagtaacccacatttgataatgacagtttaattaggctcaaaagattcgtcttgcggtttccatacgagttatgaaattagtttttttattcatatccgaaaaccccttccaatatttgatcaaacatccgatatgacgttcaaaaatattcttttccccaacagggccttagctaagctgtgttctgtggcgtgtgtgatgcggccactgatcaagtattagcccttggctcgcattcgctgcgtgtgatcggttttggtcgcaggcagctggagtttggtctcgccgaaacgatgcacgtggagaccaacccaatccagatgtaacatctctccatcaccgggtcggccgagaaattcatttacttctttttttagaacgagaaattcattcacctacacagcacaagttctggccaaacaccggttaccgaaatgaactactaccacgaagctaaacgcctgaacgggacggaatcttgccagaatatgttttttaccttccctttttaccttggtaccaaaagaagttttggcatcatattaagctctgacaagatctgtatgaaatcctactgttgcacttcagaatggacggcgtacgtgtacccgtagtcctcgttgagaccagcggtaagtcgacgcaaattaaccaaccacagtagtactcgcgcgaggtccacagggataagcatgttgtacacacatgacatattgacacacggacgcagagttaatgttcatctctttggagtgagcactgatctgattctgatggcctcgtacgtcggcgttgctgctgtacttcaattccatttgcaaggacttttcacacacgctatagtactgtatcgttctttgcgatgagctgcgatgatttacaattacagttattactgtaaccttttcttttccttttttagggaactagtgctgcaacttttcccaaagaccaattccttccttttaggtggtctaggtggctgggatactatacccatctttttagaggctcaaagacgagttctttattagagcatgcataatagtaggctataaaccagctaaatattgaggtagagaagagaaaaggggagaagcggactataaacttataagcagcttgaacataagaaccaaaaaactctgtgaaaaagacaagtgggccatatattaatagtaaagagctaactattagggcacccgcaatggttatctatagactctctaccagagatccatgtcagcatatttttctacttggaaaagattaaatgaagagagagagcaaagctatctactaagctggagatagtctatagagaaaaacgagacaatgtattagagagctatagatacccatgtagacatactattgaggtgttttactattaatctagtatattgctgaggtgtacatgttttatagagagcaccttactttaccattgtgggtgttcttactccctccattccaaaatataaggcataaccacccttaacccaaaagaccaagaaatagttattatcatcttgtagtttggatcatcctaataaatataatacatgcatccaataggattagataacatgtgagtggaggatttaaaaaagtaataatttaatggagaagatgtcatagttaattgcatgtttgcatgtatgacttatattatgaaacatttaagaaaagtggttgtgccttatattatggaatggagggagtatatatataggctaagagactggtcgactgtattattagccttgatcttagtaccaacttcatacgcacgtatatgtaaaagcagcacttacatccagacgtccagtacttacgtatgtaaaaaagcaggcacttacatccagtaggaattatatagtactagtagatcggtaaaagtgcttagagaacgtatggcactaaaatcaaacaacaattataagagaaaaacaagccatccgtgcgtgcactagaaaagtgttcggagcaattaacctatggagtttagggtagaggaacagcagaaatctgatatcctaccccccacgcacttggaattgcattcttttggccgaaaggatatgaagttgtagccttgcagcctgagaagcagtgtcatttcagactttcagtgccctcttctgcagactctcttggtactcccttcgtaaaaaaaaataaaaaaaaccaatgcacgagtataatattttttaatactatagtgaatttgatagaaatatgtctaaattaaatgtattaggaaatgctatattcgtgaaaagatttgtttttttaggatgaagggagtatatattatagttgactccgtttgtttgtgcagaattatagtaaacccatcggacaccaccaaaattgtcttgagcaggctaaatggtcatgtttagttcagcgcaaagtttaaattttagttgaaattgaagatgatgtgactgaaaagttgtgtgtgtatgataggttgatgtgatggaagaggactgaagtttgaaaccaaactttggatctgcgcgttagtgtgattcggcaggcgtagcgaccgagcaacgcatgtgcagtttcctctcgtagcgggaggccgaggcgcacggggacgatcacccgtccaccaccacgtgcaaacccgtcgtcccgaaccagcaagcggccgcgcgcgcgcgcgcgcgcgacccactgtgcgtttctcgcctcgtcacgagggcttcgcgcgcgtcgttgcgtgttttagccgatcaaaaaaccggggcgcaccgcacgcgatgccgccccgggtgcggagtacgcgactacgcgagcatgcggaagcaaccggacaaatatgcggctacttctacggagtattttcctcgtagatccggctacttttaccacggattgctcggttgctccgctcctgatccgtggccgggccggggttggcttgatctcaagctgatgatcagatcagttcatgccctgacatgggtctatctgccaaaatttaaattttcacctttaaatttaggattgattttaatgtttttctatcaaagtttattttctagtctttgttttttagatcgctaaaaacatgtatataaaattttattgataaattattttttatttgtaaatatgtcgtttagaaatgatggcttgaattgggagggcagagacactcatcagagtagtacgaaggggaaagcgtaggtacgtagaaggtgcgcagaatcggtgcggagatataagcggtaagcgaggagcgcatgagattaccaggtgtggaaaattctctggatttttagcataaaggttgcccttcgctttgggcaaattggacctagtttttcctctctctgtgtgtagaatgaggagagatcgagaggtgtctcggctttcatcaagcggtatattcatcatcatttcgtccatcttctagctgacttatactccatccgttttgaaatatttgacaccattgacttgttagcacatgtttgtccgttcgtcttattcaaaaacttttgtgaaatatgaaaaattatatgcctacatagaaatatatttaacaataaatcaaatgataggaaaagaattaataattacttaaattttttaataagacgaacggtcaaatatgtgctaaaaaatcaacggtgtcaaatatttcgaaacggagggagtatacgctaatagaagcactagagtgtataagtggaggcattagtagctcaagtggtatcgtcttaataatagaaaaacagagtagtcgtttgtttttaagttgtttttttttcttaaattcctcctgatctcgttcggaacttggaaatatcacttcacaagtgacagtttgatttcctcttgtgtttatgcattattttgtgaccgactaagggcgttttcaatattctcattttctaacttatactttctaatttttcaacttatactttctctttttttcacgtgtatattttctaaaccactaaacagattttctttaaagtttatgcagaaaagtttcttaaaaaattatattaatctaatttttggctaataactaaataatcttcgctaattaatcactttgttttacgagtgataaaatggttttcaaccctcgacaccaaacacagcctaacatgtgctactagtacgtgaaaaaaatatgaattttcagaattcccagaacacacgtttgttgtctcgagaaatgaataattaataaatacatgggacaaaaatataatcatgctagcaactaaataaaaaagaggaaataaaaacaaattcaaccccagagagagagagggagaggaaaaatggggtgcccatgcggccctgcccaatagcgttgctgtacctttcagctttataatctcgcccctcgcgagagagactccccccatcctgcagactcgccccactctcttgctcagctcctcttcatccagtcctcaaaactctctctgatctctctctcttgctgaaaattctccgcacactccggtgggcttaagcggtggcggcgtctcgcctgggtgggcgagatccctctcttgctcgtccgcaaggtcgctccccctgcgagtccaatctactgacgagctgggaggagcaaaggagggggcaattggagctccgctcggttccaattcagccccaattttgagccccccggctgcggggttcggccaggttagctcctgttcttgcggaattctggctctttttttttttggggtggagaggggatgatctgggtggggtggggagtggtggaattctggtttttttttttttgttctttctttggctggttttgttccgtggggattgaattctcggttctcgtcacctcaggagtggtgttcgcgctgcttgttttggttgatctgtgaattatgggggaagacaccaccttttctctcgtttcttgcacttaaaaatcgtctttggtgagctgttgtgcttggggagctcttgagctgagcaggttcggtttaatctttgattgggttctatacttcactgtttcggtgttcccctctgccgaatttgggaatcaagaggttctgatccatcagtatcactcggcttctcgtcattgcatatgtacaaaacctgcttttttcaatcactcatgtagtcatgtctaattggtttgtcttttatcatcttttggtgtaacttgtctgtgtcactaaccatgccataatttttttttcatgggtactatgtgatcgatttcttcttcttcttcttcttcttcttttttaaatttttacctgtcataattcaagtagtagcagtagtaatctaatctaaagcttccaaattttccggtgtagttgagacgccatgtatcgggtgaagagcgagagcgactgcgatatgatccatcaggagcagatggactcgccggtggccgacgacggcagcagcggggggtcgccgcaccgcggcggcgggcccccgctgaagaaggggccatggacgtcggcggaggacgccatcctggtggactacgtgaagaagcacggcgaggggaactggaacgcggtgcagaagaacaccgggctgttccggtgcggcaagagctgccgcctccggtgggcgaaccacctgaggcccaacctcaagaagggggccttcaccgccgaggaggagaggctcatcatccagctccactccaagatggggaacaagtgggctcggatggccgctcatgtaagtcccgtcccccccccccggtgtttgatcccatttgctgtacgtatttgttcatactaagcagttgagagattgctgttcttactcctaaagatttcccctgagtcatggtcagttaaaagcttattataggtttacttgatcttttgcctaatctgatgatatgcgcagttcttcatccaccacctaacttgatgtttccagggagaattggtgtgctattagatcattttaattttagttccaagttgtagaattcgtttgtagtgattggttgattgcctttcttgaaggatacttttatgggtttttatcaagtgaagtattttgtttcacggattagaattgtattaaacattattttccttggtgttacttgtatgctctaaaacattaacttatatttttctagtgcaaggcagaaagttatcaagcttttggtttagaaattaggtttggtgatttttaaaaggactctcatgtagtacagtagcaacctgcatgaagccctactgctttcaatttccaaaattgatttacaattcttaaggttctaagcttagatctaagcataccgttcacttttacatgattcttctgtagctttatcttctcaagttcatctttgtcggttttactcctgcatggatgcggtcatgatcatatgggaagatgggcttaggtattcttcatgtgagtagcaaagaatacaaatagtgttcatcaccagctttgttgttactgagagcaagttgtgctacgtcgaaggttgaaaattgtttggtgcagttgtttgccttaaatctgttcattttggattgttcactgtgttagaaggggttgggaacaagcctagctaaattgtccgttgtctaggactctaaacagcatagttacaattcacaaggtaacataattgatatctatttcagtctgaccaagtagtgctattattcttcgcaagcttagagtaaccatctaaggcctttcaatcttgttaactttcatgattcacagaatcgaattaattttttgtcataatagtgtgaacttactgagtttctatgatttcttgaactgatcaaacttgtccacgtaatgatgtgagtgaaaattaggctgttgtctgccgaattatttcatatgtatcctgtgtatctaagtctttagagtaagcttatcatttatcctgaactctttgcacatattttctgtattttttcctctttacttacattgagcacatcttctcagttgccagggcgcactgataatgaaataaagaattactggaatactcgaataaagagatgccagcgagctggcctacccatctatcctaccagcgtatgcaatcaatcctcaaatgaagatcagcagtgctccagtgattttgactgtggcgagaatttgtcaaacgatcttctgaatgcaaatggtctttacctaccagattttacctgtgacaatttcattgctaattcagaggctttaccttatgcaccacatctttcagccgtttctataagcaatctccttggccagagctttgcatcaaaaagctgtagcttcatggatcaggtaaaccagacagggatgctaaaacagtctgatggtgtgcttcctggattgagcgataccatcaacggtgtgatttcctcggtggatcaattctcaaatgactctgagaagctcaagcaggctgtgggttttgactatctccatgaagccaactctaccagcaagattattgcacctttcgggggtgcacttaatggcagccatgcctttttaaatggcaatttctctgcttctaggcccacaagtggtcctttgaagatggagctcccttcactccaagatactgaatctgatccaaacagctggctcaagtacactgtagctcctgcgttgcagcctactgagttagttgatccctacctgcagtctccagcagcaaccccttcagtgaaatcagagtgcgcgtcgccaaggaatagtggccttttggaagagttgattcatgaagctcagaccctaagatccgggaagaaccaacagacatctgtgataagttctagttcttctgtcggtacgccatgtaatactacggttcttagcccagagtttgatatgtgtcaggaatactgggaagaacaacatcctggtccattcctcaatgactgtgctcctttcagtggcaattcattcactgaatccacccctcctgttagcgctgcatcgcctgacatctttcagctctccaaagtttccccaggttggactctgaaattcctcatccctctttgatgtgattattcggttatttatgatgtactgttttgcagcacaaagcacttcaatgggatctggagagcaagtaatggggcctaaatatgaacctggggacacttcacctcatcctgaaaacttcaggccagatgcattgttttctgggaatacagctgatccatcagttttcaacaatgccatagcaatgcttctgggcaatgacttgagtatcgattgcagacctgttcttggcgacggtatcatgttcaattcttcctcgtggagcaacatgccacacgcctgtgaaatgtcagaattcaaatgaattctgtatttggtatttgccagacgctacagcagattcttggtatcgttcttgctcattgtttggatcataacttgaggaagatctcgtcggttgtaattctgcattgctgacagagtccttgatggcatgcaggcactatcagatgttctcttatgcgactagcccttttgtccaataaagtagtgcatggagataagccggttaattattgttttcttttttgtattagagaaccctttttgtcatctctattgcccgaattctgttggaaattcgtcatgtttgtttgaacaatgtaagaccaattattgcatttgtggtgtactatcttgttgagcatttaccacttgccaatcaatagcaatttgttactactacacaccctgtcacattttctttttctgcagcctgcaaacctggtactcaaagccatagctgtcttggagataaacatactttgcagtgcactgatgcattatcatatttaggattgtccatggaaagcagcaatgctgtgccctccagttttggcttttggaatctgcttgctttagctgtggtggctgaagagaaaaggggccataagcctcggagatgaatgattagagctgacatatggtttcatagttggaacccaacacaagctatcatgtatgacatgatcaagaagttgcgacgttacacaattcgcaaaacgatatacctaatttcctttggtgttcttgtgctgtttttgttctttttgtttcataataccagtttcctttctttttctctctctctgtaccgcagatgtgttgaacattcagagctgtggcattctggtacttttttttttcagagggtggcattctggtacttattgttattattatcatttcacaggaagtacttgatccttttctcaaacatcacatccaatccttttatagctactgatagttttcgacttctctccctgccaacttgcaatttgtcaaaaaatggtttcttctctcagacctcctttgaaacaatggaacggagtattttatttttattttgagaaattgcattgattcttagaataatcctataaaattattgcatttcaaaggaaccatcagcatatagttctattctatacactttcttcatcccaaagtagataaaaataatatgagatgtgatacattttaatactacgaatcttaaataaatgtgtcacattttatattagatttgtttagtttagaatgaaaggagcaagatacaagctgcttttctggctcaaagcagggagaaaaaaaaacagagagcagaagtatatgtatactagttatatcagcacacatgtatgcgtgcgacgcgtgaccaccgagaagatagcaactcacgcgatgtgcgtgcatgccatgacttcgccatggggaggccaaagccacgacgcgcacgacgtcgacgcatcacgcacgcacggttcggttcggccggcgatcgatcgagaggttttagattggattacctttatttcttctctctgcggttgcattgcatggagatggaccctcaaccagctagcacacgcagctgacacacacatacacacacacacactcacagcgtgcagaagaagatgtggtattagtggttgggtgctttacgctgctcgctggatctggaattatggatgttgggtcgtccatgaacgcttgaacagtgtcaccagcggcagcgatgacgcaaggatcggccaggtgtcaggccatacagagataggagttgtgatactgcaacaggtaaactttttatttttgataactcataaatttatcgtcaacaaagttcaaggggaactactgcagcaatttacgcatgaaactagtacagagataggtcgtccgttttttttttaaggcggagggagtactaggtggtgttcttttcttctgtatgtaaagataaaaattaattttttttacataaaataagatggtattaacatataattgaatgagttttaattattacaaacttgaaaaatactttcaagttttcacaggaaacgcgtcgtttaacagtttgaaaagcgtgccataaaaatcttaatatttattcaactcttgttagagaagagaacatgaccctagtaatgatcaacaatataactctccgtcgtggcagtaaaaaattctcacggtgagaccacgtgcagtaataatactcctcctccatcttataatataggagattttggatgaatggtgagaccacatgcaataataatactactcctccatattaatataggagattttagatgaatataatacattatagtataataaatctaaataaatactaaaatttcttatattatcggatggagagagcagtaataatcgcggtaatctggacgtgggaagcaaagacgcaggcagcaatcacggcgtgccggcgaccccctcggacaccccggaggagcagcctgacaacatgccagcccaccattctcaccgctgtcgttaccctccccggctcccgcgaagccccgggacccaccgccccaaaagcacaccgctgggcccacctgtcagccgccgcccaccaccaccacggtcagacgcgggaggaggacaactgttgccatatgccagcgaaaggctgaaaaagccggcagcttcttccgctttccgccgccgccgctttcctctcctctcctctccgcgatcgccatcgccatcgccgcccaccgcccccagccaggcaccgcagcaaaccaaaccaagccgcatcctcctcctttccaccgccgccgaaagtggcggcagcccaaacctgtactactactactactactactactactactactaccattccactgcatacgacactgatttgaccccgtgggggacgaggcgaggcgaggccttcttgctctgcctttctttttctcctcctcctcgcctgatcagccaagattttcggcggttttgtttcttctgctccttggagctttccccgatctcgcttgctggtgctggtgctgctgcctgacggcgaaggtatgttgttttgcgatgccgtcgtagtgaaccgagaggctctgtagctgtagcggatgggatcgagttgccacttctgggatgcgttgaattttgttgcttttcccgatcaattggtcgaactgggggaagatctgcctgccccttgcttgatcggcagtaaaggtggtggtagtggtggtgttgtgggtgttcttgctagatggttttgctgggatcagattttgcccctactctgatattggagtagtttatcagcttatgggggttcgaatcggaggctttagggatggattttggtgtgggcgagggctggattcttttgtgccttgagaagttctcagctaattgaattgatgaacaaagaattggttattgacttgccttgcatagtattcttatgctaagacactcctaacctaatgcaattatagttctctaatggatctgtttgtgcggttagtatgtcgtgaagtcgcgcaattggatttgcctgatccgttgtagttgtactagaactatctgcattagttcagatgcctaaaaatttgtgtaattaggatggttagatttacttaacaaaggttctcaaaattctttatatgtataaattaatcaaattctgtcacctttcttactgtaactaatcttgcttgtgattttcttattctaggtttgtgctggaggctgaaagagtgcatgccatggcccttgatacaaaacaagttgcgcgatgtttgaagaaagttttgaagtcctccattaaagatggctatagatgtgtttctgaacatccaatccttttgacattgggtgttttgctctatttattgtatagatcttcaccagggttatttgctttcctactttcttcttctcctgtaattatgtgtactactcttcttcttggaatcctactgagttatggggaaacaaacctgcctgaggctgatgaagataacaagatcactccagagatttcatccttaaaggttggaaatccttccagtgattttcactttgaagcgagccagagattaccagtgcctgaattgagggaaaatacaactggcttcaaagagagggaaactaaacagacggtttttattagagagagggctagtgagcatattgagctggaagataatgtcccccttctgagaagggttgagcatgaatacgatagatttgatcggcatgaaatacctgcagcgttaacgccatttccctctatggtcaattttcatcaaggttctagagttggaaacgacttgagctctaatcaggacatcaactccaaaggtttgttgtccattaaggataaggctgatgggcacactagcttctttgaaggtgttcggagtggtctggatgagaaagaggcaccctttggcattttttcgaccagtaagaatgttaatggacgtggtgaattggaggaaaatttgaatcaagaaacagtatttacagattcaacagctagcagagtgagagatatttctgaagagaaaccaacggaaggggaagctggaactagcaaatcagcttgtgccatttccacgcatcagagtaaaacacttgatgaacttaggattaatactagcaagggttttgaggacaatctactcgattcctctcttggttcaccatgggcaagagttggtagtgaggacggagttggagtgatgatggttcatctggttttgactctgatcaggctgagagttcttctcctgatgcttccatgactgacattgcacctattcttgatgagattgacccgctcttgggtgcaagctctactcatcctgatacaattccaaaggatgattcggacactgattcacatgtttcctcacaggatcatcaaactgatgatgatagtaatgatgaaactgacaataatgatgctaaagagaatggtgaggaaaagaataaagaacaaggaaaggaagctgcatttatttggacagcagatgatgaaaaaaatctgatggatcttggatattctgagatggaaagaaaccgcaggttggagcttttgatggccagacgaagatccaggaagaacataaggtttgaaatcgacaatgacttgataggtattgataataatgatggtgggaggggtgttgacgacttgtctcgcttccatgtacaagtaccacatatttcagttccaaggaggaatccgtttgatcttccttatgattcagaagaagcggcaattctggctcagcaccctcagttctgcatacaaggaaaaacccattcgatcttcctcttgatcagtccaatgatggtgatgtttctgcagataataatgtaaatcctggagaattagtgaaagcttctcatcgtgacatgttcttccgaaggcacgatagcttcaacattggaaggacagatgctaccctggagagattttctagattcaagccatattttgtccccgagacagtggaagggagcttaagtaatttccaaagacagtttagtgataaaagtgagtctaaattgagttctgttactgaatctgatttggcctcttcagttgccgatcaggaggaccacaaggacctcgatgaaaaagatttgcccaatgagcatgggtctccagctctgcagagacaggatagcgaccttgcggatgttggaagtgaatgctcggatggcatcaactccgtggatgttgaattagacaacagtgacattgatgatcgtgagattgctctacaacactttgtctttgaaagatcacaggaaagagaagcatatctttcctcaacaaaaggaaagggtcctgaagatgattacctgctcagttcagttgggaactccaagacacttcatccagtagctgacctgtttagctgggaagatggaaatggtaagaaaatctgacctcacagttaaacaactgaatatgtacttgacagctttatttgaatcatatttcttcagctatgtgatgttattttgtaatttcagctttatgctgaaacattttaataatggcatggctatgtccatctcatgatgtagagtcaggagttctcttcaattatctaaaaactaccttcttgtgcaggtgaaagcagccttggtgttaactcttcccataacatgtcagttgaattctcggactgggtttcatcccccaagccaattgcagagcatgattcaggaccagagaaccttcaggagtttcttaatactgaagttgcatcaagttcaaagacaattgttctaggcgcaagaaatccagctgaaaataatggaaatgttgattccatatcctattcaaacaatgaaatgccttcagataacttgggtcatgggtccatggagttcccatctgaattttgtaatgaatcactgccagtaatatctagggacttgcaccctatccctgaagagagggttgtcgagaacttcaatgtgcaagaaaagcatgaagcagtaatatttaccgattcagatgctgccttgactgggtttcatgtaattgaggagcactttgaagttggatgtgatgtaagcccgagttctgaagttgttccgtcatgccttcaagcaagtgattccatccaatctcgattagttgagaataaagaggtatcaaatccattcatttccatcgcttctgaaaccaacaaggtggatatgattgatttgaaggaagaaacagctgcaggatatccacttgattctgatgatgatgctgataaaatctatcctgagcccatggaggacaatgtaattgatgaaagtttcctatcagaactggatgcggtaggagatttccgggtagaagcaacaagatcggaccagcagatgcctgatgttgactcccatattgataa

SEQ ID NO: 76952 - DNA, 1087 bp, Oryza sativa
ctaattgttaatgtttatattgctatatctgtctataaatttaatcaaacttaaagcagtttgattttaagtcaaaaaaaaaacatcatgtaactagggagtacgtcgctacatgagcatctatcaaatgttaccgctattgaataactgaaatgttttattcctttcgccccgttgaggcgttgacgttgttggagcatcactgtcaggagctcccgctcatttcattagttaccagggggcgctcgccaatcagagtcgtgattaactttgctaatcataattaaactgcagcgcgatggagagagcgtcgtcgtctccatcggccgtctccccgtaacccgcatttattagtaattttttttggcttggtgcccaagcctgtgactcacaaaccaagcaaccaaccgtactttcttttttatacacgctgccggccgctgcaacgtaatcatatatcgcgtgtagagattctccattctctccacgcgcacatggcgaacgaattgacctgagagaggtgaccgatctatcgatcagagagctagctatggcggcggcggcggcgcgagaggcggcggacggcggcgacattaatgggggtggaggaggaggaggagagaggtcgtcgagccccgcggcggcggcggcggggaatagcgacgtggggcgcgtggcggtgcggcggatgttcgcgttcgccgacggggcggacgcggcgctgatggcggtgggggcggcggcggcggtggcgaacgggatggcgcagccgctcatgacgttcatcttcggcgacgtcatcaacgccttcggctccacctcctcgccggacgtcctcgccaaggtcaccaaggtgcgtgcgtgccttctgcgtgcgttgctgttgctaccccggtgttgccacctaacccatcgatcacctactgccattgctgggtgaaaacgttaccatttaaaaaaaaaagagaaactaatataataataatattttttatcaacggttactgtttctacaatttgttttttccaatttctaagttgatactaaacggttgaattcataaatataaaaatttcatgactgttt

SEQ ID NO: 76953 - DNA, 5683 bp, Oryza sativa
ataactccagcatatcatgcatggggctgcagccctcgagcctcatcacagaaatgcaattgagtcaacctaaatgctcaggaaattcaagacgcctttcctgcaaagctccgggggagtgccgacagttcagggaaaattaacctctcttctcctgaccccccgagctacgatgatactgctttactctgcgattctaaccttcttgttcttcttcttggatttctcccctggcgtctgaggaacctccaaggtcgtgccactgtcgccaccacgaacctgggatccttcagccgacttgcccgatacattcgagtgccccaaactgctctcatcctttctcttctgattgtgtttgtgcgcgggctcggcactctgttggcccagcgatagcgctgagccttggctgctgcggttcttcgacccgctagagaaccgagacctcgtcttctttgaagaacctggaagaccggacaaattcagatcagtgacggcaactactgtttaccaaagtgttctatttatgatagaaaaagataaaacacttcagctgttggctggaaaccttattaattgaaagtgcataccttaatcaaaagaaatagaaactacagagatgggcttagtatctctctctcagaacagttcttcgatcttataatacaagggcatgcattgcatcactgacatgagtcttcataatataaatcaggaatttggctaatctcaactttcaacgatgcccaaaaaatcttaagacaaatagtatgttcatcacctcattactgtcaatgcgaaaagattgaacagcaatatgcacttacaaagtttaatctggtgatactggatttctagttaaaacagaaggcctatacatgtctaagttattgactagtccaactggaatggcatatcatgcttgtcaagtctatataatacatttaccatagacagcagaagagtggcatccttacaaaatgatgcccgagaaaattaactcacctgcagacttcttactgctaggagtgagactccccaaacctggcttctccggttcttcagggtcaggataacgaactaagctaactcgacgtgcaatcttcccaactggaatttttttgttatgattaaaaattatgcatacagtaagttaaaagaacaagagtgaagtgcatgagcggtccctaaatttgtgcgggtgtgccatctagatccctactctcaaaatgcattttcgggtcctcgaacttatcttgggtgtcatataggtccaaacgagctccaaaccgctccatgcgttgatgtggcatgccacgatagcatctacgtgttagtcggacccacgtgtcattcacataggaaaaaaataagattaaaaaacatattttctcctctacattagaatttttatctttttttgtctaccttaagaggagaaaatatggcttttaattttattttttatatatgcttcacatgtggattccactgagacgtaggcaccactgtggcaatgtcacgtcagcgcatggagcgggttagaacccgtttgaacctatgtgacacccatgacaagtttagggacctataaagtgtatttttgaagtttatggacctagatgacacccagacataaatttagggaccgcccatatactttactcaaagaacaatattagctgcctctcaggaaaggaagaaatgatagatgaccaaaatcacaaaaatcaaatatgtcaacaaacagctcaatttaacaagaccgataacaagtaaaaacagcatccatgcaaaatagtaaaatactgcagaaataaactgcaaagttggtatttcagcataccagcttttgcttctggtccggatggaaggaaaacagttgcatctggttgctgagcagcaaagctaacaagatcataagatttccctgccaaattaagaacaagtacaactcaaacttttgggagaactttaaattgttattgccacaataatttaaaagcgacaaactgacaatcttaaccaataaaaagaagttagaaaacctagtagcctactgctagtactcttactgatgaatgttatcaatctagcttcaaatcacagataacgaggaagctgcgagcagatttcacttcaccaatcaaacttctgaacataaaaacttctatatgtaaactaaattatagcaccttaattccatttttattgaaaaaaatatttaataagtattaatttgttcatttgttgcctaaagattagcaagcaacttgagctctacaaaacactactagtcatcaacgaaccagcattgacgtcatcttcatacaaaaatgagacgcaagcttgaccatagaaatgcaagcagttccgttgataggattaacattgtttgggattagtaatgagaagtctaggtgccctctttgggaaaaactaatcaataaggtaaaagtgtgattgcatgagctaatacaggttgcgttcaatccaactgtacagaaagcagaaaaaccttcgaaagacataatcgatcaggtgcaacataattcatttaatattatcttacctgaggaactatccaaactgctcaattttccatcacggtgcaacttaagagtaacctcttgaccatgaaaatcagacgcatctaactgcatgcaacacagaaaaacattatattcaagatcccttgtgcagcatgccacatggcacataatgaaaataatatccgtataacctgatttagaggccactgtattagccaaagttctgttgactctgtttgtgatatatcaagcatagcctcttcgctgttctcctcaaatgccggtccaggctcatagctacaatggttggttgcagcaaagttaaaataaattacacacaatacaaaaacttaccaataagtgtataagtgaaacaaaagaagctactgaattcaatccaaaaatccacaactataattttccaaccttccttatctcatatttgaggcataactgttaatctgttattcagagaggaatcagagctaccaaatccacaaatttgatactccctccgtcccaaaatataagcatttttagtatagtgataagtcaaaaaaaataactttgactattaatagcaaaataacaaaaaaattaatcatgtaaaattgatgttactagatttatcattaaacaaactattaaaatatgtaactttttttatttaaaacattttacttttatatagatattgttgatcaaagtagcatctcggagactgtgttagagtcccatgtttgcattatatggtttgaagtttggactttagagatgaatatgttgtttaaccggagacgggttcaccacggggaaaaattcaccgcgtggtgatcggggctggtgaaaatgtagccccgtcgtggttgacgggggcggggacggtgaaattttatcaccgcggtgacggggacgcggaggtgacccccgacggtgaattcaccgttgccgtctctagcacgaaaagggagcaggcagggccagcgaggggcacgaggaggccggcaagctcgcccgcaccgcctgatgcttaggcctgccagtggattgactttgtttggattaagtgggctggatcctcatttggatccttttcggttggattgaaatggcctgggattccattttggatcggactggactgggcttacaaaaaatgtggtttggtttggggtggatgcgggctgagtaaaataactgatccacaaactgaatccatggactgaatccacacgctagggtagactcctcgcatcctccgctcctcctccgccgccgctgccgccgccgccatcgccgccgacgggcgtcgctgctgctgctccttgccactccgccctcgctgcaagcagctgcggccccaccagctccccctcgtcctccgctccggcgtcatctcccggcactgctccgccagattgccatctcctcttcatcggcgccaagaagctgctgctgctctccactttgaactcgctgcaagcggctgcagctccaccggctccccctcgtcctccgctccggcgtcatctcctggcaacgctccgccagatcgccatctccgcaccgtcggcgccaagaagctgctcctctcctccatgcaagatccgctgccgcgtgtccctgcccttaaccccccacaagatccggcaatactctctcccttcaagatccggcaagtactctttcctccatgtattgtggattgtgtgctgaatgccatgcttagaagatttgttctaaattgcatttacaagcagctacctttcattaccatgcatgcataagaatattgatttcatgtatcgagttgccatggccacaactatgaatgacctgtatgttttccaagatcagttgtgctaatttaaccatgggtacctaacaacagtctaaaattatgatctcttttcagcaaactattatatgcacaatagttggatatttatcacggtctcaactactgttgtggaacatcattagattactatgtagcatgtactgaacaaaaatctgatttattttgattttagaatactgactggagtccaaaagaaaatggtagcttgctgctgctgattgtactgcaccaacctcgcctgcttaagcggagaacatgtctatacacaattcagaaagttcaactggccatagttctagtcatgaatcatcttcacacccgcccgcagaagatgacgcgtttggagtagtcaaagcagaaggagctccagaacctgcaagatggcttttcggagcaggagctccttcaactgcaagacgacttttcggcttggctgtggtccttttcgaaggaggagacctgcgaagggcatttgcattggacttgcgagatttgtcagcacccgacccgacgaccgctggggctgcacgcaatgcaacgaccgcaggggcagcacccagcacgacggaggatccggcagtaggcccaacgttgtatcacgtggtggcaagtccaaatccatggcggcgtcccttcgcgtggaccgccggacgtgggttagtgagtcaacgacgtagctatggaagactaataactcgacggagaagaactagaggtaggcgtctatcgagtacagagaagggataagggattgaagcattttctcaccttgcatcgtagcttacgcggggggaggccgaagccatggtcggccgatggcggatggcgtgctcccggcggcgcggcgacagaggctcccggcggatggcgtcctcccggcgacggcggctcccggcggcgcggccgcgacagctcccggccgcgcgacggcggctgctggcgccgcgcccgcgtcgacggcagcaggaggaggcggcggcgcaccgcgcacgcgagaggaggcggcggcgcgcgcgcggcgcgtctggaacaggcgaacggctggcggtggcggcgtgcggcgtgcctgcagcggagagccggaggaagaggagaggaaccagtggcgtgggcgcgtggctgcgcagctgaggtttgactagggttttgctatatatacccctgttaatagggcttcaatactatgggccaaaacatcttaaaaagtctagaatcagccctctatactgtaaagccggatcaccaggaggcggggacggggatggccgtcatc

SEQ ID NO: 76954 - DNA, 19831 bp, Oryza sativa
  unsure (1)..(19831): unsure at all n locations
atccaacgatccaaattaatctgatgagtcgtatcggacggcgtcgacgcctccctcccaatcgcgcccctcccacaccccctccccatgcacctcctcctcccagtcccagatcgtgctcctcccacggccctcccagaaaccgcacctccctcccacgcctccctccgccgtctccgccgctgacgccggaaaccgccccaatctcctcccccttttcattcacacaccctcctcacgcccacatccatcccgtcacccgcccactcgccgtcgcacgagcctccccgtcgtcgatcccctcccttctcaccctcatcctcaggtattgttgccgattgtcctgtctccgctcgtcgccggcccctcgtagcgcaaatcgtcatcctgcatcgtcgattccccacgcctcgatctcccgttggtcttcccgccgctcgccattgaccatcgcccatggctcctccaagagtcaccgccgaatccaccccacgcacccgcgccacctcccacccgcaccctcgcccccgcccactccctcgctctccaaaccctaaccctaacctcccctcctctctccacgactccccgccgcacgccgacagttcgtcgccgcgcgccgcacccgcactccctccccgctcaccggtttcctcatcaccgccttcgtgccgccaccactccgatccccatctcgcgagcagagcaggggagggatctcctccgcggccgctgccgaccgcaccgtcgcctgaattgccgcctccgctccgatccccatcgcgcgagcagagcagggggaggggaggggcgccgtcgtcctgctgcattccggtgagcatacacatcctctctcgttcatctctctgtctctcacccatttttgtctggaattttcttgcgttagcactatcttctcttcaagatctggatgattctcttcgaccgcgattgctccggcgacctcctccacagtccgtcaaagggtttgtcctcattccgtcaccctcgatgacccaggccgcagtagcgacgctggtttcttagccaacaccagggtctacctcgccaattcaggtttgctctgttgcagtccattgaataaatacaatacaaaatactaaatgcagtaaatttgatgttatacaatcgtttccatctatctaaagtgtaaatactgggttgtttcaataacgatacatggattattttctaagaaattgtcagttgaagccacattattttactagatggttaacattgttggcaaaatcaagtttgtttggtttgtaatcactcccgtgacacattgtgatgacgatagagttacagaccatttccactttagtttagtcctttatttctttttcccttttgttgtattggtgggagtccacagaagcagaggtaattcaactatgtgccgctgcagaaatagctattttgtgcataggtgaaaaaaatatgatcatgatattgtggatggtgatagtccagaagaacatgaaggagatgtagtgcaattcaactttgtgtgctgccacgcaaatggctattttctgagaaaggataccatccagtactattttgtacagattcaactgatgaaactggatggcatgtagtatcagtttaagtactatcagtcaattcggttctttcatcttacgatggtttgcctgttctctgcagttcagcttggtagatcagtttagcgttgagaagcaagctgtgaaaacatccacttaatgcagaagaggtcataagctccactcctgaaaattccacattttttagatatcctcacattattcaccctatatatgttttcagttgttcctgtatatttggtacactattctcgtttaagttgtttaaagatgattcaaggtctcaaagacgttattatcatcgaaatgaaggctggaggtactttttatagctgaactacaacatactgaaactctgcatgctaatcaattggctcaatgtttttcagctctgaaaataccacggttgtacattaacgttttccatctcatcacaactttgagtgcaggtaagaggagagctctgatacctcctcaagtagtctacactgatgagagcgtgcggcccataccagaggaggtatatcctaacaaacttttccttgttttttccctattcatcttaggtgtttcttttacctgtatgtcagttcaaatagaatctggagcgatgctaacttatggtgccagcttcgaaatttgattgctcatggagacaggggacagattattattttctctaaacatttctgaaaatataattctgaaactatggtgaaatgaaacactctcatttctgaaaaattcagctgctgtatgggttgctactagcctacggaatacatggttcagttttaacctggcaatgttttcttcgggttctggtcattatggtgtcataagaaatagtcaggccactccattcaaaaaatgggaaagacaataaagctttttcattcaacaagggacaataaaggactatttttgcatgtgctcttttgcttggagtattgtgtgattatatagctgattgagctatgtttagaaaactgaacttcccagaactagaattgaatagtctatggcatgacctaatcattaatcagttctctatttgtgagactgatagttgcaattttatagaggatggtctatcataacaaactaaattacttctatgatttttttcttaaatcaaagttgatacatttgtgactgttcattgtttcaggctgaagggggactcattatttaaaaaatgaaatgaaaactgctatccatgttgactccatcgattcattgatcagatcagggggtttgaatgaataaggatatctatgctgttcatgaagtgcataatggatggtgtgatcctctttaatcatactgcttccttcagagttcagatacaaggtagaatcttttacgctactttcagcttaattgattgattcattttcgtatttgacttgcagggcctaaccatggtaactaatgatgcacagctgctttgctccagggtgaaccctcactctgctggttggatttcagccgtggattagcaactggttcatgttctgaaatttttatactaaccatcctcactctgtagtatttgaaatcaacctttcagtttgttctgaatttttatgcagaatataaccatgccagtattttggaatgagtgcagaatttgatccgtcggttctgaagaaacccggttacttattagaagaagcagagaccacaacctggcagtggctggtcacttcagtggtctccaattgcctttgaatacgacaatggtaatttcagaaatctccaagtagtccactaattttattgcttacattttttttcatcaaaagcaaaattgaaaccctatgttcccttgtaattctaaatttgactgcacatattttgattttcgatgagtactgcttgatatattcagaacggacaggattttgggaactagcaattattgattttgattgttgatgctgaagagttctgactatctacatgggttattttcttgttcaacaaattcaggaaatagtttcagctcatcagaagtttgcattgctgtcatcccttctagccatcctcgagtagttgcaatgaatacattgggcaattcagcaattgtggatcctatatctaagataatattccttggataaaatagagtatatatccgggcagttgcttttgtgactgaaaaattcatagcataaaatggtatgcctgtaggtcatttgaccaggctgttaatttggtaacatgagtctaattttcccaaaaaccatttatctgcctcaaagccctcaactcgtctatgtggaccagaaatgacttcttgaacatacaagaataccaatcacattttagaatgttttgtagtgtacagagctatcgatgaaccaggtgtcggcgtcatatgcatggtcgatgtcatcacatttaagatttataaattgaatattatcagtagaccaattgcatgtacgtcttaaaaaggatgtttggattacaagtatctatggtatagtagaaacctaaaattagatgtacgaaggtacgtaaaaaagcaagaaaaaattgagttgcaacttcgaaagaaatatactgtttcttcaattagggctatctacatcagctgcatttgagagaaatatccgaactgttgtagttcaaggaagcatttgaaataaaaattctggtaacagccttaaattaattgagagaaatatcctaattagggcacacaggatcagttggatctgttgagtttcataaagaagaggtgcttgtgcgttcatcaaatagctcggacgaagcttgtattttcgcttgtctgctagcaagccatctaaaaagtcaaagcgtatcgtcacatatttgaaaatgtgtttataaattttcagtaacttgctttgtaagggaaaaacaccaaagtttctgtgcatttgcttcgaacatttggttctgcagtactgttgactataaaatacagctcaacagaactttattttctcacatttctcataacaagttggatatggaaaaccatcgactctcataaaagactacacacaagtattaaactcaaatctattttaaagcatgtgaataggagacagcaagctttagaatgattctgagatagctccattttttttatcttgtctgaactttggctgtgagcttaaatgattaaatcagtatgttttttttttttttgcagccaccgaatcctttttaatagttttttattcttctatctataatgcttgtgtgcatgcttcttacggattgctaattattttacacgtgcagaataagtgtaattaactgggggagtgcttcttgaagtagatagaaagctttgctacttttgaagaaaacaagttgataatggagaaattgggtgagacatcattcattctacacaactttgagaactgactgagatgtaagcctggaaaatagtcatcccatgtgaataacacaaatgaacatcgaagttatatgtagcgccggaaatatatagaagatagctcatgcaactgtacgtgacatgggttgttcaatccataacactatgcattgttgatcgattggtgattattgttccctatatatgctctgggcattgacacgaaccgcataacattgcagggccatatatcttgagatattcataattgcgtttaaaccaattttttttacagttgcatacgattgtgtctttcagatctatatttgactctacacgcattgtcatgacttatccatcatatcgctttaatgtacttagcattttcacctacataaatgattatagcattgcaatgctcagttatggctctatgtgaatcaagaaaagatggtttattataacgtgattaatcagcagtaaaacgatacggggaaaatgtcaagtgaatagctataatgttcacggacaaagcacaaaacagacctggccttgccggaggttattaaagctcaaatgtacaaatcatatcaatttttttttgctaacatgaaattttaaaaattattgaagacaagtagaattgcaccgtagcgtttagcacgggcatattactagtggtgaatacatattaaccatttcattcacaatgatggatatatattaatcatccccgtcacctaatatgtgaattcaccgcaagaaaacgatgaacggggggccattgccatctctaagcctataagacaccatacgaagtgacttattgtgggaaacattatgtaaatatagaaattcgctcatggacaccgtgctcattaagatattcatttctgattaaataacatgaaagttctgtgggccacttgtcaattctcccatcacatgtctggtttaattatagtttggcactaatagagaaacaattttttcacgtgcgaaacaggattttcgcataaggaacattaagccgcccatctgcaaaatcaaaattaggcaaaaaaattccaaaaaagaaacccaaaaccctaactcctattcccatctttctcgagctcaccgccgcccgccatcgccatcacctctcccagggccgagggcagcgctgccggatctgctgccctcaagttcgccagcgccgacaccctagtcatcgtcgcctttccagggcccagagtggcggatccgtccttctcgaggccagcattgtcagatttgcctcctgagtctgtcacctctgccgccgtcgccatcgcctgagctgccctcgcctaccatccagcccaagcccaaggaggccggatgggagtaggagggagggagaaagaggagggggaagtgggagaaaggaggaggaggaggaggaggaggaggagcgtcgatggtgcttcgtcggtgtttccctcgctggttctgtcgtcgccggccggtaggagttgagaggagaggagatggatgtctcgatgggggagagagagggacatttttacatttacatttatcttccccatcctctcttctattctacccctcatcctctcttcccctcatactctcttctgttcttccaacggagaggacgaggaggggtgacgggcggtcgtcgagcggggagcggcggggtcgccaggcggaggagccgcagcagaggcggcagcatcgcgggccgggagcggcgcgggcggaggagccgtggcagaggcggcggcgtcgcggacggggagcggtgcggcggtcgcatgcggaagagcggcacggaggagccgcggaggagcggcatcgcagacggaggagccgcggcacaggcggcggtgtcgcgggcgaggagcggtgcagcggtcgccgggcggaggagcggcgcggtcggaggggcaacgcggtcgtcggaggagctctgagcggcggggatggtggggatctccaccttcagatccggggatggtggtgatctccacctttagcaccttcctcgctgccagatccgccacctctccacgggcgaggagcggcggcggacgaccggaggcgggtgggcgaggggcggcggcgggcgggcgaggggtggaggaggcaggcggcggcgagcgggcaacagtgtcgggcgagcggcggggacggtggtgcgggcggccagatccagtaagtctcctctcctccgctcccctcccctccgttggccgacggcggtcgaacgacgaaggtagccaccggtgcgtcctctcttccctcttccttcacccttcatgctcaatccggatgggggcgggagaactgcatggagtgggcgtttggggatggtacagtgtctcttctctaggtggcggcagtcaacaagaaggaggactgtagcaccaggaacaaaggccagcaaaggcacagtcccggaggagagagaaatgttggtggtgagcactacgattttcctgcacagggactcgtttagattgcagatggacctgttgatgtgaaaaacacacactagcctgggagatctgcttagctccagtgcaggtccaaaacttgatgagttgcaggcgtgccagttagtttgatcctgcaactgacaagatttgtaaatagtagatcaaacagacgatcggctgacaagccgatggagtagttccagccgatagccgataatagccgatgccgataccagccgatagcgatagggtttaagcaatcggctatatgtccaatgtagataatgatataaaggcaatcgactgatgatgatgtaataaaataacagtataatccagtataaaccaatcggcaaataatgatatgataaataagcatcgatccgaaggttaaagcatacatcggttggaggtccgatgtcataaaatccacaagattagattaaacagtgaaacctttgttgcgatcagctaaatccaatttatatgtatatgcaatccttacaagccgatgcaacgtccagataacttatcggctagcacccgataaaacattagcatgaacctattggtttaacaagacttatattatcaataacaatctaataggtcgaacctaaccgatgcagcacaagattgtatatgataatctaatactcgatgagccaatagatctgtctaatgtgatggatataacaaatctatttagaacaacattatgattgtagagatatatcggctaagacaggagattagacctaaccgagacagtcccaactaaaccgatgcgtctctaaacacaatgcaattagagatagaattgagatatcaggtaggcaaatatatcaaccaaaccagagcgatccaagagatcaaagcgatcactagtaggaaatcgcccatctatgacgtttttctcatgatgttgtataatttcgtcattaaatagggcatatctatgacgaaatttcctatttcgtcatgggtgagtcgtggcaggggtaggttccaaaactctgacgaaattaaaaatagcgtcaaggaacaatggaaaatttcgtcacaaatgatgcacaccgttcatttgttaatacttgttggtcccactgcgcatacgtgacactgtctccactggtcccaccgcatatatgcatatgttggtcccatcgcgcatatgtggcactagccccggtcccaccagtggccactacacgcgccatagtcccactgccccaccacgcatatgtggcactagcccccactggccccaccacgcatacgtggctatccatgtcactggtggctatcaaatttgtccaaaaaaataaatgctgcacctggaatcgaacccacaccacgagcaattacttaacagaagcttaaccactatgctagaaagatccttgtgtggatgcttattttgttattaacttttattggaactcccaaatgtttaacttatacacttcaagcatcagttaaagcattacacttttctgaattgccatactcaattcacatgaaaaaaaataacgcaataatcagtcgtaagtttattcacaatctcaatctgaattcacgaagctgtacaaagaagtagcatttcttctcctgctgttgtcgcccacgtccagcaagcaagctgcataagcaccactgcaccagaagcttgctactcgatcatggaggattaatggaggtgaagtagaagctgttgaacaccgataacgaaatcaggccgcctccatggccagcaccaggtcctcttcgccggcgacgctgggagcatcggtgaaggagatggcggtgggcggcgcctggtccagctgctactgctccggaatggccccgtgttcgccgccgcagccaccagcggcgtcttcgccggtcgcgcgccacaaaatcctcaacaccggcgccatcgccaagcgtcagcgctgctacaacgacgcactgagtgtcggcgccctgaacacgaggtgccccgaacgcccagaggacacgctctgtcttgccactgccgccggcgaccacctcctcgacgcctttctcctcctcgctgacacccagtagggcttccacgaggccctcctcgacctcacccaacatgttgccgaggcccgcgccgtgctgtggaggggtgacgccgccagcgtcgcctccgccgtcaggtcccagcggcggcggccgagaaggacctctcccgcggtggacatgggtgtgtgtttacgatttggtttggtttggatctgaatccctcgttatatgtgtgttgatttacgattgtgcccttgttatatgtgtgttgtaccgataagaatgaggggtaagttggtccaaaccacgccgtttgttcgattaaaaccggttggttcaatgtttttctacaaacaccggccggtttacccagtttaaagtgaatataaaatttttaaaattcaattttcaatcagaattatatttctgtgaatggtaaactgtgccgattttattgccagcctagctcaaattttaaataaaacattgaatttgctggttagaaaaaaaaagtgggattttgagaccatttctaagtggccacaattattattttcacttaaaggtacagcttatattaataaataataaaaaaaatagggacacattcatggtacagcaatttgatgatccctattgagcacagttctaaaaaaaaaatagaacacgcgcacgcgcggtaaaagaaagaaacaaaattgatgctcttcgggggattcgaacccacaaccacaagaacaacagcctatgttcccaccactaagccacacaagtgtttcatcatagggcatgcgcttggtcttatatatcaaaatgttagaaggtaatggacctatatctagccatctactcgtggggttcgtcataaagcgtggtttttctttttaatctctgactaaaacttataggcagtctttctccctcatactaacttcaaatttgattattcttttttctaaaattttctaaattcatgatctatccattttttgtgttattaaaacctttttttttgtcatacttttatgtgactttgttttataaattgaagatttaaatttcaaaaagtgctaactacaaatgacatttttgaagcagtaaatgatttcaactgaaaaagtaatgaacacaaaagttgtagaactgatcaagatctacaaattttattttggtcatttgttcatttgataaagtgatagtaacgttgtgtacaaaatttacacatctctcttataatttatgaaaccatactagagatatgtaaaatttgtgaacaatgttactatcactttgtcggatgaataaatgaccaaaataaaaattgtagatctagatggattatacatctttgttgttgatgactttttcagttgaagtcgttcactaataaaaatttctatttgaagttctcaaactttgaaattcaaatttcaatttgttcaaataaagtcagatggagaaatgactaaaataatttttttttcatctcgatgagttctacaactttggttttggtgacttttccatttgaaatcatttattaaccccaattttgttttaagttgtcaaattttgaaaattcaaaatttgaattgatcaaatgaacttatttgtaaaaaagtccaatacaattgttgtagatctcgatcagttctacaattttgttgtttataatttttgcatttgaaacacaaaaatcggtctaaaattaaatttaaaattttcataaattgatattaaaaaataccacatatattagtaggcctaaaccctgaaatcggcccgttacagtattcggcccataaatttctggccattgattcttgatcgaatggctatcgttgctccaaggaagtataatttgattgttttcgatttatggaaaatgataattactcatagtcatatacggaggatttttcgttcggcgcctaaacctgccgccaatgacagccccaaaatattccattgccgcccatttgccaaatcagaatgggaaatgtcacttttatcctccatctaacgaagagcaaaagaacacccaggggcatttgtgcaaccactatatatttacaaactctctcacccaccaaaccctaatccccaaatccagtcgccagcccatcggggcgccgctgtactagagccgccgccgccgaccgctgcaccggagccttcccccacaacctcgtcgacgacgactgctgcaccagtccttcccccactacctcgtcgacgacggccgccgcaacgaagccttctgctgcaaccccgtcaatgacgaccactgcaccagatccttcccccgcgaccccgtcgacgacggctgccgcaccggagccggtaccccgtcgacgactaccgccgcactgaagcctttccccttacaacatcgtcgacgcctcccgccacaccggagccgggtaccccatcgacaaggaccctgcaccgtcgccgtgcctagccgatgggaagacgtcgacgtccagtagcacgaggtacgcaaaattattttgccgtctcaagatcagatgttcgtgtgtactgtctaaatgaaagccattagatgttatacatcatgaggattgatttgctgtccaaatctctattaagaattttctgtgtgcaatatgattgaggtcactattaacgagaacggttgatgctgttgctagtttgctactgcatatggcattgtttctgtgttttttaggcgcacctttaaattaatcatgctatgttgattctcaaataaatttgtgcctcaagttccataatcatcataactggaagagattccttcagattaagggttggaaatctattatcctttaagaacacaataatgttctctgctcttgttttaattcttttctttcacccgaaggggttctgggagctagatgatggacatctgcaatgcaatatccctttcagtgctcaattaatggtcagtacatatttcttcctttttcttgcctttttatggaactcttgctttactgtttttttcttacataatcaaaattgagaataaaattcctgtgatatgaatatgtcccacaagtctgacatgtaacaaattttggtacatttagtttacaccctgttgtttccatacaagctgtcttgtggatgactgcctatctacgacaggtgcagaagaagaaaactgtcttggttcttcctgctgttcatgactatgcaacaatctctcatgagatttctgtgtacacagggtaagaaatctttgtgcaactatctcccatgaggttatatatatatgggtgctaatatttagtgagtgctaagtagtactgtaatataaattggttacttgtgatagttatcatttgttgtcaacacttgcataatggtgcaaaatttggatttccttggctgaaattttctgacgacaatcaagacagtagtagatacactcttgacgtataatcgtggtctgctcaaactgttgattccagtgtgtactatcttcaaactgtgcagcatttgtttatttttttaatgactgttgctaatttattcacatgcttacagcttctgtatttattattgtagtaccctcgtgtggagattatgggtaccccatacccacatggcatagttatccgactggctataggggataacttatatctatggaatatgtaacagatcatgacttgggtattacgtttccttgtatgttacggaacggcctaaagtcctggtttgataatattgtaaagtagatttaggaaaccgataccgtattggttaaggtttctatcttgtaatcctgccccccaccctatataaggtgggcaggaggccctctagggggcatgacacaacctgatcgtcagatctatactacacccggcggattcaaatccccaaacaggagtagggtattacctctcattgagagggcctgaacctgtctaaatcctttgtctccacatccatccacttttaggtctcgtgcgctacccctttttattattgccgaaatcatgtttcgacagttggcgcgccaggtaggggttgcgtcgagttatctatcaagaagcgcgatggaatcaactttacgagtcgccggcttcgtcttcacttcgggagctgcaacttcctcgccgccgacgaattcgctaagcttttcttcaacaacttggatccaatctagccggcaagattaatttaagcgatggatccaatcactgtcgtcgccgagttgtttctctgatcggcatgaccggacgtcagtcgccaagttattttcctgatcatcatgagcatcaacagacagccacgcaagtgcatgtttccatatgatgcacgcgcatgacagattggccaactaattaggagctgctagcagcactttcttccccgattgacataatatatacagtgtcgtttgttgaagcagttattctcctcaaattaaccgtccagtgacagatcaaattccaagcgccaatgttttctcgtcaatatcaaagtttcggcgagattcaactattagcatgaatcggagtcgatgtggaatccgagccgactgatcgaactcagccatgcatactccggactcatatctggccctgcacagtacctattttgccactttaactcaagtcagatgcagtcaacgatgaacgtcaaggctgaccaggttgatacatgtaaagccgatgacgtacatgcatcattaagagtttgggtgacaaacacaaatcaggtttatcgttctaaattttcttatataaattagaattaattcacatgtcactaattattatttaatctattattttatacatgtaccgccggccgccttcgttgctgccgattggtttcatcgcctccacggttggtgtgcgccgctgccgttgcnnnnnnnnnnnnnnnnnnnnnnnccggcctgcctccgtcgccgccgattggtgtctccgcctacacggctggcctattatgccgccgctgttgggcgtctacgacttcaccgccggcttgcctccgtcgccgccgattggtgcctccgcctacacggctggcctattatgccgccgctgttgggcgtctacgacttcaccgccggcctgcctccgtcgccgccgagtggtgcctccgcctacacggctggcatattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacgactggcctattatgccgctgctgttgggcgtctacgacttcaccgccggcctgcctccgtcgccgccgattggtgcctccgcctacacggctggcctattatgccgccgctgttgggcgtttacgacttcaccgccggcctgtctccgtcgccgccgactggtgtcctcgcctatacggttggttggtcacaccaccgttcatgggcgtccacgtcttcaccaccggcctgcctccgtcgccgccgattggtgcctccgcctacacggctggcctattatgccgctgctgttgggcgtctacgtcttcaccgccggcctgcctccgtcgccgccgattggtgcctccgtctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagcggtgcctccgcctacacggctggcctattatgccgctgctgttgggcgtctacgtcttcaccgccggcctgcctccgtcgccgccgactggtgcctccgcctatatggttggttggtcacaccaccgttgttgggcgtctacgtcttcaccaccggcctgcctccgtcgccgccgactggtgcctccgcttacacggttggcctattatgccgccattagtgggcatcttcgctttcaccgtcgaccgccttcgtcgccgccgactggtgtcttcattgttattgatggacgactttgttcccacattggccacttccgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaattccgattcgtgaaactttgttctattaatggcgaactcatgtcactcatatgcatgtctgggaagtgcctaggccgactcccgatgcttgggggctatgactagtcggacagagcgtttaaacgtaatgaatcatctgctcggggaaatcaaaattgacaagaggagaaatacatatttataaatattttaaaatacttgattttttctcgagtattatatttatatcagatactactcatcctatatgtttgttctgcaggatccagatccggatatgcataaaagggattcatggctttcagcttatctcttacgctccaggaatggatcagtcagaacatcaccgaccggcttgccttcgccgccgccgactggtgtttccgcctgcacggctggcctttatgccgccgttgttgggcgtctacgtcttcaccgaccggcttgccttcgccgctgccgactggtgtttccgcctgcacagctggcctttatgccgccgttgttgggcgtctacgtcttcaccgaccggcttgccttcgccgctgccgactggtgtttccgcctgcacggctggcctttatgccgccattgttgggcgtctacgtcttcaccgaccggcttgccttcgccgccgccgactggtgtttccgcctgcacggctggcctttatgccgccgtagttgggcgtctacgtcttcaccgaccggcttgccttcgccgccgccgactggtgtttccgcctgcacggctggcctttatgccgccgttgttgggcgtctacgtcttcaccgaccggcttgcctttgtcgccgccgaccgatgtcctcgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaatctgcctacgtttgccatggctgccgactggtttcttcacttccatggctgcatgattctgccagtgttgattggccttaccatcttcatcgccggtcgtctcgtctgctgctgactagtgccctcgcctctacatctggtttatacagctaccactactgatggacatcatcgtcttccgccgccgactcgtgttatgccgccgccgactggtgcttttatcttcacaactgcgcgtcttcactaccggttcacttcatcacggcaacacaactttgtcatcatgcaagtggctctccaatattcaggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatataagccaatgagtcaactccaggagtcattatcttcatctttgcttcggaacagacattctacttcaacaacttcaaatatttcggtttgaacgagttggacaacaacatcaactctcctccaagtgaagcatctacaacagctataacattaatttgatggattattgtcactgacatcatcaccagcacctctgcttcatcgaccctgacatctctgctgttgctaatggatgattatgttttcgccgacttattatttcaccttcacggttgacctactatgcaaatgctgatgagcgtcttcttcatcatgtcggttgcgtttgtcgtcgtcaactattttcttcatcttcatgattggtggattttgtcatcacctttgatctacctcgtctgtcaccgactgattattttgctgccatggctacacaattttatcgctgggttccttcatcttcattgttagttgatctgtctgccgccgactggtttcttcgcctccatggctatgcgacttcattactttagattggtatcactatcttcactaccaccagtattgttgccacctctggtgggcaatattatctctatattggtcgtcttgtctatatgccaactgcgtcagctaccatcaatggacgattgtgactacgacagaaggacaagctatatgctcaggggctcatcaactcaagcgtgaggattatatctccaatttggacttgttccggatacattccacatggattcatagtcatgagtctattttctatgctcaaagactggaccaattatattccccgtaagggctatcaaccgaatacttgcgccagtcgggattcaattgttacacctattttggagtatcccataagggataatcattcagatcagaagctattcatatgagctacacttggtctatattacccggaagatttattactcggaagcatgttacatgcgtcatcctttaaagggtgtcgaaggcatattttttggcctaggcctaatatgtctgcagcccatattttcaggtgtggcctgtcacgttcttttagggacttaggcacttttggcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcattttctaggcggttggtaaatcctttatgagtttattcactcggattttacaccacatatgccatatatttccaggtgtggtgaaaccatgtgtcttttagggactaaagcacgtctgttaaagcagtgtgcgcatggcgtatgcccaatactttggaaatttatttattcacaacatacaagcttctttatagctgttttgttatgtgaattttcaatgatgtaaccaactttaggttacactcatcatattttacaaagcggtcggtatatcactcggatcatgttattcagggattcacaccgcatatgctacatattaatatcaggtcgcttggttgactataattattaaaaccactcggttggttggattatttattcgttgactatatgcttggtttgttcaattaaccacatagtcgggggctacacctattaggtgcatctagtcgatgcacctgactttatttttcagccctccacagtcttcatatttggtaaaagtacttcggagaccatggcgaagatgattgaagcactcagctttggagtaatctagttcgagagaagattatcttttcgactgtgaaggtctcaggggctactgtggagattatgggtaccccatacccacatggcatagttatccgactggctataggggataacttatatctatggaatatgtaacagatcatgacttgggtattacgtttccttgtatgttacggaacggcctaaagtcctggtttgataatattgtaaagtagatttaggaaaccgattccggattgggtaaggattctatcttgaaatcctgcccccc

SEQ ID NO: 76955 - DNA, 23943 bp, Oryza sativa
ctatcctctcctctcctccccgcagcaacggctgggcgtaggcggcgacggcggcgcggctacggtgcgcagattcggtagccagccgccctctcccccgcgggatctcgttcccctcccctccccttccttcttccctccccgaatccggcagaggggaggggcatcggtggcggtgcggccggaggggagcgaggaggccgtcgggagtgcagatccggcggcggcccgccctccccccacgggattcggctcccctcccctccccttccttccgtccccagatccggtggaggggaggggcgtcggcggcgggtggcgcggaggccggcgagagggcggatccggcggctggcggcgtggaggccaccgccgacgacgacgagggtgggagcggcgccctctcgacgactacgacgaggaagaggatgaggacgacgacgacaaggaggcggcggctaggagcggcggtgcagcagctggattcgttttttgaaattttatttttttcggaattttgtttttctgtgcgggcgacataagcacccgccggcgaaaatccggcgacgccgcattcgttttttgaaattttattttttttcggatttttgttttttcgtgcgggcgacataagcacccgcatgcgaaaatcggatttttcgcgtgctggtgtgccacccgcacgcaaaaaccgcgattttcgcagacccttggttgcgtgcgggctgtccacccgcacgcgaaaatcacatttgaccgcatgtaaaagtcacgattctagtagtggagcttcggtggcaaacatgatcagatgtgcgcatcgaagcatgtttcaacaggggcttccgttttcatggaacttgttgatagatatggaacggtggtggcaggaaccgatggtgccgatttgggagagggggggggggggggggcatggcgtccatccatggtaaagaaggaggaaatgttgctagcgcgacggagcagcgagagaaggccagggtcgttggagatgcggaggctaaggtgcgggagtgtctcggcaactagcgacaacatttcagaactgaggcttacatatatacggcccgtatatcctatagcaaaacttgcaaaacttcagtgtgaatagtcaacgatcatgctagagcaagtttaatagtataacccactactagctctaatttatctatagccaatgtaatagccaattcatacattagatgcttactatactattagtatatggtcccacctgtcatacacacattacgtcttggagtccgtactgtagctggctacggctacagatctatagcccgctactcttctctctcatcttttatctcattaaaatatggttgtagctagcgaatagtctgctattgtacctgctcttagtatattcacgcaatgatgtattcatgccagtttaattatgcataacaagagccaacagtgatattgaaaatactaatcatgcggttcataacgtaagccgactgtacagttcacttttaaaatttgatttctttttttttttggtctagactcttttgtcatttattgccggctctaaaaaaaatcgtgcaagcagtagcccctttaaattctaagcgatccttacaaaattcataccgaaggataaccatgacacaacatatatagaattaagatttgaaccatggtttgaaaattatacactactgaagagaactgatctttcgtggatcatgtaaaaaccacattatagtcctagttcgtataggaaccgggactaaatatcatttttagtatcggttaaaaagcccaacgagactccaatcgggactaaatatcatttttagacccggttaaaaaaggcgtcaggctataagatgtcgtgtgtcaggccctcattatctttagtcccggttggtagactaaaaatcaacactttacataaaaaaatcgcgccaagccagacgcttttccgcctcgatctccccgcctcatcttatctccttcgcacgcctcctcctccttatctcctctgcacaccttctcctccttatctccttcgtcgctcctcctccactcctcctccaggtctgcttcgcacgcatcccctcctccccttaccctctccgtcggtggcgtgggtggcggcaggtggcagcgagcggcgggagttggcggcaagccgccggggccctcctcctcctcttccccatccgccgccggcgaggaggatgaaaagcaagagcaaggagaggagaataaagaaaaaaattgtggatgattttgttgtagattttttagatgtttgttgtagattttgttattgcatttgatccgtgatgttaattttgatgttgttgcattcaatccgtgccgttggaaaaataattttgatgttgttgcatttgatctttggcgttggaaaaaacaatgaaaaaaaaaacaatacgcaagcaaaaaaatggaaaaaaactatagtcccggttagtaacaccaattaggactaaagatgatagcaacaaccatatggcgttactatctttagttagtctcgggtagtgttactaactgggaacactaaccgggagttcaagagtaaagatatctctttagtcccggattcagggtcccggtttgcaacctgagactaaaggggttgcaaattaaaccggcactaaaaaccacttctccagcagtgatatcaatttatgtagccacactgtaccaccaaaatggttgaggaatttttccgaaggaaaaaataagtagcagatgctttctaagggaaaaaaatgaataaccgacttaattaccatcaatcaatcaataatagtcgcggctttgaccagtggccggagacggagctcattcatatcctctccctctgtaaccgtaaagaaagtcgtttaggatagcgacacggtctccaaaacacaactttgacttttttttataaaaatatttattgaaaagtgatatatgtatacttttatgaaagtatttttcaagacaaatctattcatataatttttatattttcaaactcaacaacttgaaagttattaatgatttatattttcaaggtttgacttaaacactgtgctaaacgatttactttatgagtatggagggagtatatggaaaaccacgtacgaatgctaaattaagttacataggcatgcatgacttaataaccactaaatcagggatgtttccttgctaacggaaatgatcgagtagctgactttgctatcgattgatcaataatcacagctccaacttgaaaaggctaatgcatggtacggtgtttcatgaggagaaatgaactgttgccaacttgccatcaattgatcaataaccacgactttcaactcgagaaaactaaattaagttaattatataccaataatcaaaatttaattgtatacattattctaggagaaatggatgattgtgtataaaaaaaacgtgaactttcgatgctatataaccaattttgcctatttaaaaatagaattatgatcgagaattgacggaagtgctaaaaatgggaacatggtgaactttaggtgctattaaagtgaaccggtatctttcggtgctataaaaccaaaaatgtgaactttcgatgctatataaccaattttgccttttaaacatattgtacccacaaattacagctgtagtatgcatagaaatatatatcgtgtacaaattaaattgtatgcatggaaaaaaaattaggagtccaacactattcagtttcaaatagaaaaccataattatatttatagaaaaaaaccaattgtgaaaaatccaactctacctttatatttatagaaaaaaaccagttgtgaaaaatccaactctaccttttatcaagctctgctaataatggtagcgacttttggttggcgaccggaatcgcatccagggacacgcacctctgtctagcactgggcacatctatgctttctatataagtgagaacacaaacaagcacaacgtttagccacgtcatcaaaatagtttcaactgttggatcgacaagaccttccagtattagccgttagataaaagtcccctccacttcctcaccaattaaacaacaccattaaccaccaccccatctaaatgctatctatttaatcaggtagtcaattgaaccataatacaatcaagatatcagatcatatttactattccaaccatcattcaatcaattatatatatatatatatatatatatatatatatatatatatatatatatatatatatgtatatatatatatatatgtatgtatatgtatatatgtatatatgtacatacaagaaagtagatattttctatttttttaaattgcttagtaatttccgcagtaaaatgcggggtatcacctagtatctgaagataattaagaaaccaaattagtacacctagctctgtctgtctagcttaacgccgtgtgtacgtgtatctgcttaattaataagagtgatcagagaagcaaccagtaagtacgctgtgcagcttgtgctccatccatgctgtacgtacgtatatatagcacgtacaataataatagttccaacttgacatgcatgaacgaacacgtagctagctagctaacttgctggcccctgtataaatacccctatatacctagccctatcatccatccatccagccagccaaacagtagcaacatgagtacttcagctcgccgcctcctcctcctcgccggcgccgctgccgccatcgcactcctgctctcggccactgccccggtggccggagccgaggacgacggctacagctacatccctggctcacccagggggccgcagaactggggcagcctgaagccggaatgggccacctgcagcagcggcaagatgcagtcgccgatcaacctcggcctcctcgacctcaccttggctcccggcctcggcaacctcaactacacctaccagaacgccaacgcctccgtcgtcaaccgtggccacgacatcatggtcaggtttgacggcgacgccggtagcctaaagataaatggcacggcgtaccagctccggcagatgcactggcacacgccgtcggagcacaccatcgatggccggaggtacgacatggagctgcacatggtgcacctcaacgcccagaaccaggccgccgtcattggcatcctctacaccatcggcacccgggacgagtttctgcaaaaggtctgttggattcataattcacatagtttgcacgcatggctaatgcttctaacaaaaatcaacatttgtaacttttaatagtaactcacgtatttgttgtcattaggttcatatttgaaatactatatatatgatgttaatttcatggttatcgacgatactccctccatcccaaaatataaggctcaaccgctactaacacaaagaccaagaaagaatttaatcacctccttgattgaattgcatccatacatgcaagcaatgtgattggaagacttaatggtacatgaattaaaataaatcaaatctaaagaattaagaggtgataggaaatgtattcatacatgcatgccttatattatgagacattggaaaaaaagtggttctgccttatattttgggatggagggagtatatcataaaataaactatttgtatttgttttaacttattagagaccatatagaaaactaatatgccttctattgtagaacaaaggaagcactgataatatcatcaatggtttgtcatgtctattttaatgtgatagtttggagcaactgatgaaccaagatagacatatattcttggtatgctgaacttcttgttgcatgcagctagagccttatataattgagatatcaaagcaagaaggcaaagagagagtgatcattggtggggcggatccaaatgtagccaagggacaggataccgtgtactaccgctacatgggctcctttaccacaccaccttgcactgagggagtcatctggaccgttgtcaggaaggtatgtatacatgcaataagtaggataatttaacattttaaaactatttgtcgcgatctcaaatcaagtgttatttcttgtcaagaattaatctttaaacaggataccgtatgtaccacatttagtttcttagtgacgatatattaaaatccttaaatatagtagaaataataaatatctaagagaattctcaataaatagtgtttatggtaaggtctaataggacaaataagtaataaattggcatccaaggaacaacctactcaatagtagcttctacctatctagctctctcccagagagtacaactttcaagcccaactctacacaagtttctttgtttccttttccaaggccttggataaaattaacccagtttcaatctcttgccaccttttatcccacatatcacattattaaagttgtaaacaatctataacatgaagcaccgggaatgtgctaaggcgaccacgttcagttttagttggtgagggaagttcttttagttatgtacttatgttcctacgctttctgtcttttttcttcttcaggtgcgcaccgtgtcactgtcccaaatcacacttctcaaggcagctgtgctcacggtaagtgaaaaagccattcatgtttaatatctattaatagatgacagtgaacaattatttcatttgttattacttatgatctgcatatgtgcatacatgcagggtaacgagaacaacgcgagaccccttcagggcgtgaacaacagggagattgacctgttccttcctctccctctcatcaacaactgaacagcatgcttgacatacacagctgatttacaacgcatcgcctgacacacgcatggagaatcagcaaacatatgtgtactaataaatatatagtattactcatgtttgtgtaatcttatcctaatggtgtcgcttatatatatatatatatatcgtcttgatcacctagcttcgtaaagagagatcagcatatatgttgttcaatcacatctgcatagcataataatgcatgcatagattttatatgtatctctttccggtgctgctatgtgtatctctatatgattaaataaaaataccaatgttttataattatgtaaatcatcatattcatcttcgtagcatagaaagtatgttgataaaaatttggttgccttggagtaggccaacttaatatatagtactatccagctggaattgtgctatggtaaacttaaaatgagaaaaattctttgtgtacacctgatcatattgagcatatccattttttaagggaaggtcatatatatcccttttgtatacatggtaaccttatctttaatgggtggttaaattgaccaattagatggtgtttggaggaatgacctgttagggcatgtacaacggtgtttattagtggtctctctctattgccatggaagtaaatttgatgacatggaagaaagagaaaggagtatggttgttatgcatgacaacagctcagagtcgactcttagcatttattagagcaaattttgttgcatggtggtgaaagaaaggaaataaaagtaagaaaaagtattttgatacattaatgattagagaccatattgtctctaactgttgtaggatactagtatctaaataacgtagagctcatatccgactctacctttgtacatgcccttagagatgtatgaaccctgcactgtcagtcgacgtcctgtgtttccatagcataacatctggaatgatttgttattacgagatacggtgaatgacacacgtaatgtgtcatttattatgaatcgtttatagatgagggtcttcatctataatggcttataaatatgacacattagagatgagttcttctctctaattggcctggtttttaactgttacatcaatgactaatacctgatccgttcaaatgttaatgtccagcccgcatggcctgctctctctctctctctctctctcctcactagctacatctcagctagctatggcatctgccttgcgttgtgcttagttacatttctaggtgcacaattggctccaatattgtcctcattttttttgttgactttgttcatgcctacaacttaacccttttgccctgtgtgtgctctctgattggtctcaccctttggtcgtcctatacatgccttcctaaaaggtaagcttgtatgtaggccaccttgttcacgagatcacttacttgatcctagtacaatcgtctaatctttcttatttacctcttatctcttttgtcaatattgttgatctttctaaaaactatgttgccaatctttctaatgttcgatcatcaatatatttggagctacctcttgatttagttcatgaaaacacataattagatttttcactcaaaaatctggtttcataaaattacaagcttatatgaaaaatgtcaatgttacggatcaggtatacatcctatacttagattcgtagctaccataaaatacagaaaattatatttaaatatggtacataactagataagaatgaaaactccctccacatgaatagatgttgtcggagtccgacctgaaaaaggcaaggtcttatctacccacattccacaagggctctccgactttaacttggagaggaagttgcctacccatataaatacaatgttccctagaaggggagggcatggaatcacaagccatagctacaagccacaaagcaaattcgtccggtggaagtaaatatagctagcccccaactacaagtcatcggatagttctcggcgcctaacagttgttaggctaatattagctagcttactccaccattgtcatgggccaccaaaatctcaggacaagtccgtgaaatatatagtttttccatctcacctctgtacggtcttcttttcttatctgctctgttgtaaatgtaagccgttatagcacttagtcacttgtcgcttatcttttttttgtcaaatgcccttgttaattaaattctaccactcatacgagacatcatttctatagagaagaatatttgagacattgtgaggcctcagcctgagatgtgcccgtcaaacaactcgaaggcggcgactaaatgtgttacacattcaggagacttgacaaaatggctagagatctacaacatctcaaatattcttaactcgtactcatgtgaatctagttcccaggatatgcactagattcacactttcatcttaagtatggttatacataacaaacacaaataagatgaaagcgattaaaatttgtaactactctagagatacataggccgaccagccaaataaatatatgagagaacagcggaagcttgactacccaatcctcaagcacactgactagggtttaccccattaagttcaagtcctagaagaagcaggcgaagcctaatttatagatttgattgagctatcataaactaatttatagatttgatgtggtatatcacaaagctaatttaacattgaacttaccttgaaactataaatttaagatatactataacaagagcacacatttagtgtaagttttatcacaaaactacaacgcttaattatattttgagctgaacactagaggtctaaactctatagatttatggtaactttgtcagtaaatctgtatttgtgtgatatttcaccttaaaaatatagtttcatcataaatttgctgctaagtatatacttgtgcaatatgattgcccttttatctattttacagatttactctattaaatatgtacgtaagagagaacacatgaaactcttctaagatcacttttagtgtatatgagaatgatttgacatcattttgaggagttttggtttggttattgttctttcttggtgccatgttgcaaaattatgatttgagggggttatagtacatatgaaaagtggttacccacttgaacaattggctttcttctcactatttgatgagtctattcctctccacccctcaatctattggtgccatgcatgctatcctaatttaattggtcttcctccatagctgtcctatccacgccttcataatagataggcctatatgcagtcatcgtgtttgggtggtcacccacatactcatctggtacaatagtccgatctttcccacttctgaccactcttgcccatgtttccaatctttttaaaatttgtcaccaatcttgtaaagttcatgtattggcttagcttcgttttaggcggaagggtttctaggagattttcctcgtggcttgttggcacatttggaaactgcgtattggaaagatttttcagaatattgatatttgatgcttggtggactgccttcagacataagattctcctacatatctataggatgaataaccccctacgacaaatagttgttgattggttacagcttttgtagttctttgatctttatttttgccttttatgtacgtatctctgtcaaactgttttattcccttcagttataaaaatcacactgttaggaaaggcgcctggcagttttccctttttttttctaaagttcatgctttattaatatacatagaatcagctagatttattttatgaaaaacacaaaattagatttgtcactgaacaagcggtttcataatattacaagcttaattattatattaaacatcaatatgaatctatatgaaaaataatagctaaagtcacacccatgaaaagtcaaaaacatccaaagattttgtatatggtaccgtgatcaaatagcctaatatgtaccaatggagattttggatatggtactgtgatcaaattgcctaatacatatatggagcgagtaatgattaattgccactactctaggtaatgttcatttctgactaagatatggattttaccccatttatgttagaatgttttttttcaaactgataaatatggtgtatttcgtgtgaaaacttcctatataaaaactgttgtaaaatatctgatatatattttttcaagttaaaaataattataacttaattaaccatgtgataatagttttctcattttatatacccgtagttaatcttcatccatcacctgttcaatccgatggctcgtatatttttgtgctcttccttaccgtaaaccttttccttttcctttttccatataatcttgacctataatctatatatgtacatcgagtatatttacataaaataatagcccccctaagaaatataaaataataatgagagcttaaatatatgtttggttgtcaggtctcgccagagctacctagcgaagaatccaattaaggcctcgtttagtttccacacaaaaattttatacactatcatattaaatatttgaatagatgtataaagtattaaatatagactaaaaaataactaattgcacatattgtgattaatttgcaaaacgaatcttttaagcctaattgctccataatttaacaatgtggtgctacagtaaacatttgctaatggcgattaattaggcttaataaattcgtctcgctgtttactgacggattctataaatattttttattagtgcccgaataccccacgcgataccctatataatacccgatgtgacacgcaaaaattttacacccctggatctgaacaccccctaagttttctttttactggataaacaccccctaagttgatgattaatttattatccatatgcatgttaccacatatagataggtcagcacaactggccttaattaaccttttttatttgttgttgtcgacacaagcagtcccctacatatataatttggccattagatttctacttatatttttatgaaaactaagaaaacatgcagtaaccttcttttatttgaaagcatttcacatgataaatcaaaaatatttttaactacgcctacacgcgtttggcattctagctaaaactatatccatttgtcggtgatatgggaccgggagtatcatgaccagaggcttgaggcagacgcaaccgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgcgacatatatgggataagtgagcacagctgtgctcacctaacagcatttattgcagtctggtcaagcgtgtcacgctgcatgcagcgcagtatggcgcgttcctttatccggtctgtgaccagtcacagaccggtcagatcacgggttaggtggcgactggcggtctgacgcacgccttgccccgtcccgtcaagacgaaagcctctaggcactcgtctcaagccggagttaagcgcgttatctattagagatgacacgttagccccggacgatatatgccaggcttcatcctaaccattacaggcgagatgttgagtgaagaagggcaaacatgcacgttgccaagattacacgcggtggacaagaatgaccgatttgtgaccggtctgacactgatcatatcgtcagcgcacagccatgctcccacgacgcgctcacccccggcggaagtggaggtaggcgtgggctgtcccatcggagcgtcattcggacagcaaccgtgctgatctccgcccgttcaagagaaaaagaacagtccagtttggaaagagaagggtgcatgtggtatccccttgaagtataaaaggaggaccttgcccatagagaaggggctttttgattcttttccagattgtgagcttagaacgggggagaagtcagctcacacttgtagcccattcatacacagatccaccaaaacacaggagtagggtattacgcttctcagcggcccgaacctgtatagatcgccggtgtctcgtgtttctggctggcagacgatctttccacatacagagagagagcgagagcttgagatttcaccctaagcccccggccgaactggcaaaggggggcctgcgcggtctcccggtgaggagccaccagctccgtcatctggcgcgccaggtagggggctcagcgtgtgctttttgagctctcagactcttccgtgtgccccaagtttttcttgttcagcctaatggccgagcaaggaaaaacacacgacctctcgccgagtgtgagcggcgacgacggggagccgaatccgcgccgtcgagctcgtactcctccacctcctccgcgccaaagccctaagcagggggaggcgcttgagagggtcgacaaatccgcggcgtcaccagccgcaggtgatgcaggagaacggcgagatggggagcgtcgcctcctcgtctacggcgacggcagcacacctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccaccaccaccaagacctccggcgccgctaccaccggctccgtgtcatcaaggcggagggcgcggcgagcggcggcggctgcacgtcattcggctgccactccctcgtctacaccgtcgactcgggaggatcagcatggggagccggatgcccgcctcaacatcgggcgccggcgtaatagccggcgtactccccgtgcaacggagggagcctcctcgtccagagtgtcacctcgacatggacgtgaagatcagccctccgtgcccccggccggtggtgttggctgtagagcctttgtggcgagtcttcggaatgtccgttggcccccaaggttccggcccaccatcaccgagaagtatgatgggagtgtcaaccccaccgagtttctccaggtctatacgaccgggattgaggccgctgggggtgacgacagagtcatggcgaacttctttcccatggccctaaaaggacaggcgcggggttggctaatgaatctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaacactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacctggaactcctccggttccggagtggcagcttcggccgcccccggatccgccgctcagacagggcggcgtgacaggaggaggaagaagaggccggaccgttccggcgacgagggtcatgtcctcgccgtcgagggcgctccgcgggccactcgaaaggggaggcctgcgagcgacaaaaagaacggggctggtacacccagcagggagcgccccgccggcaggtggtgctccgtccacaacacctccctccacgatctcgcggactgtcgcgcagtcaaaaatttggctgagcgaacgaggaagtgggaggaggacaggaggcaggaacgccgcgaggacaagtccccggcggtcccatccggcaaacggcgaagtgaggccaagcagaaggcccccgctgttgacattgatgatggtgatgatgacctaggtttccaagaacctggggccaccattgccaccgtcgatggaggggcgtgtgctcacgtctctcgccggagcttcaaggctatgaagcgagagcttctggccatggcccctacccatgaggcgatgcgtcgggcgtggtggtcggaggttgctctcacttttgaccagaccgaccacccaccgtgcattgcccggggagggcaggttgcgatggtggtctcccccaccatctgcaacgtgaagttgggacgtgtcctcatagatggaggagcggctctcaacatcctttcccccgcggcctttgatgctatcaaggccccggggatggtgctccagccgtctcaaccgatcatcggtgtgacgccggggcacacgtggccattaggtcacatcgacctaccggtcaccttcggtggacccgccaacttccgcacggagcgggtgagcttcgatgtggcggacctcagtctgccctacaacgcggtcctggggagacccgcgttggtgaagttcatggcggcggtccactacgcctacctccggatgaagatgccgggccccggtggccccatctctgtccgtggcgaccttaaagtcgcgcttgcttgcatggagcagcgcgcggaccgcctcgctgctgcgtccaagcccgagggtggtgacgagaggcttggcccctctgcccccaccgccccgaggcagcggatggccacatgcgacgaggttccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtctggcagaaagtgcggcggcaagccccggaacgtcaagccttcatccgcgaggaggtggctagacttttggaggccgggttcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagccaaataggacgtaatgttgaggcgtatgtcgatgacttggttgtaaaaacgtgcaaccaagaaactttactttcagatctagcggaaacttttgagaatctccgctccgcccgcataaaactgaaccccgataagtgtgtgtttggtgtacctgcgggcaagcttctcgggttcttggtctctgcccgaggcattgaggccaaccccgagaagattcgagctatcgagcggatgcgcccccccagcaaacttagggacgtgcaatgcgtcaccggttgcatggccgccctaagtcgtttcatatcaaggctgggagagaaggcgctacccttgtttaagctcctcaagcgctcggggccgttcacttggacggaggaagctgaacatgcccttactcagttaaaggcatatctcagctctcccccggttctagtcgccccggagccaaatgagcccctgctactttatttagcagcgaccccccaagtagttagtgcagcgttggttgtggagcgcgatgaggacaatcctcattctgcgcacccccactctgtgccgacttggcccgggagcaggcagggaggagaggcccccgagtcgaacggtggcctaaggcccccgacgaccggagtcggccctccgcccgcttgtcagacggtgtcgggtgcccccgaccctcaggaaggccccgaggccactgcggggaggccgcacctatcaccctctgaccccgaggctaaccctgtaccgattcgacccgggagagagcagggagaagaggcccccgagccgaacggtggcctaaggcccctgacgaccggagttggccctttgcccgcttgtccgatgacaccaggagcccccaacccccaggacggtcccgaggccactgtgggaaggccgctcctgtcgtcttccgaccccgaggtcatcggcacagaagacgggtgcgccccgaggggccactcggacgaagaacgccccgggggtgcggcccctagcgaagaagatcggcctcgccgaaaggtgcagcggcctgtctactttgttagtgaggccctccgggacgccaagacccgatacccacaggcccagaagatgctttacgctattctgatggcctcgaggaaactgcgccattatttccaggcgcatcgggtcgctgtggttacgtcttaccccctcggtcaaatcttgcataatcgagagggtacaggacgagtggtaaaatgggcaatcgagctttccgagttcgatctgcactttgaaccacgccacgctatcaagagccaggccctcgccgattttgtggcagagtggaccccggctccagagaccgtctcaatacccgaggccagcacgaacccctcacagctgcctcaaaccgcccactgggtgatgcagtttgacggttctctgtctcttcagggcgccggtgcaggggtcacgttgacctctccgaacggagacgtcctcagatatttggtccgtctcgacttccgagcgactaacaatatggcagagtacgagggactccttgccggactcagagtggcggctggactggggatccgccgcctcttggtattaggcgactcccagctagtcgttaaccaggtctgtaaggagtaccggtgctctgacccacagatggacgcctacgtacgccaagtgcggcgtatggagcgccatttcgacgggatagagcttcggcatgtacccagaagggacaacatgatagccgacgaactctcaaggctcgcgtcctcgcgagcccagaccccaccgggcgcctttgaagaaaggcttacccagccgtcggcgcgacccgacccctcaggggagacggatgcgcctgaccggcacccgaggcccgtcggagtccaggcctcgggacccgaagagagcgttccaagctcccttagattgattgcttggatctctgagatccaaacatacctcacagataagactctacctgaggaccgcgaagggagtgaacgcgtacaacgcatttccaaacgctatgtgctgatagaagggaccctctatcggcgcgcggctaacggaatcctcctgaagtgcattcctcaggaacaaggcgttgagcttcttgttgacatccatgagggcgagtgcggagcccattccgcctcgcgcaccctggttggcaaggcctttcgtcaaggattttattggccgacagctctcaatgacgcagtcgatctggtccggcgatgcagagcgtgtcagttccacgccaagcaaatccatcagccggcccaggccctgcagatcataccactgtcgtggccatttgctgtctgggggcttgatatcctgggaccgttcaaacgggccccaggcgggtttgagtatctgtatgttgcgatcgacaagttcactaagtggcccgaggcttatccggttgtcaagatcgataagcactctgctcttaaattcattaagggtatcacggcccgttttggagtacctaaccgtattattacggataatggcacccaattcactagtgaactcttcggcgactactgtgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgccaaacccgtggaacatcgaacaccttcgtcgcttctacccctgaagggggggggtcgggtgtcaggtttcggctcgggctaaccccgcaccccccctcgggtgtgcagggttagccgggggctaccacacatgcacatatattcctttcagcatttcaataaaagcagtttcaatttcctaaaggttgtgtctgtgccgtttttttttccttttgaagaatcttgacttgaaataatgtcactcgtactcaaccttgccctcgggggctcggttcggtcggctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgtggatctccccaggcactagccccgacccgagccattcgaggaccgggacttgggcgcgagcccttatttcaagctaaggcgcaaaaggaccatggcacagatcatcctcaactcatatatatagcaaaataaaactaacacaaaaatttttcatcatttctcattgcagattaagttagattgtacaaaaaagaggcatgaaggccttagaagaaagaacaagaaaaaagttaagagtggcgggggcctgggggctcattcatatgcgcccgggtcgccggcctcgtcgccaccgccgtcctcgctgctggtgtcgccttcctcgtcggagctgggggcgaacgcgagccgaggggccgagccctcgaagccattgacgatgtggtcagcagcatccccgacccgcacgcgcgcctcgtcctcggtcccgggagggaactcctccagcgccatccatggggagaagttgggatcccgggcctggtaacttgccagcacgagttcgaccgccccccgggcgaggtccctcgaggatgccttaatggtcttctcaagctcctcggggagtcgttcgagaacccaggccatcctgttgaggtgcggagcgaggccttccagattggtggggggcaccgtcgtctggcctccccagaggcctgcttgccgaccggcgcgcttcatgcgggagaccgcgtcccaaagcatgccgggcccaatctcgcccgccaagcgaagggcctcggcctccccagtggaggagtccagcgcgcgctgcatgtcagcgacggtgtgttcggcagccgcgaggcgagcggctaagtcgctttcgcccgcagccgccccaccgatgcgcgcccccgcggccagctctttctcccgtgcctcgaggttggcagcccgctgctccagcgcggctctctcggcacggacgctttcaaggttgcggcgcgcctgctcctcttgcgccgcctcgcggagggagaggctgtccgccagccgtcgcgtcgtggcctcggcctcctcgagagcccgctcccgctcggcgagtgcatcctcgcgaaggcggagcgcggactcctcctcggcgcaggcggcctcgtgcgccaccagcgtcgcctcccggagagcagtggcggcctcgcggtccatcaagcccctctccacggcgccggcatgttcttccagcgccatggcacgggcctcaagggcctcctcgcgccgccgggacgccgcttcggcttccgttgcccgccgctctcgggcggcggcggagtcgagaaccccttgggcggcgtcgagcttgctcttcagctccgcctcccagcttgcgtgctgaagacggagggtgtcttgcgcctcgaccatcgcggtggtggcgacgagggcggcctctcgctcctcctccacctctcgggcgatctccgccagcgccgccttgcgggcttcgagctccgagatgtggcggcgatgggccttacggcccacctccaccatggcgtccaccgagcgccgcccctcctcgacgcgcgcccatgcggcctcgagctccgctcgttctgcacgcagggcctccacctgggtgttgaacccatccagcaccgcggtgtttgcggcggccaaggcctgcataatgggctcggcgctcaccggggcgacggaagatgaggaaaaaagccgccttggagaaaaggcgacgcggcttggccccccggaggatacgctgagctcggggatgtcccccgggcccgttcggtcctgggcgtcgcccggtgaggtaggcccaggcgatgcgcccgcggcctcgtcgcgagccgcctcggaggatgtcgcctgagggccgcccgagggagtgggcccaagtgacgctgtcgcctcagcctggcgagcccgggcggcctcctcccgagcagcttcctccgcttggcgaacccgggcggcctcccgggcggcctcttcagcttcccgaaggcgggctgcggcttcacgccggtcagactcccgccttcgctcctctgcggccgctggatcttcggcctcggactggccggacttggggtggcgggaggaatgcgacgggacatcgctgaagcagaagaaaaaaccagaaggcgaacaaaatgagcaagaaaaaacttctttttggagaaagatggttgcaatgagagtgagacgaacctgcgagggggtcggttgaatgaccaccttggaggggaaattaagtttccccgggctggttccgtctcccccatcttgcggaggcgcttcttcttgcgctccccctcgggctgtgacgtcggcgcggccccctccgggcgccgaccgctggtacgcaccgccccgccccctcggggaggagatgggggaggtgttcctcccagcttcctcttccccggggcgtcggcaggacggctgctccccgagcccccgacgcggggcccagaagcacgaccccctcctggggcagatcgtttcccccggcggctctcgcccgcgccatcgtggcccttaggggctctctcctctgaggccccaacccccagcataatggatagaatggagacgcggtcgggatcgatgcagagggggaggatctcctgaggaaggcgagacgcctccgcggagctaagattaagcaccctttggactacgatcttgaagtcctcaggagcccaatcccatctggttccctgatgggtccgcatgtaatcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtactcctcccccagatctgccggcgcccgccagctggagacctgcgccgggggctggcttggaaggcggaggcgcgcttcgtcggcgaggggggtgtagaaccagtcgctcttccagtcgtcccacttcttgcggaggacgcaggggatgtagcggttcaacaccggcccccgcggctggaagtagcagccgccaaccaccgatggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcactatctcccgaccggtggtggactccggcatgaagcggcgcggcagtccggcgtgcctctcattcacgatgcgggaaggcggcagtacactgccgtcgagcagagcagagccccgtgccatggcggtggaggaagagatgattgggaacgagcgcgtgtggcgaaagtagggcgtggcagagaaagagttagagctcaggcagcgaaggcaagaggaacaatggcgaaaggaagggagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcttgaagtggatgtgcagttgtggcaatcgaaacggattgtatcgtgcgcgcgttaattacgctcgccaaccgaagcggcgttaccgtatctccgggcgagacaaatctgctcacccagattcgcgcgctgctcaagtggtgtggcagtcttgaatagaccgcccattatggacaaccaaagttaccaataccaatgtgcgtgaattgagaccgttgggtattttgcccaactacggaaaccggtcccacctgtcacagggtggcgtcacacctgaccgcttcccttgggaagggaaattgctctggcataacgccgggggctactgtcggtgatatgggaccgggagtatcatgaccagaggcttgaggcagacgcaaccgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaaggctgcgcgacatatatgggataagtgagcacagctgt

SEQ ID NO: 76956 - DNA, 7105 bp, Oryza sativa
taatacagaaaatattacgaattaaataaatgatttatgatgtcacgatgacatcatcgccggcctagcactggacgacgcggccaccggcgatagagagctcggttgggctatccgaggacacctacgcgaagaggacgacgacgcgaactcaccggtgcaaagaacaacgacggacgacgacgtacggcggccggcgacgagctccgacgacggcacggctcggcccgacgtcgacggcagcgctccagcggcttgcgacggcggcgaaggggcggccgaggtgctcctcctccgcacgaacccgacggcggcgacggggagcggcggcgacggctacagcggcggcgcggcttggctggaaaggcggcggctagggctacgcggcggcggcgctacgggcaaagatagagctcgggacttgaggggaaacgtagaggacgactaggggatgctttatataagcttggattagagagatcggactctaaccgagaggaatcgaagccggaaaaatctagggttagtttggagagataaactcaaaacgaattcgattcggtttatccgggcaaaattgatctccgaaactttaggggaaagggagaggataaggaggagatgatttcccctcaagcaatcggactcggagatggccggttgttgcggaatcgacgaggaggcggcggggctcgggcacggctcggccggccggaggtagaagaagacccgacatgtgggccccacatgtcggcggcttgagaggagggggcggggcggcggcacggcctgggccggtttgggccacaaggcgcacgcggctgagaggggagttaggccggaaatggcccaacggcctaggggagggttttaaagactttcatttaaaataattcgtgaaatgatgtttcatttattaaaaatactttctttgctcaaataattcctagaaaaatctagaaaatatataaacaagcaaagtatttaatgaaattttatctagctcagttttatgtcgaaatttttcctagattattagagtttaacttgtaggcttttaaaataatttctaaaaatgcattaaagaattaattattaaattaggcgattttcagggcatgacactgcctgctgaaattgggccaggttggcccagcccatggttcggccgaaccccccgcagctccgtttgatccagggttctcttggacggctgagatggctccccaatgacggttggagggtattaccgaccattccaaccgtcacaaccgtcattgggaggctataaaaggagctctcatcctcacttcactcacacacctcaagcaaaagctctctcatttctctcaagtttagtttagtagtatctagctggtggaataggaatagagtagaaatcaggagtccggaagccttcggaagagttcgggtatagctctactagcttttctcttctcttttgtaagctttgtacttttattagaatactcttctatatacatttatggtattgaaatactttatgagtatatgaatgcccattttacattatggtcatgttatactgaatatacggctagcttatctgggagatgcttttatgcgggtataatgtttgcatatgcaattactctatgtcatgacgatgatattatagtagtatatggtagtttagacgtggtgtctagattaccggatatcattatttggggttatatattgcggacgaaaggtgggccgctgatggtgacagctcagtacgggtattcctccgcgccggtatataatcataagttaattccctggggagggtattccttcatatttagccccggttgtatcgtcatgacgggttgtcgtaaggaactcggcagtcaggggtggcttctcaaagtaccaggagggcatcggatagagggtattagctagtatatcagttaactagaatgtatgaatactatgtatattagaagtataggaatatattttctttctcttttccgtccacttagcttagataatatataatgagaatgagtagttaatgcttgtgtgtcactctacccttgggattatcttaacccttgcctagaatatgattatcacaagtaatatataaattattagtcaagttctctctacatgatcttctcacgggataaaataaatacgatacccttggaatactctcgggtgaaatgctacaatggtatatccgtgcgcttgcggatgaactctgtaaccataatataccataagtatttctgcgtcattgttgggaactatatttctagtaatgtcgttaagaaataccaacaagcatttctggcgccattgtcggggaagattcataatagagattacctgaactaatattttttatttacctttgtataatcattttcctttgcaggctaaccttagttgttttcacttagtgcatgattggtttcaacctgccggaaaacttcaaagaaaatccagaagctttcttccggagcgtcaggccgcgagtcgctgctccacagaaaaaactctaccaatagagaaaccagccgtaccagtgccaccgaccttcaagactatggctaagaagactctccgcgagttcgctactccctctgctaacaatgtggccattgggccgtagttcaacatgggagacgtggatttcaacttgaagtccagcctcatcacgatggcgcaggctagcccgttctgtggcaagcctaatgaggatgccaatgctcatctgcaacagttcctggagatttatagcacgtacactatcaagggcatcagtcccgacgccgtcaggctgcggctgtttccgttctccctcctcgggagagcaaagaagtggttctacgccaaccgtgctgctgtcaatacctaggacaaatgctctacggcattcctctcgaaatttttcccgatgggcaaaacaaatgcccttcgtggaaggatttccagtttccagcagacaagggacgagtctattcctgaagcatgcaaatggctgcaggagtacgtagccgcctggcctcatcatgggatggacgactggctgatcctgtagaacttttataatggactctcccagatgtcccgcgatcacctggacgcggcagctggaggagctttcttctctaaaacggttcaaggagccgttgatctaatagagaagatggtctccaatacgggttggagcgaggaatgacttcagacccgtcagcgaggcatgcacaccgttaaggagacgaaactactagctgccaagctagacctcctcatgaagcggttggacgaccacgagaaatggccacaaggcaccgtcaaggccttggactcacacgttacgtgtgagggtctgcggcggcacgggtcatcctgggaatgactgcccggaaacccgtgagaaggcgatgtacatggggggtaccgtccacaaggaggtcaagggtggaatcaaccacgcccatattatcaaggaggtaacaacaacaataacttttctaaccagccctccttgaaggatctagtttttgcacaagctaaaaccactgatgcgctaagcaaaaaacttgctgccactgacaagatcctagaaaacataaatgtcaagttagatggctttgcttctgcttttcaaaatcagctgagcttcaacaaaatgatagaaacccagctagctcagttagcatctttagtccctgcaaatgaaacggggaggattccggggcaacccgactcctccgttgaaaatgttaaggcgatcacgatgaggggaggtaagtcgactcgtgatccgccgtatcctaaccctgcaggagctactgggataaccaaagaagcgccatctaatgactcggctgacaaggaggttcagccagaaaagacagtgccgcaggagtactgtgacacacggttgctgccgtttctccaacagatgaggaaaccgtcagtggatgagcaattcgctcgttttgttgaagtaatccagaagatccacatcaacatgccgtggttagacgctatgcaagtgccagcatacgcccgttatctcaaggacatactcaacaacaagagaccgctcccaacaacggaggtggtcaagctgacggaacaatgcagcaacgtgatactccacaagttcccggagaagaagaaagatccggggtgtcctacgatcacctgctcgatcggggcacaactgttcgaccaggccttgtgcgaccttggagccagtgtcagtgtcatgccaaaagacgtcttcgacaagcttaacttcacggtgttggcaccaacaccaatgcgccttcaacaggcttattcatcagtacgttacgggacttcttgtatggtcatgacgggctgtcgtaaggaactcggcagtcaggggtggcttctcgaagtaccaggagggcatcggatagagggtattagctagtatatcggttaattagaatgtatgtatactatgtatattagaagtataggaatatattttctttctcttttccgtccacttagcttagataatatataatgagaatgagtagttaatgcttgtgtgtcactctactcttggattatcttaatctctgcctagaatatgattatcacaagtaatatataaattattagtcaagttctctctctacatgatcttcccacgagataaaataaatatgatacccttgaaatactctcgggtgaaatgctacaatggtatatccgtgtgcttgcggatgaactctgtaaccataatataccataagtatttctgcgtcattgctgggaattatatttctagtaatatcgttaagaaataccaacaactggaggctctcttaaggaaccatccatacaaacagatatccattttttttatttttgttgccacaaaaagatttgattttgttttcatattttagtagtctgctacagggttgcatgtcacaagtcatgtaattttagtcgcgtggagtatttatgattcgaaccgaggacctctcactcaccgtgtagcctcctcatcatatcctttcaacttcatccctctaaaacttataacacatattttatactctaaatgatatcaaatggaaaaattatcaaccatgaacgtgtacttcgcgttgagctctaagcctttgagaaagagcatatctctattcgagctcatttgaaaaactcaaaaattcatctttttttattcaaaataaagctgagagtttgtaatgaatatatggccctctaaactatctcaaatgaagcaaatgtttaactacgaagttgtgccattgagagatacattgttcatataaattttgtcatcatctaactcaaaatttcttttttttcctattttagtggtgctccgatttttaagggtggttgttgaagagaaccgtccatggaaatcgatttttataaccttccctcataagaattgcccgtaaaaaatattttaagggtgttcattaataattcatcctgtaacaatcattttaagattttaagggcggctcgttaataattctgccaacaaataccttttttctttatcctttcaaaatgtttaaactttaaaaatttataaaagaaattaatttaagtccgattgagatgaaaaaaagtcactactggagaatgcctcttctcttccggctggcaaccccctatagtcccggatagcaaaccggaagaagaaatccgggactaaagatggtgatctttagtcctggtttcaatacccgagagtagagatgcatctctacttccggttggtaacaccaattaggactaaagatcgctatctttagttccggttggtgttaccaatcgggggtagagatatttttttctttttttatttgcttgtggaccattgtttttagctatttgcacttgtttttcagccgaactcatccatggttcatctcccaacatccgaaatcatgcacaatcccaaatcattcacaacaacaaaatcatcatccataatctcaaatcattcacaacaacaaaatcatcatccacaatctcaaatcatccacaacaacatatatagtcaacaaataatcatccataaattaagaggaaaaaaggaaaaaaaataaaaacattggccagccctctgcgtgcgcccggccgcctgccgccgcactcctcaccggccacggctgccgtgcagccctccatgccggccaccacccgccgtgcctccccgcgtcagccgcaagccagcccggctcactctgctgcatgcgtgagaggatagaatagagagaggaaagggagaggataagaaaagagaggaggaggataagggaagaggtggttgctagaggataagtgcgagggattatatactatacgctgatttttagtccaaccgggaataaaaagagtggggggcggacactttttctaccgggactaaaaatgatatttagtcccggtttaccataaaatggctgtaggcttttcaactggggctaaagatgatttttagtcctggttctttttggaaccgggaccattgtgattttcagccaacccaacaaagatcagttctctccagtagtgagttttctataatctttataatatttacaatattttgtttaatatgcctgccatatttccttgataatacttctttaaatatgattgtctactcatgtcttgtagtctctatatgagagttgatatgttatctaactaagatatttcaaaattaaataaaaattaactaggtcatattttaaaaatagtgtaagaatataacttttatttacctcaatcttaatatgaactttctgaaaatttgaaagctttaaatttctaaagaacaccttgtaaaatataccaaaaatatttaggcacttaaacaatctcaaatataaaaaatttcaactatacagttgtagatttcgtcgaggtctataattttagtgtagaacatatctccacctaaggtcgtttgaagaaaaaacaatattttttttctaaagtagatatgagaacttgtaatgaatatttagcccctagaagatatgaaatgaaagaactttcggctataaagtaaaggggg

SEQ ID NO: 76957 - DNA, 1477 bp, Oryza sativa
gtgtgtgtgtgaaaatgcagatttgcactcaggttcacatgtacctacaatctgcaccgttgatgtgtttcaagattcgtgctgcaaaatgtacctaaccttaaccaaatgaatgattactgtagggagaaaagattaggattaggttggttcacaatatgtataacatgtatgttgtattttttaccaaataatttttttcaataataattatatatatgacatttatatatctagtgcgctgtatttctctaaccctttttgttacgcggagcacgcggagcaactacaacaatgcgtaagcattcaatatatctagtagatccatgattttttttatccttttctaaatatgtttcatatgcttcatcttaagagaaaaaaaacatcccagaagtcatagagtttgtgtgtgtgtgtatatatatagtgtatctattctacacccctctcctatgggccaaacccacctcccctaccctccctagggcccaaaacccccctcccacctcagtcaaagcgtcctcccgccggtcaaacccgcccatcactccctcccccacccaccactttgctgctctcgtcttgcaggaatcgtggggtaacaggacggtcatcgtgcagtaacaagaccacattatcgcagtaacaacgtcaaaaagtagccatgatggatcttgtttcgttaagcgtttttttatgaacttcatggtgcacacggattggaaatacaagatatgatgtgagagatattgctctctaaagattgagatttacctttttttagtcctcgtctcactggaacagcgtagtaacacgatggccaatatgcagtaacacctctgcttttcgcagtaacaacgttaaaaaatagttatgatggttctagttccgttaagcactttttttacgaacgtcatgatgcaaatgggttagaaaaataagacatgacgtgtacattagtactctctaaagattgagatttaaaatactctagatctaaaaaaacattactactatagggccactgttactatgcatgttctctgttactgcaaatttcgtcatattgttactgccaaaagtgcagtaacaacctataaagtttacagtaacaacttatacatttttgcagtaacatatgatgttactactcttctaggataatgttacttccgaatcatagtaacaaggtatgattgttttaggtacataactgatttgttcacaaatcatcatatggtgatttggttagaagtgcttggcatgaaccatgagatcatgggttcaagtcttgaattcaccaatttatttttaatttttctaaaaaagagagaaggagtgagagaaaaaaaaggagggggacgcgggagagaggagcgatgggagagggagtgctggggggagcgatgggagagagggagggggcgcaggaaggaggggaggtggggatggataggaggtgggaggggggtgt

SEQ ID NO: 76958 - DNA, 14869 bp, Oryza sativa
gcccatatcttagtgttttgtaagtctttaatcagttattgcccgcatcagggtcatggtagccccttccaccacaagaacatggcacctaaaatatcaattaatagggtggctaaatgcgcgcaaagaagcgctccaactcctgggtgttttgtaagtttagtcagttatcggccaccacaagaatatggcacctaaaatatcaatgaatagggaggctaaatgcgcgcaaagaagcgctccaactcctgcagcggccaccacaagaatatgtcacctaaaatatcaatgaatagggatgctaaatgcacgcaaagaagcgctccaactcctgcagcaggtatctcttgatagcaaagaatagcatttttgaaacagagttgtccagcagatttaccaagttatccctgagtatagtggacgaggaacccttctttcttcccaatcaataaggtaaacccagggtaagcctagcacaaagttagtagtaaagttggagaaaccaccttgacaatcaaccactttacccactttctccaagttgttgtgcacttcctttcctttgcttcgaatttacaagagagcagaaacaatgcaatataactagaaattgatgcacctatgctgaaaatcatagtcagtccagaacatgttttttttattatctggatttgtctgactctaaatgtcagaaactccttgatgaagctgattccataatttatttgaccacatcatgtggcattcccgccaatagctcttttatcagccacttcttgacaggcaatgacatcgagaaaagtgtgctctttaattcattgaaaagttccagttgattagtcacatctcgagcttcctgttgcccagttggcttcttaagttcctattgcataacatcaaatgacaaaatgtttagccaaaacatcaactgagtttgaaacctttaggaccacactgtgagcagtgtcaagatgtttagccgaaacaaccctaagatgcatgccctgtgacttaaaccagccatcattgtcttttagagcttggtgtgcattggtccaatcttgtaataccacgactgcattaggcccctcaatagcaactaatggtagctctccataaggaagaaatgctaacttgaggtgaatataatcaaactcaggatccagagagtgcacgaggagggttcgtagtgtggtgtcggcacctaggaggttgaggaaagataggtcgacgtcgctggtaggatgcactgttagcttggcaaggagggcatggagatcattgatttctttcatctttttcacttagaacctattggatggaaacctgaataagatccatattttgttggcatttaaggtagaaatttgaacaagggtatcctgagaaagggaataacattatactcattttaatttcttattcaatttcaatgtttaagtttgaactagaagaaatcagattcgaatgttttcctagttgaatgaattctataataaataaaatgcatctcagaccaataccatcatagttgagtctgtcaacagtacagattacatgtaatgatgaataaaattcaagctgttgttaatagactacctaaaagctctcactcaagaaggggataacaagatgaacaagtcaacaagagtagaatagaaataataaaaagaaactctacctacacagattataccggctacagcggctgaaatgccgaattgggaagaggcggagaagaggttggagttgtacctgcagctggtatggaaggtggcgaatgcagggtgcacacccaagacaaaatctatcttctatctattatatactaaaagtccattaactttcctacaaacgctctcaatccgccacgtgtcagccctacaaacactcctagaccgccacatggcactgtataatctcaccgtcgattttcacttaaattggtggatccgatattttagaccattggattagatctattatttaagaaaataatcccttcctctgctgtgggccagaaaaagaaaaaaaaactacgtacgtacgtgtgacttcgtataaccgtgggccagaaaaagaaaaaaaacataagaacgtagtacgctctccctgtctcttcctattcctattcttttatatctccatctctctcctcctaattcttttatgttatcaaattaaaaacgagttaagttgaccataatttaaatgtacatagctaatttatattctattaaaacgttgctctatttataattaaattgacaattttacatccaatgttttgctatatataagcaatttgttattgtggtatagactgtgcattttgcaagtttgcatgccatctaaataaattaaatacttattaacaacatatattatatatctatctatatatctatctattatatactaaaatatactaaaagtccattaaacttcctacaaacactcttaatttgccacgtgagactcctataaatattcctaagccaccacgtggtactctaataaattagaaaaaatatataacttgaactggtgagccaattggatttatctcataaaaaaatccttcctcaactactaccgtacgttctcatgtccttcccctcaatcccttctcctcatctctttccttttttctgtatggtagttaagatttttattttattacttaataattaatttcttcacttctatctcaccagaatggttgtggactcttgattgcatgtcccatgcctaaatatgtaaatgattaatgatttgatgcatgcttttataaataacaaatctatttttaactaaaaatttagaaaaaagataatagttacatagcaaaataatcataattttaaaaagttgctccctctatttcatattataagccattttaacttttttcttaattaaatttctttagatttgaccaaatgtataaaaaaattttaacaacatctatcacacaaaattgttttgttagatataacgttccatatatatccataatatgttttgaaaattttactatattttctataaacttggtcaaacttaaaattgactaaaaaagtcaaaatgacttataatataaaacggggccagtatatctgtttttatttagtttgtttgaacggttgtttcataattagacagctaaataatttaaaatcagtattaccaatatttcactataaaaaataaaatatgttatttgaactgccacctattctttacataacccaaataacatcctatttttaatttatttgaactgttgatttatgttactcatattttaccatgtaaaatttaaaatacgtaatttgaacatagaccaacaagcaaacaacactgaaacattaaaaaattgacaacatgtattatgtcatcttaatcattctacataataaaaattagaaaaatacaaagtcaccatgtatgaccttttagagacatgttaaattaccaagtgtcacattttaaaaattagtaaaatcttatatattaaaagaaaaaataaaacatctagctaacggttttcacctagatcgatgacctattaacattatatcactacacacccaatccttcccgtcactggctcaagctctacacttttcattcctcttacgttcctatttaactaaaatataaataatctataattataagtttcatgtctgatttctaatctaactattgcaatgtttataatcaaaccaacgatataagatccatatgcctatagtttaacacaatcggcctagcctattacttacgattatctcaaatacagcctacgatacatgcccacgcgaatgcgcgggctaccttcctagttgttgtaacttgcaagaccacgaagaggctgaggccaatgccgatgtcgaggcagcggggcagaggctgacagtgacgggtttctttcgcggtgcggaagaagccgacgccctggaggtggcgtggaagagcccgaggccggcggcgaggaggagcctgcccgaggccgacgtagagcgccgtcgtggaagagcccgaggctgacggcaattagcgacgctgagggcagcctacgacggagtccttgttcttatcacggcgccctggaaacggcggcgaggagcccgaggacgacggcgagcgccgcggaagagcccgaaaccgacgtagaaccgaggcggcgagggagaggtcgaaggcgctcttgtacttatcgttgtcgagcggggaagaatccaaagtcacgggagcggctaggagtagtccacggccgaatgcgagaggaggcgccggacttacgcgggtaggacgattttggtgtggtggggtttgtgaggtcacgactcacgacacatttattcaagtagtcggtggccagaacgtggaaatgaaataataggaactatagaaacattgattggaaattggtaatttggaaattcgaaactcaaatggaaatttaggatgctagtagtattgctatacaaagagcaaacaacagaaaatggggttgcattgcggtggacatttcatcattctaaacaggattgaagttgctctgcttgagagaaaaaaacaaaaatgatatatttgaagcagttgatagaaagacaatccactgcaactcaagtagactatctagaaaccgttcatctccagtagatatgttcgtctcttcatcagcgccttcacagcaaatctgaaaggttcatcgaatgcacttgaaacaaaagcttcagtttccttccgactgctgtgaccaccactgcctccatcattggagggtttgatcacaaccagggtggcaccttgcaatgtcatgccaccaggtagctcaaggtatggggcatatttcagcttcatgttgcaggctgggacctgagttctattggaacatgctgaggctgacagtttgttttctctaaactctctaagctgctccatccccatgtacaatgtcccttgcccatcggcatctgctaaaaccaagctcctcaacgtcggatggtccttgataattgaccggagaagatagtgtcttgttgatgcagcaatcaaagagctgatagtccacacgacacgaagtttaagcccgccattggtatagaaagattctggcatgcttccattatcctctaccgacgactcatgctctgcgcctataggcttgcgatcgaccagggtacctcccagaatcacacaattccgaagtgtgctaccatactcagccctccacttaagcagaacaccctcctcggtcccaacatctcccgagggaagctccacccggagattccagacatcagagaaattcctaagcacatgtaccggtgaatgctgcgcaagcgggaacaacggcctgcccgtgccattcaggttgcgcatactgtggaatggcttgacgattgtgaatagcataagcttaaagaaatgggagaagatgttctttggcttcgccgaagacaggttgagagcatcatcagcatcaccatctgtggccacgacacggtcaatcttgacatacacatcggaaaccagaggaacaagtccgctgaaccgcttcgacacggcagcgcagcggccaagcgaacgcacgtcctccagcttgttcagaatcaggaggacaactggatccggcaggcagtcgaattggtcgaactccggagccgggtctgcgtggattcgagccctgggatgcattgtccaactcaaaggtgagcacctctttattcccacgacaaatcaaggattccctcttctgctacggcttggtgtaaacacttctgctcttgaaatgaatcgtccagccaactgaacagcccgttcgaaattgaagcgatttcctgaaacaaacgcaacagtaaggtacggacacaaaattccgcagggaattaccatgatgaactgaataaatcaacatgaatcacacaaaatcgatggcagccaacgtgctgaacagacaattccccataccaaatgcttaaaattgataataataatgcttctgggcgaccagaagagctcaactgcaacagggattacagctccacagcataaaaaaaccaaagtaatccaagaaagtacctcaaggccaccacgagcctgccgtcgagcagcttcgcggcacccttcccagaaatcctctcttccgccggatccaactccggcgagcccgccgcagcttggaaaaaccacccccaagaagctccaggaacaccaccaactcccctctgggagacacggggaagcgaatccgcgcgagggggagggtttagaggggagcaaggaggcgtctcggctcgaggggaatttgtgcttcgagactcgactactcgagaggcggtttctatagcgtagcgagaagcgtgccgctaccaccactccaccagcagctcagctcgacgccgctttaatatacgcccttcccacggaggtaacggccgtctcccggactcggtaacggcgtctcggggagggataggctcgagaggtgggccccaccgagcagcgacccggtccgcgacttgcgcgtgcgttttgggcggctttgcacgccggctggtcggcaagtctcggattggttactcttctggttgttccttttttgtgtgtgtggccaattttaatttcatttttgtttggcacaacttgtggttacaataacgcttggagaaaaaaaaacgcagtaagactgtctctaacaagtgacccataaggacacctaaactcaaaataggtctccgatagtactatttcagtctccaacagagtacctatacggaagacccattttgcgtgctataagaggcataacctaaatttgagtatcctctctcctgaagagctatttgcagtaagagttcttttttaggttttattattagagaagaccaaaaatagatattgaactatttgacttgactgtagcgctatgtaaatgtgaaatgggtcttgtattttgggttttattgttagagatagcctaatgaagcctttggagtttggatcatcttacgacgacgtgcgcatcgatgtttttttagtttttatataagcttttccaccatgcgtccatttcaccaagcataccgtgcgtgcacagaaacgaataccttactcaccctcacacgtactactacttagtggttcggttcaggtccactctgtggatgattacgagtcggtggccgtgctcccatagccccgtgccacgagagccacaagatcaacggacagtggcaggggcaagtgaaccaccacccccaacacacgcgcacgtcaaggccgtagcatcacccccaccccccgtgtcgccacaccgccacggtggaagccggggattgtggcgcgtcgtgacggctttttgtcgcttcggagcctcggatggcgaagcctcgctttccgcccgtccgtcccggcccgcacgcaccgcacacatatgggaccagaatcccccccattcctccgtctccgtgcgacctttgcctgtcaattccactgtagctggggacaaccactcacccggtgcgtgcctgcctgccttggttggtgcatttttcctgcacagtgaacaccgtgacgacggagcggccagttgcccagttggatcgatcacaacccgcgtgcgccgcgcagtacccggcatatgatatgacacggtcttatagcatcccagcagctcctctatctagtcatccatctgatatttggagtatggaagagaaaaacagtgctccagtagagtctctatcacatactccattttttgaggtcctccaaacctagcccttcctaagccaaatatggaggttctctctcctcactccatcctcaactacccacttcccaagatttttttaagtggagaaaggtgggaggaataggagtaaaaatgtgtggtagttgaaaaatattagtaaaatataggatgttggtatatgtaggatgtaatatggatgatctgttagagtgaaaagttatatagggtgagaatctttttatatggctatctaaataggagtatggaggatgaaatttagatgagctactcggatgctcttagccgatacaacgacgatgacgaggccggcattacgacggcgagtacgagcgatcgagtgattgattgatcggtccgccggcgggccgcgaccctgctgcgcattattgcggaaaacgaccctgcccctaacgcgtcactcgctcgctcagccgtgtgtactctcctcgctcgccggctgcacatgctgctgccgccgccgccgatggcaggttgggtttgtgattgtactactgattaagtgattattagcctctgggaatcttaggacgacggttgtctacagcgagattaaatgattggttaagagactctctactcgtcaatctcacgccacacacgcacgcaatggatagtactggcgccactgcggacgcttatccaaccacaactactccacgtgagggcgtgaggccgacatcgtttagaatagtgaagaacataagggacatgatgatgatattaaaaagccgggattgtttcgtggagccaggcttgagctttgacgtcgttgctttcagaaacaacacacaggcggcgccgaaaagtgatgtgtttttttctcttctttttcttcggcggcccttgattttgttccattatatcccgccctgaaagtgaagctttttctgtctgtagtctgtacatttgtagtatatgagaaaaggtgagtacagttgtgttgtctgaatcttttgctcattgctgcacctctactcttttctgaatcttttcttttcttcgttttgggaagcaaatgcatatgggtcgtcgcgatcatggcgtcgatcgttatgcagtatctttgtctgttttttagcaccacatgcttctggatcgagatactccaactcccttcattttttaatagatgacgccgttgactttttctcacatgtttgaccattcgtattattcaaaattttatgcaaatgtaaaagatataaatcacacttaaaatactatgagtgataaaacaaattataacaaaataaattataattacgtaaattttttgaataagacgaatggtcaaatatgtgaaaaaaagttaacggcgtcatttattaaaaaacagaggtagtacttaattagtatggaagactctactgttacatgtatctagttgactgagtatgaatcgaatcatagtgcgaaaatcaatttgtcattgtttaggttgcagtgtctgcacagttcagggtttcaggctatcaatgattcagaaacagatttctgtgacatgccagtgcgttggctagatcggagacctcagacactatctgattagaactagtagtagtagtattctactgtgagccagtgagttaggctaaccgcaacatccaatccaaaaaaaaacaattcatcctggaaagcatgtgtctgctatgctatactatctcatggaagaaaggaacgaaacaccaacccttttctttaaaaatacacaacttgcagagctgctcctttcaatctttttagacgtcatgtatactaccgagtatttcaggtgtctctgtaccattcagaatttcagatactgtggatatgctggcaaaagttttaaaaatacaatgagcttacatgggcactactgaaccacagctgcttaactcagtctagtagtctcgcacgcacaccacgtcacctgcatttcccgtccaagctcttgcctgctaatctatacactaaaattcaaacgtgcagaaacagaatcaatcatagataaaaccttatctgaattgatacattcgatcattggttgatttgcagcaataatgcaatttccatgacatgtagtagtagtactgcagtgtggcatgcatgtcgagatgttgtcgtctcataggtgtcatgactcatgacaatgaagtggtcgtcttctcagtaactaatggagagtattctagtaattattagtattgcaggcaggaaaatttccatacacgaagtgtacacatcagggatcattgtcttctgctgagaatgatttttgtttttcctttttcttcttcccccgagagagatctccagacctctattatggcagttcttgtagaggaatcaaagtttccctgttgtgagactctgacgtgacaatttcactcttacagttcggataaaaattcaacctgtttcacagaattgatgacacgaattttaattaggacaagtacgaaggtcctgccatcttgacaagtcaactgatttgtgatttgcatcctaactagcagatttctcggcaaatattcccaggaccacatctcaatatcacagagatttttcttcgggccattgcacaaaatgataaggctggacaattcttcatggagccgcactaatgtcttgagaacaaatctgacaaaaaaaaaagagataatataagaggtacagattaaggaagagatgccgacattttctctggtatggtcgggatgatcagccggccaggacgtggaagacactaccactagctgtgcggagattacaacaactaattaaccagtaggcgaaaaaagacactagaaaaccgtggtctcaatgattacctcttctgatagtctgacatcacagacggaaatggttctgaatattcgatcattcagtgttgcaagagttaacctgcagcagcacacatctgagtttttcagcaattcacggcatgttgcagtgctcaggtctatacttgtgagatcattcagtagtgtttgtgttccattgccaatctgatcctattcagtttcaaccataaatcttgagtttatgtacgctggaaggagcatacgcgttgttacagttctgattgctgaatgttcagtttttttttttttgtcaagaatctgtgtgagccttcatggttataaagggcatcagcaatcaatgggattgtgtacagtactgctaatgtagtagcagtgtttattgccaaagcaggtaataagcgtgagcctcttatcagttaaagtaactagcagaaagaccacgtaatgtgactatgtgagtatgcaagagatgggaaaataaggtgggatccatcttcaaccaacctatcaaaagtcttggtgtgattaaaaaagtgagatgaaacccgtcataacatattttattttcttgctaccaacaataagattataagactgtaaactgttagtaaatatttgctgctctcataatatttgttacctggtaacaagtagtatatatttagtgcttactacttactttaacactatattgtgaatgtcctaaatgggaagcaatgccagagaaaaatattggatcatccaagttcacgcgacattcctgattgtgttcaggcaaaggcattaggcatacacaaccaactcacgcatttcatatgtgagaaatgcacaggaaaactacacattagcacacatacaaatccactcacattcaaccggtgagttatctttgaacaacatgcgcaaaaagagaaggcacgtatcctcgaggtacaaaaaaaccaccttcgaagttgaaatataaactctatacaatctgctttaggtagcactgttcatgtactagaagaacacaacaagtgccaaaaacttttttcttctcatttgtaaagaacacataggtgcaactcatgaacatcacaactacaacacgattttggcattaggatgatcaacattactctatcaaacccacgaacagatgatgattacagtaaaacatcattgaaaaagcacagcaagaatccattggtgccaaaaaactgcatgttcttcttctcctaatttaatcaaccgattactccactgttcttgcttcctcatcagtccttccagaagaggaaccgcgccttcacgcggcacgacttggacaccaccttggcgtcggcggcgagcctgtccacgaccaccgcgcaccgcaccctcaccggcacggcccacgtcctcacgccgccgacctgcaggcgcacgggcaccttgacgtccacgtcgaacggcaccgaccggagccgccccgccgccgcgatgtcgccgagcaggcgctccgagaaccgtatccccaaccccttcgccgtcgccaccagcaccgtcacgttgcgggggccctggtagaacgccggccacgcgccgtcggcgagcctcacgccgccgtacgacacggcgacgtggctcccgccgccctcgtagtgcacgccgatcttgccgttcgggttgtccgcgcgcacggtggcgtcgaactccggcgagaacgagacgggggcaggggcagcggtggaggaggcgttgccgaggatgccgccgaggccggacacggcgagggacaggagcgtgtagtccggctgcctgggcttgaacacgaggtagacgacggcggcggaggccgcgagcgcggcggcgaggaggacgagcgcgaggaggagccacgagcagacgcgggcgcaggagcagcgggcgcggcgcctggcgcggcgggtgtagtgctggaagaggcgcgcgttctccggcggcgggacgcggaacaccttgtccttgggcatctgcaccacgtacgtgccgggctgcggcgccggcagcagctgctggtaccgccgcgcgtcggcgggcggcggcgccgccgccgtcggcgggaggggcttctcgaagtggaagctgtagggcgggctggaggaggggtcggaggaggcggcggactggttcatctcgccggagaagtcggagctgctcgccgccgccgccgggtggacgcggccgtgcggcaccatcggctgctcctcgaggcgggcgtccgaatcaatctgcgcgttttatgcatgcatgcataagctcaattagtcataaattaaattttgttaaaaaaatactaaagtgatcgattcatatcgaacggtgtcgatgcgatgggtgtcagtgcaaatcaaatttaggccgtcgatgtaatactgtaccagtaccatttaggaatatcaacgaagagttttcacctaaaaaatctaaaccagaactattgatttaatttaaagctctccttttttttaaaaaaaaaaagcaaactgtctatgttctttccaccaataaaacgcagcaatataagagtattgaattttgcgaaggccgaatctgtgaattatgtgcatttctgtatagttgtacttccagattgaccatttcagttcctgcagtttttttgctcaaaatgactgttgatgcaagccatcgatcgactgcaatttaaggccatgcatatatacagtgtgcaagcaaaacactctctatgctctagctctggacaaaaacctttacccaacattccaaaaacacgagctttgatcaagagaaaccaatatatacatatgcagtacataaccacattcccaaagttcaaaaaacggcgccaaatcagatcagaaaaatcagaagcgggtagagaccaaaaaaaacgaaaaaaaattaaagccaaaccttgcacagcttgctggacgagaccgctcgtcgttctctcctcgatcgatctcgatgtgttccggaatttcttcaggattgtgattgcgaagagaggaaggaggagacggcggacgtgcgaggtggtcaggacagacgccggagagagagagaggcggtagagtttggaggcggaggggattatataggagacgcggaggtggggccctgcacgcggatctcgcggggtcgctgacaggtggggcccgcctcgggcgtgcgggtgcgtcgcttcccggggaaggaaacgggggttggaagttggaaccgtgtgcgggagacggggtttatggaaaaaaaaccctgtcgtctggttgtcactgtgggaaaggagtaaaacgaaatcgatctgcaaacgcgggcgaagcgtgttcagatcacagcagtagagagttgagtagaatacacggtggcaaaacgagaaaaccattaaaataattaattaagttttatttattactataacttaacaaatttgatttatttgatatcgtagaataacttttatatagaaaggtttggcataatacatactccatctgttccaaaataagtgcagttttgcattattcattttcaacgtttaaccgttcatctaatttaaatttttttatgattagtatttttattgttattatggatgataaaacatgaatagtactttgtgtgactaattttttttagttttctcataaaaatttttaaatatgacggaccgtccaacgttggacgcggatatctacggctgcacttattttgggacggaggtagtatattttaggcaaattttgctacaggacactccttatatgtggttttagccctaagacactgcccaaactcacttttggggggaaaacactccataaacgtggtaatttgccagtggacaccgcgccgattaaaataataatttccgattgaagaggagagagaaatcgtgtgaaatgtcaaaaatgcccttgggtccacatgtcagctctatctcccatctatcttctcctcttcctgcccacatgtcgctccccgccggtcgccgaccgtgcacgcgtagacagcgacagaggcaacagcgagcagcagaagcaccccggccctccggtggcccaccaaccgcagcgcgcggtggagcagctgcagccgctccttttccctgccgcctcgcaaccctcaccccctgcccccacccttcctcccgccgccggccgacgcgagcaagtcgtagctcccgcaccgcatccccagcgccgacgccgagccactcatcgccaccgccaccgcctttctctcatcccaatcgccgaatcacgacacc

SEQ ID NO: 76959 - DNA, 20020 bp, Oryza sativa
tcccattgagacggtgaggcctttcttattaagatagttggactgactttttctgtgttatgtaggtcagtctgtatatcacctccatattcatcttctagggggacgtcagatgaactggcctcctggataagttgtatattcccaaagaggtgctctgttatgaaaatgtaaccggtaacattctctttatctccatctgatgtgatgagcagtttcctttatggtatgtgctctgtaactgctatatactggtcttaaggttttccgtttcctgtttgcgacaacatagccatgtcaacagattgatctctgaagcagtggctaatttctattgacagccgcaagagcatccttcttctccctgaatgaatgttatccctgaaagaatgcagaaatgttttcgcgtgtgttctgacaattcctgctagataactgactttcgcatgttatgccagagtgcttgacaactctacctaaacttgacaaaaaaaaaacgcgacagcctgaaacagtgaaactgtgaaacattctaattatgctgtgttcctttttgcaagttctcaacttcttttcgcacgcacggttcccaaattgctaaacagagtgtcttttttagaaattttctatatgaattttgctttaagaaaatcatactaatccatttttcatttttttagataatacataattaattatttgctaaactattacttcctccgtttcacaatgcaaatcattctagcatttactatattcatattgatgcaacagaggaattacgtcgttttcccaacccatacctccgaaacacagccataactagcaatctggctttgagccatagttggaatcagagacaatctcagaagaaatcaccgtacttcaattttgaaacggcaaaattccaattttgcattcaagcagttcgagaatcatatgcgtcgattttttccaatcagaaggagtaggtctcgtcgctctcgcgtcgcgtccaggtgcagccgtcgttctgttgcaagcgcatcgcatgttgtacagtacaaaatggccacccacccccaccaaacacctttcactaccactcctgcacagcacagcctgcactacaccaaccaaccaccaaaacccttcttcccccatcgaaagcccatctcactctcctccccgccgccgccgccaagcctgcgcggcgccctcccctcccgatcgccatggcctccatggcgttcaccgccgccaagttcctccctgccacggcgcccacgcacctcgactcctccccgcgcctctccccgccccgcgccggtagcctctccttctccccgctctcctcgtcgtcgtccgccctcctcctccgcctccgatccccgtccccgtctggtccgtctgggccaggtggcaggctgcccccgccgccgcgctcctacggcggcggcggcggatctggcgacgccgcggattccgggggcagcagcggcggcatcctcggcatcttcctcgccgggtgggcggcacgcgtcgccgcggatccgcagttcccgttcaaggtgctcatggaggagctcgtcggcgtcagcgcctgcgtgctcggcgacatggcgtcccgcccgaacttcgggctcaacgagctcgacttcgtcttctccaccctcgtcgtcggatccatcctcaacttcgtcctcatgtacctcctcgcgcccaccgccggcgcctcggccgccgcgtccgccgccgcgtcggggctccccagccacatgttcgaggccggcgcctactccttgggctcccgcgtcgcgacgctgctatccaagggcgccacgttcgccgccgtggggttcgccgcggggctcgccggcaccgcgatctccaacggcctcatctcgctgcggaaacgcatggacccggcgttcgagaccccgaacaaggcgccgcccacgctgctcaacgccgctacctgggcgatccacatgggggtcagcagcaacctgcggtaccagacgctgaacggcgtcgagtacctgctcgccaacgccgcgccgccgtcggtgttcaaggtgtccgtcgttgctctccggtgcataaacaacgtgctgggtggcatgtccttcgtgctactcgcgaggttaaccgggtcgcagaagtctgatgcgccggccgcctcggcgactgcggaggaggagaaggagaggttgatagccgtgggcaatgacattgccgcagacgccgtcggcgcgggaagggatggagagggtaagtgagtggatgcataatgcatatgcttgcttgcttgcatcgctcaagcttcgtttgcggcttcttggacatgggccaagaaagctctgtagatgataagccggttggcttggcaataaggagtgaggcttgaaacaatttgttcagtccatctttggtgttcttggtttaatctgtcgacatgcttagttgatcttagaataaagctttaccttttttctgttgctcgttttggtcactggcctaaccggggggattactttgcgcgcggtaacttcaattgctttgtttgcatgcaattctgtgatccgatcagaccaacattgtagatgtaaggactgaacaaatgaaaatctaagcgttggggggttagtgatgtacaactcagataaaattctctagtgtttgcataagtgaattgctgtttgtgtgtttaagtgcagataattatgtctgcacagccagaaccagacttacctcaggtcttccactgtggcaattcgagttttaccttttccttcataaaccatatctgaaattggctgtttgactgtgtatcctgttttgggcaaggtagcttgtgccgaaatgctttggttatatcgatattcttcaccgtaataagctgtgcaaatttgaggcataaagattgccagtatccctcttatttgcacaattgcgcctaagctagcctttggctgtcaacgtgaatagtggtactccacattaatatttgttaaatggatagaatcacaactttgaaattaaacaagtgcacgaatcgtatcaaatattgtaatgcacgcgatatgaatcgaatactaacatagttcttggtcctagcatagataagttacgaaggaaaattgttccagatcttaactgattatggtacctattgcttgcacaataactcagtgatgatcatcatctactgtctatcagtgtttggctcctgtcttctgaatacggagggcatcgatagatgaatagtatattgatgtgcttttctgattgaattgtttgcaattccatatcgagccgttcaagttgatattatcaaagtttggtgagaggttccaaatgcgttccacctttccccttgtttggtgaaggaaaagacgattcctcagtgtcctcccgaaacagcaagcgcaaacacttgtaatcgcgactggtagcatttgccatttttgtttgctctgtaatcctcctaacacaagcctgaaaagtacaaatatgaagcccaattttaacacgcgatgagttgccaggtggactccggcgtcgaccatcctgcacgtaccgtgcatcaacgtactacctaaaccaggacgtgcgtacatcgcacgaggcatgtagtagtaaactcgtcacttgtcaccaaccaaacaatcgccttcgtccccttcgagttttaccactgtctgtcttctactcttccagcctatcgttttgcctatgcttatgtttatcattgaaaatttaatttttcaaccttgattttaaagtttattttagggttttttcattgaagtttatttttagcatttacttttatatcgctaagaacacacatataaaaatcttattcacaaattactttttgtttgcaaatataccgtttagcttattccacgaataggtcaaacgatgagaccattcatctggcaggttgaaaaagcaatgtactccctctatttttttaaaaaaaaacttaacctgggaaggcggatgtgagctattagtataacgaatatgaacaactctttatctagatttgttgtactagcctactaggagaaatcacatattcgttgaatttttgttaggggatatttagatctaggagtgtaaaattttggcgtgacatatcgggtattatatcgggtattcgggcactaattaaaaaactaattacagaatacttcagtaaacatcgagatgaatttattaagcctaattgatccgtcattagcaaatgtttatcgtagcaccacattgtctaacaattcgtctcgcaaattagttgcaatatgtataattagttatttttagtatatatttaatattttatataaatgttcaaatgttcgatacgataaggtgtaaaatttttgcgtgggaactaaactgcgccttggacgaacggagtgtgttacacagtgacagtttcccggtttgctacggcgagcaggttccgtgcgtaagcaactaatggagagagagagtcagtcagaaaaccgcacggctcgccaaatccgcaggtgcgacactgcgaggtcgaccgcgcgatgtccggtccctgacgccggtttgggtcgctgcgccgtggcaagaccggagacccctccggctgcggctcgtttccaggtggagagagagagagagagcccagcccagcagcccgtgatcgatccgcacggcgattgaagcggctgcccttgcctgccaccttgatcgatcgagcatgtacatgcccactgtgtccgtgtcacggtcacgcccaaaattggccgtagcgcgatggcagcatctgaattttctgtgctcccagctgaaggcagtccacgttagagcaagtttaataggatagtccactactagctttaatttatttatagctaatttaatagccaattcatataatactaggtctcatctgtcatacacacactgtattttggagtccgtgctgcagctagttataaatctatagctcgctgctcttctctcttatcttttatttcattaaaatatgtttatagctggttaataatctgctattgtaattgctattacgtcgagctaccagccgtgccagatgcgcgcgccggtgtgacggtggtgtcgttggccggcggcgtggtttagtcaaaccaaccggtgaaggggagagaccaaaaaggctctggattttcagatcttgcaatgacacttttgccatgtgggtgtctatcctgcggacacggatcctctaactttacatggtaaagtcacggtgtgactttcagaccatctccaccgtccaactcatccaacggaggacgtccctgcggatgctgcttcctggccattaatgccatttgattcctgatggcctaattctacctaaagattaatctaaataatactacatgagattagttcagtaactaaaaattacctgccactttgtgtgctaagttattttgtattttggtgattaaaatttataaaggttgtaatttgttattatatgaaatactaagttggtattcacacaaagaaataggacattgaaattactatggaacaactgaaatttaagcaaataattgtgtgaaacaaaagaaatttaataattgtgtaccaatcagcttctttcattaaccgagtcaactaaaaaatcatatcaaattttggtgttaaaacaaactaatcacatgcactgattgtacaattgtttgttgataatgctaattacagtagttagtcttcacatggaatcggcaacttaattagcacataaagtgacaagtaattatttttttttcagttactagactaatctcatgtactagtattggagtattgtttagattcattaatcgttgagtagaatcagcaaacaaatactagcattaatggccaggaagcagcatccgcagggacgtcctccgttggatgagttgaacggtggagatggtctgaaagtcacaccgtgactttaccatgtaaagtcagaggatccgcatccctatcctgcggccctgtcgtttcaccagattttatgccagttcctttcttctacgaggaccatggtcatgtgcagtttcaccacacatgtttcgtattggcacatgcaccggttgcccccctggatcgccttgataatctgcacaagttccaactctaaataagaaaagaaaaaggtgtaacacaagtggctagatcattgcttgtgtacctagaaaaaaaagcaggaaggatcaaaatacatactacaaaaccaaaagggagagatttctgatcaaaatagagctcgactgtccaagcttctgcaacttgcctcaatcatacatcagtgctgatgtaacataccctgccaattggcacgaaacaaagggcaggaccacgttgtttaactgaaccaacaattttcagtttgctcgagttacctaatgtaattttttcttactttattcaatgaattgaatgctgtcaggtgctaatcgttaaaattggagtttaggatgtgttcacgtcaaaattaaaagtttggttgaaattgaaacgatatgacggaaaagttgaaagtttgtgtgtgtagaaaagtttttgatgtgatagaaaagtcgaaagtttaaagaaaaaaattgaactaaacttgcctaatctgaaggccgaaacggtgcgagcagcagcagcaggaggctgacaggtgacagccacagcgccggatacgtggctaggtgaggagagcgtgaggctggctagcgatcataacaatggaaatcttccactaaactatgactaaaatacatattctccaccaagaaggaatcgatgaaatggaagcaggccggccggtgcgatctttggctacatgtgctgcccacaaatacatcggcatggtcgcaacgacagatccaatttggtgcctcatagactaacatatctcgcaactcacatgctttcatacactactgtcttcaactctcgagtacagatctctttgtatcgattgcctatttgcctgattgtctcacatggacgctgtgtatatatataacaatggacttgatcgaataacatcctcactaatcacttctcagttctcatcattgttcagacagttcagtagcttctctcctcagctaaacacacagcaatgagatctgtcagcatttctgtctacttcctgatcatctctgccttgctacttctgcattgcttcctaagcctgcagacagcaagattgcctcgtgatgattgggcatcggaagagaggtttcagtcaaggaagctcctgcagaatgtgctgatcacaagttcagagaatccacaggtgttccttgaagcagcattactagtagataacaagagcaagaagcagcctgacgtcgaggcgaccgagagcctgaagaaggagacgccaagcaaggccaacccgattcagaattagtcaattagcaagtgcagattatgactccggttggagactgatgtgaagtctttgtagactgaaggctgtatagagggatttttgtatgccgttcttttaactgaaaccattcgattcatcattgttttatactagtatataaagctagacagaaaaagagattttgtttccctatttccatttgtttgcatctttttcagtcacactcaactttatcagcccgtcaggtccattgaaagaggttggtttggaaatgcatattgagccctgtactgtttcttttgttcagatacagatatgcaaacaaagtgaacatggaccatgaatcctacgggagaagatgcgccatccttatgcctgcaaacttggctgcaaatatcctgttccattatgctacagtgatctttattcccacacaaccataaaaagataaaaatgacctatttgatgagcctacttgccaattatcgtagcttttgtaaaaaggcaggcacttgtatgataaggcacatatgttaaggcgttaggaatcaatgaatcattgcactgaacttttttttgagaactattgcactgaccgaatatacatttgtccgtatccggtcctctccaacctaaagcatagtctgtagtactagttctctaccgtcacgatctactcctatttgttaatgaatttggggcatatgaattccacgtgtattccaaaatttctcctcaacaaaaaagaagcactccttgcgttcactgttcagtgatttttaaacagtccaaaaatccgggaagtttggactgcgggatttgcagaagaaattaccaactgggctggcttgatacgcaaagttggcccagtaagaatctgggcttgaggccgtcgatacgcaataatgtagcccaataacgcaaggcccatctctcacgttatatactcccccctctgttcgaacccttgttgacgctgtaggtttcccattcccgccgccgccgccaccgacgccgtcgccgacgatcccatggctcccgttaagaagacggtggaaaacctaagcttttatttggttttgaaagttcttgctgtgtggctttgtctcttggtgtgggcgtttgatcgatgggtggggtgttcgcggtgttttgcagaagaagaacgcggaggggatcaacaacaagctgcagctggtgatgaagagcggcaagtacaccctcggctacaagaccgtcctcaagaccctccgcaactccaaaggtagctctttgattcgtttcctagtcaccgctctagcttcattcgttcatcagtcaagcctggtacatatagtgtgataaatctaaatcatttggaattgggggtggggtggggggctgtaaattttcggggaacacatcttattatgttatattccagagtatagcatggatcttgggcagttttgccatgacagaaagttgccctctgtcgtttggatgttgtcatttttactcatgtggatgtcagaatgggactggagtttggctcttcggcttgccctttttgtgtcttagagatgaatgcagcgcccaacaacaattcatctttccttgctggtgttctccttgatcaagtctaggggactaagtgagattgaaacatttactgcgtcactgactcaccgttgcttgtatgcgcatcactagttgtttctactataacttacaataatgtaaatgtcctcagttgagagaacttttgtcagccgtatagtaatttttagcatggtaattcatgaaataaaactgcaggctttttcattttataacaagtttatccaatcagacatgttcaggtgattaggatgctattgccatgtttgtatgattgtccacggtgaagttgctagttggcacaagggactgaagtttggccctttggctttcctttctcagccttagggatgaatgcagtacccaacagcaatatagtttcttttccttacataaatttccagacactcccttgttatctgggaaagtaaggagctgaaacattttgtcttacctttttacatagatatttgatgtggtcagttcatgcgttttcttatgttatttctatgagttaaaatcgtcctatttccagtttatgattaccttgctgttttttttgtagtgggcagtaggtgtttaattttcacaactatatctttatctggggaattcatgcatcttgaaagactgttacttctgtgaatgatatacagtcttgcttctggtcaccatgattgtgttgcaaggaattaatcattaaagtgttcatcattatggtgctatacgaatctacctttttcaccatggaatttctcttccaatgcttagtagaaatttctatatcagcttattcatcaatgtgctaccttcttgataccctgtttatccattgggtcctgatactttcacgatctgttttgaatcttcagggaagctagttatcgttgcaaacaactgccctccacttaggaagtctgaaattgagtactatgctatgctgggaaaagttagtgtgtatcacttcaatggaagtaagattactcttcattcactgaaccacacatgatagctgcaaggctttcttttttgcattaatttatgcctgtgcatgcattagcctgtttataatttgattcgtcaatttcaacctctcaaataggctaaccgttatgtgttggttaattcagacaatgttgatcttggcactgcctgcggcaagtactaccgagtgtgctgtctcagtgtcgtcgatcctggttagtttcagtgacttcaatctttgaacctttccttccgcatccatatgaactctccatttccgttctttttttcatttgaaaacaccaataatgcttctcttgtaatccaggtgactcggatattaccaagcaattacctgagagtcattgatgtgcatgcattggccttgtgaccgatcttatcttcactttttgctcacatgaaaaagatatatatcttcatacggtgttcttgtgaagttgcgatacattgatgaaccaaacctggcacacttcaatagcatcgcctagttttgctctgctaagcatctgtcaacggtaaaggtaggagtgaaatgtatgtaggatttggaggtaatgggaaataaatggtgcaatctgttttactttccgagtattctcaggctgtcatgcatcaagtaaatttaattagatgacaagcagtttcaaaatccaacattgtcttgatgcgcggtgttggctgcagctatagatggccaaaaggcccgaggcccgacggcctggcccatggcacggtgtttaggtccggcccaagcacggcacggcccgtcaagggtcgggcccgtgccggcccggcccgaccaccgggccgtgcctgggcctctccgccggcacgttgggccggcacggcacggccgggccggcacggcacgatgggccgcatgccaggcccgacacataaacaatagggagtaaaaatagacattatatgccacggtcgaaagaatagggacgtaaagtagacttaatttacatatatatatatatgtcagcccaaagaggagggacaaaaaatagacttattttcactatatatatgtcaccagcccaaagtggagggacggaaaatagacttattttcgctagattatgtcacagcccaaagaggagggacagaaatagacttattttaaaaaaaggcacgatgggccacccgcgccttcgggccggcccggcacggcccgacagctggtgggccgtgcctaggccaggccgtgccgggcgggccttttggccatctatagctgcagcagatgatcaaagccatgaagaaatgaacttgtcccgcccgcgatcgaaaacgcccgtagttgcgcgcctgcaaatccaacttcgcgtgcggtgtgccgtgcgtgtatgtgaccaccgtctcggagactcggagtacgtaccctacgccactggtacggggtaaataatcgcaaaacccacgcgctcgcgggtgtcgccgaaccggaagcagcgcgcgcatcgtcgttgggtcgcggtcgtggctaagccgtttcctcagcttccacgcactctctcgatcgggtcgctgccgctgatttgcccaagtagatttggactctcgaatcctagtcggatccagccgcgcgcgcaacacggacgcccgggtgttatattttccggtcgacttacgccaatcaccaagtcgcgcgtacgcacggtcgcgggggcagcctgcatggggaccgtgtcatccagcagccgccgccgtgcggccgggagccaaccaagcagcagcagctgggtgaaggcgctcgacgtggagaacgatgaggaggcggcggcacgcgcggacgcggacgcggacgcgcacgcgctcgaggcgaagggcgacaagctgatgtcgcaggcgaggcgggagctgcacggcgtctggtcttacgtctcgcggcccttcattgtcgctgccagagcgcgcttctacttccacaaggccgccgaaaccttcgtgctcgccaacagctgtgagtctctctctctctctctctctctctctctctctctctctctctctctctctctccgtactcctctctacgtacgccaaccaatcgcgtcctccgtgttttgcacatttagatcaggttgttttacttatttcagccgtgttttagtaagatttcgttccaaaagaattaaattggtaatgtatacctcaagtttatttgctcaaattgaacgcattgcctcatttggaggacgtttttttttttctgttctctataagatggttgtagaattactgcactgtgaatgcgcttcaacgatgcgaatcaaattacttttccatagtaggttgctaaacattgtgtgactctttttcagggaggaaagcggcggctgcacaccacgaacatgccgtttgttgcatgaaggtcagtgtgtaatatggcttacgcgacttttaatttctttcattgctaaaaccgctctagacacatcttttgatgatacattcttaatttatgttcttccaatatttcagattgggcgatcaggtaggctcagagcggcatttgcgctcttcgaggctggaaaatgctacatgaaagttcttgaacctggtaaacacgacacgtgaaaccctcacgcacgctctctacttcttaacatctactgtactaactttcaccacgtagtaagtatatattcgctaaccatcgtcatatgaaaaatctcttgactttctatagatgatgaggagatgacgagcagaacggtgagcgacctggaaaaatcccttcgcatgtttgtcttggagaacgaattggtaatggccgcagaagtctgcgtggagctagccaacttgtatgccatgctgaaacagtgggaaaaggttagggagtacagacaaaaagcggcagaattccacgcaaagacgagtgatgcgttgttcgacacttccactgtttagtactacctcttttaatgtatgacaccgttaactttttattcaacgtttgaccatacatctcatttaaaaaattcatgcaattatcatttattttattatgatttaattcgtcattaaatgttctttaaacacgacataaatatttttatatttacacaaaatttttgaataaaacgaatggtcaaacgttggtcgaaaagtcaacggcgtcatacattaaaatacggagggagtatatctgtatatgtaggatgttgactgtcaaattgtgagatgccaagatgatcaatatatatatatttttgaaatctaagccagccgagctggtttatattcagaaggaaaacactgtacagaggtcacatatatcccatacatcggattccagagttgcactgttccagagatggcgttgttcgatcatatatcccatacatcgtaatcacacggggtttgctcgagctgctgcgccctcaagaagacggatgcggcagctgacaaggcttcctatggcacggcagtagcgaacaccttgctcgttggggttggggccactcccataataatccttggcttgtaagaagcaatgcactgcagcgtgcaactctctctgttcctcgtggaactcagctagctccttgcaacatgtggcagccgattgcatatcattgttcttggtgaacaacgagaccgccttctgcagagcaagcttgatggccgccacctccccctcgtctgcattaattaatcaccagatgagtaaatagtagattagctaacttgactattaacacatattaaagctaacctatataatatcactactaaaaaaatacatcgaagttgacgctatagataccggaacagttaaaaccgatacatatagtgtttttcctatttctgtgggtgcgaaaatacagaaccaaaacctttcaaaaactatatatgtcggttctaaataaaaaccaatacctataccataaatacatatatatatagtaaatttgtttggtgctccatggtgcccgagcaccattgttgaaatttactatatacccaattcaaatgagtatgaaactttttcaaatatttaggtattaacgttaactactttactaactagttcaaagcaagtttgaactgaattcaaacttgcttttgttagattttgattctagttatatagcatccaaacatataattagttaggtatgtaataatggattgtgaaataaagttaaatttgagttgttttgttgctaggtataggtatgaatcgaatacttataactaggtatatactcacaatttaaaaattttgaaaaatttgggcgaatttgtgtatttcataccatggtgcccgggcaccatggtgccccatatgagtgtcctgtatatatatatatattataggtggtagtttttatattataaatattggtttaaaaaaactgagcggagcctagcgactgatcaacatgcatatatccactattaaacttgttctaataacgaaactaatcagataattaacattgctaattctaagtggagactaattcacgacacgattcactgacctgcattgtcctggatcttcctgtagcatctcgctgaagcgaggagcgctacagctgcgaccaattctgcaggtggcgatcttctcttgagcctctggatggcttcgttgccgaatgctgccgctgcttttctccctgcatatataaatcaaatcagatcaacggaagatcggcaagtaatcatcgatgatgttacaaatcaattaatgttcgatccaatcgatcgacgttgaagcagtaacatacagttcttggcgaggacgtaggagagactggccatcctgaagtcctcggcgatggcgaaggccgtgtcgtgcttgaacgacgtgaaccaccagcttgaggctcgccggtggcccctcgccatgaggcggtcgccgcgcgcctcgagctcgtccggctctagcccctcctcctcgaacatcgccggctcgtacgccggcgccgcctcctcctcctcctcgccgccgcgccgcgtgatcggttcgtagccgcggcggcgaatgcggaactgcagcagggacgccatgttaattccggcaacgtcgacggcgaccacggtgtacgtacgtcggaggcgaggggttcgacggcccgctaatcagttgcacccggactcgtgtgctaacgttcgatcgatgatggtcgcgtacttgtataaaggcggttcataaacgaccaaacgacaatctgcttcggaatcggagtgcataaataaaatcgggggtttgccatcgccgcgcgtactcgcaaacaaaacatctgtggtctattgtatataaacttcggtcccatagtatataaactttaggtggtatttagatccagagatgttggagaatgaacttctccaccagagaaccgtgaggcccccctttgtgagttcggccgggggcagcgggtgagattcaagggcttggtgagtggagctgtgtgatcttgaggggttaggcccctccaagacgatgaaacaaaagaggtttatacaggttcgggccgctgagaagcgtaataccctactcctgtgcatgattgattgaatgtagaacgcaagtgcttggggttgtgagacccaagcaccagttcgctcggaagtccccccctccaccactaggactggacctccttttatacctcatggggttaccacattggcccaacaacctaacctaactccggtggagaagcattataatctttgcattaaatgcatgtcttgtctcttgacttgggaagccaagcacacgtcgtttgaatgatggggcctgtcaaatcttgccgcctgacacgggggtgcccctgttagtcaccatttaatgggtgaagacttctgggctcctattacaccgggaaacgggagtcttgctttgaccagagcgggaggaccgattccggttgggataagaggatgagaacctctcaccatcattatttgatgggatatgtcaggctgcacgtcgcctgatacacgtgatggtgcgcctgacatcttgggtcccatcagtcattcgaccggtcacagaccggttgagtgcattgcacaccgcattaaatgcggcgtggcgtgaccgctcgggtcgccataaatgcgggtaggtgggcacctggaggcggacacctaatccaccgtacgtggtgacctagagagggggtcggaggagcccaacccctagtcacgggagggggcggccgccgcccgacctcgggcccgatcccccctcgggggggagctcacgtggcgcctagggcggccttctccctctagtctcggccagggagtggccgccgccctacctcaggcccgacccccctcgggggagggccacgtggcattggagggcagcctcctccatccagtctctgggaagaagtggccgccgtcctacctcgggcctgactcccctcgggggagggccacgtggcatcgggggggcagcctcctccgactagtctttggggatggagtggccaccaccccacctcgggcctgactcccctcgggggagggccacgtggcatcggggggcagcctcctccctctaaacctgatacccccgggcccatatcaccgacaagagacttaactttagtctatgtatttagacactaatttagagtattaaatatagagcctgtttggggagctttagatactgagaagcagctgtttgatagccagtttctgagaatctggaaaagctctgaaacccagcttctctagcttctgccttcttagttcacttttcagaacagaagctgtggattatttggggcagcttctagcagaagccgcttttgggaaaagctgcagctgggacaagctccccaaactgggccatagactacttacaaaactaattacataaataaaagctaatttgcgtgacaaattttttaagcctaattaattcataattagagattgtttactgtagcatcacataggctaatcatagattaattaggctcaatagattcgtcttgcgaattagtccaagattatggatgtgttttattaatagtctacgtttaatatttataattagtgtccaaacatccgatgtgataggaatttaaaagttttagtcccatctaaacagggtctaagacttcacttgtaatacaatgatgcactggttgcgtattccaaaaaacatctatgatctatctgtttcagagcacgcagttgtgtaaacgagaaaggtccggaggtcttctggctagctccataaaatggtgtgctagataacctggtttggagcctcacccttctaattactcctttcgtttcacaatgtaagtcattctagtatttcccacgttcattttgatattaatgagtctagacatatatatctatctagatttattaacatcaatataaatgtgggaaatgctagaatgacttacattataaaacagaggaagtatttaatattaggtcattacctaacattcatgtcgtgtaaacgatcaccgcgtcgcagtgtcgcatcatttaggcgatccaaaagagaggccgaggggacgagccaagagcgactggttgctggcgcgcgcgggggcggtttagccgtttcattgggtgggctcgggcttggcaactgacaacgtcagggtcggcgctttaccgcaactcgcaaagtaatgtacataaatgtagcgtgtcaagcattgttacatgtactacaataatcttcaccatttaatttagctagatataagttataaaaaatctagatacactcatgatatgacatatcctagtaagaaagaatttagtaataaaaaatgagtacgtatagcttttttctagattgtccatctgcctacttgcctacatcgttttgatatcacatttaactccgtagtttcgtttatatttatgcttataaacgaaaattgtaaaaaaaaaattgtgtgcagctgtgtagattttcattaggattgatgtagcagagcattccctttttatggactggattcgaagtgtggtttgcatgttcaagtccagatatggaatgtgctgagactttgtatgcacggacttgaattttcgtactcgcacaattttgaacatctgcaattgacatctcgttatggtatactgtagcctaatagcagagtactgttgtttgaacgaacccttgctgccggagtgccggtcttaagatttttgctcttaggatttagtgaagaatcatgcagaattcagtattttattattatttttttcattttactgtgatgacatgctggtcacactcacacatggtttgcatgccaggactcgctgaaacacagtttaaccataaagtgggtattcactataggggtgggcgttaagtttactccgttaattcggctcggtttcaacggtttaatagaaattcggttttctagttatggcaactgaagaatctataaaaaaaaaaagaacaccgagccgattaaaccgagtaacttcggttcggttgttcagtgttaccgaacaaaccgttggaacacgttgccataagactgaacagaagcagaagggtgatgcccgaaaaaaccgacacttcggttttgttcggcttgcggtcttcggggatttttttgctcacccctattcattgagatcaacatgttgtactaattgttgtagcatggggaaaacaccatcccctgattcggtcgaagacgcataacaaggaaagtgagttcgagtttggcaggctgcttaagtgaattttccacataacaacctgcaactgggaattttcatttgcctaaaagggcccgttccaaggataatttattcgagcaaagatcacttgctcgaatcagcatcactaacaatatcaagtcatcaaacaaatataataaaacatccgacgcctcgagagaagaatattggagacattgttgggcctttagcttgccagtcaacttcagcctgagatgtgcccgtcaaaccactcgaaggcggcgaccagatgtgttacatattcatgagacttgacaaaaatggctaaagatctacaatatctaaaatattcttaactcatactcatgtgaatctagttcccagaatgtacactagattcacactttcatcttaagcatgaaaatacatagcaaaatacacattcaaatcagatttgctttcaaataaattcagcaagctagtacttagcatatggccatcaaagtaggcattaatcatgtgtaaatatgcacctcattgccattcatggcagcaaggagatcattctcaaatctcatcataatttgaaggtaaattttagcatttaggagaataaacacaagtctatactcaacacatatccacataccgctcataaccgcgagcacggctaatccattagtttttagactccgcaaagtttgtacagctttacccacatgatgtgaatcgctctagtttgtccggtacccgtcggtaccaccatactctacacattgagtgggtctagaggtcacaacgaggcttttacattaagtcttgtttaatccttgcatgagcacgatgagtgttgttccacactaagtctagaatcttaatgtcattatattggggggtctttaccaatataacgtcataggcaagccggtacagtcgcttcctgtgtggcactcaacgttgtaagtgaggcggaacattacagtcgtcccctcacgcggaacagtacagtcattccctaccaaaccataaataaaagtgaggcggaatgttacagccgtcccctcataaacatcatacacataaaaggcggattggtacagtcgtcccctttgcaatttacataaacacaaatagccctacagttcactcgtaggcactatcactactacaacggccttctaaatgtaaggttagacaaacacttaacataataggccaaggtcgccccataataacacatgtggatgtacggtaaacataatgaacagacattgagtgacgttcttagatcggtttgggcgcactctcccccatcggtac

SEQ ID NO: 76960 - DNA, 4657 bp, Oryza sativa
aaactcaaatgtaaacaagaagataattataccattaggaatgactttttttcatctttctttcattgtcttgagggacgccaatgccgataccgtttcaccatatattcttcaaatgattgatgcggttacttgtagcttcaaatggtctcgcacggttcatcatgacaaagccgtcactcgcccttcaccaccggatttggttcttcggcgccgagccccttgcttgcccttcaccgccgcatggtccatcgtgaccaagcatcgcttgcccttcaccgtcttgccataatagccatttcgtatcacacatcttcaatatcttcactttgtcattcttggtattgttaggtgtaatgatatcacttgagcatcaacacctttgtaatccttgggacctatttctttcattaaactcaataaaattattagtcccaataatccggttgtcaacctccacatgttgaccaaccgatcgcatgtataaaaggatatgaataaatgatgagtattaatcaacaccacaggtgtcatatactcaaatatatgttcaaatgtaaagatctcaattaaatgaaggtgaataacttggatcgattacatgcataactaaagtataggatttgctccccctaactgtatgcatacaaaatatttgtgtgaagcaagagtatgcataacaagatattaaacattgagagcttatcctatacaagaatagagggcatttatcaaatatagacaataaaataaaaacataccttcatcatctccatgttctaaatgtaaagagactaaacaagatatggctcaaacaaaacattagtctcatatgcttatgtaatcacatggaaatattatatatgaatatatcaatatgtgcacggatagaaagagtgatacatatagcttgatctccatgcatttcatccttgtgatttaggtataccatcaatgaacgtttttctctcaactcatataaagtccagaaatcacctctcacatattccactttcatatccatatgagactagtagataaagaaatgcttataacaatgttagtctcatgtaattggattcgtcattaatcgtcaaaaccaaattaatggcacttgaactttcaaaaggaaccgtccatggtggcatcgggtgcatttagggatgctaaagtgcccaacattttagcctacaaaatattgatgggtataaaatggggtgggctaaatttctatttattttgaactaaaaatatatgagggatagatagggttgtgaaagaacccatgggcattgacccattatcacccccgtgcatcaaggggtgaagttgagctgcgccatcaacatcacggcgaggtgactccacaaactcctagtctccgacggctgcattgacacttgtggcatgttcaatagtggcacctactactataggagacaagcttgatccaatcggatctaggggagcttctcccagcggcgggaaaggtgggatggcgggggggagctagcaccaatggggcactgactagagtataccagcaatgtggccgcccacaatgaactaagggtcaacttggaggcataggctaaggcctaaggggcctaaggggactcagggtcaaagaactcagcgtcacaatagcatccgaggatggcaacaacccaacccacaagatgccatttgcttcacttgtgtatccccttgcactgttgtaaaaccaacaatcaattgccgatgaaaccacaaggcatggtaaccgccaagtaggacgatagcgagcctgttggaaagaagaagagagaggatagagtagtatagttgaaggaagaaataaaggtggtcaattccacatgggtccttgtcaatttccacatgggtcattgtggatgccacatagtatagtagtatggtataaaatcaggttgcaaaattgttgagatccaatttacaatggttttagggcctatttggtagacctctggctctagctccacctcttctgaagctggagcccatccaaacagtttcagctccatccaaaatagaagtggagctagctgaagtgttatcacaaaataaactagggaggtggagctgcgttttggctgcttcacaacacctaacttttgaaattaagagttctactccctctgtcccattttaagtgcaaccataattttccatgcccaactttaatcatccgtcttatttaaaaaaaattaaaaacataagtcacgcataaagtattattcatgttaattagaaaaaaatttaaataagatgaacgattaaaattggatatagaaacttatggttacacttaaaatgggacggatggagtaccaaataaccaaacagccaaacaggctcttactgtcgagggaataaatcagacccggccatagttgagggaatcaaaatatactctctcttttttttctctacaacagattgtaaagacatccaaagagggcagaagtcttcctccggcccaaacccactgactttctgagatgaagcccactcggcccaaataaagccccaaccagacaatccttcttcgagacggcgttgcgtcccaagcccaagagcggaagaaagaaaaagtcagccgcttttgactcgtttcctccgggtccgccgctactcctccgctccgctgcctgcctagcctagccttcgccgtcgccgccgccgccgccgccctcgccgttgattccgccgcccgccgcgtgatggacggggaggaggcgccgccgggagcgctcaacctggccgactacgcccccgccggggcccgcaccgtcgactgcttcaggcgcatccgcaagatcggcgagggcacctacgggtaagcgaaacttcccctcgatctccgccgctcgcgctatgaaatgtttcgtgcgaaatcgctgtctcccttgcggcgtggttgagccgcggtggagtgtagcggtgtagcctttgagatcgtagtggggggcgggatgttcgtctcacccccctagttagggctgtggttccacggaattgtgagaggtcgaattctcgtcaagtcaatgcacgctttgtgtcaattgttgctggctagtttgctcgcttcagaatgcgaggcgacatttttggtctagttgttttccctatatttagttactccttttcgtttgagctctagaaatatgtagtggttcgttggtttcggttaggtttcgttggttaatgttgcacgtggggcatttcatttacagctgattgctgaattcgctagttatttggcagatacgctgactaacctgcaacaatgagaagtaatttatccacggcggctagctagttgagattttcaccatgatgaaagaaagaggacacatgtttatgctcgctacaacactaaccaatataaatgattcgttcgaaacatcccgtctcttcacacggagtagcatatctttcttaacataggcctttgtcctgtacaaagcaggtttattaaaaattcacatctcatttgccgaagtacattaggaaaagataaagaatgttagagacatgtaattgatgggtgaattcgaatattgtcttgttaggtccaacgactttgcaatttcatccatattccataaggaaaaagaatccaagactgctctttcctgtgtgcagaagaaatgaggtttcgcttgattggcaacagtccagattatgccacactagtatggtttgcagtttgcagctcactgagtccaaaaataaatgacgcagttgcaatatttgtttcctttttattttccttaggaccaatatataataacaatacatattaaatatttaaatgtggtaccagtttttttatgaatttaccttcttcaccattggccaagctggcagtgcgctagttttacctctacatttatttatttttcctaacaatctcagtgaagtattcgaggctatggatattataactggagaaagagcagcacttaagaaaatcaaactggatgatggcaaagaaggggtaagctttatgatatccacaaagctatggctactctttctaatgagcaaccgtgttcattgaagaacattgcacttctctgatctgatccatacttttgtagtttccacgccaaatcttgcgtgagattaaactattaaaaaagctggatcacgagaacatcatcagattgaaagaaattgtagtatctcctggtaacaaatttcttctagcaatttcaagatgtctaagagtacagaaaactgcatattcccaccatgtgtaaatatttttcaggtacagcacatggagcaggaggatcaggtcagttactttattctttgtttcttgcattctccattgatgtgctaatgctgatatattttatttgttttgtttaataatttttcattctgctcaattttttcttcatattgatcaatgcacagaaatcattcataacctatgctaaaattctgcagatgattacatgtataggggagatatctatatggtttttgaatacatggatcatgatttgaagaaagttcttgcaccacagtaccccatcccaagtcaaggtactctggtatatgtagttcttctatcccatgtgttttaagcaggggcggagctagaacgaaatggagggggggt

SEQ ID NO: 76961 - DNA, 13750 bp, Oryza sativa
agcgggatagacgaacgcgccacgccgcatttaatgcggcgcagcgcatgcttatccggtccgtgaccagtcgcggtatgtgactggtcacagaccggtcagatcgcgggttaggtggcaacaggcggcctgtcgcacgcctcgccccgtcccgtcggaatgatgagagcttcctggctctcgtccctagccggagccggcgtgctaactcctggagttggtatgtcagtcccggtcagatccattccagacttcggcgcaagcatggcaaggaagtcgctggccattgaatgaaagttgaaacgggcgtccaccgagagagctgatgagcggagcagaagatgtgcgctgtgcttgtcagaggtcacttccggctgtagactagccctctttgtaaaaagtgtgtttcctttcttaggcagctagaggcccatgtggtgacccctgactagataaaaaggaggcccaggcctaagagagagggggttttttggggggactctgggagattgcagagcctgaactctctctcgttctcgagctctgtattccttcacacacagatccaccagaacacaggagtagggtgttacgcttctcagcggcccgaacctgtctacgtcgcccgtgtcttgcgcgcttcctctctcgctgacattcctcagatcgagggcgaagaatctcacttagcgcccccggccgaactggcaaaggggggcctgcgcggtctcccggtgaggagccccacgctccgtcaccattgattttttgtccaacgtttgaccattcattttattaaaacaaatttatgtaattatcatttattttattatgacttgattcgtcatcaattattctttaagcatgacataaatattttcatatttgctcaaaaattttgaataaaacgaatggtcaaacattggtcgaaaagtcaacggcgtaatacattaaaatattaaaatatggagggattattatgcaactatattggaacaggggtgcaaaccatattgggatgaagggagtatatatcattctgtgtgaaaatgcatgaaatctgcaaaccatttttctttcaatcaacaagattcttatcgatcgagtactacgtgcgtaaggtacgtacattttgctgaagtactctcgtggaagagctagctagctcacttttcatgcaacaattcattaacggccatattacagtggtcaacaattcattaacatgccttgcagaggcttactccaagttgctctgcataggaaggccaataatttctttggtacctaaagtggtggcgtgaggtacattacattgtcgacaaatcgtaaatacgtacgtaacccactatcttaaataagtaaattttgtcctaaatagtactatgagttccaggcaatggtgccgtcttatgtgatggtcatacaggacacactaactatctcgatcttatcttatcctatatggctagataacgtcgcacatttcaattttggaacaataactgataaatcttaaaaaatatttgcaatttaattaggtggtcgaaccaaatatatatatacacggtcgtacctcacaaactagacacaagtcgagtgtttctttcgcaaaatacatttgcatatactgtatatatgcgactcaaactagggatgataattttgggcatgggtccgggtatccgtggatacctgacccaatgggcacggatgtgagtgtgatttttacctatgggtaacccatgcccaacccaccgatacatatgtattagttaatttcgacttatctcttaattcttatacccctttctcttggttctttttttatataagttgtgatgtaattcaaattatagttgataactgataatttggtaaattattaattttacttctctttgttaaattatctatctttcgagttattattcatgtgagatccattggatacccaccgagcattcccgtgcccgtcgggtatgggtacgtgcacaaagttttgacagctaaccctagtgggtagggttcaggagggcgacgacaggcatgcggtcgggcattgttttgctctacccgtgtccgacccgacctgttgctatccctgactcaaacctggaactccctcatcacacgtcatcttgccatcttatgtatacgtcatcttgccatcttatgtatagagcaatgttagcatgaaataatttattttgcttccgcgatctttttgtccgaaactctttttgtccgaaacttgtgacaatagggaggcatctaaatgactttaaaaaaaatggtaaatataataattataaattttatctccatcaaaattaagataaatacttgaaggcaaattctactacatgatagagtgacttcacggtttagttgtaggacaccatacgaagtgacttcttgtgggaatccggaagacactacgtaagtgtgaaaattagctaatggatagcatgctgattaagatattcatttctggttaaataagggaaagaaagctgcacgaaagtttggagatacccttgggccacttgtcaattctcccatcatcacatatctagtttaattatagtttggcattagtagagaaataacttttgcatatggtcaaaaggcattttcacaggtggacgcttgactcccttgccccagatgtatatgaaatttaaaatttttccaggcaggcagccacgcaccacatgcgaaaacaggattttcatatatgaagcattaacccacccatatgcaatatctaaattaggaaaaaaaaaccaaaatccaaaaaacccaaaaccctagctcccattcccatccctcttagctcactgccgcccaccgtcgccatcgccccttccggggccgagggcagcgctgccggattatgtagccacactgtaccaccacaattactgaggatttttccgaaagaaaaaaaatgaatagaagatgctctctaaggggttaaaaaaatgaataaccgatttaattaattaccatcgatatatcagcaataatagtcgcagctttgaccagtaactggagctcattcatatggaaacccacgaatgctaaattaagttacatagacatgacttaattcccactaaatcaaggatgtttccttgctaatggaaatgatcgagtagctgactttgctatacattgaccaataatcacagctccaacttgaaaaggctaatgcatggtacagtgtttcttgaggagaaatgaacagttgccgacttgccatcaattgatcaataaccacgacattcaactgagttgaaaagactaaattaagttatatataccaataatcaaaattgaattgaatgcattattctaggagaaatggatgattgtatatttacacaaattattgtatggaaattgttagttttctagtgaccgtgatgatgagctggatttcctcaaatcttagccacctgaatctaatgcccagggagtcatctttaagcttcggatgggaaggagacgaaatggaggagagtaatacaagtcaccagcgacgacttcctagtagcaacaacagtgccggaagtatatatatggtagagaacttacagtttagggtttcggggtgtttttgccgcccaaggggaggggacactagaatggataccctcatctcaatcagacggtaagccccatctcaatcgggcatggcgtccgtcacaggttagaaatcactgatgtgaagagctatctcaatcggacaaacggccgtcacggatgattctatctcaatcgggccctaagtaaagcccgtcaccgatagctttgacccagacgaccagtcaaactatagcccgtcacagatgacctatcttaatcgggccacagacgaccagtcaaactatagcccgtcacagatgacctatctcaatcggaccacaactagcgcccgtcagtcatctgtgacgggcataaattttgtttttttggctagccctcactcgtgtgcacccacttcccagtcggtcacccatcccgaaattgctccagaccaagcacacttaacatcaaagttctttggagattggcttctggaagtgtagttgtaacatgttagtatgagtattctattaatcctattatgccctaggccaggatgtcaaattggggttattaaatgatttcaaatggaaaagtcaccaaaaccaaagttgtagaactcatcgaggtgcaaaatttttatttttgtcatttctccatctgactctatttaaacaatttgaaatttgaaattcaaagtttgaaaagttcaaatagaattttagatcagtgaacgactccaactgaaaaagtcatcaacaacaaaattgtataactcatcaaaatctataacttttattttggccatttttctatataacattttttgaaccgtttgaatttgaatttgaaaatatgacaacttcaaacaacattttcaaatactaaatgatatcaactgaaaaagtcatcaacaacaaagttgaataactcatcaagatctaaaacttttattttggtcatttcttcatacgacaaagtgatagtaacattgttcacaaaattgacatatctcttatctggttctatacactataacacatatatgtaaaatttgtgaataatattaataacgtttcgtcggatgaagaaataacaaaaataaaagttttagaccttgatgagttattcaactttgttgttgatgactttttcagttgatatcatttagtatttaaaaatgttgtttgaagttgtcatatttttaaattcaaattgaaactgttcaaaaaaaagttatattgaaaaatgaccaaactaaaatttgtaaatattgataagttatacaactttgttgttgacattttttccatttgaaatcatttactacccgtaaaattattttgacttataaaatgaattattatacggcactaaattattttgctatagtcaacttacaaatataaacatttcatatgaaaatagaaaatagtcatcggtgacgggttttagttaatgcccgatagagattaagtatatagcccatcactgatgagtcatctgtgacgggcctagttgttatctcaaacgggcctcaagttggtgcacgtcacagatgatggtcattgtgacgggccacaacttgaggcccgtttgagatatggaatgttatctcaatcgggtctaaagttgtggtccgtcactgataggtgtcatccgtgatgggcttaagttttatgcccatctaacatgtctatgcgaccatatctcaatcggacacttttcggcccgattgagatgacttccttgtgacggcccgctatttctaagcatattagagcccgtcacagatagaaggatctgtactagtgggaggagaatttctctaggcttagatcgatgtccgttagtcgtattccttatgtatctattatgttataaagataactagctcttcaatgatatgagccacaaattaagttcacccgagagactagaaaatctcatattaattaacttaagaatgattttttttaccattaaatcatagtgggcctaaattattgaggtgtagattggtcgataattgtataccatccaacaattttatttttaaatatatcgtagacacaaattaccactgtacgcatagaaacataaagagccttctatttttaaaatatataatattgtgtacaaattaaattgtatgcatggacaaaaaattaagactccaacactattcagtttcatataaaaaccataattgtatttatagaaaaaaaggattatgaataaaatccaatttctaccttttatcaagctctgctaatcctatcttcctatatagttggcacccactaaaaggcatttactcctataaaacaaaccatgcaagaagccacatcatcaataattctaagccatcggatcgtatcctatcttattataaaattatcctacactaactccttaaacttaacatgcaaagatgccacatcatcatcgccacatcaccatccactaattaacaagatgccacatatcatccactaacaatcatcacatttaaacatcatgcaagcatactatatctttatagtttttataatttaagagcttttcaaatacaaacatatgaaattatcatccaacataattcacataatgtttcaatgtatatttttattatgttttatgatatcctatatacttatatagttcatcctcacttagttagtgcttaaatgattaatctatagtccaaattatctttctccttttttcctctaattaagtcatatcacatcaattgtttttagcctttagatgattaatctacggtccaaactatctccctacttttcttcttccataaagtcataccaccttactttttacgtttgaatcatcattctacatactatttatatttaaattatcataaaccacattaatttacttaatctgatgttatctagctatcttacacgttattttttttattgttatcgtactaaattcccgcagcaatgcacggggtttcacctagttagtacatagttatcagccgttggataaagaagctactcatccatctaatttaatcattgattacttatccagtcacctccctttagctcataatcgcgcgtgacattgttatccattttgcgcataatactatgttttcccctcccaagtcctccgagataatgcaaattaacttatctttttttaatacaactcaaattattgtataagatgtgagttttgttttgttataaataattggataacataaggtaattagacatcattaacctaaacctatttttgaaacaaccttgagataaagcaaagaggtgcagactactctaattatgacgatatccaaattgtgcatgaaaataactttcgtgcatcataaaaaaacacaatgacatttaaaaaaataaaacatgaattgcattgtaatagcagaggcggctatatatgaagccatattatcatttattttgtatatatacagagttacatctaatcatttaaaacattgattttatttgacgataaaactagcaaatcccacggcaaggcgcggggtgccaactagttattgtatataattaaacaattaatggttgcggctttcggcaggcacacaacaggccaactggggagggctacttgaggtgatgaatgatcttagctacaaatgcacttaccatcattcctatttggtttaggactgcaagcatcaatcatttatgtatttttattcgaaacaaaaaccatttcataatcttcaagagagatgtaatggattaatacgattgatgcaaaacaaactgatttcaaagattgctaccttaagaaatagcctgtgaaaaacgtattttaatgtgcatccagcttcttaatccgcatgtgtaaaaaattttcacgggcattttgtttggtcgttctgtaaaaatatctgaactctcaactagaattgaagcagatcagaaagcgctcatacaaacaggttaattatcagccgtctgtaaaaaataattaccagcagataagaaagcgctcatccacggcagattgatccactgcctcgcaaacttcggtcgtcgggatcgaagaagacgagggagagagggaggagaagcggcgggatccgcgagtagaccgcagccaccaacgtccccatcgctgcagtcacgccacgccatcaccgtagccgtagccatagccgttaccgagggcggcggatccagcactcccgagggcggcgccaccggatccgctgcccgccgtcgccgctcagtcccaccgccaccacctgccgcttccgaggtcgagggcggcggatccgcaagctgccgccactagctccagaggtcggtggcgggtgcatccgcccgctgcccgccaccgcccactgccgcccgccgccgccgctcccgaggttggggtcggtggatccgcgcgtcgatgtcgccaccgaggacggaggcggcgcagtggggggagagaggcggcgcggtgggggggggggagagagaaggtacggatgattggaaagcggaggcagcgcggtggggagagaggcggcggcagcgcagtgaatgggagcgaggcgacgtgcctggtctagggttagggtctaggcgcggtgaattgaagtgcgaggcgaggcttttttccgtggatattttccagcatttttcttttcgtttgtaggtacaaaacattgctgacagataatcaatcactaagttttgctgacatataattggtttctacttataatattgctgacagatattttgatcaaaaaatatttagatttgctgacatataacatgtcatattacatagtattgccaacatataatttaccaaaaacctttactaccaaatagtctaacaataattttttatttttaccggcaatataatttaccaaaaacctttactaccaaatagtctaacaataattgtttatttttaccgacagatgtccgttggcaatcttgtgtcatggtgtagtgtagctagttgtatacatacaatgctttactttgctatatatcgatcgatcaacagttgcggcttaacacattcaagcatccaggcacacgcacgtacgtactatacacacggacacacctctgtctagcactgggcacacatatctgaagataactgagaaaaaccaattaaattaagtacacctagttctgtctatcttaacgccgtgtacgtacgtatctgcttaattataataagagattaagagtgatcagagacgcaaccagtaagtacgttgtgccgcttgtgctccatccatgctgtacgtacgcatagcacgtacaataatagttccaacttgacatgcatgaacgaacacgtagctagctaccttgctggcccctgtataaatacccctatataccctagctctaccagccagccaaacagtagcaacatgagttcagctcgccgcctcctcctcctcgccggcgccgctgccgccatcgcactcctgctctcggccactgccccggtggccggagccgaggacgacggctacagctacatccctggctcgcccagggggccgcagaactggggcagcctgaaaccggaatgggccacctgcagcagcggtaagatgcagtcgccaatcaacctcggcctcctcgacctcaccttggctcccggcctcggcaacctcaactacacctacaagaacgccaacgcctccgtcgtcaaccgtggccacgacatcatggttaggtttgacggcgacgctggtagcctaaagataaatggcacggcgtaccagctccggcaaatgcactggcatacgccgtcggagcacaccatcgatggccggaggtatgacatggagctacatatggtgcacctcaatgcccagaaccaggccgccgtcattggcatcctctacaccatcggcaccaccccggacgagtttctgcaaaaggtctgttaaatacataattcacatagtttgcacacatggctaatgcttctaagaaaaatcaaaatctgtaactttttacagtaacaactaaactagcaatatatatttttattgtcaagctagtatttgttgttattaggttcatatttgaagaactacacatgatgttgaataattcaccgttattgatgatatactaattgttttaacttattagagacgacatagaaaactaatatgtcttatattgtagaacaaaggaagcactgataatatcatcaatggtttgtcatgtctattttaatgtgatagtttggagcaactgatgaccaagatagatatattgtttctttaaccatcacaaacagattattacacatgtatattcttgctatgctgaacttcttgttgcatgcagatggagccttatataattgcgatatcaaaccaagaaggtaaagagaagatggtcgttggtggggcggatccaaatgtagccaagggaaaggataccgtgtactatcgctacatgggctcctttaccacaccaccttgcacggagggggtcatctggaccgttgtcaggaaggtacgtatgtatatcataagtaggttaatttcacattttaaaactattttgttgtttctttttgtcaagaattaatctttaaacaggatactataagttaccatatttagtttcttagtgacgacttactaaaatcttaaatataggagaaatactaaatatctaatagtattctaaataaatagtgtttatggtaaggtctacgagcacaaataagtaataaattggtatccaaggaacaacctactcaacggtagcttctacctgtctagctctcagcgagtacaactttcaagctctcagcaaggaacaacctacacaagttttttggtttcatctgccaaggcctagcttgtataaatttaacccagtttcaatctcttgccacctttaatcctacatatcaccctattaaagctgtaaacaatctataacatgaagcactaggaatgtgctaaggcgaccacattcagttttagttggtgagggaagttcttttagttatgtacttatgttcctatgctatctgtctcttttcttcttcaggtgcacaccgtgtcactgtcccaaatcacacttctcaaggcagctgtgctcatggtaagtgaaaaagtcgttcatgtttaatactctcttcgtctctaaatatttgacgccgttgattttttaaaacatgtttgattgttcgtcctattcaaaaacttttgtaaaatatgtaaaattatatgtatacataaaagtatatttaacaatgaatcaaatgataggaaaataattattaattacttaaatttattgaataagacgaacggtcaaacatatttaaaaaagtcaataacgtcaaatatttagggacggagggagtatctattaatagatgacaatgaacaattatttcgtttgttcttacttgatgatctgcctatgtgcatacatgcagggtaatgagaacaacgcgagacccctccaggatgtgaacaacagggagattgacctgttctttcctcttcctctgatcaataactgaacgacatgcttgacctacacagttgatttacaacgtatcgcctgacacacgcgcatggagaatcatcaaacatatatgtacttataaatatatagtattactcatgtttgtgtaaatctcatcatcatggtgtcactatatatatatatatatatatatatatatatatgtgtgtgtaagtccattgttagtcttgatcacctagcttcataaagagaggagcatatatatgtcgttcaatcatatttgcatagcataataatgcatgcatagtttttatatgtatctctttccggtgctgctatgtatctctatacgattaaataaaaataccaatgttttataattatgtaaatcatcatattcatcttcatagcataaaaagtatgttgataaggatttggccatggcccatggagtaggccaacttaatatatagtactatccagctggaattgtgctatggtaaacttaaaattagaaaaattatttgtgtatacctgatcgtattggccatatcttttttttcagggaatgtcatatcccttttttatacatgataaccttatctttaatgagtggttaaattaaccatacttcatggtgtttggaggaatgagctgttagagatgtataaaccctgccccgtcagtcatgtgtttccatagcataacatctggaatgatttgttattgcgagatatggtgaatggcatatgtaatgtgtcatttattatgaaccgtttatagatgagtcttcatctataatagcttataaatatgacatgttagagatgagttcttctctctaattggcctggtttttaaccgttacatcgatgattaatacctgatccgttcaaatgttaatgtccagcccacatggccttctctctctctctctctctctctggactagctacatctcagctagctatggccgccgccttgcgttgtgcttagttacatttctaagtgcacaattgactccaatattgtcctcactttttgttgactttgttcatgcctacaacttaacccttttaccatgtgcgtgctctcttattggtctcaccctttgaatgtcctatacgtgccttcctaaaaggtaagcttgtatgtaggccaccttgtccacaagatcacttaattgatcctagtacaattgtctagtatttcttattacctcttatctcttttgtcaatatcgttgatctttctaaatattatgttgccattctttctaatgatcttgatttagtttatgaaaacacataattagatttttcactcaaaaatctggtttcataaaactacaagcttatataaaaaatgtcaatgttatggattaggtatatatcctatacttagattcgtagctaccataaataccgcataccgaatatcaaacagaaaagtatatttaaatatggtataagaatgaaaactccttccataggaatagaggttgtcggagtctgatacggaaaaggcaaggtcttatctacctgcattctacaagggctatccgacttttacttggagaggaagttgcctacatgcataaatacaatgttccctagaagaggagggcatggaatcacaagccatagctacaagccacaaagcagatccgtccagagaaagtcaatagctagcccctgactataagtcatcggatagttctcggcaaagatcaattggtaggctagattagctaacttactccactattgttatatgtgagagacatttcataactatacatataaattagattagtgctattacccatgtcgggggcctgaaccagtataaaaatctattatcttccatcttctttaccgcaatctcgcgtatatctacgtaccaacgatccccatactctatatttaaataccgcaggcggctatagcccatcgacaaaaaagtcaacctcaaagtcacatctcaaaccatgaaaagtcaaaacattgcaaattttttggtatattagtcacatagcctaattaatgtatttttggagtgagtaatgattacttgccactgttagcaacttagcaccttaattatctccatgtacaatgatcaaatggttcgtgtattttcatggttagccttactataactttttccttctgccatctaattttgaccgacaccgacgtatccatatatgtgcatcctatctctactattagaaaaattgaagttgtttttgccgatattttggtacgtcatccgtgtatgagtcggtttctaagttcgtttgcttttggaaatacacattcgtatttgggtcggtttttaagatccttcaatttttagtaatacagaaggaattatataatatatctgtcaaaaaaaactcgcatgctaactagatgatcggacttctaactatagctcatgatttttctatatatatatatatatatatatatatatatatatatatatatatatatatatatatatatatatatatatatatatacacacatatacatatatacatacacatatacacatatacatatatatacatatacacatatacacatatatatatatatatatgtatatatatatat

SEQ ID NO: 76962 - DNA, 524 bp, Oryza sativa
  unsure (1)..(524): unsure at all n locations
cggcggcataatatgccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagacgatatcgccatangcaacggcagcggcgcacaccaaccgtggaggcgatgaaaccaatcggcagcaacgaaggcggccggcggtacatgtataaaataatagattaaataataattagtgacatgtgaattaattctaatttatataagaaaatttagaacgataaacctgatttgtgtttgtcacccaactcttaatgatgcatgtacgtcatcggctttacatgtatcaacctggtcagccttgacgttcatcgttgactgcatctgact

SEQ ID NO: 76963 - DNA, 13881 bp, Oryza sativa
tggatcccccttttttaaaaaaaagataaatatttgatgattactgatcattatttctccatggatgtacatatttgtgtcttccattgataaattcaaaatattgttggttaacactccccaaggcaactctcacagtgacaaagctaaactttccagcggagttaaaatcactaaaaatatgcaatatggtatttatatatctgtttcacattgtgcggtttatggtttgagttatattttgttctgcaggtccttaggtcatgcgacatcatcaataacagcccttgcaggaggtcaaggagcagcatatagactgtttaggacaattgaaagacaaccagatattgatgcatgttgtaccacaggtgacatatttgaagatgtcaagggtgatgttgaactcaagaatgtgtactttagttatccttccagacctgaacatttggtatttgatggattctccttgcaagtaccaagtggcacaagaatggccctagttggagaaagtggcagtgggaaatcaactgttatcagtttggtggagagattctatgatccacagtctggggaagtgttaattgatggagttgatattagaagaataaatcttggatcgataagaagaaaaattggtcttgtcagccaagaaccagtgctgttcgcaggtacaatcagggaaaatatcacgtatggaaaggaggacccaactcttgaagaaatcaatagagcaatcgagcttgcaaatgcagcaaagttcattgataagttgccaaatgtacaatgccaaagtaaaatgttctaattgttaactccatttcagttgttagttgacatcatgaaatatcgcagggtcttgaaacgatggttggtgagcgtggaattcaactgtctggaggtcagaagcaaagaatagcaattgctagagtgattataaaaaaccctaggatcttactgcttgatgaagcaactagtgcattggatatggaatctgagagggtagttcaagaagccttgaataaggtaatgttagaaaggacaacaattattgttgcacatcgcctgagcacagtaaagaacgccgatatgatatctgttctacagcacgggaagctggtggagcaaggtataccatacaaaaacctcttcagagattcacttttttctttgaagagatttaacttgaaatctgatttctagagtgtacatactacatatgtctgcgtatcactattgagatattgtgactatgcacaaggcattttcaggtccacattgatggtctggtgtgtatgtttcagaaaactttaaaatgaatttatattcgacatttacaatattttaaattcagctcactggataatttcaatttgatatgaagatagtaaatagaagttctttctgacccctaataaacagataggtaatagttcacttgtgtagcactgcttttgtaccatattagctgtaatattcctttgggctttaacaaaatgttacacctttttgttcaagagctacttaatgcacaaattttggtacataacttaccagttgtttatgaattatgaaaaggttcacatgaagaattgatgaagaagcctgaaggttcttactgtaagctgattcatctccaggagactcggcaggaagctgtggcacctaatgatgaccctgatatgataataagaaatgattttgactctaggattataaatagcaaaacaagaagccaaaatatctcatttaggaaatcaaccagtaaaagctcctcttttgggcacagtggtacccatcctttcacatctacttgtgacttatctgatcccatggaggtccacgatgatcagcacataaaggagaccacagacaaaatgtctaattgccaagagaaagcttcgatcctccgccttttctctctgaacaagccggaggcctttgttcttgcacttggttctataactgctgcaatgcatggagtcatttttcctgtattcggcatactggtttcaagtgcaataaagatgttttatgagccacgttcagaattactgaagaactccaggttattgggcagcatgtttccggtgcttggaatttccacatttcttcttattccaacagagtacttcctatttggactagcaggtgggaagcttgtggagcgcatacgatcattgacatttaaaagtgtcatgtaccaggagatcagctggtttgataaacctgaaaactctaggtatacattatgtctttccctaatcgtgatgtggtacattttttcctaggacttgttatatcagaatttccttcaagaatcaagatgcacaactgcatgaatattagacttattatggttgttcatgctctcaagctcttaaaccaaatgtacgaataatataattttacgtacctaacaaatactctggcatatatatattttgcttgttaatatatcagaattctttgaaaaacatattctagaaattaaaatttcaaaaataaaatatcataagagctttctgaaaatttgatgggtactaaaattagttaaagtggattttttaagtggaaaaagaaaaggcattatacttgtcagctagcaatatatttttacaggtgtacttatatgggtttcaacttttttttttctagtggatcaattggtgcaaggctatctactgatgctttgaacgtgaagcgcctcgttggggacaatttggcactaaatttccagactttgtcgaccataatatcaggttttacaatagcaatggtagcaaactggaagctggcattgattataacagtggtagttcctttggtgggtttccaggcctatgctcaaatgatgttcctgaaaggtttcaacaaaaatgcaaaggtacatgccttgaaattaatcatgaatattctccatacaggtgctccaacacatggggagttgttttgcctaattttttggtgcaatgcagtcaatgtttgaagatgcaactcaagtagcaactgaggcagttggaggcatcagaaccatcacgtcgttctgtgctgaacagaaggtgatgaacgcctatgagaagaaatgtgcatctccaataattcaaggaataagggacggagttgttggtgccttgggttttggcttctccttccttgtgttctactttgcgtatgctctctgcttttatgtcggagcaaagtttgttcaccaaggaacagcaacattcgctgaagtgtttagggtgcgaactcattcttatttcattttgcatagtgttaatcatgctgagggtgtgaactcattcattttgcatagcgttggtcattattaacattttggttcactgatcatatgctaggtcttcttcgtgttagttttgggtattaatgaaatctcacgaacaagtgcaataggatcagaaagcagacgtgttaatgaatcggtagtttctgtcttcaaaattcttgatcgtaaatccaagattgattcgagcaatgatgagggtgtggtcattgcaagtgtcaggggtgacattgagttccagaatgtgtgttttaagtaccccttgcgcccaaatgttcagatcttcaaggatctatccttgagcattccttctggaaaggttgccttctgtctgaactaacaagtaaaatatttatttctttacaaactgctgtttggtgcataactttattgacgggattatcatttcagactgctgcgctggttggggagagtggaagcgggaagtctacggtgatttcactgcttgagaggttctatgaacctgatgctggcaggatcctttttgacggtgtggagcttgagactctcaaagttagctggcttcgtctacagattggccttgtggcgcaggaaccggtattgttcaacgacaccatccgtgcgaacatagcttatgggaagcaaggtgatgcatctgaagaagagatcattgctgctgctgaagcagccaatgcgcaccagttcatctccgggctgcctgatgggtacaacaccattgttggcgaaagagggatccaattgtcaggtgggcagaagcagcgtgtcgccatagcgagagccgttataaaggaccccaaggtgctgctgctggatgaggcaacaagtgctctggattcagaatcagagcgcgtggttcaggaggcgctggaccgggaggtggttggtaggactaccgtggtggtggcgcatcgcctgtcgacaataaaaggagcggatatcatcggtgtcctcgaaaacgggacgatagtggagaaaggcaggcatgaagaactgatgcagataaagggtggaatatattcttcacttgttgagcttagctcaagctcaatgtaacctttctgaaagccagaaaaccactcttcttcaattggacactgatttagtccctgatatggattgttggtttgcattccaaagttttatatatgtatgtttgtactaggaaagggttgttccttatgctgtctgttaatgcgcaactaccatggaagacatgcccagtttgtagtttgtaatatttaaattttgtacaatgtgtaccatcaactcagtatatatgaatgttcaggctgtagcctatgagcctatttggttgtgaatgctttttttaaaaaacaaaataggtccatgcagcttttatttctgacgtaggttgaatcaaacgatctattatgggttatttccggactgtgtatcaactacctgtgccaattcatggaattaagaaaaaatggcacagcccgccttccatgcttaacccataaagaagttgaaaactgagaaagattcatgatatatattgagttgagcagattacggagttgaaattgaaccaaatttggatttggtatgaccgtattggttaaagtaattccctatatctacaaatattcaaaacaactaacttaattaggactaacatctggtataagtaagactactaactcaataaagatgacttctcaataaaatttcttttaaaatttgtaaacttcattgtactgattcttccatatagtaccacatacgagtcatatgacacgtgagtttgatggtgaatgctttctatcggtagcgcgagggaagagaaaatggaaggcaacttaaccactatatgctatacaactacttttttttatctatgtatttatttatccatatatgtgtgcacatggttgtcttcttaatatttttcttctcaacaatttcttcgattttttatccaatcatatcgttgtatttgttataattaaatctttataacaaaatatcacatgattatactctgatgaaagaaaaacatatgtttcaaaccgttaaaactcaatgtttcatacgcaatagcgtcatgttttaactggtgttttcattgtgtttcacaaaagaaaattaaatgtttcaataacttttttgtttcaccctgtataactcaacgttcacaagtggctgacaaagtattgatatattatccctactcactctttcttctgctatatacttaattttctctccactctatccccgcatagggaatatatatatatatatatatatatatatatatatatatatcatatgcgcacaagcttctcttacacactccgtacacaccaaataataaatgtcatgaaaaactatacaaaatattgaacatttactcctaatagtattacacatatatgcaaagtatcatattcaaattcactatattttagccataacaaaaaaagagaaaaatcttttttgttcacttacatcttttcgttgactcgagaagttcatgtgaagggatccttttatttcgataaatatctattatcatatccgtgccattcgtttttgtatttaataacattcgattttcttttatccgggttttttgtttcggctccaattcaagaaaaaaaaagagtaaattgtagtttggaccacatatttttaccattgttacaatttagacaaggtcctagcaatggttttcactttgaaccacatatctttaccattggtttcactctagaccaccccctcatcttctccaagtccggcagcccatctccaatgcaagtactgttcgtctctctctcccccctagtctcctgctatctgccacgctgtcagaggaggtggtgactgctcccgagacatgcatgatccaaagtggagcatgtcagcaagagtagggcagcgatggtctcgtccagaactccggcagcccaatcttaaaggaaagagtacggaagcggcctggaactccgggcacccaatctggagggacgagcagcatatcatggatcggcaacatcgaaaaagctcgagcacgagcgaacggccaatagcactggaggtgctggtgatggagctcaagtagggaggcagggcaagaagggctggtcttcatgttgaggtagccagtggtggttatcagttctgtgggttcgacacgtgcaggactcaacctcaacttctcaagcatcgaaaatttgatcctcgcacaccagctcagctacagatgacatgattatgaatagccaaacaatcatggttcaggcaactccaactgaagcgaagcaatcgatgccgccaaatcaaatgtggatgattgaaatagccgtggtagcactagcaccgtagcagctcaagcaatgccctaggtccaaactgctatgctttggcaagtctagctggtgtgaattgaaaattttgttaaaccccttgtccattgtgaaactcaaaaaaaaaggtccaagatgaaattcactcaaaaaaaaaaagagaagaaaacggaaacggttgggtggtgtggacccttttccgtcccaatttacacttccgtacctttctctctgacaggtgggccctgataagcagcggccgtgcgtccgcagttacgtcttgtttcgtttaccttctccgactcctgacgcggcctcaacaagaagaccagaagcttcctccaactccggccgccaccgacccccctcgacacccgactccctccataaatttccccccctcccgcggccgccgggagatcatcgccgacgacaaccagagcagaggagaggggaggggaacccaagcaagcaatcagcgtggaatcggatcgggtacgaggaggaggaggaggagggggatggatttcgagctgcgcaaggcgcgggagaagctggagcgggagcagcgggagcgcgtgcagcgcgccaaggacaaggccgaccgcgagcgccgcgccaaggccgaggccgcgcgccgccgcgacgcgctcgaggcgtcccaccgcgagcgccgcctcgacgccgcccgcgcgcaggaagaggtaataataccaccacaaaagcacacaacaaccacgttcctaacctgctagggaatctagggttaggatcacttttgctccccccgtccgtgatccattttgcggtcgtttgtattggtttttatcctgtttgatgattgtaaataggcttctcaagtggagtaattcgattcccaaacccaaatttgatcccaaagccttcatgttaattctgagcaaacacatgcggcaaagattatgcattcactcgatcgcccaatgtcccctttgttgttatattagaaacaataatttcttttcctgatactttggtggatatcttgaatgtttgattggttcaacttgttgaattggactgcttgctccccatgacaatttatcgaaatgcttgcatttgttttctttggtgtctactcctgccttttgatgtgctaccggctcgtgttaatgatctgttttatgtatttgtgttgtaataggctcagcagaagatggaagaggtgatgcaacttggaaaggggatttctttcttgcacatgtttgaagctcttcgatatgatggtcctggggataagatcaagttgccaccatcgtcttttaaggaattgtctgatgaaggagcactggacaaaggtcccatgtacttcaggttgtcaaaggttagagacagtgttccgggtgcccctcaggataatgatgccgatgaggcaacatgttgtggtgttcttgagttcactgcaagggaaggctccgcagaactcactccacatgtgtggaacaatctgttccggggtgatagcccagatgttcctctgattgaggttaggtatgtcagtttacccaaagggacatatgcgaagctgaagccagaaggagtggggttctcagaccttcctaaccatagggctgtccttgaaacggcactccgcaatcatgcaacactatctgaaaatgattttgttgtggtgaattatgggcagctgcaatacaagttgaaggttcttgaattaaaacctgcatcaagtgtttctgtcctggagacagatgtggaagttgacattgaaggaccagattcagttttggacaacgtagagaatcaacatgtgcttgtgccacttgagactggaaaggttgaatctggagttgtggaagaaggaaagtttaggtactacaaatttcttgttgatgaaggtatgggtgagaaagtagcttctaggcatgcaaatattgaggttaagatagagacatatacaagtggtggtgacactgatatttatgtatcaaggcatcctttagttttcccaactcagcaccgtcacgaatggtcttctcatgaaatgggatctaaggtcctcatactgaaaccaagggatgccagtctctccagtggtacctacagtattggagtttatggtttcaagggaaccactaaataccaactttctgtagctattaaagatgttcttaatggccaaaggattggtgagcaggctagtgcctcatctagtgttgatgttgattcagtggtgtgcaagaactgcaaacgctatatatccaaccgaacttcactacttcatgaagcatactgtgtgagacacaatgttgtttgcatgcatgatgggtgtggtgttgttcttcgaaaggaggaagcaacagatcacgtgcattgcaacaagtgtgggcaagctttccagcagagagaaatggagaagcacatgaaagttttccatgagccactacaatgcccttgtggggtggtccttgaaaaggaagatatggtatgtattttgccttcgctacttatattctttgaacattcttcctaacttctgaagttcttttttactcgttgaatcccgccaatgatttgagtacacccagtttaccaagcgtaatattgtctttacttctaaacaaaatgattgcaatacctttttagatgtaataattttatttgcatgatatatttttattgccaatggttagttttacgagtattgttcctcactcaatacaaacagtagagaaactgcctaccagcttttgtttcaaacagttactgtaatttactggtaatgtaatattggaagtcacatgactaatttattctgttcttaaatctcaggttcaacaccaatcctcaacctgccctttgcgcttgattgtgtgccgattttgtggtgacactgttcaagctggtggagaaccacttgatgctcgggatcggcttcgcaacatgtgtgagcacgagagtatctgtggatccaggactgcaccatgtgattcttgtggacggtcagtcatgctgaaggacatggacattcatgtgattgctgtgcatcagaagagctaactattgtaaagcattggctctgagaaagatggcctgtcctttatcctgctgggctttaaccaccaaggccatgaagtttcagcactgctggaccaaatgttatttccttttgtgttacatatatcttgtgtcattggttaaattgtaacactgcgtatgggagcatggaacactggggcggtgtatgggagtatggaacacagtggcggtgtctccttatgtatacacaaaccatctataatatttgatttgagctttctcatattcaggagctttattagaaactttcatttccgtgtctatacttccactgttttatcattagggcttttttttttttggctccgatggataatgataatttcgttgcgtagtgtttgcacacacgatgcatttgaatggaaaaaaaaagttgacaactgaacaaattttcgctgaatcaaaaaagtaactaaattttggccagagacatgtcctttggctatggggacccatcgactcatcgagcatcgatagaccaaaatttgagaattttggcctaaaattctctctatattttatattataagctggtctaacttctttttagttaaactatttttttttgtttgatcaagttttcaataaaaacaaatatattattaaaatatattcaatgttagatttaatgaaactaatttagcgttttagatgttgctgaaattttttttataaatttagtcaaactctttttaagtttgaatagcaaaaaaaataaaattaaaatgatatttttttaagatttatggtacgaaacagtgggagtacttttcatccgtatacaaagtttcttatgtcgaggttcttttgctggtgatgctagctaatttgccgtcgagtttatcctccttgagtgccgtggatggtagggcgaagtgagagccggtgccggtttgatagccacacgacaaagatatatctccaggtattgtgccgaacatcaattcattcagatcaaatagcaaaagatattaggcgcgggcaaaattcgtcctagtcgtttctctcttcattctctcgcttagctccagatttgctgcgaccagcggcgaaggcgcaagaactaattgctacggactcaatccggggcacttccgttgacaaggtaacgatcgtcgatcagtgatttctctaatatctcctccttcccttaccatcctaatcccacatatataaaaactgttaaaaaaactaatctctactattataaaaattaaagatgtttttgccagtactttagtatgtcatccgtgtatgggttggtttttaagttcgttcacttttgaaaatacatatccgtatttgagttggtttttttaagttcgttcgattttgaaaatacaaaagaagtcgtataaaaaatttcttttaaaaatctcacatgcttagttgagacgatcggactcctaattgcagctcatgattttctaaaaaaaaagataaatccaaacgaattcccacagtgaatttcatctcaactaaaccatataataataaaaaaattaaaatagccttcactcgttacaacgtacgggcattttttcagtgtgcttaaaaatgaaaactgatcaaccgagagaaaagaaaagggaaaaattacaacagccctttgctttgagttagctcagtatttgtcaactgatgcgttcttctaatgtaacagtggtcttgattgtgggatgtgattgattaagtggggcatgcgagtgaaacaagcgccagcaagcggcaggcagcagatttggtggcttcgatatttactccgtatttcttttcatcttgtttagttccagattcctacaaaataaccggagaatttaccaagatcttggctaggatcgtgcgaccacagattcataaccgcagaaaacaatgaaccaggggatagcaatttacaccaccacatcaccaggaaaacagtgaaaaatacaggaaagcaacatcgggagcccattggtatatatatatatattttgccattcctccttgctgtaaacaaaaccgatcctcaaaaccattattggtgctctttaatgtacatgtcgaaactacaaacctactagccatcacctctattatatttatagccgttgatcatttacaatttcagcaagggaaggtgattcagagccattgtatttactcggaactggggtgttccgtctggactggcgctttgtcgccacgagaacctgctccgcctctggttcgtcggagatggagaacttctcgtcgtcctcgtcgcctttgaacaccgggtggatgtaggcattcatcaggtatcctttgaggtcgaaccctggctctcttgcgcgttctagggtatccttccgcattgcatcctggaaaagggaatgatgagacgttattggttgatttcagtttgaaggttgaattccacagtttctctaattcacaagatgcacattctccttttgacatagaactgacaatgtccaaaataaaatatagaagcttcaattctatccaagttatggctcccatcggatggcctattcagctaaagaaaaagccaaaatttgaattttcaaacttaattttgacattgattttaagatattttcaacgtagtttctttttcaacattggcttttaagtcaccgagaacacatatataaaagttttacctacaaattcatttttattctctaataagccgttttggcttattacgaaaaaagccaaacgatgaggctgtatgttaagacatttattttgcatgataaagtttcaacaccatctctgtagatatcactacaaatgatttcttttgtaagcagaaccattcaacagcagtagccttgttgtaaaaaaaggcacgtcgaaaataatttaatggcagagtacttatgttgtactattggtaaatttgaacacataggaccatcacacacacttggaaaggatttaaacagatgccttcagatatcttgttagttgcagacttgtgcttggcatatttcttgcaaagcagcattcgatgagaatagccacttccatgtactcttattcttaaaaaaatgtgaatattcatcgactaaataatactacttcagtacgtcatacacccaaatcttactgaaggcaactatatgccaatcctgctaacaagattgtataaaacattttaaacttgctggctgttaaaatctaccatttctggatatttagttcattttactacaccacgacagctttggctaaaaagcaattctatagggctctagacaaattatggtaacagacatctacaatgtttttggttatttacagttcatttcaaatagaaccatgggtgaattggtgataatacgctcatatgttcttatcaacatgtataggaactttcatcccaaggtattaactacgaaaacttcagaattttaatattgttttttatttcacaagctaaggtttaatagataaaaacttaaaatacatagtggcatgataaactgattctgagatgagcattacctgtaatggatattccacaaaagcaggctcatagcgattcttgcagtatttatagaaataaaaggttacaacagggagaacaaggagcaccggtgttgactggccagcaccttttgtgcttagtaatccaaggagaagcagctgtgatacgattaatgctacaattatgcgtccatgaacacttggccaaaatgctgctgcactttcatattcttggttgtacacatttattatctgaaacaatgaaccctcagttaggaagtcaatcattttaatacataatcagaatgtagaattacttgttctattgcaccgaagactaaattgtcacacatttaattcctttgaatacagtgaaaggcgagagtgctaacttcttacatggaaataatagtagacaacatagccaaagaatcaaaagaactatataattgtggactagcaaacacatagactatcacacctgacaaacaagtacagacagggtatgcgattgtatagcaacatgataaattatatggagctacctaatgcaattggttatccattatttaagtacaaaacagaaaacaacatcgttttgattccaaaatgggggaaaaaacagtttgaagtgtccttgatgtagcagaaacgcagtcaatt

SEQ ID NO: 76964 - DNA, 5232 bp, Oryza sativa
gaagtccgaacccttctattcagacttctcttcaaaatcctcacccgcatatctcgtcaagtagtcaaactcaaactcccaagttacactctctttctctaaattatccatctccctttgactcgtctccgaatattgttctcttccttgactcctttctattctcccaagaccgagtatcgacttcgaaattcaagtccagactccaaccctaaaaccttccaattaaatctctctgtaaaagtctagttaacctcccccataggttggattccttcttcctttttccggtccacctcttccttctcttccatcccgtctctctctgggtctcgacctatcaacctatctacctatcaatctatctatacatcgatctacctaacgatctatctatctatcgatccatctatctatctactatacctatctatctgtttatctatccatctgtctatccgttcctctacctatcaacctatctctctgtctatctatctatccttgaactccttcccaaatatttgtcccatggtacaagatttctttaaaccccccctctcaataatccttgagccaccaaatacaaatatatccctagaatatcaattctcgctttgaactccaacttcccatcgacatcgagaatcatgcctcatcgaaattccttcccatttccgaaagtatcaaattcgctctttgaatcccctccttggcttctccaaactttgttgagctcaaatatccaatttgaattcaatccagaaagtcgatcccttcctttgaatccttgccgaatattcgctccgactacaaaaatattcaattcccgttttgaatccttcttcgactcttccttattgttcctagagtccaagtatcaaggttaaattccctccaattcaaattgtctccacattcaatccatctaaaaaagtctattttgcctccctctgctttgtgggccgaattcctctccctcggcccatcactctctctcagtccgtttcctcctctctctccacgtgcgccgcgcgtgaccaccaagagagagcgccgtctctctcccctctctcggacgttctctctctcgttctctctcactctccctcgccgcgcccaaaccgctccccaccagcgccccgccgattcaaaccgccaccattcgattttcgccgccgcccgtcggtttcccgcgcgcgcgcgcgtggctaaccacgctcggtcggtcgccgcgctcagttgtcgccgcgtccgtccagacgccgcccgtgccctgttgccgcatgcccggccgctccaagccatgtgcgtccaactcccggaggcagagctctctctccctcctcctttctcccagaatggcatgggcagagccccctttcctccctcccctttttgcttttttccccgaccggcaccatcgacccccccctctgccgcccgtgactgccaagttcgccacccccaccttgaccacacgcgacattcgagctcccttgaccatctaagtcggttccccctcctaaaccgcctcttctccgcctataaaagccaagctgctccccgctcttcctctgttcttgccgccttgccgccaccaccttcctcgccgttgcgcatgccggaaagtcggcaagcgcgcggagccgaaggggacctccgggcgccgtcttcttcccctttcccggcccgaggccgaggagatcccaacgcggtagccccgttctccctccccgcctttcctcttcccctctagcttgcgtagtggctcggtagccctcccgaacgcgcgtggatgccgccccaagccccgccgccgcccggcatagccccgctgccattgccgtccgatcccggaggccgccgctcgtcaccggccctcctcggtactcctctgccccatccgatgccgggaatgcaccccttgaacaccggagatgctcccaccccgccgaatcgaactcccattgcaccggtggattttcccccttttctcgccgccggcgtgcgccgccgcgattcatcgtcgccgacctccctccggcgaatccgagccgttgggtcgctccctcttgactccatcgtcactccggtgtgctccccgaagaccaaatccgtcgcgcaaggcttcggtgaactcggccgccgtccgccatccatctcggcttcccctttcttcctcctcccgccggcccgcgtggctgccacgtaggcgccatgttggtgccaactcggctagaccgagtcaaaccggccagccccgctttccccctccgtgcgcgcggacgatggtgcgccatgcggctgcgtatgggcccgccgccgtttgtccacccggtgcaccgttcctaagccacgcgcacccgaaaccctagcgccgcaccccgcgtgcgccctccccaccgtgaacccaaccaccgccatgtgggtcccacgcggtggaccgcgtccacccgcgtcggcctctttctccccgcgccccctctctttggccgcccctcccgcgcccgcgccggcccattaggtctggccaagctgcataaacccctcgggccgcgcctaagccgcccgaggaagtctatatggcatccctccttcctttctttttcaagggatttaataaaccctttttcccctattccataaatcatttctctattccaaaatcccatgaatcattttccttggtctcgcacaccagtgacactcaataatattcttgagaatattatttctataaatttcaattaaacttccaaaatccatatctcccgatccgtaactccaattgaccccgttccacttccaataattccgtaaaattgagatctatttaatggcactattatttagtctaaataggatccttttcttggtcttttgtttaggtttttgattgtttgcgtatagattcgcgaagctctgtgaagaccctgagcaaggcaagccacctttgaacatcttgagcctatatttgaatttaattatattgcttgaaaaatattatgcattgataggattgcactcaatctgcttgccccgtctgcaaggcagattggcgggcctacctaacttgttgcatttgatccttccattgtgattgttatatcatgttcccttgtaaccatctagttgcgcctcgatattcgtgcactctgtgcgagtatcgacggtcgccttcaaacttaaaatttgagtaacttcttgggtaaatcttagtttacaaaaggattggaaaacccgacgcctgagtcggtgccttgtgaaagaaaatgagttttaaaaataaaactcgcgacacaaggccattcctgggcggaatgcatgtgtggtcgcatttaaggaccgattccttcggaattacatccgagcatacaatagtgcgaccacacgggtggaatgggacacccctggctgagtaaattgctaatcgggggagccttgatgccgagagacatgtggattcaacggggtggtgtcggggagaacccccgggcttcctggcatagtatggtctgggacctaacctgttgttggtctgggacccctctcgtcggcatatggcaaccctgtgtatgctctcgaaatgccttgtcatgaaagcccttaggtcaccagacgtggccattctgcacgggctgggtgattcgggttagtaatgtcgtgtgggtaaagtgtaacctctctgcagaggttaacaaactattcgaacagccgtgcccacggtcatgggcggatgtgaggtgattccttagcgtagtttttgttttaccctgttttatgaaaaggtgttaaggttagggaaacctaatgcttgggaagcaattagctgtccggaagacagcgggaccgggagtccctggaagtgattggtcgtttggggaccactattatcgggaagtttggaaaagttggtttggtttggaaaaaataaaccagatttgaaagatcttgataaataaatttgttacttctcaccccgaccgagctgagacttgtctcgctctagttgtggaaagcacacacttaaattgttgaaaatcttgaaaacaaaattgattgctaaattaaccagccttcccttgaagcttgcattaaccacctaagttcccatggcttgctgagtacgtaagtactcacccttgctctatataaatatagttctgccagctctgaagatgaagttgaagtgaagtaaagattagggtttgtcctagttccctgctgctgcctgtggtgttgggtgttagaccgttggttccgctgctgccgctgttgttggtgtttgcctcgtccgtgtcgtcggttgcattctcgggctgtctgagctgcaacctaagttaaggtaaataagtccactatttattttaaggattgcaatgattcatatttgtcaccgtgggtaccagcgctacatcctgggactggtactgagatcgcggtttcgtaggaagcggctcgcgctgtttttcctacgacacgctcctatcaggtgccgttgtacggcggtgctggattggggtgtgacacaggataagtaagccgaaccacacatacacgctagacgaaaagaagctaccagaacacatcaaggcgatgactcccgatgagaggaaatcttacatagcacaaaggcatcaggaaaaggtgctagatgtcgctatgtacatagctatggcgcttgaatctacgcaggacaaggagtgtgtttatgccccatatgcctttgagtaagttgtaatatgcactaagagtatatacatataatcatggctcgactaacaatttcgtttgcagtgaccatttgatagtctttcttctctatccaaagtacaatgaagtcaacgtcttggattctctcgataaagatagcaagacctatcaggaatttctaagaattatcgatctgtaagttatatattagcatgacgtgttttaatatatgacgaatgtaaattaattatatctacaaacagtgcatttaaaagaggtattatcagcgaggcggacaacgcaaaaactcaagagaacgcatattcgtcctcaataagtggccggtgggtacatatggatgccaaacagtgctacttaattttcataaatgcttgtgtgtttccatttaataacctaatataccttataattatttgatgttgaaagtgtcacaagcaaccggtgggaacaatactatgcggatattactgttgtgagttcctaagggttaatggg

SEQ ID NO: 76965 - DNA, 8031 bp, Oryza sativa
gatggagggcttggtggcgaaccctttggtctttgtcgctggcttcgcccaagcacttcaccctatggcttcgctaagaggcaggtgtctgtgaaatttcatttttgctttcctgggcagctgccttaagaggccagcggtggtaacacaactttcgcaggctaagatgccatgtataaaaatcggtttatatgcacatgcaactcagtaagggttgtacctccctggtgcaaaacacaattgctgcactatttgtagaaaacgataagaaacaaaagaataaattagcggtgatgctctaccaatttgggaagacgtttttttttttcaaaatgaagatctgaagaggaattgtatcctgatgcattaatataaattttaaaatatggaatgtttaatgcctctaacacacgttcacatcattgtcatgtgccatagctctttgctctttgaggtagccatgatcacctcaaacacttatcggatatgaagaaaacatcatcgttctagccaaataaataaagatgtaaaagtcaaactttttaaaaatagagcaagagtcctttaaacacatcagaacacattggcatcgattaaatatgataaatttagggcatataattttttggggaatgttcggtcgccacttcgcatacccttatcattgggtccacaatgctctttagattgtcgcccgtgtccatagcattttctaggcggacgttgttcgttaaatgtccacctgtgtgttgttgtttgttcatcttcctcaccccactgcttcaactacatcaacaacattggttgtaaagtgcatctaagctccctagtgggttttagctaattgatgacaaatggttaattgactaatgtgttcactactacaggaaagattttcctgaatgccatacccttttgtttccaggcagaccgtaagtgaaatcgcacaggaaaatagggggggaccggcgccaggccatcgcctgcacaggaaaatcaactttcgtgtgcaggtcagttaacaggcccgcacgtgaaaataaaatagcccaccctacatcaagtgctcgatatcccttcgcgccccttgcccctccgcccactaccccactacctccctctctcccacctcactctctcccactccactcctctcctcccactcctttcctctcctctcctctccctgccggccggcggcgacagcaggcggcggtgctcggccccttcctccctctccctcagttgcgggcgggaagaagggcggcggcgggtgaccacggcagcgcgtggcccctcctctccctccccttgcagatccggctacacgccgcccctcctctccctccccttgcagattcggcgaagaggaggcatgggggcccgacggatctggcagagcggcgagaggcggcgtgcggcggcgggagggaggcggcatgcgcccctcggcggtgagaggtggttggacaaaggcggcctgcgccccttggcggcgggaggtagtgggatagaggcggcccttggttcccctttccacttggtttcttttttgtcactgcattatttttcttttttttaagtaggggcaattgtgttcatatagtttaattattattttacacctgttttttagggtttgtgattttgcccctgctttttttaaatgaagcagccgtctacctctggttttgacggtagtttagtgggttcgaaatttccgaattaaacgaataaaaaaatgatattataatttgtgaatgacatcctacccttgtttcactaaaacagtcaaccacttgctggaagtgtaatttccccaatccaaaaccctagagcggcggcggcgacgcgcgagcacagagaaggggaggagcggcccgcgcgcggcagggagacgcagcgacccggtgggccaactgccgcggggccagcgcggcgcgcggcgcggcggagaggagcggcggcctcgcgcgcgcgcaggtaggcgtggtgcggcggacccgcgggcgcgcgtgcagggaggcgtggcggccccgcggccagcgcgcagggaggcgcggcgcagcggccatgcggccagcgcgcgcggagaggagcggtggctccgtcggctcctctctgttttatgcagttaagtaggtgcttctttttttttttttttttttttgacaataagtagctgcttcttcatctgcataaaagatgatagcattgagggaatttatgatactctttcagaatgtgctaccataagcaaatgtgctggtggaattggtgtctcaattcacaatattagagcttgaggcaagagtatggatatatttgtccattcaccacacacttaacacccttaccatgagttaaacagagtatgggcaagcggctgcttcattaaaaaaagcaagggcaaaatcacataccctaaaaaataagggtaaaatcacaattgaactgtaaaacaaggacaacaacacaattgccccttttagtaagtttatacacctaaaatttacacatctaaaatttatatacctaaattttatagagctaatgtttataagtcaaaattttatatagtcgattcaaattcaaattcgaatttaacttgtacaagttgtaaaaagtagcaaatataactatgaatgtacgatgattactttcagtttaatttgttaattttgttacaacttgtagaaattgaattttggcattgcattttgtggagtgatatatcacatattaacctatgttattattttttttcaacttgtagaataatatcaaatatatcactgcagtggaaggagcagtgacctccgtgggctagagaccatcccctctcacatccgttgactaagcccgtctctactcaatgcctagacatcgcagctcgccgccgccaccaagagagggcgagggaggcgcatcagcacgtgaggagctgatgaagatgatgccgacggctggttctcccatcttcactgcgtgcaggatgggggagcacacgatgaggtcgagggtgggaagtccgccatcagaatccaccgccgacgccatcgtacctccagctagcgccgcacgtccagatccggcacagactgccgccgagaggcgcggaccaccatcgtcccacggccgcacgccgcctcccgcccctcaaactgcctccgtaccgccgccgcacgccgcctaccgccagatccgacgcggactgccgccgtcccaccgccgcacctccagatccggcgcgggccgcctccctcccaccaccggccgccaccgggtcgctgcctcccctcccgccagatttggtggaggggagggccctgccatgttgcagctgtggtggatgaatggaggaggaggagaaggaaatgtggagaggatgagagaaggaaggagagaaggaagaagaagagagaggggaggggcggtggagacaggatggagagggagagagagaagtggataaggatggggcgagagaggagtggctcgtcttaggatgggtgtcggttttaactgaaaagtggcatctatttcttttgcctacaaagatgctggttatagggtaggtcccgtagttgggatagggactaaaatgccggttttagtttagaaccgacatctatatctaacaggggtaataggtatcggttttgtttaaaaaccgcgcaccttttaagtgataaaggctgacggttcttgctggtttggacgggactgaggggcaaggggcccccgcgggccagggggaggcactgtagcgtgcgtgattttaccacttcccacgacctatagagctgacttatattaactattctgcagtattaacaagtattattaactttagaggagtagggtatataaatgttatgtctgagtatttaagcacgcggcaggaatccatgccgtcgccgtgggccgtgcttctcctggacctgaaatggccagctggtgcgggattctattctcagatgaacgtcgtggagctgtgatggtggtgggacgttacgcggtcgggatcggatcgatcggcgctcagccccaccggacgacggcgacggcgcgcggcctccgagtcttggacgcacgcagggggacggcgacccgtttgtccgcgcccgcgtgcatgtacttgcagtgatttttcctcgtttctttccttcgattaccgtgaaagtttcgtacttcctctatttcataatataagtcattttaacaattttgacatatatactgatgttaataaatctagacaatgtaagtccatctaacatttttcatatttatattgatgttaataaatctggactgtatattgatgttaataaatctagacagtctagattcattaacatcaatataaatgtgaaaaatgctagaatgacttacattatgaaacggagagagtacaatacttactatgttctaatataaataacgtctttgattttttaaataatatttaactatttatttaaatattttaagtacatcagtgcatcaatctctgatttactggtagtattggctatatactgctcgtattgtggcagcagcatgaggcctgagcatgagcatatatactccttatgcctgattgaattgatgatgctattcttgctatctctgcacctttgagccaagctctgaacgagtggaaggatattgaacctatcaattttgatattggcttttctgtactgaagaatccagagtgttgtgggttgatctttgcgtccagccaccgaagtcacgtagtgatgaggtagttctcgtacaagcttcgtacgaatttcttcgtgtgtacagtagggctgaggggaaaaaacatagggcgagatttgtgggaccgatatggcgatcgaacatgcaactggctagacattgttacacaggaaagtatgattatagaaatggacgtttcagatttgtttacgtcaccataagtaaagttttctctcagatataaccgtgagatctaagacgtttattttttaatccaattataattttcagatttgcactacatttttttttccttatgattagcctactacacatacactatgggtagtcgtcatcggacattgggtgccggtgggactgtgggaggcacagtcccgtagcctgtaggtaaccataccgacatctcggccacggccgcacgccgacccagcgccttccggcctacggtcttctcccccattttctcatttcggtattttcgattgtttacactataattagactgttttatattttataaatttttaagaggaaatttatagatacatgtataaatagttactgctttcaaatgtttttctttgggaacgtgataaagattgaaaggcccaaaacgaatgtacccgaattcaaacaagagcgagagactttgggccatcgtagtgttctgatcttctggacttatggcccatataccaactgaattcaacaacagcacacttctctcccagtcccagcctccatcacccagtccacctccccacctccgccggccggcggggccatgactgcggcggcagccaagggagacggcaaatgcgccgccgccgccgcctcccctccggcaggatgaattgagcagtccgtcgatggatttcggtatttccagataaaaccctcaactcactgttttctctgtgcaacgagcatctcttgaggggaaaaaagaaggcgataatatcgtgaaattgggcgtctttttctgcgtgtgctccgaataggatgaattaggcaaccgctggtcgctttggctgctgtgctggctatatttggtttacttgtaatatttttgttccacttctttatcatttgggtatatgctgttcttgtgatgggcatatatgggcccaaaaccaaggttgcctcagatatgattcagtaatctactccgtagaatgtattccaggaaactattcactcgcaatgcaggagattgattgaatttttagcttaactctgattattcgtttgctcgtactgtcaagccaatagagtttctgttaagattatttgtccttcgtattttatcctgcacactatcatacatattttatggtgaccaaatttacaattctcatctagtactagtaatctgctcagttatgttttaggctggcaagtcacatctgaactctagaaattcaaaaggtattactaaatgttggaaatgaaccttcctcttcttttttaaggggaacaaagtgtatgagtttcctgtgatgggtgcctaaactaattagggtatgccatttacgtagagctgtatattgagccccttgtaagttgcataatgatgtaatgtgtttctttatgagtatttgcaaatgagcagctcccaatttaaatatggactaagtggcaactattctttcagaagaatacgtcttcatgtagagcagtagcctgtatgacaggggtaaaattatctgtgcttgttttttcattgatttttaaatttcttaatcgctaattaaatcactctttttttttaattttcaggtgatcatgaattttatctatcttggtgttggagcaggacttgtttcagcacttcgtaagtgtctatcttatgcaagaaaataggctatcttaaacatctatgtttgcatagaaatttattttatcttttgatatagaaattggagaataaaaatgtacaacgtgctactagtacttgcagttcttttgtcaggagctttttattggaaatattattagaaacaatgcttacttgattcattatgacaatttggtagaagtatcatgctggacaatcactggagagagacaggcagcacggattagggcgttgtatctcaaagcaatactgaggcaggatattgccttttttgacaaggaaatgaacactgggcaactagttgagaggatgtcaggagatgcattcctcattcaagatgccattggagaaaaggtaggcttgttttcagtgtgtaatctaattgattaaccaaaagtagttcttttgagaagttcagttacaatatttcctatacaattgatttggttttgtacaaatatttagtaactgaagaaagaagacccaacgaatcccttttaattgaaatttatgtagtcaattttctgtagcccatacccaattgcatgcatcatacatggtctatttaggagtttacagagccctaaaaagaatctaggagttcagagaaataacttggtttcatgtgtcacagtcaactgtgtgaatcgcacatacattgttctaactacataatatgagtttgtgcttgactcaagtaactctttggtcatgcatcatatatgttctatgtaggagtaaaaaatagtcaagatgcataatctttgcctgtatgcaagtggagacaaaaagacatattatatgtatcagcattataagttcaatgaatctttctttttttaaaaaaaaaatcccagttgatggattttccagaccataaatgcagttgggttcagtcaatgggaaatgcatatgtttaacttgccaagtactgcattatatttcattatcctgcttcaatgagaaatatgtacatgtactaattctctattagcatataataacatgtaaattttgttatacatgcgttgtctattaggctggcaagtgcatccaactgctttctactttctttggaggcttcattattgcgtttgtgagaggatggctgttggcacttgttatgctttcaagcattcctccagttgctgtggctggtgcaattatgtcaaggttgatggtaaaactgaccatccgcatgcaagcaaaatatggtgatgctggaatcgtggtcgaacaaaccattggggccattagaacagtgagtgatggccgactcttatatttggctataaaatctttgctatcgcgtgtatattgatcctgttctttttatcttcttttgctttgaaggttgttgcattcaatggtgagaagaaagctataaacacatataacaagttcataaaaaaggcata

SEQ ID NO: 76966 - DNA, 1958 bp, Oryza sativa
gacttaatattgatgagatatatatacatcatcgagtgatgcaagtcaactagtgtctattcgcttaattggtgactcatcagagcctgttcataacgggtactcccccgttctaaaatatagtaacatatgacttattcaagaactacgaatttagacatgctcggagtaataatagttattagtatcggtgcactgtacaatctacagtaaatggagaaagatatatcagggagaaagatatattgtcgttccaaaagctgacaccggtacttgctccgtattaattagtgtcagatcaagaaaaacgacactctactatactccctacgtttcataataaacgaatctatgaccatacgtgacatatttgatatattctagttctataagtctagagatatatacgttcagattcataatactaggatatgtcatatctgatactagttagttttcatagactgagggagtactggatgtgacacattatagtactgtctagattcgttgtactatgatatgttagatcaaattttaggttcattatttttttttgacggagacagtagattcttcccatgaacccatgaactggaatcaatatcaagtgcagttagttagtgactgcaagttaagcagtcatatccatttacagccgttggatcaaagttgatgaacggcagagagatatgccacgtcacaacctggctggcagagctaagtacatgccacagtgcgcaacaggactttatgtgcgtgctacagtaccctggccgaatctgagctgttcttatttgatctaacggtgaggcaacgactgctaaagttgcagtccctattacaactgcaggggatcctgatccgtaagaataaatctgaatataatgcacgtctagatacatcccttgggttaaactttatttttggcacaaagagtatcacttatgcacattgccactacaatcattgtccgtccgataagaaattaatggttccttttggcagatgtgtgggttctctgccataacactagatactgtatcattgattttcctcgacgtcacctcattttgttttcatgcggtccgtacgttgaaccgcatgaaaaaaatggagggaccagagccgggtcgtcgcccgcacaggaaaatcaattttcgtgtgcaggtcatttaacaggccgctcgaccttctcccctcctgacgctcgcgcgaggcggccgggagcggcagcgccctccccatgcccggatccggcggcggctgttgccccttgcccggatctggcggcggcggcagtcccccgtccggatttggcggcggtggcggtggggtgcccggatcttgggttagggtttccaattatttgaaattttatttttttttcggattttgattttcctgtgcgagcggcataagcggattttcgcgtgcgggtgcgccacccgcacgagaaaaacgtgattttttcagacggggcgttccagacaggcgtaaaaactgcacgcaaaaatcaaaataaccacacgcaaaaatagctattgtagtggtgagaggatggttatgattaatttgttggtccgacgggaaatggtccctggctgccgtgtgatactgcatatgtggcaagtggtgaaggaaatatttttaggcccgagcaaatttaaatatacctactatttgatacaagatttttaactttaaattaaattcaattgtgtatttgacggtgagccggacagctccttgtggtagccggacggtagctccgcccctatgtgtggcatattccaccaatagacactacaagaaactttaataccacaagatttatttctatggtataacaattttaaaattgttgtaatacataactattgccaagatgctgatgcaatgatttttttttctggcaaaaggctagttccgtggtggagttaactactcctacgcaa

SEQ ID NO: 76967 - DNA, 2031 bp, Oryza sativa
agagagagagagagagagagagagagagagagagagagagagagagagagagagagttttctccatttctaggttggattcattttagtcttgacacaaaggcagccggcacagaggcttcgtggttctactccaccgagctgcgcatgcacaccaccatgtcaccatgtttctgactgtactgtagcacctatatactcttgttaaattttagatttacttccatgtaattaaatgcttgaatattgtaagaactcatgaattgatctatgcagaatgaaacaagaaaaaacaatatggctgttctgtttgttaggcacaaaatgcacgatatggcagtatatatagaattttcaaaaccaaacattcacttgtacttatatattcagctaaatttaggttgagaaaaatgggcagatagttgacttaaaatctgcaacaaaatataattcagtgcatattcaacaaaatttctaacatgcaaccaaatatgtcatttctgtttaattgtatagacaaatactagcagtaaaaatttacaacccaactcttatatttacacagtcacaaacagttaactcaatctattaataatcactaactcaatccacactcgtaccataaaagcaaggtctaactcaattcataagcagtgtcaatcaaaatcataataacctggacaggtgaagtgtccacctatgtaggatgctctgttctttgtatgtagtaggtcagaactacacgaataacaaaacttcatgtcaatctccaattaaggctcactaatttcattgtctccaaattctaacccacctatgaatttaaaggttaggttagcaaaacaaataatgaatatagtcagtttgtgcaaaaagcattaaagaatattctcgccaactttatcttcttaatgtaacaagcagaaacatgtcggaaccatagtaccatcttcaggattcaactcagcatagaagagttcaccttcagaatcctcatgcattgcccttgcaataaagttaacatgtccaaatgaaccttcagcatctatgatatagcaactcttcgtagcttgtaccaactcatatttgatctagtttgtaatatgtgataacttgtagtccaattttacaattgaaatgtaaagagaaaacaagagatatggtccaagacaaatatattttattaaaatccagttgagtaataagataaggtgagaagacagtaaaacagtttgggtcaatgggaaaatgtgaaaatatgtgtattccacatattctatgcagtctataatcagtagagagacaaggagatgactaaacactttaaatatactaccttcagtcacaaagaagtgacatatactaccttcagtcacaaagaagtgacattttcaattagttcgattattaatcctcatgcgacatccccacgagggatgaaaatccttatccttgttaaaaggacggaagatttgttgactaatagattttttttagctgagtaatctattcaaaaaaggacgaaggatctttaataatagatataatcagaggctgaatcactattgattatttacccatacgatttttgtaaaatataaatacattataactcgtatgtaactacaatattttacttgtatgtagcttttacataattttacacccttagatttattttaagattcatgcaagttgggaagaaaaattcatagcacgacttatttattttactggtgaggactttcagtgtcactacttccgcttcgagaaaatagcttgttactgtaagattatctttaagttgtagtatagttatatacaagttacaaacttataatacaattacactataattatactatatctacaagttacaaacttttaggattcccaacctatattagattttgatatatctatagcgaaatatttcttttaattgcattgttgtcgaaagacaactgcatcacgtcgaacaatgtggttcactcaatgaattgatggattagtaaaagcaatatattaattg

SEQ ID NO: 76968 - DNA, 1324 bp, Oryza sativa
tcctgcagccctaggttaattggatccgtgctattgcaaaattgcctattgtgaaaaatgccattacaatttgtctattcgtagccgtgccattacaaaattagaactgtgccaccaccgtcacgttttccatgcatcttcttccttctccgtcttcttccttctttctcctcttgtatcgtgggcggcggggctgtggcgcgctgccgcgctggggatgtgggcacggccatggagcagccccggtgggatggtgccggtggggatgttgccgctgaggttgacgtagcggaggttggggtgcttcacgagtgacggtggtatggggcagagggcgagcgcggcagtggtgggctttgctggctcggcaacctcgggcggccctgccgccaccgacgaggaggtggccgggagtgggcgggcgggaggcgcgatggctccacctcctcttccaccgctttcctcctgcgcagatctagctgccactccgccctacatgtgcggatccggcggcggtgctgcggatctggcacgggcgatggtgggaggcgcggcgggtgagagggaggtgcggcggctccacctcctcctccactgcctttcttctgcgcggatctagccgccgctccgccccacgcgggcagatccgacaatgtcgcatcagatctagcgcgggtgacggtggaaggcgcggtggcgggcaacggttgtctcggtgctgccgccatcgaggcggtggccaggagcgggctggcgggaggcgtggctccgtcagctcgctgagcaccgacggcacgcgtgcggcgtcgtcggggaggtagaaaagggctagctcagtgatgctgccagactccttggagcagaagacggcgggctcccaggtgctgcaattggtcgatggctgcttgacagggtcgcccagctacgcggggcggcgaggacggaaagaaggaagaagaagcgagaagggcttggccggcatcggaggaggaaagaagacgggagaaagaaggaataagatggaaaagggaggagttggatggaaaatgtaacggtagtggcacggttctaattttgtaaaattttaatggcactgctacgaatagacgaattgtagtggtatttttctgaataggcaaatttgcaacatcatatatccaattaaccctttaaaaataggggaaagccataaagtgtatgtgtaaccaccacctaaactggaattcctgagtgatagtccatagtagcaccagtgaaattttttgtttccatccttggcttgacttttagaagatgtcatattcggctattcaagatattttca

SEQ ID NO: 76969 - DNA, 4429 bp, Oryza sativa
cctgcagcctgtttaaatccgcaagcagttttattacacggaaaggaattaataagagacatgctatatacgtatattgtcccgatcgaccagctacttattcaaaccctttggatgcttgatgatgacatcaaacggctcgtcatcaaagcaaccggaaggctggggatccatctgtatctcgtcgtcgttgttcaatgagacgacgcaggtcgtcgggagcatggcgatgcggtggtgcagctcggccaagaagaagcggggagccgcctccgccgcgccggcgccggcggccctggcgaagaagctgacgtggaagtggaaggcgccgcggcagtccatgaagccgctcgccgtggcggaggcggcgacgagctcgtacttggcctcgttggcggcgtcgccgttgtagtgcttcagcgcgcactccgcgaggtattccgcgtgcttctcatccatggcgtcgtcgtcggcgtcgaagtcgaagtcgaagtagaagtcgtcgtccgcggcgacgtcgacggtgctcgcgaaggtgatcaagctgtccgtggtgtgatcggcatggtcgtcggagagaggagacgtgggcagcagcgtcggcgatgccggtggcgatgtcggcggcggcgacggctgtgccggggaataaggcggcgacagtggcagaggacaaaactgctcctcctccccgaggtcgtggatgtcgtccgcttcttcgcacggcacgtagtatctcaccgccggtggcatcggcatgactgtctctcggaaagagagcggaaatcgattgatcgatcggcttgcggtatagcagcgagaaaatgcagcagctagctagcagcgcacgcaccgtcggccgtctccgcgcggcgcctgattatatggagtggcgcgcgtcgactccgattcgatcgaatccgactcggagtaatagcctggatcgatatcggcaaatgcggcacattcggaggggggattcgagtcggaacaggaagacggtggcgcgcgacatccgagctggagcgtgacgctcggccgcatggcctcgcgatgtcgcctccatgagtccatccaaatctgattaggcttttttccttaaaaaaaaatcttattaggttagctaattactccattacatccactatgacacttgatacgtacacaagctagcaagccaacttgcacgtttctttccaacgttagagcagggaaaatcactacctaaaaatgattttttttacgagcatcctaataggttgagttccgcatctgcaaaaatcgactctaatttttctatatgacttaaaaaatatgtatgcaaaaatcaaattttccaaattgaccacttaaaatatccgcacgcaaagggctcttactcgcccgcatgcaaaaataggagaatgattaggatcagtcgacgggggaggtgggaaaatcggtcgttccccctcctcccacgtgcgcacccccactggatccacccacttgtccctcccctttccatagaagatgtttcatctagtgtacttacaatgtttcactatatatagatctaatgttgcagtgaattaaaatattcttttgcaacaaatcacccgcatattttggaaacccactattaagagaatttggtttattttttgttccacaaaaaatgttttaccgagtgtactcacaatgtttcactatgtatagatctaatattgcagtgaactgaagtattccattgcaacaaaaaaaacccacatattttggaaacccccaagtaagggaattcgtttcatttttttccaccgaaaaatgtttcacctagtgtatttataatgtttcactatgtatagatcaaatgttgcagtgaactgaaacattctttcgctatttgctgaaacattgtttttatataaggtgaaataacacccgatttaaacgagtgaaacatttttgaatacttagtgaaacaattccgatatacctggtggaacatcgtgcaacatttaaaaataattcaataataagctaaaaaaatttcgtcggaatatatccaggtgtggtcttgttttgaagatttaattacaatgaatttaatggtgcaatcggatcatgatttgaataagtaatttaagagaaaaatcagtttaaagtagttttacacgtaaattgggcgctgacatcagcgcccgattttaacctcctcccatcgggcggctaagtcggagtcacgtcctgcaaaaatacctccagaaaattcccacttttttttttatttattatccactctctctctctctcctcccatcaccccactcctctcctggctatctctttctcccactcctctcacccacttctctcccctctcctccctcccagcggcggcgtgcaaagacgacaacttcctcttctcccccactcctcctctccccgctccttcctcccgatagcggggaagggtgtattcatcccttaaggggatctttcatgcatatgctatctaaatagtcatcaaaaaaataaaaataaattgacaagatagattaatacgaaatatatcactccacgaatatgtaagttaaaatttaacttgtacaagttgtaacaaaaataacaaatataactacaaatgtattataactatttttagtttaattttttccttttgttacaacttatagaaatcgaatttagccttgcatgtttgtggagtgatatattttatattaattagttgtcatttttttcaaaatttttataactatttagatggcatgcatgtaatgagagttcatccccacggggaatgaaaatccaaatctgttagagcagacgtgtagtcaaaaggacagatgatcgagcccggtgtaagcctgtaatagagctaatactctaatagagtctagtgcgagtctctaacagacttatggctggatgaaagctataatttcatctcataccttgtgtgaacacttgttagctaagtaatcaatttccctttgtaaaaaaaaggacggaggatctttaataatagatataatccgaagctcaatcactattgattatttacccatacaatttttgtaaaatgtaaatatattataattgtagtgtaattatattgtgattatttacctatacaatttttataaaaatgtaaatatattataacttgcatgtagctatagtattacttgtatgcaactttcacataattttacaccgttggatttactttaagattcatgcaaattgggaagaaaaaatcatagcacgcactgatgaggactttcggtgtcatgatatccgcttcgagaaaatagcttgtaactgtaagatttttgaagttgtagtatagatataaacaagttataaacccataatgcaattacaatgtaattatactatatttacaagttacaaacttttaggattcccaacctatgttagattttgctatatctatagcgacatattttcttttcaatcacatagtacactttatgatagtcctgatatcattgtacccatcgtgaaagttactaagaaccaagattttttagataatggaatgaaataacatctcggcctttgctcaaaaaagctacagccaattattacaaactagcactctgtaagagtgtagtccaaatgaaagcaaacacaccaaccaaaaaaaataccaagataagagcatgattccatattttcccatcgatgcgtgcaagttaaaataccattgtataagacaatttatctaagaaataacatcaccatgcattagggttccgtcaatttcactccgttagcctaagtagtttttttttcatcttcctctcatccatcggtcattttctctcgtctacgagtaaaggggaggagagtaacaaagaggacacagagttgagctaggcggtagggcggtggttgctgatagcccgcagaaggaagagattcgtggtgatggcatgttgcaaggaggatccacaggatgggaggggcttaggcgatgaagaccatggggcaagcggcaacatcatggagttgaataacaactgggaatggagatctaggctacgacagtgaggggaaaaatagatggcggtgggctggccgataaaggagaggtgagacacacttgtagaaaaatgatttttgcaggcctctccccttaatttcatagggagagaaaaaatacaaaacacatgctttaggcttacggtggtagtgtgtgtgtgtgtgtgtgtgtgtgtgtgtgtgtggtgatggtggtgggaggaggggggtggcgggtttgagaggatggcaacaacactggttgatccagagcagctagccctgcgagccagtttaagttgtggggtggtggagtgggcttgggtggtgatgggatggcgcggtggtccgacgatggtcgttgtgtaagatggttgtg

SEQ ID NO: 76970 - DNA, 4084 bp, Oryza sativa
ttcctgcagccccagagcagggcgagggatcgcgatgggagtcgggaggacttcttcttatgtaggagtagtaccaggagtaggaaggagttgggctggctggcaatctacccgtcgcttttggaagggtccgactcttctgttcgaggaggagaagaaggcgacgaagccgagaaggggaaacgggcgaggagagggagagagagacgttgctgttaaccgcatgcgcaaagctgtcaccccgcgtggcagcgtacgccgctacttgatggagttggagtttaccttgggttaggttgggttggggttcgcttcgctgcgtgggagacgtggcggcgaagcgtggccgccgcccgcacgcgagacgccggcttcgtctcgggggcgtgggtgggaaacgggaagcgggggtggtggtccaccaccggagcaggtaaagaacaaagaaaacggacacgatatgcaacgtcagggcctcaggggggcgcagcgcagcgcaggtgcgcccttttttttcacttttgttactgctaatctggtccagatgcaaaacgggagttggagttttgtgtactgacatttttcggggtttttttttcctactagggctctaggagtaccatatggcagtgagattttgcttgcgtgtggatgtaatgagtcgtaggttctgtttttaggtgagcggtgtttcctctgtagttggtacaagggtacagcatcagccccgtttgtagcactatgtttgtgttaccaccaaatgaccagattgactaccagcacaatttcaacgtgcaatagatgtacagcagtagcacttgaccgcttaggcagctcctaattacgtagtaagagtagtaacatcttacgcaaaatagcactgattttaagtgcggtgcatatcaagagccggaacggatcggcagggaataaagtccacacgagaacggtgacagcctcgctagtaaccaccggacacttattaccagaaagagatgtttagtccgtgaccaccgatccatcaatgttttgtggtgtagtactacgtactggtagggtaggaggggtactgctagaatcgtacgtacattgttgcagaaaagattgctcgcaagtgacaaacagaaaccggcgttgtcaatagttgctccataagctataccccacggctttttcactaacacccttgtaagtactaatttttccatataaacctacttgattttgtgtaaatgatcccactaaaatatcaatcaatcactaaaatatcaatcagtaatactcctcaatcagtgataattgatctcacggggtgctggctctgtcattggttatcaaactggtgcgaaatgggagtatgcgtgcgtgtggttgccgtgccgacacgtacgctgagaattctcacgtcgatggaacgaactattttaatctagaatccaatccggacgggcgtcgcgtcaccatccggatacagtacggcctgtcggcaaaacacatgtttttttgtccgtgtgaccgtgtcggcacaccgtacctcagctgcccaaccaaaacaaccggtatcgcctcgccctcgcctctgcacgctcgtcaaacgccttgagttgacatatactactccataggagtagagtaatgcagtataacgtgcgggacgcggccgcctccaccggatgcgacgcggacgcctcgtgaaaatgggacggcggcgcgagaaaacgggaggtttcgccggccaacgaggcaacgacccacccgctccagatgttgcgccagcgctgcgcccacgagaccgaccacgaatcctttgcttccggctgcggcctgcggcgttctgacgtccgatcgcgggggttcggttgatttctcggtttctgcttttaacggctgcatggttctggagtctgtctgtacttcacctggattctgttctgtaggtgtacgttctactacggagtactagctgcttcgacatgttgacttcagttaattttaccggcgcattgtgtagggcgtgcatatagtaatagtactagcacatgtcgggaggattatatacagtacttgagacaacgtgcggccggctcgttgacatgtcaaagattttgtgtgcatgtgctaaaaagtgtgcatacccgttcgtgctcctcgaattgacatgtgcatcggcattatattagtggcacccgttcttttctccaataaaaattggaggaagaattaaattttcgttgtacgtttttcaaactgctaaacgatgtgttttgtgtaaaaaatttatatataaaagttgctctaaaatatcatattaatctatttttcaagtttgtagtgattaaaacacaatcaattatacattaataccacctcgttatgcataaaaataataatcttcatcttcaggagaaaagaacaccaccttagtgccctatttagatcccacctcaaaatttttcaccttgtcacatcgaacgtttgaacacctgcattaagtattaaatatagactaaaaataactaattacacagattgcgactaatttatgagacaaatcttttaaacctagactgtgtttagttcacgctgaagtttggaagtttggttgaaattggtacgatgtgatagaaaaattatttgtgtatgaaaagtttgatgtgatggaaagttggaagtttgaaaaaaaaactttggaactaaacagggccctaattgttccatgatttgacaatgtggtgctacaataaacatttgctaatgacggattaattaggcttaataaattcttcttgcggtttactgattgattctataattagttttttattagtgctcgaacaccccatgcgacataataaccgatgtgacacgccaaaactttacacctatggatcaacaccccctaagtatgctttcacagggctaaatttgttcccacccctaggttaaataatcgtttgctgaggccatgttctaaagtagaggtcagcttggctactttttttttaactaccagatggtgtgttttataaataaataaataaatatatatatagaagttgctttaaaaaaatcaaatgaaaccattttgtatttattttaataattaatacttaattaatcatatgctaatcatgtttctcattatgcgtgaggctaatcaaccctttccaatctctatttagaatgcaccctaatttttttagtttgttaaaacaattggtgaatagccaatataatcccaaaagttttaccaaaggccctattttgacttacaattatcattgaacccacttgatgtaccacacggccgatcctaatcatcatttgtattagcaaatgtccattttacccttaatttacatatactagaaagaaaaaaatgaataaaaattttatagatgtagtactttccattatctcaacctgcatatgggggttgtgttttaatgtctatcgtatacttataagaaaatgtattattaaaacttttttaaaaagcgcaatgtagttattgaacgtatgtctaaaaattaggtttataggggttctcgttatgtaggcattttttcttatacatgtgaaaaggggtataacagccatttaattaatcaagagaggtgttgattagatttagccatctgactttctaggtgggttaaagatgagtttaaagtgaaacaagaacttgaagaaataaaatagacgaattgaaatatcaagaatcaaattgagaggcttagatgaacttgaaagactaatctacaattcttcgtaccagaaaatgtcagtataaaaaacactgaacattagtctatactttatttacgcccataatcatccgcaatctaacattttcattgttaggctaactgcaaacactggacctagctaattaattatattctcctacttccgtcttataatataatacatcttacccttttaattaatttgtcccataattgtattaggctatgtttagttccttccaaagttggaagtttaggttgaaattggtacggtatgattgaaaagttgtgtgtgtatgacatgttgatgtgatggaaaaagttagaagtttgaa

SEQ ID NO: 76971 - DNA, 1450 bp, Oryza sativa
cctgcagccccgcagttgtgcgtcattgttagacataataaaaaaaagagaaagtaaaaaagaaggaacaaaggagagaactcacagggcagccgctgaccaaacagagcgctcatcgccattgatgtggtgttttgtggctaggacatcatgtctagaggcctcgagtgccaggaccagggtgaacttttctcagaactactctctcacaaaatcaatactaataggtctcactgcctcttctaaaggtggttacccaaaagtcatgaatccatcatggataagcagtcctaaacccatagaaaatcaacacggtattgcaacggcgatagctaattcgcgtgtgtgttgcggcgtgcgttttaggcccataaggcccacagcgctagtgcgtgcggatggcgtccacgtccatattttttttcacggaaaagctaacgtacgcgtttttcccgtttctttttcccctttttcagcgattttttatttagaagttgaatctttcatctctaatttctgctgaaagttttgaatttgagttgaaagtttttaagatttgagtcgaaagtttttaagttttgagatgaaagttttcaaatttgagttgaacgtttttgaatctgagatgaaagtttttaattctgagttgagatttttcaactctttagttgaaagtttttaagatttgagatgaaagtttttcaaatttgagttgaatgtttttgtatctaatacgaaagattttaaatctaagttgaaagttttcaaatctttagttgacagttttcaaatctttagttgaaagtttttaaatttgagttgaaagtttttaaatcttgacttgaattttttcaaatcggacttgaaaattatcaaaatcaagatttggaagcttcaaaatatgagttgaaaatttttaaatttaagttgaaagtattcaaatcttgacttgaaaatttttaaatatgagggtttcaatctagacttgatagttttcaaatcttagttaaaatgtttccaaatcttgaataaatctgattcgaaagtttgtttcaatcaactaaacaaagggaagaaacagacacatgatgaattcttattgaaaaaaaagaaacaagaaaaaacagcgctaagtgctattagtggaaaaaagacgctaagtgctcttagggctgcgaatgtgagcgccgcgtccgttcctagcgcttaagcgccgaacaggaaccccgtagtgcaacatggataagtagtgcgttagctcacctattggggaagtcaacacacagtttgtataggtctgtgaaaattgtattacacaaatggtggcttcacatggcctatttttataggcagacctttttagtggccatctagaaaatcaatttttacatgtcagattaaaccacctgtgaatttttctagcccacctgtgaaaatagatacctcacat

SEQ ID NO: 76972 - DNA, 740 bp, Oryza sativa
gtgccattgcgttgttcttatcaatttttgctttgttgagttctgcgttacatcgtcgaatcgagttgctggtcttagcgtctagtccgtttagagttttgagttctagtcatgttttgttccacaatcgtcgccgccatcatgtctctattgtcgtcgggacctaagaaaacggaatcggcttgctgccacggttctatttttgtagttttcagaagttttttgtcggtcagttttggagttgcatctaggttttgcttaagtttctggtttgcccgtgaatagatcggccgtgcttgttgccggcgtagagaggaggaggaagaatttccaaatctgtttttggaagtacgagagtttaatttggaaagaaatagtagatcagattgattgaaaatcagtttctctttttcctagtggtgccgtatccatccacacgtcgcccaccaccaccgtgaggagtccgaccccctccctctcctctcggtttcggtttcggtttcaatgcataccgtgagttgctagacaccttggtgaatttttgtttggtgtcagtttcgtgatctgtttggaaaaacggaaccagtataaatttagcattccattttttgtataattttaattttcggtttggaacttttccatttgacttcctgtaatttttttatttatatttgagtccctgtaatcgtgcattgaggtccttgagttgtttttgcagaaaaaaaagaaagtaagaa

SEQ ID NO: 76973 - DNA, 933 bp, Oryza sativa
cttctttgttaattccctgcatcatacccctattccggtatgacttgctgagtacagtgggtagtactcagtcttgctctacttttcccaaccccagaggacgggtatgtgtcagatgaaggtttccccgaggagtaggcttcgtccgtgccgtcgaggatgcctgtggagtggtgttcccgctgcagtttagtcagggcttagctccagttaccttttgttttccgctgcatttttgtaagacttttatgacgtttgtaagacgtggatctgaatgtcaacattgtcgtttgtgtaccccggctggtcctggacggggattttaatgcacattctgcttggaattctattcgggaatttctgggcgtgacaatcggcccggccgccacggtggcacaatgtcagcgccagtcccgttggcgctgacacggccaacctcagcgccaatgcgcttggcgctgagccgacggcctagttttggttgaagtttttggcaggggttagtttcgaaataagtttttgaaaagggtcaatttgtcaaaaaaaacggttcttactagacataactctagaatgagcgtataatggtgtaaataataaaaatattatgatctatcatgtgaaaatgatattaatatttttttcatatgaagaaatggtattgaaccatatatagttttactagttctcctaaacatataagaagaaaaatctaacaaaatatataagtaacgggtattgataacaacaagcaaaaaaaaggttatgtttggatgtaaaaaaaggttaggaagcggtaacatgcaaggataatactcaacttagttggattcttcgctacctgtcacttggcggccatacaacatatatcataccatatactttagttttcaattcaacatttaatatatttaaatatactgaaaaaatgcc

SEQ ID NO: 76974 - DNA, 14892 bp, Oryza sativa
gtcatgcatgcaactaatcaagcgaatcactaattaaacatctttttttcccaaagaaattaaatcgatccataaacagagataattaaccttgtgcaggaactcatcctgggcgccgatggcgtagaggatgccgacgacggcggtctggttctgggtgttgagatgcaccatgtgcagctccatgtcgtacctccggccatcgacggcgtgctccgacggcgcgtgccagtgcacctgccggagccggtacgccgtgccgttaatcaccagcccgccggcggcggcggcgtcatcgccgccgtcgaacctgaccatgatgtcgtggccacggttgacgacggtggcgttggcgtttcggtaggtgtagttgaggtcgccgaggccgggggccagggtgaggtcgaggaggccgaggttgatcggcgactgcatctcgccgctgctgcaggtggcccattccggcttcaggctgccccagttctccggccccctcggtgtgccggggatgtagccgaactgatcgtcttcctcggctccggcggccggcgccaggagcaggagggtgacgacggcggtgacgacgacgacgaggaggcgtgcgcgatgcatgtttgcgtttcgttgtgtgctgtgcagagtgctggctagctagctagctgatctctctggggttggccatggcagcttaggcttgtaggggtatttatccagtggagagtttaaggtagagtatagggctagctacgtggaggatgcatgcatggatgacaagttggaattttggttgcgttgtctctctgatcgactctgatcagctgatagaagtaggtgtacagagtacagagtacagactacttcatccgtttttaaaaaaattagatgtgatatatccatactaagtttatttattttggaacgaaaaagctagacacatgtacttatagcacactactacaaaatcaaaattctcagacaagacccctttaaggtgtaggcaagccaaaattgctctcacttgaaaaatcactttcccgaacgcggttcaagaattgcattgtaggtctcttaagatgacttcttagtaagaggtccatatgccaccggcccacaagatcaagcccatccttaaattatcaagtctcccctctctctcctcattctctccatcctccacttactctccacctctcctctcctcctcctctccgccggtggcacgcgagtgcgatcaatgctggagggatccggcagtggacgggagcagccgatgaccacttcatctgacagtaggcaggaacaggaaggggcatgagcttggtggcggaggatctgacaaaaggttgctcggagatgggggatccagtggtggggagcacagcggcaacggatccggcagtagggagcggcggctgccgcggtggatccaacggtgggtaggggtggacgaaaaactcgtggcttgttagctcactcgactcgtgaccaacttgacttggcttgactcgtgaccaactcgactaggctcgacttggctcgttgcgtttttctaacaagccgagctggtgttttagcttgttcgaaataacaagctagcttaagctggctcacgtgcaaaatgagctgaggcctggagtatacatccaacacatcaaaccagagctcaccaccaacgagccccgatgggaagcacatcagcagtggatccggtgatgcggagctcagtggaggtggatccgatgggctctccccctcccatacgcatggatcagaggcggcgatgggagtgggggagggcatttgcgacagcgaggacaaaccctgagcacgagagcggtgacagccaccggcacgggagctgctaggattttggattattttttgtgggaatttttttttgcagtcagacggcttaagcacccacatgaagtttcgcatgcgtttgttctacccacatgtagaagtactgattttagaagacacttgggtacagacagaccatccaagtgctcgtgaaaatcggttttgaccgtataaatgaaaaaattgtttctctagtagtgacagtggtgcaaaggtacgatacagctagccttctccagttgtgtgcatcagtgcatggatgcgtacgttccggcaactacgtactgatcgaacgctggcaagtcatgtggcaatgacatgcatgtcactccaaagcactggtacggaactacgactcaaggcggatcggagctggagcgagatggagggagggtgccacttgcttaatttactctgatttatatcaaatttaagctaatgcgggtgtctaaatttgtattgtgggggatgcacacatggtgaaaatatgtcaggtatagctacaattttttctttactgggttcctgggcacccctcaatactctagctctgcccctgatgacccgtgaccgcacatatgccttgggtaaatgtgtaccattattgatgactttctgatatcaaaagtaagatgatccatgattatagatggcaaaacgggtcgtttggccacgcacggctcaggcatgactgggcttggcccaacctacatgccgggccgggccgagctcacccacttgctggaccaatggtccaggcacggcctaataagacttgggctgtgccgagctggctcgaggaacaaaagcctattgtgctccttcttggaaaaagtctattttgcctccctcatctttgggccgtctcgaaatggctgtaataagtctattttgcatcattcatctctttgggtcatacctttatatggatggaataagtctagtttggctccttcagctatttggctccctaatctttggaccgtgccgaggcagagtcctaggcacgggcccacggtcgtgctgtgctgtgcctaggccgggccaaaatctcgtgctatagaccgggccagcgggccttgggccttttggccaactttattcatcatgtgtacctatctggtcacgtctattccctagttcagatatatggacatatataacacgatagaggtgtgggtacttacgtacaacagtacgtagtttgcatggtacgtgctagccttctccagttgtttgcatggatgtgtttttcagtcaccggtggaaagccgcaactattggtgatcaataccaagttggcttgtatataatcattcatttctgatcttaggatttattctcagtgtgtttatcattttcgagttgaagccgtgattatttatagacttatcggtctataaatatcgcgatggcaagtcgccaagtcggctattcatctatcctcacaaaatatatcattaatatagtgatagagttgtggctacatacacaacctaatttaacattctcgagttgtcctataaccatgatgagctccagccatcggttaaagccacaattttttcaacgatccatggcaagtaatcaattatgcattaatttccccttagaaaatatccccattgtggtggtacaattgtggttatacatagctaagtataatttcactcccaaggttcaaatatgaatatctatcgtgttcacatggttgactttcagtaagaattttgtacgagtctaaaaaaaaacaattttgtaagggtcattcaactagggtgtgtttagttcacgttaaaattgaaagtttggttgaaattaaaacgatatgacggaaaagttgaaagtttgtgtgtgtaagaaaattttgatgtgatggaaaagttgaaagtttgaaaaaaaaagtttggaactaaactcggcctagaattttaagggtactactgcttacatgattttttttttatttagagtagctactgcttctgcgttcatctcatacatatgatctctgaccacctccatattccatagcctggttgcaacatgggtaagatccgagacaaacataggtggatcattggactgcgggcacagcggcatcattttaaagtgcctgtcaagtagtcgagagcacagacccaaatttgtaaaaaaaaaacaaacaaaggtatagttggttcacattataaaccagctacaatttaatgataatttgtatatcagtgttggttcatgttatgaacaggccctacgccagatccttacacctctgacgggatacctgtgacgggcaaacgaattggtcagtagtgaccattacctttgacgggttatacgggatgccgtcaccggtgaggcatctggccgcggcccgtcacaggtatcccctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagaggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgtactgttcacaaatcggttgggagggcaaggggggcgattttttgctaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgttatgcgtgttggaactcatgaagcttaaggctagtaatggctggtcggacaagagttttacagaactccttgagttgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtggggcatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtacagtggaggacaatcgataggatttaccaggaattctcaaatgacccaagaaacatgcgtttcgcaatgtgtacggacggcattaatccttttggtgatttgagcagtcgtcacagtacatggccagttctgcttgttaactataaccttcctccctggttgtgtttcaaaagaaagtacattatgcttgccatgctcattcaaggaccgagacaacctggcaacgatatcgatgtgttccttgaaccgataatcgatgacttcgaaaggctatggaatgagggcacacgaacatgggacgcatatgcacaagagtatttcaacctccatgcgatgctgttttgtaccatcaacgattatccggcccttggcaacctttctggccaaactgtgaaagggaaatgggcgtgttcggagtgtatggaggaaacaagaagcaaatggttgaagcattcacacaagacggtctacatgggtcacaggagatttctcccaaggtatcacccgtataggaatatgagaaagaatttcaatggacacagagatacagccggacccccgacagagctaacagggacagaggtgcacaacttagtgatgggaataaccaacgagtttggaaaaaagaggaaagttggaaagcgaaaagagaagagcacatcgaaggaaaaaacagaggagcatgtggaaaaacaaaagacaaaagagaggagcatgtggaaaaagaagtcaatattctggagactaccatactggaaggatcttgaagttcgccactgcatagatttgatgcatgtcgagaagaatgtatgcgagagtttaatgggattactacttaacccaggtactacaaaggatggtctcaacgcccgacgagatctggaagatatgggtgttcggtcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactgcaagatcttaagttggttggaatgaagtcgcatgattgccacgttcttatcacacagctgttgcccgttgcaataaggaatattttgcctcctaaggtgcgacacacgatccagcggttgtgttccttcttccatgcaatcggccagaagatcattgatcccgagggactagatgaactacaggcagaacttgtgagaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctggggatccttaagggttatgtacggaaccgttcacaccccgaggggagtatcatcgagagttacaccaccgaagaggccatcgaattttgcgtggactacatgtcagaaacatcttcaattggattaccacgatctcatcacgaagggaggcttgacggtgttggtactgttggaagaaagactattaggttggatcgtaaggtgtacgataaagctcatttcacggtactacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgcctagtgaaacacttcagtggttgtcacagggtcctgaatggagtgccaccacctggcaaggatatgacataaatggatacacctttcacacggtcaagcaagacagcaaatgcacagtgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatgtaaaagttgacaatgaagctttcaccactgtcaacttggctaacaacgcgtacaaggatgaaccgttcgttctcgccaaacaagttgttcaagtgttctacatagttgacccgtgtaacaagaaactacatgttgttcgtgaagggaaaaggagaattgttggattggacaatattgcagacgaggatgattacaaccagcacgtccatggcataggtcaagaaatacctctagaagaggaggaggaagaagatgaagttcaatatgcacgtgtcgaccatgaggaaggattatttttgtaatttatgtacgtagtttatgtctacatgtctgttatctgtatgactctaatatgttcggaatgatcaatagtatattgcttatgaaatagtcaaataaaataattaagtgaaacacccactagaagtgaaataaaataattaagcaagtattagcattggaaataatataattaaagtagtataataatgaagtgcaattactactgttaatgaaataaaataattaagtataaaaaaatatgtagtgtatgtgaaaatatgttaaggaaaataaaagaactaagtgaaataaaataaaataaaattgctctaggcaaactcacctgtgacgggctctatctgtagggccgtcacaggtgacctcacctgtgacggcccagagtgctgggcccgtcacaggtggtcttacctgtgacggctccacggttggcgcccgtcacaggtgaggccacctgtgacggccacatagttggagcccgtcacaggtgagtttgactagggttgacctagggttggacatcttctagatcgatccagatccggcgcccactctcactcactcactctctcgaccgccgcctcgcctctctcgacctctctgccgccctctacgccctcctctccaccgccgcctcgacctctccaccgacgccggcctgcaccaccgccgccgcactcactctctcgaccgccgccatccatatccaccgccatctccgccgccatccagaccctcctcgccgccgccctctctgccgccatctccgccctctccgccgccctcgccgcctccttctccaccgccgcctcctcactcactctctcgaccgccgccgtcctctccaccgccatctccaccgtcgccgcctcaacctctcctccgccctctccgccgccatctctgccgtcctctccaccgccatctccgccgccgcctccaccgccgccctcgccgccggtcgtcctctccgccgtccgtccatcgacttccccgacctccccgaccctgacctccccgacgccgggatccccgaccaccgccgaccgcctcgacctcttcgccactgcctctccgccgccgccaccaggatccaggacgactacggcctgcgccgccgtctccaagtacgccgcttctccaagtatgccgccaccctcccccattcctccttttttccgatggatgaattgcattgtttagatgaatgaaatgtgatttgttgtttcgattattggtgctgctgtatagatgaattaaatgtgatttgttgtctgtggatgttttggatgaatgtaggggctagattttatatacatgattttggtgcagtgaatcttagcatcaatagaggatcttagcatgaatttttaatgcattttgttttctataattctttgataattaaggacctttattaggtgtagggtttgaaatctagttacaagggaagaattgatagattggccgcagatttaatgtagttccgaggttatcaaaccatcacagaatacaaaatgcatggggaattttggtggataggccagtgtagtccatggacggaaccgacctagacaccaaaattctccatgcattttgttttctgtcataatttgatgattaaggaggctttgcagattatctaaacttgttgatttatataccctttttgtctatgaataggtcaattgtatgaattgttgtttatatacatgatttatatacccttgctgctgctgccacaatgattgtgggctgttttattatctagacttgcttgaattgaatggatgaattgctgtttacatgaagttagtagtactgtctccttttttatctacacccctgctactgcccctacacttgttcacttgttccttattaaatggccagtgtagagtggttatatacctctacacttgttctttttttatgcataagaacagattttgtgcacttgctctttttttatgcataagaacagattttctgcacttgctcttttcttctggattgataaatggccagtgatgaattgctcaataagaacagattatctacacttgttcatttttttatctattcttctttttgcccctgttgtggctcaataagtaatgaattgctcaataagaatagtttatctgtacccttattgtgggctgttttttaaatttgcatgattgactcagtggttatatacctctacacttgttctttatggataagaacagagtatctacacttgttctttttttatgcataagaacagatttgctcttttgatgttatgatttcctctttttatcccttcatgcaaatgaatataattgatgcatatttctgagcaaaactgaggccatatctttcatagtataccccgtattacatgattttggtgcagtgaatcttgaatgtggatttaagtgcaactgctgctgtctatgtttgcccttgctgtctatgtttgcccatgctgctgcctatggttgcaactgttagttaagtgcaacttgaatgtggttttaagtgccatttggacatataaccattcatggagtgtgtactgctatatatgttgctagacctattgaattttgtggacttgcatttatactcctcctgctgctgttttatgtcaatcatgcaaattctgtacccttgctgctgctgttttttaaattttcatgattgattcagtggttatatacctctacacttgttctttttttatgcataagaacagattttgtgcactctctctttttttatgcataagaacagattttctgcacttgttcatttttttatctacaataatatatgcatgatttatataccactgctgttgttgcccctgtacttcttgttaaatggccaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgctgtttatgtgaatttccaccctactgttgctgtttatgtgaatctccccttgctgttgctgcccctgtggcatatatacccctactgctgttatatggccctgctactgctcttattgctgctattatatggccatgctgttgctactactctaatttcctgcacttgctcttttccttatggataagaacagatgaactacacttgttctattttattgataagaacagatgaactacacttgttctattttctttgggttgcttttttctcctagtagctgatttcctctttttatcccttcatgcaaatgattgtaattgatgcatatttctcagcaaaactgaggccatatcttttatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgagacaagtgcaagtaggtctagtagaaatccgcggtcacaaaatatatggccgaccacagtgcaagttataagagaggttgacgctagtggtaggcccacggcgcccaggactgtcattggcagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtatgtcaacccgcccggcaatcatacgccgttcgatgaataccctcaaataaccgaagcggtgtgggaggaattctgctctctcaagaccacccaagagtttagggaatccagcgaggcacatcgcgtactgcaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttgggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtgctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattgttgttatccgatccatatctaataaaagacatttacacattccaatattaaattcaaactttcaccttatgcagggcgcagcacagtgtgtcctactagcgagagtccacccaactttcgctcctgaagtcgctgagggcatggctttcaagccctcggttactgacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcctaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgaggcaaggggaaggtcggggagttggcgccggagccaaaaaggggcaaggctgcgacgtcgatgccggtgagcaaatcggggaaggtcgtgagggcgccatcccaatttgagctaggcatgccattggtggaggacaatgtgttagctgtgatgggtattgcttgccgagagctacataagcaatacatggagctaagcaatgccaagcggaaaatgagagagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacaacagagctccactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaagaacgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaattgtgtgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatattgtactattcatctgttttctccttttttttc

SEQ ID NO: 76975 - DNA, 15907 bp, Oryza sativa
ttgtaaattgttgctttgtaaaggatctgtgatatgtgatgcatctgtgatgttgggcagttggggaatatgtgatatggagggggggtgactggcacctgtgatgtttctgtttttcagagggcatggctagcaattcctgaggctagccaatatttagcatttattttttttctggaattaactcatcagtgacggttcggaagaaacatccgtcacaggtaacctcacctgtgacggactcgcaaacgtcggaccgtcacaggtgacccacctgtgacgggcttttactttcgggcccgtcacaggtgggtcaccctgtgacggctactatataccggagatcatcacctctgacgggcctttatttaggggctcgtcagagatgagacacctgtgacgggtcctaacaagccctagtctagcttagaccaacacctctgacggccttctattaacttgcccgtcagaggtggatgtcaccactgacggccggccacccgtcaaaggtgactggacttaccagtgaccactgatcattgaccaagcccaaaaccgtcaaaggtgagggtttgggcccgtcacaggtgaccttgaccagtgtagtgaggtagttataaccatacactaatacagtgttatacgaaggtaatatgtattggcactattcttaaacatctgcatttacgataaattatatttatttattatgatagctttaaaaaatgacatatttacgacttttcaataatgtacatagtctttactttcaaaaaaaggcgacgacttacctcacaccaccacttcaaaagtaccatatatatatagaaaatattggcctatccatcgcgagcaatttggactaagccatgtactttgcaatacaataagttttaactgatcattattgcacgatcgttaatgaagttgcataaacgtgagctagctattcaacaagagtacttagcggtttttagccgcatgcatcctattgatagaaaaaaggttatggatcatgcatgctaatgcacacaggaagagacgagagatcagaccatgcatacatgcttggtacattcgtatgtcggtcttcttactacccttttttttgacaaattgacccttttggaaaacttatttcgaaactaacccctgccaaaaacttcaaccaaaaataggccgtcgcctcagcgccaaacacattggcgctgacgttggccgtgtcagcgccaacgggactggctctgacattgtgccaccgtggcggccgggccgatccccagctgacgtggcagctgcctcagcgccaaccggactggcgctgaggtgggacttggccgcaaccccaaggcccagaccagcaagccttctggatggcttgcgggctgggacctcagcgccagccataatggcgctgaccgtgggacactcagcgccagcccacctggcgctgaggtgggacttggccgtttcggccttggcccagcccagcaagccttctggatggctgggctgggacctcagcgccaggtgcactggcgctgagtttggacatgtcagcgccatttagcatggcgctgacgtcccagccctgctaaactttagcaaaactttgcacacaacacaggcaaacatcaaatcacaaaaatttacaggcagtaatatatccagagaaccatacaatacatacatccatccatcaatcccaacatcattccatacatccatagaatccatcaatacatccatatatgaagtccatacatataagaaataaaaacatcccatcgatcctcgtctatacatccagtcgagtccatacatccagtccatacatccatcgaaccatgcatcaagtccatccatctatccatccatccattgaaccatgcactcacctcctcctacctctagtgcgaggatgaggcatgtcgggggtgtacctccagtcctgcgaaggagcccgccggcgtcgtggtcgagacgggccgggctgcgagatatccggctgtgacgactctggtgcgtcctctagctgcgagggaccgagctcaaccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcgccattcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcatgtgggaccgtcggttggctgagcctttgtatgctttgtccatatcgttcttcaaccttcttgtccttcttcttcctcgtgtgttgttctgtaacgacaagtcgggcacgaagaactctccatcataacttggccactgcgatggatctaggtaaggttcaaacctaggggagtacgagtcctgcacagccttattggaagcttcataacacattcggggggccacctccacatccaaacctcgcaacttacaaacggttatcatgtgggagcatggcaagtgatggagctgagggaactgacaactacatgtgttatctctcgcaaccacgacgtagtgacgtccaccccattgaaccccagccgccgtgactccgccttgctcgctgacctcatacttcatcgaagggaaatcaaaacatgctgccctttgccccaaggttcgtctttgctgctcctccaacatgtccttaacttttgtgggccacttctttccacacaggatatctacagttgcctctttgtgtctatcgacaaaccaactattgcacttcgaaaatgtgtatgccacaatagctgtaaccggcagtttccgaatgcctctcaatacattattgaaactctcggccatattactagtcatgatgctatgacgacgcccgttggtatcaaatgctcttgcccatttgaccttaagtggcatatggtcttctagccacttctttggcctctctccgaccacacccatgaggcgtttgatctcatctaggaacaatgctttctcatttatttgacatatgcgctcaagatctttcatctgatcagtcgtagctccagctgtgtagaagttagcacagaagtgcctcatgcaccacctgtggtgaatggttaggtgatgaggcatgatgtggatgatggagttcaaaatgccagggtgtctatcagaaattatacacacttctctattaggaccgatcaacttgtttctcaacatgttgatgaaccactcccagttggatgtattctccttctctaccagagcaaacgccaagggaacaagatgtaacccggcgtcgacccctattgccgtgagcaatgtaccttggtatttaccggttaagaaagtgccatcaattgctagcaccggcctcaagtgcttgaatgcttctatggactggccaaatatccaatatgcacgtccaaatactcgcctctgtactccatccaccatcctggacttctcgggatgagcctcaacacggaaatgcatggtagggttctttgctttgatggcacgcatcagtgtaggcaagcgaacatacgcctcgtcccaatctccccaaagaccttcatagcaacttgcttagcacgccatgctttgccatacgtaggccgatagtgccatatttgctcaactgcctcgacaatcgctgctggagataaagttggttcagctcgcacaaatgcctgtaacctgtttccaataaaccttgaagtaagttgcaaatgcttgccggttacttccgcactacagcatgtgtggtcttcgcccaccctagtcacccgccacctatttcctccacttttccttgcattaatctgccatttgcaatggcgatcgagacaagccacagtatactttactgacgcgttagattccttcacatggtacggccggtggacacggatagaataactctgtagccatattttcagatcatccatcgatcgaaactccaaccccttccttggttcatcacacattggttcgaaggcaccgtcatattgtggatccccatcagcaattgctagcccagatctggtaagatcctcgaattatgttatttccgggtttctacccaccagtttcgcaaacacagtcctttcatgctctgacatcttacgcactggacgatcatcatcggagtcggaagcggactcatccaattcatcctctgtatcatactccaaccagcctgggttcaatccactgcgtatcatagcctcctcacactcctctcgggtatagaatttcagcctagccaactcccttaggcccatacttacattcttagcattcgcttcttcctcaggcaactccacatcatctcctacctcccgaccatccttaacatctccttcctctcttaccggcacattctcctccacattaacttcctcccttaacggcacattgtcctctgcatgtacttcttcccttaacggcacattctcctctgcatgtacttcctcctttaccgggtcattctcttccctgacctccacatccgccatatcatttactccctcgcccccctccacgtcttcctcaatcaattcttccttcctactacacctctccgacagttcgtgacagctaatggatgattctatgagtggactttcattaaggtctataagttctttcttccctatcctaccatctttcttccatgcaaacacctcaagagatttgaaatgtgaccccaatactatatctatatatgtttgccattcgatctctccattcaagtctaacataaatttatgtgacatgacaccgccgcccacatcgtatctcccttgcataccaaccgactcatcattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaatttttaacccatgcataaacattaattacttgaaaataatatgtaattaccattgcaataccaatacttcaaaagctaacaacatgtctaatttttccaataaataagtacattactcaaatactacacattattgataaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtgaaatgtatcaataacaaccaaatggataaagatatgccacctccacacttcatccccacccatattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgcggtggcgaccgaaccctaggcgggcggctggggaaaaaatggaggaagaactagctggggcggcctcggccgggctctaagtagccaaggtcagcgccaacttacttggctctgaggttgggcacctcagcgccgaagcagttggcgctgagtagctgccacgtcagctaggggatcggtgtcacaccccgaagttttcctcccaagccaaaattgtaattttcaaatgaccccaagaaaatgcaggtaaaatcaggagaaaaccctaagaaagtaatgcaaataataatcggacttgacatgtggaatttttcttgagttctacatgtcaaaattcattaacaggatttttagtggaattttcagagctctagaaataattttaaccaattaaaattgagcaagcaatattttattccagggaaaatcctttttcctttttctttttctttttcctctctttttcctcctttttgtcaaatgggccgtcggcccatttctccttttcttccccccccctctctgttgggccggccgcaggccgaggcccagcccggcagccggccgcccgcctccctccctcccggggtcgccgacaggtgggacccacctgtcagacccgtctcccacctcccgccgatcccggcgcgccgccgcgcccgcaaccgtcgccgcgcccacgcctccgccttccccgggccacgtcggccacgtccgcgcgtgcgccgcgctctccgcgcccattcccctctctctcccgctcgcgcccgctcccgagatggccgggattcgaaaaccgaatcccgcctctctctcctccccactcccccgcgtcggcggcgattcccgccgctcccggccacgtccggttccctctccccctatttaagcatcgccggcaccccctctcgctttttccccatttcgccgacctctcccgagctccccatcgctcccgcgccgtgcaaacacccgccgccgccgtttttgctacttcggccgccgctagccgccgctaggctcgccgccgtcttgcgccgtcgtcgccgttagcttcgcgcggccgaggtccacctcgtccacccctcctccgtcgaggttcgtcgccggagccctcatccccacgcgcacgggtgagcaccatctctaccgccgctttcggcctcggatgccggtcgccgttgtccatctccctctctctaatccctctcttctccttccttagggcacgccgaagctcgtccgccggtcgccgtcgcctcccgtggcctgccgtcgccgttcgccatcgtcttcctccgcgccggccaccctcggtgaggcatctcctctcctctccttccccgtttccccgtgcgtcgccgccacccgcgctcgccgtcgctttgggtcgttgccgccgtccgctgccgccgcttttgcgtcgcctccgccgccgggtgccgtcgccggcaacccgttcgcgcgcgcgccgtcgccgtcgccgcggccggtcggccggtcttgagccgggtcgcgccgagtgccgccgccccttcctttccctctcccgcgccactgacctgtgggtcccgcgtgccaacgcctcctctctcctccccgtgtcgctgaccggtgggccccgcatgtcggcgccgcgccacctgtgctgacgtcagccctggttaatattgcgcaataaattatttaaggatttttggttatagtaataaacacagtgaatcttctaaaattcataactaattcatccgagctccgtttaatcccattcaagtctcagtaaatcaaggaaaatgtgtagaatccattaaaaatggttttgttctctgtttcagtagtcttatagcctgtttgcaatgtttgctttgtatgtcgttagattccgatccctccgacgctccggtgtacttcgagatagtcgccgaggtccctccagcagcagagcaaggcaagtcatgcttgtcacttgatcatattgatcctatattgcaaatgtcctaatgttttctttcaaataccgcatttgttttgcaatattactatgggatggttacctattgttacagccatgctattttgataccatgctcctttgttagcttgggtcataacatgattagagttaggactagggtttgcttagccatgcttagttcaactagcacacaatggggagatctcatttaaaacctagactataggtttatatgataatgttggattagtaccaccgctctggtgttggttaattaaaatgaatcacatggtgggctgtgggtgcatggttttgctggtcgcacccatgacagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaatggtcctgtcacggcctctttccggtatgtcgtggtggcatgtcggcgcacggaaacgtgtcgtggggctgtgtcttgtgggtacagttgtacacctctgatcagagtaaaactattcgaatagccgcgcccgcggttatgggcggtcaaccagattcaccgtgattagtctcaccctagtgtaatctgatgaatttggatagtttaggtggatggttgggcctgtcgcaacgtgggttagcgttggacagcggatgtttaatactgcttaattattacaaccgttttcgcattcaattcctgtttataaatgccagtatttatgcaaatgaaccactctagctcttctttgttaattccctgcatcatacccctattccggtatgacttgctgagtacagtgggtagtactcagtcttgctctacttttcccaaccccagaggacgggtatgtgtcagatgaaggtttcctcgaggagtaggcttcgtccgtgccgtcgaggatgcctgtggagtggtgttcccgctgcagtttagtcagggcttagctccagttaccttttgttttccgctgcatttttgtaagacttttatgacgtttgtaagacgtggatctgaatgtcaacattgtcgtttgtgtaccccggctggtcctggacggggattttaatgcacattctgcttggaattctattcgggaatttctgggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcgagggaaaaatcttgtcgcttgtttaagtgagattttttcaaaacaagtcagtttagggttttagtaaaattattgggatttattcgtcagtcagttggggtttgatgggtgaaatgcattaggtcctagctctataacatgggttgcaaggtatttatgctttgtttgttattattaaatatgtatctaatttcccattattttgtcgttatgtgagtatgtcttatttattcgctctcatgcaaaatgatctatgcataaaattccgctcttattcgattctcttatttgagtctttaattgctttatttaaatttggatttgagcatgcattgatcctactcctttgtcttctctagatggccggtcacccacccaaccaccgcggagaaggcatgatcgactttgtggcagagctggcacgcatgacactggtggtgggctaccccaacgcgccggagtacacgaccattccgccgctcagtggcgagcttcctcaccgtgtccgcttggaggtccatggctacgtggggacttgccttgctaacatggcggttgaggcgtcagggggcacagcagatcacgcttgtcaggaggcagcctacttgatgatggccagactacgggagcgccacgactacatcttccacgacacggcgtaccgctaccacccccgtcgagcccatggtgatggcgtcagctccttccgtccgacagctggcgagaacgacaccacctttggtcacatgtgtgctgtgatgaggggattggacaggatgcactcggacctgcacaaggcgaccaaggccttgaacgatgggaagctcatgaggatcgtcgctctgaaggacgagatagcgcgcctgaagaaggagaacgctcagctaaagggtcttccagcgccaggaggagtccggatccgcaccacgccccgcaagacgacgactgcacctgtgcgcatccagcttgcgcccaggaacccacctccaccagcagctcccgcagcaccttcagttccgcccgcagttcctgcagctccagttccagctcccgcgttcactctctccttcgctccagcatcagccgccagaggttcagccagtggtaccggaggttggctgtctgctactcccagtggcagcggcgagactgatctgtcaggctccaggagtcgctcagagggaccgggtgacgagcaggaggacgctttcgactccaccgaccgcaggagccgttccgagcattaggctcgtttttcccactagtttatcgatggtctagcttctggttgttagtttgcgtgtttaggctgcttgtttggggtcagttgacggttgatatcatgtgcctatgatatggctgtcttaataaggatgtttgcttgctcttttaagtgtttttaattcagatcagaacaattgcagttttaattcctttgtaataaagcttagttcttgagcatctgtttttcttcttttcccccatctgcttttccctccagatggtctacaccaggactggcaaccgcacgacaggcgagggcagcaacggcgaagaacgcgtggatggtgtgcaccccaacagtgattctggcaatggtccgccaccacttcccgagaatccgacgcttgcccaagttatggcacatcagactcagatgatggcagccatgatgcagcagatgcagcagcagcaccagcagatgcaccaaaggatgatgcagcacgccgaacagcagcaccagcagtttggtccccctccccctcagtccaagttgccagagtttctacgcgtcaggccacccaccttctccagcaccaccaaccccatggaggcgaacgactggctccatgccatagagaagaagctgaatctcctgcagtgcaatgatcaggagaaggtcgctttcgccacacaccagcttcagggtcccgcgtcagcttggtgggacaaccacatggccacccgcccaccgggtactgaagtcacatgggcagagttctgccgtagcttcaggaaggcacaggtgccagatggggtcgtggcacaaaagaagagggaattccgggcgctccatcagggcaaccggactgtgacagagtacctccacgagttcaatcgcctcgcgcgatatgcaccagaggatgtccgcaccgacgccgagaagcaggagaagttcatggcgggtttggatgatgagctgaccaaccaactgatatctggggactacgctgactttgagaggctggtcgacaaggcaatccgccaggaggatcaacgcaacaagatggacaggaagaggaaggccgctcagttcagggcacctcagggaagtcaccagaggccgcgcttcactcccgggcagcagggtggacctaccaccatgatcgtccgtcagcaccgcccgttcaaccctagcaacttccaccagggcactagtggcagtcagaaccaccatggaagtcagcccaaccgcggtacagctccacgcccaccaatggcaccggcacagtcaggccagcccgcgcaagccaagaaggagactggagcaaaaccagggtcctgcttcaactgtggcgagcttggtcacttcgctgacaaatgcccgaagcccaggcgtgccgggccaaggtttatccaggctcgtgtcaaccacgcgtctgcagaggaggcacaaacagcaccggaggtcgtactgggtacgttccctgttaacttaatccctgcaacagtacttttcgattctggtgcaacgcattctttcatttcaaagaaatttgtggggaggtatgggttaaggaaagaagagcttagcacaccaatgagggttcataccccgggaaatagttcaacctcagtcagttttagcccctcagtgctaatagaaatccaaagatcaccatttctagccaacctcattcttcttgaatccaaagacctagatgtcattcttgggatggattggctgactaagttcaagggagtcattgattgtgcgaatcgcacagtcaccttgaccaacgagaagggagaaacagtggtgtacaaatctctagtctcaccaaagcaaggggtctccttgaaccaggtcgagatggaagttccagtggacaccgtagagaagaacttgaggaaattggaagatatacccatagtctgcgagtatccagaagtgttccccgaagacctcactaccatgccacccaagagagagattgaattccggattgacttggcaccgggaaccgctccaatctataagagaccatacagaatggcggccaacgaattagcagaggtcaagaagcaagttgatgagcagctgcagaaagggtacatacgaccaagcacttcaccttggggcgctccggtcatttttgtggagaaaaaggataagacgaagaggatgtgcgttgattatcgcgcactcaacgaggtcacaatcaagaataaatatcctttgccgcgaatcgacgatttatttgatcaactgaaaggagctaaagtattttctaagatagacctgcgatcaggctaccaccagctgagaatccgggaagaggatattccgaagacggccttcaccactcggtacgggctatatgagtgcacggttatgtctttcggacttaccaacgcacccgcattcttcatgaatctgatgaacaaagtgttcatggaatttctggacaagtttgttgtggtattcatcgacgacatacttatctactcaaaatccgaggaagaacatgagcaacatctccgtctggtactcgaaaagttgaaggagcaccagctatacgccaagttcagcaagtgtgacttctggttgacggaagtcaaatttctgggtcatgtcattacagctcagggtgtggcagtcgacccatcgaacgtggagtcagttaccaaatggaccccacctaagaccgtgtcgcagattcggagttttcttggacttgcgggttattaccgccgattcatcgaaaatttctccaggatcgcccgacccatgactcagttgcttaagaaggatgagaagtttaaatggacagctgagtgcgataagagctttgaggagctcaagaagaaattagtatccgcaccggttttgatcctgcccgaccagatgaaagacttccaagtctattgtgatgcatcccgtcacggacttggatgtgtcctaatgcaagagggcagagtggttgcatatgcctcgcggcagttgcgtccacacgaaggaaattatccaactcatgacttggaattggcagcagtggttcatgctttgaagatctggaggcactatctgattggcaaccgctgcgaagtatatacggaccataagagtctgaaatacatcttcacccaaccggacctaaatctccgacaacgaagatggttggaactaatcaaagactatgacatgagtattcactaccacccgggtaaagccaatgtggtggcagacgctttaagccggaaaagttactgcactgccctatgcatcgagggcatgtgtgaggaattgcggcaggagtttgaacatctcaacatgggaattgttgaacacgggtttgtagccgctctggaggcacggcccactctcgtggatcaagtcagagcagctcaagtaaatgattctgagatagcagagctgaaaaagaatatgagagtcggaaaagcccgggatttccacgaagatgagcatggcacaatctggatgggagaaagattgtgtgtacctgacgacaaggaactgaaggatctgatactcaccgaggctcatcagacccagtactccattcatccaggcagcactaaaatgtatcaagacctcaaagaaaaattttggtgggtcagcatgaggagagaaatagctgaattcgtcgcactctgcgatgtttgccaacgagtgaaggcagagcaccaaagaccagcaggtttactccaacctcttcaaatcccggaatggaaatgggaggagattggaatggactttataacaggactgccccggacatcatcgggtcacgattcaatctgggtagtcgtggatcgactcaccaaggtggctcactttataccagtacataccacctatacgggaaagagattggcagaattgtacctcgcaaagatcatgtgtttgcatggggtacccaggaagatagtatccgaccgaggtagtcagttcacctcaaagttttggcagaaactgcaggaagaattggggacccgtttaaacttcagcacggcttatcacccgcaaactgatggtcagaccgagcgagtcaatcaaatcttggaagatatgttgagagcttgcgctcttgattttggtggagcttgggacaaaagcttgccatatgcggaattctcgtacaacaacagctaccaggccagtctacagatggcaccgtttgaagctttatacggccggaagtgccgcacacctctcttctgggatcagacaggcgaacgtcaactgttcggaacagaagtattagcggaagcagaagagaaagtcaaatcatcagggaaaggttgaggattgctcagtctcgacagaagagctacgcggataaccgtcgaagggagctcacttttgaggcaggagattacgtgtatcttcgtgtcactccgctccggggagtacaccgttttcagacgaaaggcaagttggcaccacgcttcgtgggaccatacaaaatcttggaacgaaggggagaagttgcttatcagctagaacttccatccaacatgatcggcatccatgacgtgttccacgtgtctcaattaaagaagtgtttaagggtacctgaagaacaggctgattcggaacacattgatatccaggaggacctaacttatgtggagaagccggttcgcatacttgataccagcgaaaggagaaccagaaacaaggttacccggttttgccgagttcagtggagtcatcattcggaagaggaagcaacctgggaaagggaagatgagttgaaagccgcccatccgcacctcttcaccagctcctctgaatctcggggccgagattccgtttaaggggggtaggtttgtcacaccccgaagttttcctcccaagccaaaattgtaattttcaaatgaccccaagaaaatgcaggtaaaatcaggagaaaaccctaagaaagtaatgcaaataataatcggacttgacatgtagaatttttcttgagttctacatgtcaaaattcattaacaggatttttagtggaattttcagagctctagaaataattttaaccaattaaaattgagcaagcaatattttattccagggaaaatcctttttcctttttctttttctttttcctctctttttcctcctttttgtcaaatgggccgtcggcccatttctccttttcttcccccccctctctgttgggccggccgcaggccgaggcccagcccggcagccggccgcccgcctccctccctcccggggtcgccgacaggtgggacccacctgtcagacccgtttcccacctcccgccgatcccggcgcgccgccgcgcccgcaaccgtcgccgcgcccacg

SEQ ID NO: 76976 - DNA, 6432 bp, Oryza sativa
agaatgtagaagaaaaaagtagtaaatcaaatgtaaagtttatgaacttgtctatttagggcattaggtgctcaaagatatactttggcttggtaggttccatgacttgcttgctcctcaaagtggtacattaatggataagttgtgagattggtagattgccaaaacattttcataatagaggaaaaataagatgcaaaaaacagtattgcttagcatcaaccattcaatggacagatttcagcaagtactggatcaggtgtatagaacagactttagctgcactagaacatcaagttattgatggccacaggcaacaaagcaggtgcaaaagcacaactgatataatgctaattaatttcattctagcaagtttcagttgtatttccaaaagaaagcaagaatgaaatgttaacaaacaataaatttgcaatgactggaaattcacaaattatgtgccaaaatatataacagaaatacatctgtaaagagtgcacagtgcagcaggactaaaccccttcatagcatccaagccatgttttcaattctttaacagtaagttcaagttcaaccgtgatttcatgcatacatttcctcagtttcattcggtaggaaaaagcctctgttacctctgcatgatatttatcttgaagcttacttaaagccttaaaggacaactgaccctatgatatcttgaaaggatttgatcatcaaaagttaacaaaaatatattttatcattttttttctgcaataacattccttgcaagttgcaacccacacagaagtctaatttattacatggcagtagcacttaaatcatatattggatgatgataagatcataaagccatgttctgaaaatccaatactagaaaagcagtatgtggtaagctttcaactgaaaaaaaaaattgaggaacaactgataataattattgcagaagaaagagataaatgcacgtacatttcaatcaaaggcttcagaaatggagctgccttctcaatcccttcaatatttgcaagggactgaacaaatgcaatcgggagcacataaaagaagttcaggaagaagaatgcaaccgcaattatcagcctcctaattgtcaggtaaacaaaaggaatagagaggttatcccaatagacatcacgaggttctggggcccactcggtcaaccagacagttggattactggtttgctgtgtctgagcacacactgctgctccccaccgcgatcggaaggaaacaaaggctgctggcacaactgattttggatccttcataatctttccacgttcatcagtttcctaaatatcatttataagaagttaatccggtggtttatggtactggggaaatccttttaacatgtgaaacacaacattcaacttatacagtgctaattactaataaaagctaacacatatttgccaatattgatggatgcaaagacaagaaagaaagacactatttgcttcagtaaaatagcaagaagctttacttttgttaagacactatatgaagtcaactgtagtattttgaaataacactagactcaaagcagaataatgcattaggaggcacagcacaaagatattatgacttacttccttttctatcctctcaatttcagatgtgtagtattcaatagcatccacctttgaaccaaaacatccaagaaaaccagtctggaaaagaagtatagaaaaataagaagaataaataaggaatcataaataaaaattattcttttttgttttgataaaaacaacaagaactgtgtaagagaagtaaagagattaacatgatcaaatttagcaacaacctttgtagtaggcctttgagatgtatttctttcatatttcagctgatagtaatcaagccaattctgcattttcttcttctctttgaccatcttatcaagcttatttgcattatagacaacctataccagtccatgaaatgaatgataagaacatggtagtggtaagccatatcagagcatagattttttttttttagtaacgataagcagttaaaactaaggaatcaaacagaactacatttgattgcagaaagataaaaaggaaaggcatatatgaaagaagttaatggcatataactattcacatgacttcgctatgaactttgaactgaccagacagaaagatccagtgaagcataaataccagactgtaaaatataaatattacctggtgcgtaagataatggtcaggatggtttacaaggaagaaatgttccacaagctcaccaattgattcatcaggatcaggcggtatattccgcacaaggacctaaaaatcaacattggtcaattagtatatcattgctcttcagtcataatcagttacaaaatcttccttcaccagaggctttccaattttaaagatgagttctcccaccaacctatcttggttagccacattcagcttagttaaatatctggatagaaccaggtacttgcaagttcaaaagtcacattaaaaattatacccagttggcagttgaaactattggtgccctaactaattcgtcttttcttttggatagaaatccatttcttagagcatctataagaataaacagtgcaaacatacctaacaattttcattttacagaatgagcagtatacagcaagcattcaataatgatacttttatggttttgatgtcaacaactcaatgtccataacatttcaagaatagtggttttcatgattatcttttttatcagctgatattttacattattcaagttcccacgtagtccctcaatcactatccatgaggtgaagcttttttgtcttccatagatgtgtaaaaagacttaagtggcattattagattcattgtgaaatgaacactgttagtgacatgacatgctatgaactaagtagaattggaaggcacattagaaagaaaatatcaagtaatataaattgaactgccaaatgcatagagttcacaagatcataccgtgaactgatctgggcggcgcttctctgatgcaagaaagcgcagacgcattgttgccactatttcatactcccgtaacagcacatagcatgtccaaaatgtgaaaacataagccatggtcaggtgagctgcgaacctgcattaaaaaaaagtcacaggcatagtgaacactaaaacaatagtttcagagttgatgaacagggtatcctgcaagactaatgtgctgcctggaaggctaatatcaactataaccactcacctacttatctatggcaagatcaaacctttgcgactatttgtctaattactattacaaagtatcacaccaaactgacacaacaagctaggttaaaattaatggccttcagaattgcacaccccacacatgcaagctactaccgtttctgactcccagctcatgtattatcacagaggctgggtggttgttcatactgcatggtcatctctatacatcttcggatcttcatgactttcctaagcccaaatggggaaagaaagtaagagcaatcatcattccacttaccatttgaaccaaccccatactcactatcttaaattgtgtttgaagtaatctatcaggcatgcccatattttagccaaagatggtacacaacattaacagtaatatgtaggtatattactatattttaagacagaaaaattatctggtactaacctctttgaccctacaggtatgttggatattgaaagtttgtcaatatcactgtgctgcaccttcgagctttgaagggtaatattggtccaattaacaggcacaagaataataaatgctagaactgtgattggagcaaatattttaagcctgcaacagttaatagtaaaggagattagtgtaaaagtattggcagagaaaagtaacagagatgggagatacccagtggataaaacagaaacattcaacaaaacaacattttcggtactagaagtacacttctacatatgtaagaaatggagaaatagcaacgatttagaatccataaaaatataagacaattaaaatgaatagtatgtaaatattagaatatggtccaacactaaagcccttcccttctgtcaagaagaaaacctgaaagctaaacccccccccccccctcccttaaatatatgtctgacctaaagtataattgacgacttaaaaagttagcagaatttatgaatataaattgcataccctattaagtagatccgcagatagacagctgaatcaaggcctgcatggctaattaactcatcctctggcattttgagagcagcaggcatccaacttaagaccttcaagtatgatcgcatgtccaaattgacaaacttccgcacaaatgcacccccatgacttggactctctcttgcacctttgagataccactttgggaagtaaaccctatcgttgatgggctgtagtcgcaggaaagcaaacgctagcaggaaagtgatggcactcagtatgttgatagctgcagagacacctatatcttgaatagtagccatatttgtccttcaaataacttgcgagaattactacagatgctagctgaaagatgtaagaaaacaatactacggttacagggaacaaacttttatgttaaacaaactataaaattagtgaacaaaatagcaaaacaatgtgacatgttgagtggggaacacaaccacacaatgtaaagaggggtatagccaccaatcttggaaatttcatatcatacattaagttctagtttgattcatagtatgattcccatataagcacaggcttgaatcgaggtttaactccacaattatgttcaacccttttagcaccaagatcatgtaaaataggtatgtaattccaagatatgttttgtttgaatccattatcctatatcaatggtgactgcctcaattgttttcttcagcacaaaggtatgttttgtgtgaattccagtatcgcatcaataacggcagaccaaattgattttttttagcacaaagacaacaagcagatctaacagatgaaaatgcccatttaaaaatactgattcaggggttaatattgtcaagaggatcgcaagacattgataagatactttcagagtttcgcatggtataacgtacattaactcgagcataggtgcagcaatcctatctgactgacagctacagaaaggaagtaaatgttgattttattcctaaaattatatttgacaaccagaagagaaaccactaatattcccatcatatcagctctgcgatgctcaatggattaggctgatacgaactttggacctccagcattttttttaaaaaagaactatatgagctgcaacaggactggaattatggatggttagatataatccaacagtccttataattagtattattgtagcacatgtgcgagtaagaaaacaaaatttggttttaggtgcagaatatcagccgtgtgatcgggacaggccaaaagatcacaacttgggtataaattcattgaattgaaaaaacgtccgcttgaagcctaaagctttcctaaaaacaaaatcttgaaacgccagcctagaaaagtaatttaaatttaaaaacggcaggcatttaaaggtagcattaagcaggcaggtttcttactaactttaatttgccaactggacgaaaaaaatcataagatcattactactagtagtataatggtagccaaagccatatcttctaccattatttaatttgtgaaattgacagcgaaaaagcaaaagaaaattgcggtggaagccaaagccagttcatctggtagtagtactattttgtgctaacagttgggatttagcacatgaacagttaaacaagaaagacaataatcttagattagttgcggtaatagtactctactttgtcatatcagaaaataaaagaactctactcctactactttgcagcagagtcccaaaggggagagcttttccgagtggcatacagcaaaatttccctattttgtttgcaaaaacaaaacaaaaaagattcgtttcccccataaaaatcggaaggacaccaacaaaatgtttctcttcttggactcccccgtaagaatagctgaaaaaaagttttaagacaacagaagtaaagcaaagtcgtatagcgctatagccgcatggtcacccatggaggaaacggattgaaacaatcaccaaaacatccaaatgcatcggagacggggggagacaaaatttgaaagggaggaagcacccggagaccccagatctgaccagcaacaggaagcgaagaacaggagcagagagaatcgcagggagagcggagggcggggaaggagacaacaaacccaagaacgaacgaaaccccgaaacccacctcgaagaacagcaaaccaccaccctagccgccgccgccgctacacatccccctccgaaatgcc

SEQ ID NO: 76977 - DNA, 12075 bp, Oryza sativa
  unsure (1)..(12075): unsure at all n locations
gatcgaactcttctacatcgtcaagggcaacatcctgaccctcggaatggctacggtttgttttgtatcgactactcttgcatgttgggcatctgtccaaatcctcgtactctttatggaacaggatacagtggttaacacacgcgtgtatctttcgcacacccaatgacaacgggcatataagcttcttcgcttcataggtgcttgttggcagggagttgggttgcggaaaaagtttcttcaatagaaccaacatgtcgttaaaactactgtcggaccaaccgtttctggccttcaatctcataagctcaagcaccgttcgcaacaatgtgaaatccttctcgcagccctttgcctcattgtacaaaagatcctttgctgcctttttcaatgcatcaaagttatccaacccatgagcggacccagcaacaacctcaggttcagcatgacacaacatctcttccaaatctgcaaaattaccatcatctacgctgacattaccatcatcggcatcatcaactgtaccatgctgaccattgtcaccaaaaacatcatcatcatcaacgggttctattgcatgcacttcttcttcttcttcttcttcagctactacaatgacatcctcgtcccagctcaacacttcatcgcgtactgtaacctggttcggaacttgcttgcttgggatctctccatgatgtgaccaatttatgtagcgttcaataaatccatgcgtcattgttggtatttcttaacgacattactagaaatataattcccagcaatggcgtagaaatacttttggtatattatggttaagagttcatccgcaagcgcacatatataccattgtagcatttcacattctagttaaccgatatactagctaataccctctattcgatgccctcctggtacttcgagaagccactcctgactgccgagttccttacgacaacccgtcatgaatacggaggaataccctccttagggaattaacttaggattatatactggcgcggaggaatacccgtactgagctgtcaccatcagcggcccacctcttatccgcaatatataaccccaaataatgatatcccataatctagacaccacgcctaaactaccagatactgctctaatatcatcgtcatgacatagagtaattgcatatgcaaacattatacccgcaccaaagcatctcctagataagctagccgtacagtataacatgaacataatgtaaagtaggcattcatatactcggaaagtataccataaatgtataaagaagagtattccaataaaagtacaacgcttacaaaagaggaaaggaaagctactagagccatacccgaactcttccaaaggcttccggactcctgatttctactattcctattccaccagctagatactactaaactaaacttgagagaaatgagagagctcttgcttgaggtgtgtgaatgaagtgagaagaggagctccttaaataggctgccaatgacggttgtggcagttggaatggtcggaattgccctccaaccatcattggggagtgatccacgccgtccagccaaaacctagatccaacggtgccaggggaggttcgaccaaaccaggggccggcccatcctagcccatattcgacaggtggactcctttgttgttctcctccgtagacttgtgaattttggcccagtgtgtcgtgtcaattctgagttcttggcccattcatgcataagtctaactctcgacatcatccgattgatttatcgtctgtgttgatgtcgattctcctccactttattgtcattctctgcaaaaggttagtagacctaatactagtggaatattattattctaacagatatatgcgttgcaagcatggctagttctcctctattttggtaatattgacggccgaaactgatcaataacgaccgtcaacagtcaccaagtgttgctcgattacagatggatccttccaaattttctgatttttgcagtgcgcgcatggacatccatgccctgtccgccatctatgcattaattaattaattacggaaaaaataatacaactttagttagtttaaatattttgaacacgataattaaagctagccaaaaatctgcatatataaagcatacaacttgaagaattaccaaactacccttctttctcttcttctcttcctagctagctcattcttttgcagttaactaatatataaatctgctaaacataaacctatcaaaaactagatatgtatatggaacatcgatcatgcacaatatttcttgcaaagtttgcccattttgagctccaaataacaaataaaaaatgtttttcttcctccatgtcaagtactttttgcgatgaaaaatctcaacatacaaccaataaaaatgaaaaaaaaacttgacaaaaagagtaggagaaagtataactaacctctggtacaataaatctttcaaaagattcaagatcaaaaccttcccccctatgtatgtgttcttaagagagagaaaatcgtgctcctaatggtgctcgaagttactgtagctgggtgatatagttcagcgcattttccctggcggtcgtcatatgtcggttcgtttgaatcgccattgaaaatgattagaggtggcggacggtttagatggccgccagcgaagataccataccttcgttggcgtcagcttaagagggccgacagagaagatatcctatcttcgctggcggccttcttaaatagatcgctagcgaagatatgtttctgctggaggcccttgacccccccaccccacaattttctgcactggcggtttttccacatagccaccatgaaaaatattttccaaacgccatgaaaaatcgattttctagtagtgtacatgcctcttttccgtttggtgaacaggtaatgcaccatgtccaaacagtgtcagcaaatggatggccgctaaatccaccaatcagttggcggcacagacggcagcttgtgataattagataagatagagttaatattgatgtgacatacatcattgagagaatgattcatcagagcttgttcataacgggtacttcctccgtcctaaaatatagtaacctatgacttattctaggattatgaatctggatatgaacctatgactcattcggactatgaatctggacatagtgcatgcatgttcagattcgtagtgctacgatgggacggaagcagtagctagctattagtattggtgcactgtacaatcagcagtaatagggagaaagatatatcgttgtctttccaaaattaattatgcgctagttagatatagagaaaaggttaatgcaacatggggaatggtgactttcgcataagagggtggagccactgtagtggactagtggccccttcttcacatttttgttaaaaataaaaggatttactttctgttattctattaatatccccatctattcgtcactactacacatgagattttccttgacgctggccccggtaacttccaagcgggccgtaagtggctccgcctggaacaagccgaaggccggcgccgggcttagggccgcacaggataatgcattatcccgtgcagcccacgtaaaccgaccgcttgcgatggtcgggaggctacagaagcccccagcccgaccattgtcatgataatccgacggttttctctctcctaaacatacacaaattaggggagaaaggttttagatctgaaatctttgattgggttacatataaaaggtgtagagcttgttctcctccttcatttgcttcttttttgtcagttttcatcagtgcaatgcaaagaaacttgcacttttataaatggaatagtgtaggcagttgacggagcgtggggctcctcaccgggagaccgcgcaggcccccctttgccggttcggccgggggcgctaagtgaggttcttcgccctcgatctgaggaacgtcagcgagaaaggaaatgcgcaagacacgggcgacgtagacaggttcgggccgctgagaagcgtaacaccctactcctgtgttctggtggatctgtgtgtgaaggaatccagagggcggagagcgagagagagttcaggctctaggaaccattcgccagagtcccaactccccctcctttctttcccccccccttctcttttcttaggcctgggcctcctttttatctggtcaggcgtcaccacatgggcctctagctgcctaagaagggaaacatgctttttacaatcagggctaatctacagccggaaatgacttctgacaagcagagcgcacgtctcctgccccgctcgcccgcttttcccggtggacgcccatttcaaccttcatttaatggccagcgacttccttgccatacttgcgctgaagcctggaacgaatctgaccgggactgacataccaactcctggagttggcacgccggctctggctagggacgagagccaggaagctctcatcattccgacgggacggggcgaggcgtgtgacaggccgcctgttgccacctaacccgcgatctgaccggtctgtgaccggtcactcaccgcgaccggtcacggaccggataagcgtgcgctgcgccgcattaaatgtggcgtggcgcgctcgtccaacctgccataaatgcggttaggtgagcccngtgggctcacctaacccacacacgtggcgccaaaaccacagggggtcggggcgccccagccctcggggcaggaacgggagcggcccgacccctcgggcagacagagggaggggtggccacgtcaccttcgggcccgacccccccgaggggtcaggcaacgtgggtgaccgcggctacccaagcctctagtcacgatacccccggccccatgtcaccgacagtagcccccggcgttacgccagggcgatcgcccccctcgagggaagcgctcgggcatgatgccactccttaggcccggtgacaggtggggccggtccctacaggcgggcagaaacccagcggtcgcaaatcgcgagcatcggcaagggaaaaccgaccgacaataatgagcggcctctttaagaccgctacattactcgagcagcgcgcgaatcgggacgagccggtttgtttcgcctggagacatgatgacggcgcatttcacggttggcgggcgtagttaatgcgcgcacgatctgccccatctcgactgccacggccgcacatctgccgcgtgcgccgcaaacgggcgagcggggttagtggaggcgtgggcgcgagaaacgagggggcgaggtagtgggcgcgggaatcgaggagccgggcatagcgttggcaagggtgtaaagacgccgagggagggattcgtttctttcctctcgccactcttttccttgccttcgccacttgtgctctaactcttcgtttccggtgccctacccttgccgcactcgctcgctctcaagctcctcctccgccggcgtcatggcacggggctccgcaccgctcgacggtagcgtgctgccgccttcccgcatcgtgagcgagaggcaggccgggctgccgcgccgattcatgccggaatctgccaccggccgggaggtggtcgcgctgggcgagggacgcccggcgccacactacccggggcggtccgtcttcttcctctctttcgcaatggcggggctggtcccgccattctctatttttttcatggatattctggagttttatgatctccagatggcgcacctcacccccaacgcgataatgacgttggccatcttcgcacacctgtgcgagatgtttatcggggtgcgtccatctctccggctgttccggtggttcttcaccgtacagccggtgtcgccgccgacggtagtcggtggctgctacttccagccgcgggggcaggtgctgaaccgctacattccctgcgtcctccgtaaaaagtgggacgactggaagagcgattggttctacacccccctcgccgacgaagcgtgcctccgacttccgagccagcccccggcgcaggcctccagctagcgggcgacggtagatctgggagacggctacgacgccgttcttgaccgcctggcgggtctgcgatcccatgggctcacgggggccatggtgttcggcgactaccttcatcgccggatcgcgccgctccagcggcgcgcccggggcgcctgggagtacaccgggcccgaggactacatgaggacccaccaggggcgcaaatgggactgggaccctgaggacttcaggatggtggtccaacgggtgctgaatctcagctccgtggaggcatccctcatcccccaaggggtcctccccctctgctgcgatccagagcgcgccaagatcctgaccatcatacaggtggtcggggtgtcgggggagcgggccccccgaggccacgatggcgcgggcgggagccgcaggggggaacaatctaccccgggagggggtcgtgcttctgggccccgcgacgggggcccggggggcaaccgccctaccgacacccgggggaagaggaagcaggagggtactcctcccccatctcctccccgagggggcggggcgatgcgtgccagcagcaggcgcccggagggtgccgtgccgacgccgcagcccgagggggagcgaaagaagaaacggctccgcaagatgggggggatcgtaccatgccgggggaacctcatctcgcccccaaggtggtcgtttagccgacctccccgcaggttcgtccccgcgcccaccgcggccgtattcattctcccatctcccaaggcgagttttcactcacccgtttctttttgtcttctggtttttcttctgcctcagcgagatcccgtcgcgcccccccccctcccccccgccattccaagtccggccggtctgaggccgaggagacggcgactgcggaggcccggaggcgggaagctgaccggcgagaagccgcggaccgcctccgggaagccgaggaggctgcccaggaggccgtccgggttcgccaggctgaggaggtcgctcgggagcaggccagactccgccgggccggggagtccgtccgggtggcagaggcggcgcgcgcacgccaggcggcctgccaaacccccgactcgactccgcccgaggcgacgacgacttcagaggccacccatgacgaggccgcgggcgcgccgctcgggcccgacccctcgggcgacgcttgggacgagccaggttcggggggcgcccccgagtccggcacgtcgatcggcgggtcgagccgcgcggcacccacaccatgggggctctcccctcggccttccgctgccccactgagcgcggagcccttcctgcaggccttggccgccgcgaacagcacggtgctggacgagttaagtgcccagatggaggccctgcaggcggagcgggcggagctcgacgcggcgtgggcgcgcgtcgaggaggggcggcgctcggtggaggccatggtggaggcgggtcgcaaggcacaccgccggcatgcctcacagctcgaggcccgtcgtagggacctggcggagatcgccagggaggtggaggaggagcgggagactgccctcatcgccaccgccgtgctcgacgaggcgcggagcgacctccgcctccaatacgggagccgggcggcggagctggaggagaagctcgacgccgcccggggagtccttgacgccgccgctgcccgggaacggcgggcggcggagaacgaggcggcgtcccggcggcgtgaagaggcccttgaggctcgctccacggcgttgaaggagcgcgcccgcgccctggacgcgaaggagagagacctggcggaccgcgaggccgccgtcgccacccgggaggcaacactggcggcgcacgaggccgcctgtgccgaagaggagtccgcactccgcttccgcgaggacgcgctcaccgagcgggggcgagctctcgaggaggccgaggctgcggcgcagcggctggcggacagcctgttcctccgcgaggcagcgcgggaggagcaggcgcgccgcaatctggaaggcgcccgcgccgagagggccgcactggatcagcgggccgctgagctcgaggcgcgggcgaaggaactggacgggagagcgcgcagcggcggggcggccgcgggccacggcgacctagtcgcccgcctcgcagccgccgaacacaccatcgccgagctgcagggcgcgctggactcgtccgccggggaggtcgaggccctccgcttggcgagcgaagtagggcccggcatgcttcgggacgccgtctcccgtctagaccgcaccgggcggcaggcgggcctctggggcgggcggcacgcaaagtacgccgccaaccaggggggcctcgcccagcgcctctcagagatcaccggggccctcgagcggctccccgaggagctcgaggagacgatcaagtcatcctcgagggacctcgcccggggggcggtggagcttgtactggcaagctaccaggccagggaccctgacttctccccgtgggcagtgctggaagagttccctccaggaaccgaggacagcgcacgcgcgcaggtccgggacgccgccgaccacatcgtccacagcttcgagggtatggcccctcggctcgcgttcgcgctcgactccgatgaggagggcggtgacgacggtgcggacgacagcgacgatgaggccgacgccccgggcgcgtcggagtgagccctcaggcccccgccaatcttaataacttttgcttcttcttccgaggccttcgggcccccttcttgtataaactgatttaatctgtaatcaagtaaagaggaaatttctgcatcagctctgtttggtgtgtgtatgagacgaggatggtctgtgccacggtccttctgtgtcttggcttgaacaagggctcgtgcccaggtcccagcctcaaacggcgcgggtcggggctagtgcctggggagatccacgtgtcgagactggccaggccgggagcgcggtgaccgagggttatggatgacccgattgtgagcctttgccgattcccccccggagttcaccgcgccccggggcacggctcggttctgggccccgtttggcgattttagccggcccgggccaccaagggcagggtcgagcacgggcgtgctaattcaagccaagattcttcaaaaggaaacgatggcacagacacagtcctcaggaaatcgaaaatgcttttattgagatacggaagagaaaaaaggtaagtatatgcatgtggtagcccccggccaaccctgcacgcccgggggggtgcggggttggcccaagcccgaggcatgacacccgaccccgactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttagacgcggcgtaggacgaggtcgtcgacgcagagtgatcgggcccggacgtggcgctgatggtagcgccgcaggctctgctggtagcgcgcggctcggagggccgcgcgccgccttcgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcgtggttcggttcgcccagagcaccgcaggcagctcctcgatccacgagtcgccgtccttcttgaggatgttgaaggtcttggttttgaggcccttgaggatttccgcgttggcgggctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccacccggggcccgcctgaatggacccaggatatcgagcccccagagagcaaatggccacgaaagaggtatggtctgcagggcctgggccggctgatgggtttgcctggcgtggaactggcacgccctgcaccgccggaccaggtcgaccgcatcgttgagagccgtcggccaatagaaaccctagcgaaaggccttgccaaccaaggtgcgtgaggcggagtgggctccgcactcgccttcatggacatcggcgagaagctcgacgccttgttcccgaggaatgcacttcaggacgactccgttagccgcacgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctgggagcgctcccctcgggtcccgaggcctggactccgacgggcctcgggggccgttcaggcgcgtccgtctcccctagggggtcgggtcgcgccgacggctgggcgagcctttcttcaaaggcgcccggtggggtctgggctcgcgaggaagcgagccttgagagttcgtcggcgaccgcgttatcccgtctgggcacgtgccgaagttctatcccgtcgaagtggcgctccatacgccgcacctggcgcacgtaagcgttcatctgcgggtcagagcaccggtactccttacagacctggttaacgaccaactaggagtcgcctaacaccaggagacggcggatccctagtccagctgccactctgagtcccgcaaggagtcccttgtactccgccatattgttggtcgcccgaaagtcgaggcagaccaggtatctgaggacgtctccgctcggcgaggtcaacgtgacccccgcaccagcgccctgaagagacagggagccgtcgaactgcatcacccagtaggcggtgtgaggcagctgcgaggggcccgagctggcctcgagggcggagacgggctcgggagctggggtccactccgccacaaagtcggcgagggcctggctcttgatcgcgtggcgtggttcaaagcgcaaatcgaattcagagagttcgattgcccatttcaccacccgtccagtaccctctcggttatgcaagatttggccgagggggtaagatgtaaccaccgtgacccgatgcgcctggaaataatggcgcaacttcctcgaagccatcagaatagcgtaaagcatcttctgggcctgagggtatcgggtcctggcgtcccggagggcctcactaacgaagtagacgggccgctgcacctttcggcggggccgatcctcttcgccaggggccgtatctccagggcgctcttcgtccgagaggccacgcggggcgcactcggcttctgtgccgacgacctcggggtcagagggcgacaggcgcggccttcgcgcagtggccccggggccatcctgggggtcgggggcgcctggcaccgtcggacaagcaggcggagggccagctccggccgtcgggggccttgggccaccgttcggctcgggggcctctcctccctgctctctcccgggtcgagtcgatgcagggtggggatgcgcggagtgagggttgtcctcgtcgcgctccacgaccaacgccgcgctaaccacctgcggggttgccaccgggtagagtagcaacggctcatctggctccggggcgaccaggactgggggagaactgaggtacgccttcaactgagtgaaggcccgctcagcctcctccgtccaggtaaaaggcccggagcgtttgaggagcttaaacaggggcagtgccttctctcccagcctcgatatgaaccgacttagggcggccatgcagccggtgacgcactgcacatccct

SEQ ID NO: 76978 - DNA, 7342 bp, Oryza sativa
atcatccacatatacaccaaccacaagtcgtgagttcttctctccttgaatatacacagcactttcgacaccactcttgacaaaattcaggctcacaagactagaatccaatttggcataccatgcacgtggtgcttgttttagtccatatagggccttcttcagtttcaacaccttgtcttcttttccatcaacaacaaaaccaggtggttgaaccacataaacatctttttccaattccctattcaagaaagctgatttcacatccatgtgatgaacttcccatccctgatgagcagccattgcaatcagcaatcgcacagtctccatcctcgccactggggcaaacacttcatcaaaatcaactccatgttgttggacatatccctttgccaccaatcgagctttgtacttcacaatggcatctttggcatcacgtttgattttataaacccactccaaccctattgctctgtggctagagggcaaatcacagagaaaccaagtgttgttaccttcaattgagtccatctcttcaagcatggccttcctccagcagctctcctgctcagcctccaagaaatttgctggttcctctgctgccataaggcattgatcactgtaatcaaaatcaaggattggagctgtagtggcaagcgtgtttgccactgttctgtacctcctgggcccttcattagtcccttcactagcatcagttggagaggaacagaattcaacaccagatggcagagttattgcagttccggtgcttgatgttggtgatgttgctagcatggtaggagtgactgctgcatcctgggcatgtgtctcacccccttggactgggactgtgaaattctccaccgtaaactccacataggcatcctgatctccttcttcatcagtgttgctgccccagtcccagaacgtcgtcccatcaaaaatgacgtcgcgcgacacacacaggcgtcgcgccacaggatcatacatcctgtaggcttttgatccttgctcgtagccaatgaagaccatcctcgtgccatgatcatcaagctttctcaagtttggcttggccgtcttaacatagcccacacacccaaacacacgcaggtgttcgacagtgggtcggcgaccatgccacgcttcatacggcgtcaccccatcaagactcttcgttggtgatctgttcaggacgtagacggctgcaaccaccacctctccccagaaatatgccggcatgtttgccgccttcagcatggacctcgccgctgccaccacagtctggttgcgccgctccactacgccgttctgctgcggtgagtagggtgcagtgagttgacgcttcacccctgtatccgcgcagtactccatgaactctacagaggtgaattcacccccgcgatcgatgcgcagcgccatgagcttccgattgctctccttctccacgccggcttggaactgcttaatcgccgccgatgcttcgtgtttggcagagaggagtcgtatccacatgtgacgactcatgtcatcgaccaggagcaagaaatacttcttgccccccggcgtcgccggcgtgattggtccgcagaggtcaccgtgcaccagctcgagcgccgtctgtgccctgtactatgcctcctctgggaatggtgtgcgacgttgtttgcccgcgaggcacccgtcacacaactgatcattatgatcaatttgctggagcccgcggaccatgcctccttgtgccaacctccgaagtgcctgaaaattcagatggccaaatcgtgcatgccatcgccatgctagctcggagccgttcgccgccatatagattggtgtcgcaagattaaacttgagaacatacaggtaacttgaatcacgatttaccttagctagcagcatcccttccgggtaacgcaacgtgaaaacaccatgccaaatgtgtgcgtcgtagccgcgcgcgtcgaggcgaccaacactgacgatgttttttctcagcttggggatgtagtacactgcctccagtgagcggtgatcaccattcttgcactgaaacaccacagttccgtgcccctggatgtcaatcaccgagccatcgccgaatttaaccgtgcccacaacaccagtgtcaagctccgcgaacgccgagcgtgcgcccgtcatgtgattcgtggccccggtgtccaggaaccactctgaagtcttctcctcctcacgcccatcctcgcggtcaagcacaaccttcttctccgtgagatgcacttcctgcacacaaggtgttcgaccaatggccgcttcgccggcgagcgacacccccatcacgtgtgccatgagcagagttggttcttcctcagcctggaccagattcgcattcgcctctccccgacgttggcgacgcggcttacggcactgcttcgagtaatgaccgtattcatcgcaattgaaacacttcaccttagagatgtcacgacggccatggccgccggtggccatcttctttcccttcggtgaatcgccggccttacctcgacggttctggttgctagagcccgcccggcccttgttgctgctgctggatccctcctgctcccgctgcttgacacgggcctgccactgctcctcagtgaggtacaatttgctgccatcacttgcctcctcgtcatcactgtaagagtcgaccgtcgacagccgcccgacgagctcctccagggccatggtcttcacgtcgaggagctgctcgagggaaatcgccaccggcttgtacttcttggggacaacacgcagcagcttcttgttgatgtgttcgtcttccatgactccgcccatgtcgcgaatgtccgcaacgacggcagtgagccgcattgcaaattcctctggcgtctccccgtccttgaagcgcatcgcctcgaactgacggcggaatccctgctccttcgcctcacgcacgcggtcgacactgacccgcatggttttaatggcatcccacgtcgccttcgccgaattgtgcttcgccaggccacgcaacatctcacgcggcacagcttggagaatcgccgagagcgctgcacgatcctcgcggtactccgcgtagccaggatcgatggccgtccagagcccctgcgcctgcaggtttacgcgcatcaacagtgcccagtccggataatttgtcctcgacaggatcgggagacgggcagtgtgcccagcatctctcccctgaggcactagcgggagtgatgcgccgtctgcgcaattccccacgccgctgccgctcgcgctgccgcggccgttgccgcttcccccgccgccgccaccaccacggcggccaggcggtgtgtatgacatcaccggatcgtctcagcaaagctctgataccaaatgtcagaaaactcatgcgaactggctctcaatctcacagaacacacacactgacgcttgcaggtgcagctacagttaactgaacaatttttcagtaaaacagagcagaacagaacaactgacgaacagagttttcgctgcgtaatgccgtgcagcttttccggttttctcttctatttattcatctccacacggagtttgttgcatgcataacagaatcacgacaatctcggatcaactactcaccgcgccatcccacgatccgagccgagtcatcgcagctaaagaatgaagcaaatatgctaaaacagaaaatgctattctaccggccagaattcagactccaaccgaactctacatgcaacaaaacaaaacagaatataaatgctcaagattacaatccaacagttactactgatgaacactcctgactagtccacaaggtagcacgagaaatatcgctgctgatcaatagacagtaggcacatctcgatcaggcctggttctttcttaaatcagtaagaaaatcatcagggtcttccgactagctttatagggcggtgggttggcccgcctgggttagaagcctcacaatttctatttatttgatattagaccattttctaatattcgtgttttttttctttgttcaatcaatggaaattcaacctgtagcttcttttaatttctaatgccagcagaaaaaatatggatcaagacaacttaggggttgtgagttagcatagggccgggatagtacattatacagtagacaccttagctgctcctaatccagtacattcttttccaggtcatgggaacgaaagggaccagaaatacagatcaccggccggtccttggacaccttcatggcaagagcactagttttggccatgcagtggctggttggctgcagtagggccgatgaggataatatgctgatggacagcgaaactgtagaatacaactgtgtatagcatgttttttggacgagcaactgtatagatgttgtctctgtggctgtcgaaatcttcccgctggcttcgtgaaatgtttcctcattgcgaaatgttttctcatccagattcagatttcgggaagggacgtgtattagggatcttcgagggggggggggggatcatgcatttcgtgcaattgatattaattcttgatgtctgtaggaatttccttgtcaaaaatgttagtaaatctggtcatctgtttaagtggaagtaaattttaactttcatactataaactgtataaggtacaagtggccagagttaattttgaattttagaattattaaaatagaagaaaaaactaaaatggaaaccgtacaacttatatatatagctgtctagcatagcatgttttccatggcctcaaggaaattagaatatgtattctgtctattgccgaaccaaatgaatgaacaatttgtaggtttggggggcaccaggagttcatgtcccacagcaccacttttgcagtggatgacaaatgacaattcactccttgattctgtaaaagttcatcggtgtgccactcaattgctccgtcgttccgaggacatcttgatccgtcagatgcatattgcatcatgagctccggcgagcagatgattaaagtatcatatttcataagatagttttacttagccatccattggaatgtgttacgtttcatgctcgtgaaatcaagctcataagtaagaagcttagccccaatgcatggctcccaagtcatgaaaacttattatatataatcagaaaacgaagcgatccccgtccttccattatacgttcgaaatgtctactgctggaattttacgtacataacagtgtatatgtcttttctcattacaaagacatgtcagtgcacacatccgccttctgtagttgaaggctatcaagctcttactacgtcattgcacgcaagaaaaaagatgatatagtatagtttgacaagttacagtgccactatatcagtccatgacattatatttatcttctatctatctatcttctatctatctatctatctatcttctattatatactaaaagtccattaaactttctataaacgctctcaagccgccacgtggcacttctacaacgctcctagatcgccacgtggcaatgtctaatcacaccgtcaattttcacttaaatcggtggacccaataatttggaccattagattagattacatgtattatatatttaaaaagaaacaaataccttactgttcaccagaaaaaagaaaacaaaagcatatgtactccatatatccatatataggtacgtacgtagtatgcaaagactaaaaaataatcaataatcttacctactgttcattgtaaggaaaaaaaatacacacagacttactataaaaaaacaatagagccaaaaaaaaaaacgtacgtacgtactaccaataaaaattgattatttttaagatagatttttttcgactatttaaagataaaacctattactctataaatttaagcaaatatagctatagattttgacttaaatgggtgaatctaatattttaaaccattaaattagatgtatattattttaaaaactaataccttattactctgtgtacataaacgggagaaatatataactgttaggctagaaaaagaaagaaaacacataatctcatcgtcgttttcacttaaataagtggacctaataatttagaccattcgattagattagatgtattttatttaaaaataaactaataccttactgttcaccagaaaaagaaaacaaaaacaaaagtatatactccatataggtacgtacatacataagactaaaaaacaatcaatcttacctattgtttattaaaaaaaactacgcacagctatagaaaacaataaagctaaaaaaaatatacatacatagtaccattaaaaaaatcaattatcttttaaaatggagttttctactatttaaatataaaatctattactctataaatttaagcaaatatcaccgtcgattttcacttaaatctggtaacccaatatttttagaccattagattagatgtattttattttaaaaacaccatataactctgtgtatgtatacgggaaatataagtagtcagtacgtgcatatgacctgggaaaagaaaagaagtttacctactgtccttcaatatctactcacggtggttttctgaaatagtattttcaaaatcacttactataaaaacaataaaaaaatatgtatcattggaaaaagatcgatggtcttttgaaatagtattatctactatttaaagataaatatattgctctacaaatttatgtaaatatacgtagttaaactaaatttatattataaatatgaaatatcccatcaatgatctttattcgttctatcttaacatacaagactaatgtatataataattaatgctatgatatttttttgtcaaatatcacttgacgaatatacaacgctaatttaaatcaatatttgtaaaactgaaaacaacacaatttagttgtttcattttacaccattagattagatttattattgacaaataatacaattctcctatatacggatacatgaaaaatatataactgttgaccggaaaaagtactccgtacatagagatgattgaaagaaaacaataatgcttacatatcgtctgacggaagggaaaaaaaagtacttatgataaagtaaaacaatcggaagtctttaaaaaagatttttctacaatttagggataatacccctaaaaaacaatttaaggataaaatataataatcttcaaatttacacaaatgtaaatttaaaatatccaatcaatgattttaagcgttctatcttttaaatttttttaaaattatttatccaatttgtgattcagtagtattcctttaaataaataaactattactccctcattccctaaatgtttgacgc

SEQ ID NO: 76979 - DNA, 1551 bp, Oryza sativa
ggactgataccaatccgtttttccacatgaccttttttttaaccgtcggtgattttttttacggtcggccttttttcttttacccagcattttttgcaaatttttttatccggtaccaatcgtacttctttttttcctctgtttttcttttgcgatttttatggcgtgttttctttttccgtgtgccctttttaagttatggattttgaggagtagagattaaaaccgaaacaataaattgaaaccgactcaaacacggatgacttaaagtatcggcaaaaacatatttaatttttataaaagtagagatatatctctctcggttaacatattttctatcgtagacctagataagtttaggtactaatattaggggcatgttctattattgtggttgggaacttgagattcttagctgagaattaattggagttacgtaccggtgctcaactacatctacgttatattgttctgcatacttcatgttgcagcaatgagcaaatgcatgtgttcgtgcgtaagcactcagctaagctacatggggcgtctcctagatttgtaacgagtcccttcttcatcgcttggctggcaatgtgttcatcgttagttaaccaacaattaatatagtttgtggcttggtaggcttcgagaatttgtgcaagttattttcatcaatggatatacactatgatgaaaggtaattttgtgaggaaaagatcatagactgttctataagtgaatagtctaaggttaatcctacatgaaagaatcacctatgacccaatcgaattatagcaccgtgttaacatgcttggatatatgctaggaagtagaaagcgtggtgaatggcaaaataaatcattagtgtaaatgcaagatgatctgatcgagatccagtttccaccttggagcgccatatataagcctatggtcctctttattaaggttatgtttattggggtagacttttaactgagtttatttcttatatatttgagagagaatctattctatatcactgagtttatcatagctcaacaatttaccactgatttttttctttttctagattacgtcattgggtttggcttatttttcaataaaacctaaaatacccttatggagatataaggttaacagttgatttatatcattagaagtttaaaaaaagaagaaaacttttatgtagcctccttacacaatataaaagtttgaatttttttcatttctattttttaaatataacttatttgttatatgccatataaaatattttttgtgttgttgtttttaatgtaaattatctttcaaatgaaacataagatattttttgctattatattttgtgtaagctatttctctctgatataccacacaaaaatattttttctaaaagaaataccaaaaaaaaattgaacttatgtacatacttctctgttgtgtaaggatgccatataaaaaaattcatattttttttaacttctaacaagataaattaattgttaaccatgtatgtctctaagggtaattttggtattttttttaaaaaaa

SEQ ID NO: 76980 - DNA, 5198 bp, Oryza sativa
ttatgataataatttcacatcacattttagtgtaagaaaccacttgacgaatatataatgctaatttaagtgtacatatgtcttatccaaattactaaaggtgtctcatgtgattagaacaataggggctgaaaacaaaacagacactgaactaacatgcactaccctatagatatttgtcaaagtatgataccgtactttggattatcgtgatagtattttaaaaaaatcactttctctcagttacatataaattcttctattattttggaataaaagttaactccttccatttatgtgacggtggtaatataagtaatataagtctatgtttgattagatgaagtagtatcattagctatatttttaatagtaaatatctttcattaatatatagtaaaattaaaatgttacttaaagtcatctataacatacacaataaaaaaagttatataaagttgggaaactctagaaattttaaaaaaagaatcacacataacacaaatagatatgaactaattctattattgtgacatattttttctaataaatttgaggatatacattttcaagtaatacgcccaaaccaattattaacgaacatacgttttaaatagagtcaaaaaaatatttcaaaaatatgatccacacataaagattcgtaataaaagttcaaacaatattaaacaacatgcccgcgcattgcgcgggctaccttctaccttctggttcaacaaaaaagacagcgtgtgttaagaacttcctgtaaaaagagatacatgaaggctgcagattcagcgattattatgcttgcatatgaccctacacggctagcgcagtcttcgttctttgcttgcggctagcgattttatctgtgggactgagagtaatctggaaatcaggtgtcgatgctacacgctgagacagtataggagtatccatttcgatatgccatgcatgcaaattcagcaccatatcctactctcggacaccaacgactgtaagcagcagaacaacgagaggggacttcttcgcaacaagatcgtaaggctcgttagagttccgcgcggccatgctcatcagctgaaggatgcaggatatatatggcaaattatttgaggtgttttggtcattttggtttttgagccatgtcaaatcaacatcaccttaacgcatcgatccaccatcaaattatttgagagtatatatgtgacgttctctttcaattgataagaggtaccaaacatttttaataaaaatcttttggctcctctccgtgtcttgctagtgctcgatcggatactgggagttatgcatgatgcagaagctgggatttttattccattatctgaaaacgataccgggagttatcgctaccactgtttttttaattaaattactgtaggagattatcgctagcagtattaagcaccgaaacttgatggtggataccgtgaaaggtacagtggtacgggttaattggatccataccactataattgtggcaaatcagaaaaataccactactatttgtgttatcggctgggtaccactgaaaatttctaaaattaaaatcatgccactcccttcactctttccgtcctcctctctcatcgtcagtagcagaggggtgcggggagcgggcgcggccgcggccgccgccggcgaggacggtcgaggaggggcgaggatatggcggaagagctcattgacgacggggaaggagataccatggccgccttgccttctccccgtcctctcgctactcgccggcgccgcctcatcctcgccgctcaccggcgctgcttcgccttatccccgtgccgaagtgagagaggaggatgacgatgtgagggaggatgacgatgtgagagaggaggacggaaataatgatgggagtggtatagttccaattttagaaattttcaatggtacacatccaataacgcgaatagtagtaatatttttctgatttgctatgtttacagtgtcatggacccaattaaccctacttcgaaaccgactctcttagtacgtacttggtcaatcttaaccatctgtaaccaagtgcccttgttaggtagagcaatttatcaccacacgcacatacacgtcatctgtctattgaattacattgtagatagttcttggaatgaataattagtgaacatgactctgtttgttcatctttgactttctcccaaaagccggatcaatgcaatttgatctgtcctaaaaaaataataattagtgagcacggatagatacaacccaacatcaacttggctttaaaatgacagtagcacgaaccaaagtcttcctgtgagagctatagcagaagggagagcagatagtagccaagtcacgagttaaagggcgtgcaagcctgcagagcacctgctacacgatatgcacacatgatctcctgcaccggtgttcgtttccagatgatgggcatgggaggcaccgggaatgaactcccctccttttgcttgtgaccctgctcacacaaacagtgttgttcgccccgattcatcagctgcagcagggtcgatgactcgatgcacacggtcacaaactcacagactcgcagacaacaatttcatctaagcttggggatttgttcctgcgggctcacagtagcagggtgtccctttctacgtgcaaagcttgctaattctgtacgatgtatttctcttcaccacgaacatggcatttgcagcgcgttcgtccgatcgggaaggaaacgtgcctcgccctgcttgtgagctgtgaaccgggagcgacaaatatttttattctccatatacccttctctattaaactatatcatccttttaatttatactccctccgtattttaatgtatgatgccgttgcacgatctatcacaaaactacaggtttaagaatatgtttcacaaaactacagtttcagtgtattcgtttatcataaaactacagttcacaaaacttcatatttaaaaacttgtttaacaaaacaacagatttaatatcttcatttatcacaaaacaacatgtttaatgttttcattatcacaaaactacaggttttaacattgttaaaacctgtattttttatgataatggagatactaaatctatagttttgtgataaataaagacactaaatgtgtagttctaggataaatgaatacactaaatctatagttttgtgaaacaaattcttaaatatataattttgtgaaacaaattcttaaatatatagttttgtgaaacaaattcttaaatatatagttttgtgatagattttgcaaagtacatgtagttttaggatatatagagacactaaatatttagttttgtgaaacaaactcttaaatctgtaattttgtgattacttatgctaaatacctgtagttttgtgaaatttactctaaaatttataaaatgcatgttgttttaccttttttttcatttatcctatatatatctataaagtttatccccactaagtgcaattaatactaattctctcttatctcatgaagccatattatctcaattatttttagcctttggatgattcatcaatggtgtaaattgcatctcttccccctcaaaaggtacaccaaacaattcaatcatttatccacatttataaatgaggtatagctattttgtcattgtatggctatttggtactcctagacagtaccttatctaccacttcaaactgaaggaagaatttaatattagctagtagtatgataaactgcagcctaaagatatgtgtaattgttgtgcttgctcgaagtgagagaatgaaccagttaaggaaggatatattcatgtccgatggagttgtgtgccatgtgttacctctatgaggattgggacatgcgcgagacttcagggtcagacgagttttggctactaattgaacaaatctttatatactcctcatgatccaccctagatgcatatacaggggaacatcttttacatattttctttatcgttaggggtagcaggcgtcgggaagtgatctggttatgaaatggtatggtgccaaccagtagaacatgaatattctcctgaaaagataaaatgattcctgatgaagatcctctaacttacttccctgtaacttgtatcactgacatgtgggtctctatccaatgggccgggacatgtcagtgccttaaagctagaagaaagtaagtcagaggatcctcttccaaggactccagttgcaatagtctgccctctaacactccaataaaattttgaacatccaattcatatagcgattttaataaattcttagcaaaattttgagggtgatggaaagcatagcaatcttggacatcgaagtctcgtagcaggcaaggccgtccttcatttttgaggggattgaaaccaaacggggaattttggaatatccaaaactattttctccttttgtacgaacgaagagagaatgcttcggccaacccggctataaatatatggggaatatgcttaaactgtgatagcctattatcgtcggagacagctcaaaattggcaatatagtagttgaaaatggttaaaggagcgtcatctatgatgatcttgcactgtaacacacatagggtgcaagccggacggccaagctgggttttttttcgcttatccacttctagttttttttttctaaaatttatactaccatgcatataaaaaataacctaccaagtaggattttatgtgggtaatgggcttgctcacttacatccctaaagacacacgcatcaaagtggtccatatatacattcgcctgtattcttgaatggcctctagttaatataatggtgaagcagaccagctgggtgtagctgcgtggttgcagtgttactataaaccaccaagtacaaaaccttatatatgtagtagctagcatgcccgatcacaggagcacacacaacacagtccaatccgacgacctaagttcgaatccccaccccttctaattatttgatattaggttcttccctaatattcgagtcttttttttactgctagaaaaaaattccacctgctctatgcatgttcaagtaatccatatcctcgatcgctctgctacaacaaattaaccaactagacatatgtttgatgttccagttcgatcgcaggcatgggcggcaccggggatccctctcgctcgatctccgga

SEQ ID NO: 76981 - DNA, 2869 bp, Oryza sativa
ccatcggcaccgccagatccagctcccaccgtcattctctccgccaccgccgggtcctcgtcgtcgacgctgcctccacctcggccagccgtctccacctcaggagtcatcaccgccgccgggtcctcgtcgtccatgccgcctctaccttggccggccgcctcaacctcgggagtcgccgccgccgggtcctcgttgtccacgccgtctccacctcggccggccgcctcgacctcgggagtcgctgccgccgggtcctcgtcgtccacgccgtccccccgccaccgccaggatgccgccgccgcgcagggacacgtcgtcgccgcctcctttcaccaaggtgagcccacgccctccgcctcccctcttctatcttctctctgattaaccccatcttctcctcctcagccgcgccgggactcgttgttgtgccaggaccgtcttcaccgccgccgggacctcctccccgccgactcttcctcctctcggctgccgcgccaagaccatcgttgccaccgccgggacctcctctctgcctcttcctcctctcaactgccgcatcaggaatcgccgccgctgcctacgctactcgccgggcagccgaagccatcgtcacacgcctccaggtacatccccctcctctgcgcatcctacctatgctggaaatgctgatgaatgctgagaattgatgaatggtgatgaaaattgatgaatgatgaatgactgaattgagatgaattttgggtgaatgcaaattggttggggggtttgcaggggatttgcaatgtggcagatggcactgcaattgaatggttgcaaatgtgatttaaaaacatgaatgtatagatgatttaaaacttgaatgttgcaaatggttgagatcaattttggatgaatgcaaattggttggtaaaatttgggggaatgcagaaatatttggggggtttgcaatatgtggcagaaggcattttggatgaactttataatttatagttacagcagtagttaatggaattttggacgaacttttggatgaaattttggatggaattcttaaatgaaaccgcatatatatataattgtaacctttttttttcaaataagttcagaatgttgcaaatgtgatttaaaacttgctattttgacatgcatactgctttatatgttgttatgttcccttttgaatcagaagtgattggttgatggatggatgaattgatgaaatgatatatttttttcaccccatttcgtaatctgtaattgatatatattgatgaaatgatatatatgtgagatgtagttgggacttagggattattgagatgtcatatctatagctagcccaattcaaaattttggatgaacttttggatggaattatgaactgaaactgcatatgaaattttgctattttttgtcatataagttcagattgtagctagtttgaaacttgtggattgttgctatttttttttcatataagttcagattgtgcaatatgaattggttgatggatggatgaatttggatagattttatttgctgttttgtttgactgatgcactgaaactgcatatatatcatcgtgctcttttttccatataaattcagattgttgcaagtgtgatttaaattctgaaatccagtgatgtatggctatatatatggttttgcaatgaaatgttgtagtatctgagagaatgagtgtttgaaatatgagagaatgcaattttgggtgaaattctgaatgcaggaattgggggtgaaattttcatatactctgaaattctgaaatctgatatgttctaaatgaaatctgatttacattgccatgaactttgtccataagtagttcatatgtgagatgtagttcatatttcatatgtgcactttgagatatgtaaactttgggacttaggggttattgagatgtgagatgttatatgtgatatcaaaccatcacagaatacgaagtgcatggggaattttgttggattggtcagggtagtccatggacggaaccgacctagacaccgaaattttccatgcacttcgaaatctgtcattctttgataattaaggaacttaattaggtttagggtttgaaatttagctgaaatggatgaattgatagattggccgtacttttaatgtagttcctatgttatcaagccatcacagaatacgaactgcatgggaaattttgttggattggtcagggtagtccatggacggaaccgacctagacgccaaaattttccatgcacttcgaaatctgtcattctttgataattaaggaacttaattaggtagtttgaaatggtcagggttggtggattgtaatattgttgtcgttaccaatctcattgattgctttaagcgatcaaggagtttgttggcgataacaatattatagttgtagtacaaaattagtatctaaattttgccttcttttcggacttacaataagaaaatgattgcatttcgcaactaacataaattcaccttcaaaggatatcaatcgacaaacccacccaagagcaacccacaggtgacaagggcaaggaaactcaggccgtcatcgaggaagatatttgcatgcaagtagtcacggaggaatcttcgtcatctagttgctgttttagagcctgagccgagctatcctttcgatgatgtaacggaggatactccgtgcaagcacttgattctggtcggtagggtgggaaagaaaatactcattgcaactgggaggttcatactaggccgcaggtttcattgccaagacattccggatgactacgccaaggtagaggtccggacggtcattgaggcttactggatgcacgagctcgactttccaactactgag

SEQ ID NO: 76982 - DNA, 1455 bp, Oryza sativa
agatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattaaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagagatttagttcatttgctaaacaaggttttataaaatagttgagaaggaaaactctagtgaaagttaatcttaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggttttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtatgctgcatccaggactattcatttccacttgtttgagtcggggttcatgccaagctataattgttggacatcccacggagagcaaggtgttgaaatagaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgactgtatcctatatcgcggtgaggagtatgagaacctagaagcatgccctgtttgcaaagcactacgatacaagattagacgggacgatccaggagaatttgacgggcagctaacaaagaagagaattcctgctaaggtgatgtggtatttccctataataccacggctaaggcgt

SEQ ID NO: 76983 - DNA, 6994 bp, Oryza sativa
  unsure (1)..(6994): unsure at all n locations
cctgcagccccgcacacacgttttcaggtttcagtacgagctagctagccaacacccgtttgcagcagtggcgttttgccagaaaccaaaatggaaggtgattttgttatttgtgtaataacggtggagtttaatttccttagatatatattcagagactggctaatgactgggtaattataactgcaaaacacttgggctgattattatctcccacttggccctagtcgatttcagtgtttgttagcttgcaggctaccatgactgaatgattgattattccgtaatctgtagctaatcagatcggatacgctaatacggcgcagtaggtatagggaggacaaagtccacaggcccagtagcactctttctgtcactcactcactcactcactcactcactagagttatagagcagacgactctctcactgtcagtcctcatgaaactgaaagctatgaaaatcccatcaaaagaacttgaccgtgaaaaataccccaattaaattacataaccatctaattttatgatgatagtttggttcgttaaaaacctaaaccaattaggccccgttctttcacgattaagatataagtagattttagcacggtttttaaactgttgaacgatatgttttatctgaaaactttctatatttatatatttccttcgtttcatactataaattgtttgatttttttcccagtcaaactctattaaatttgactaagttttttgcaacatataaaatattaaattggttttactaaatctaatattgaatataatttgataatatgtatgttttgtgttgaaaataatactatatattttttatatatttggtcaaacttaaaaatatttgattgaaaaataggtaaacaatttataatatgaaacggacggagcatcagcatattttaagtttgcaataatcaaggctcaattatgcactaatgttttttttcttgttttgtgtaagtaatctgagccgttcgatcacgcctcttctctccggatcacacgacacccaccgtttgcctactttttatctccgtcctcttggattggatgcgtccgacactcgagccacaccgaatcccaaccaccattgccgcgccgagctcttcttcttcaccatcagcgaagcagagcagagcagaagcagagcgcggagatatgctcggaggtcgacggcgaggtcagcagcaagaagcgaggtagcgggcggcggccgcagagagacatgtggacgccgtcgcgggggtcggcgagcgggcggcgggcgacgggtcaccgccgcatcgcggactacctcgccgacgaccggacggaggcgtcgacggagaacgggtcgttcaacacggcctacagcgacgagctgttcgcgccgacgtcgtcgtccgccggcggcgatggcgtcggtggaatgctgccggcgttcctcgccgaccagagcgacctcgtggaggtcatgctggagctcgacgaggagtccatggtggtgcggagcgtgacgcccaccacgggcgcgctgtacgggcccacgtcgttggccgggggcggcgccgcgcacacgccgccggggagcgggcggagcctgagccggtgctcgtcgacgtcgtcgcggatacgcaagaagttcgcgtggctacggtcgccgtcgcccgcgccggcgcctcgcgcccccacgccgtcggagccgccgccgccgcgggaggcggcgatggccgcacgcgagcggcggcgcatccaggcgcggctgaaccgtgctcgctccggcgccaggcgcgccctcataggcctccgcttcatcagccgcaccaccggctccgccgaggccgccgagctctggacccgcgtcgagcaccgcttcacgcctctccccacggctccttttgnncccccccggcganccaacttcggcgtctgcatcggtaagcaagcaaagccatcctccatgtccatggcgcgccgcgcgcgggcgcgatcacgcgatgacacggcgtacggcgccggcattggtgcagggatggaggactcgaaggagttcgccgtgggcatcttcgacgcgctggcgcggcggcggcggcaggagctcgagcggatcagcaaggaggagctctacgacttctgggtccaaatctccgaccagagcttcgacgcgcgcctccaaatcttcttcgacatgtacctaagccagccataaatccaaccaaatttccttcgaattttgagttcgtgcgtgtttcgatgaatttgtaaaaaaataaacgagtttctttcagggtggataccaacgtggacgggaggatcactagggaggaagtgcaggaggcaagtagacttaattacacttacttattactccatgattaacttgtaaaatcactggacagtaacattttagaagcttccgttgttgcatggctaacgacattactactaccgtaactgtcactctcactctcacagcatttccagtgtcaaactaggctacacgaatgattaacttcactgttagttaaggtaattaaataatttttactgcatgtggttatttttttttttacagctgatcgtgctgagcgcgtcggcgaacaagctgtcgaagctgaaggagcaggcggaggagtacgcgtcgctgatcatggaggagctcgacccggaggacctcggctacatcgaggtgaggatttcgctttcgccatttctgtgctctgtgtccgttgctgcttgagcttgactcgtcttctccggcgacggcgtggtgcagctgtggcagctggaggcgctgctgctccagcgagacgcgtacatgaactacagccggccgctcagcagcggcagcacggcgcagtggagccagaacctcggcggcggcggcggagggcagcaaggagggcaagggcaggggcaggggcagtcggaggggaggaggaacgactggaggcggcggtggagcccgcggcgagcggcggcgagggcgcaggtggcggcggaggagaactggcggcgcgcgtgggtgctggcgctgtggttcgccgccatggcgggactgttcgcgtggaagttcgtgcagtaccgccgcacgccggcgttccgggtgatggggtactgcctcccgacggcgaagggcgccgccgagacgctcaagctcaacatggcgctcgtcctcctccccgtctgccgcaacacgctgacgtggctccgctcctcctgggcccgcttcttcgtccccttcgacgacagcatcaccttccacaaggtaggtactcctcctcctctcgagctcaccgccggtggttgggaggtcgccgtcgccggagttcggggagacgactcgtcgcccaatgattggcggccggtgcgtctctgccttgtgggcccgggtgggccggctcgggatcttctgcggctcggcccatgtggggcggtgcgacttttgggccgtgtaggtggagagtagctcgggctttaagtgggccccaccggggcggtccaatcagtgtagcgtggccggggaacccgcgggtacagaagatccccggcccggtcggctcagggtcaaagcgccggtcattcaaaagtctccccgaccgacagggctcccactgtcatgtggggccactgtaagctactccaaccggcagggcccgtgttcattaagctaagctccaggcataaaacgtttgtaaatgtacttataggatcaaggtggtcaagatcgcaataatcgtttcttctgacattagcaattataaatttaccaccctcttaactcgttatcataaaactagaatatgaatagtgtaaagcattttattgtaacatataaaaaccattgataaatttacaaatacccctgcttatacctatgtaggatcagtcgtcatacgtcaaatttaaattttaaaagttaatttttatttttttaatattttgtttttaacattttctttggaatttaaaacacgtatataaaaattttacttacgctccgttcgttttttctcttaaatggcaagaaaaccggagcaaagaaattaacaaataattaattaattattactccattacaaacttaaaaaatagattcatttgaatttttaaataaaattttatataaaaacattttataaaaaatacaccgtttaatagtttgggaaacgtataaaaaacaacaaagttgaagtttagactttttttaggtaacttttttttagggaacgaagtttagagttggagtttagaacgggcctttataaattaattttgattgtttcatctactttttcacaactaattagttgtagagcaaagagagcgaggctaaaattagcacattgttgaggttgctagtaattgcaaaagctaaaaaactttggctacacctgcagatcatcgcgacggcaatcgcgctgggcatctgcacgcacgcggggacgcacctggcgtgcgacttcccgcggctgatcgggtcgagccgggaggagtacgagctgctgctgtccggcttcttcggcgcgtcgcggccgacgtaccggggcctcctcgccggcgtcgagggggtcaccgggatcgtcatggtggtgctcatggtggtctccttcacgctggcgacgcggccgctgcggaagcgggaggcgccgcgcctcccgttcccgctcggccacctcgccggcttcaacgccttctggtactcgcaccacctcctcatcgtcgtctacctccttctgctcgttcatggctggttcatgttcctcgtcaccaagtggcaccagaggacggtaagtaaagcttatattagctaccttgtcacgtcatctttacctttcactatcagagcttagttctttttaatatattcatcagattattggaaggaaatatttttttcacgcttaaaaatatatttaagctatatgtttatctatttatcaaaatatctaatttgttcctataatgaagtactatataattcttatcaacaatctgttttaaactgagcctcggagtacttgattataataagatcctattaaactctcaaaatctagaataatagctgtaaaagttaagaactattataattttatatacttatttcgatatccttaaaaaaacttactactacattgatatgaaataatggtaaaaaaagtactacattttcaatattgtttttttaaaaaaagtcaaatgctaattactctgtacttcttaccgtacaatagattctttttgctaggatgctcatcacagatgccagtaatttgcctcgtggggtagctttcgtgagggcgacatttttccggttaattttgatccttccaaaaggttgcaattgcacgtttttttgggttctagcatcgatcgttttggatgtgtgctctcgctcgctctcgccctctctttctcctttggtggcttttgcttttgttatccatttgttagggtcatcctcctcctcctggtcctgcctgttacggtgatgggcacagggcaccattggaaaaaaaaaggagagaaattttagttgcaaattaagggacaattgacctcttggggggccggccaaaatcattgcaaaacagaaaaaggaaaagataattaggacattacaccagaaattatttagtgagtatcaagaattcaaagttaaattttaaggtcattagtagtacgtagttacacaggcacatcaatttatttttgggtaggtccatgctttggacattggacatggaaggaagatatgtagaccaccattgcactgcttcaaattgctttccttggaggaaaaatgacgtgtgcataaatgtgagtggagcccacgtacatgtggggtccaggatgactagatgcatctctatccgtgtccaacactccaacctgttttagatagtcttgaaaccactgttcaatatcatcatgttgttttcaagttattcactcgattatgaaaatagattatttgctccacgctcttctttttaagcttattcactaaattattgaaacgggttatttgtttcacacccaaaaaatacgtttctctctacggcgcgtcgcttcgacaacctgatttttctttttgttaagtctatttcttaaaatatttaatttattcataaaattaaatcgatgatccattgtaataatctgtttaatgatgtataaatcacatggcttctatccagtttcaccgcaaagagtttagatccaatcattccataaacatagcagtcttggataaaatctgttgggttctacggaccgtactgttgcaaagctagctcttgcacggaacgtacagtgatggtaacgggatgttgacgccggcgcacgcacaatttattgtccggttggtgtcgcgttcgagtcagaccggaactcgatcgaccgaagcaaatatgaacctgtccagtattgagggggtttgatacgccaatttgtcattttcagatgcctacgcatcaattggggaatgcggggtccaaccgaatgccaagcccaatctgttgtgagttgtgaccatgaaataataaagtatcctgcaaatcagtctgggagatgaaatcactgtcacatatatatatgtagtatattttttggatacacagagagttttataggagaaaaatactagccaattggatatttttggatccacagagatttttatagggggaaatgctagcccattggattactcaattaggttacaattatagtgacaggggatttcgttaatggcatccatttgtagattatgattgggtgtgatctgctagtggttttcctttaaagcatgtctggcattggttggttttaaggcatacaaacttccaaaactacagaaaattaatttaattatttttgcaccatttctaatttgagcacatggaaaacacctataagaaattagctttatcttccacaattacaatggtcagtgccattcacaaatctgcattcatagccttatgggt

SEQ ID NO: 76984 - DNA, 656 bp, Oryza sativa
acagtagtccatcaatcctttaacaactcaaggagttctgtaaaactctggtccgaccagccattactagccttaagcttcatgagttccaacacgcataacaacttgctgtgcttcgacttgcatccatcatacaacggcatctggcaatcttccaccaacttactaaacttctcataatctctgcgttgtcctctgcgtcttcaatgtcatgcaacattgtagatagacattgagtgtccaaatctatggtctctccacctaaaggagaaatgacattggccatcttcgcacacctgtgcgagatgttcattggggtgcgcccctctcttcagctgttccggtggttcttcaccgtgcagtcggtgtcaccgccatcggtggttggcggctgctacttccagccgcgggggccggtgttgaaccgctacatcccctgcgtcctccgcaagaagtgggacgactggaagagcgactggttctacaccccccctcgccgacaagcgcgcctccgccttccaagccagcccccggcgcaggtctccagctggcgggcgcccggcagatctgggggaggagtacgacgccggcctctaccgcctggcgggcctgcgatcccaggggctcaccggggccctggtgtacggcgattacct

SEQ ID NO: 76985 - DNA, 1276 bp, Oryza sativa
  unsure (1)..(1276): unsure at all n locations
ttcctgtacatatctatctcccatgtgaatattcatggttggtggagaggaggcaagtatggaaagatgggtggatttgttttggggttttgaggtagtagcaaaattacccacaaaaaaattaggtgaaaaaaaaaagaggagtagaaatggaggtgattcagtgtctcctgtgtgcatagggtgtgtggaggtgaaggaagcacggaaggaagaagatcatggcggaagaagatggccggatttcggccgccgtcgcggcggcggccttgcctatttcagtgatttctggggtttatcctctgttcatcgtttgttgcatcatcgactagctgatgaagatcgtcgatcgatttcaatcaagccccccctcttgttgatttcgtattttgttgatgtaatctttgttttgttaagaaccccaacagcatatttgtaccttagctttaaatctgagaatcttttgctgactcatctacctatatgtggtgatgaagcccccctcaatgtattgtaatcacctgcttcaagtaaatgatccaataatattatgttgctatatgtttcattacttccttgatccaataacactcatcttaatatcttgttcattagtgacgaaatcgatgtgttttgtggagctgagcggngggcgatggtgccggggaacctgccgtgacagagaccggcggagagtgcgacggcggcggagtcgccggcgagtcgttgtcatctttggtggaatcgatggtgcaggattggcctgcacatgctgcagcctctgcttcttccaccgcaccgctgcttggccacaaaaagacacgtcctctntattcgagtatgtacatgtactactacccggtagcgtagcgtcggctttgccttttgcaggcagtgcgactgttcatcgtccgtacacgtcgccggagttggggaagacgacgatgacgccggctgcggcggcacccgaatctgacccggatcgatcggatcgcggcgactccgtctcgagacgaatgggttggtgggttgggtcgcgaacgcatcggtcggagtcagggtcggggtgggggagaaaatatcggctgcttgtgtgtccggttcccacgagacagcaggcgtggtggtggtggcttcttgttgctccgtttcgtctcgcacactttcactttactttctttttttgatgggcatgtctagtccttttcgacccttcctgtgtacgtcacgacctcgcacagtcagacaatctccatacacagtatcccgtagaaaa

SEQ ID NO: 76986 - DNA, 837 bp, Oryza sativa
gcacgtcggcggtgcgcctctgaagaagtgcttagcatggagtgcctatcgtcgccgtcgccgtcgccgtcgccggcgtactacgccgcggtcgccgtcgccgcctccaactcgtcgccgaccgtgtcgtcgtcgtcgtcgctggtgtcggtggaggaggccggcgagaagatggccaacgggtacctctccgatggcctcatggcgagagctaggaggaagaagggtgagttcttgagagacatatggtttgtgcatgcttcactaatttgttgtggtttagcactaattacagccacctgacagtgatctaatcatcattaagactgaatttatttttgttgatgagaagttatttgacttcttttgttatgtccccttctccaatttttccaccagttgctgtctgccatacaagcccatttttatgcttccaacttgtacaggaatatatgcatgactgacataaatttcctaagaatcagatttctgtctctcaagttgcaacctgaaactctcatccttatcacaaacaaagacctgatttatcctagttgtctcgtcctaatcatttgcatctagattcttgaactccaaacactagattgtttttgcagatatcaacagataaaaaaaaatcctctaaattgctgtgttttctacacctgaaattctgaacatgtcaaactcatcagttaactgtcatcaggtgttccatggactgaagaggagcacaggaaattcctggtagggctcgagaagctcgggaaaggcgcctggcgcggcatttcccggcacttgtcacgacaagaacaccgacgcaggtggccagccatg

SEQ ID NO: 76987 - DNA, 1119 bp, Oryza sativa
  unsure (1)..(1119): unsure at all n locations
cactgtctgtattgctaacttcctcctttactgaaaggtcagtcagggagaaagagagagagagtgagcaatcaatcattgggcaaaaagaatcatcaagcttagagtagatgttggtcaagctcgagctccaattctttaatcctctgaaagctaaaaaagtccggtcatctctcaacagtgaaccctcctatatgcatacagctatgagcagcctctgacatctcaatcacatgatcatgagtggttttcacataggtatatatacttccatttgccatatataccccttccacacttggaaccttggatcatctcatctcacacacccaaaaacctaaattgcttgattgctcttgtactgcagtngtgcttcctacactgccattgcatataaattntgcactgcaagaataantcagtctgagagaccagagagaacatcatgggtggcaagcctgtgcctgctgcggcgttcgccgggtcggcgccgccgctgtcgcaggtggcaacgtcggcggcgcacggcgaggactcgccgtacttctgccgggtggaaggcctacgacgaggacccctacgcacgccgtctataaccccgacggcgtcatacagatgggcctcgccgagaaccaggtctccttcgacctcctcgagcctacctcggaccacccggaggccgccggctggagcaccggcggcgccggcgccggtagcttcagggacaacgcgctgttccaggattaccatggcctcaagagcttcaggaaggtacgtgagagagagagagagagagagagagagtttgcaattcttgctttgcttggctcgaacgccatgctggtggactgatcgagatggcggcggcttgcttggccaccattgttgcttgcaggcgatggcgagcttcatggggaagatacgcggcggcaaggcgaggtttgaccccgaccacatcgtgctcaccggcggcgccaccggcgccaacgagctcctcaccttcatcctcgccaaccccggtgacgccctgctcatccctaccccttactaccccgggtaagccactgtccattgccattgccattgccatgcatctagctagcttgggatcgatcgagc

SEQ ID NO: 76988 - DNA, 2288 bp, Oryza sativa
aatatgtgacctgtaaaatttttcctctcctctcctctctctccgaactagtgcaaaggagagatgtgcaacttttttatttttattttattttctgatatttttttcacacttagaaactcacaggaatcaaccatgtaaaaaataaactcaaacggacgaaatatgtggcatgtggaattttccaaagttctaccgaaaaacttctctcctcgaaaacacaatcttgcaagcggaatttggaggttttaatatcgccgaacccggcaaagcgagggagaattggatgtaacattttctatagatgtccgtacatatattatttgcctgattccgagttcgtatgagaaagttacgcctattttaatagatgacatattttgtccgtttcggtagagttttggaaaattctacaagtcacatattttgtccgtttgagtttattttttatacgattggttcctatgttctcctaagtgtgaaaaacatatcaaaaaaatgaaataaaaataaaaaaaattacatctctatgtactgtttaacttatatatgtcatttcatgtggttatattttgaattagattaagtaatttcatatagtggtagagtgtattatgtttaacatgctgatcaaagggttttactaaaggaattatggtctaattttagtgaaggtgcaaagtagactaagtggtatgctagctattttcagacttagctaagtggtagttcgagtttaaattttttttgtggttggttgtatcgtgatcctaagtgtgaaaaaacatccgaaaaaataaaataaaaaagacaccgttgcaactccatacagagaaacaggaatggaggcggcggcgccagcatggctggcgccctcctcctgccacgtcagttcgcatgcgccacggtggcaggaggacggcgccagagatggcgccgccccattcgatgacagtgccagccactctggcgccaaaaaggaccatttttgagataaattttttcaggggtctatttgcgaaataagttttttaaaaggaccaaaatgtgaaaaatccagttggatggcatacgtgtgacaaaaaacgcacatgctagctattttttttagctaactaaccatgcctctaaaggtttgttacctatctgactctctcctcacgcttgtgcgatgtttataaacctggctctatgagatggttgtttgtttttggccagtatatatatatatatatatatatatatatatatatattggttgtttcttaaaagagaaaaaaatgccatttaatccacacagttggatcaatttaatttgtctttaacattttcatgtagaaagcaattttatgtaatttatagtaaattcgatacggtggttgttagggccgaattcaccaccaatgaccccagacgcccgtctaagcttatggttgttgtgaaatggaatttaaatgttatttagggattggaaattatattttcatagcaaacgttcaatttgagagtggcccggactctaaaactattgtagatccgattgaggggtgcaaattggacgagagcacaatagttcagagtgattttagacattacacttattaaaacccatgatccaccaactaaacgcgttttgagtttcaaaggtgtacgtcctactttgttttgctactgaaatctttctccattagctaaaatgatattatttccatcggtatagcagggacattattaattaagtccatttcaagaaaggccaggatcaaagcaaagtctaagagttcaagaaattaattcacatagcaccctgggagaagaagatagtgaaatggcttgcgcaggccaacgaggtcacaatgatctccatgggtatcaaaacaatgtgcacagcccatgagacaagagtgcagaatgtgctataaggctgtaagagacaatacgcggtacgtttgtttgccattttcttgactattcctacgttcgatccggacctctcgggttatgtgccacactggcaggatgttctgcacgtactccatacgtgaagatcttcaggcgaggcatccgacttcccgatgccgcccaaacctatgaaataactgagcatagatcgagctggacttctccttgcatgcagttttggagtgtagttcttggtaattcagtaatactctgttgagtacttgagttgctcagctcatctcccttgtgcacacgcataaaatacactggtggagaaaccatctttcgtcggtcggccgatttccccaatagtcccggatgcaata

SEQ ID NO: 76989 - DNA, 5134 bp, Oryza sativa
cagaactagatatttgaattgatttacaaaaccaggcgcggagtttaatttatagtgtttcagagtctctcatctccttcctgttcatggcagggtatagttaactgaccatttttggccttactaaaaaacttggtagagccaaaaccttatcgagtttcggtagtactaaatttattatagtaaaacttgtactcgtgtatgtaaaatttgacgtcatacttcctattaaagttgctgaaaatatgataagataaaaatttgcttcgactcaaatagaggaggaaggaggaagtgcccaaatgtaactttgttttgggccttggaagctactacaggaaggaaggagagttattgggtggggctgggccgtcttaattacttagtagtggtggtgaactcctctcattggcgccccctcggagtccgtctcatcttctctatctacacttgtacacaacactagcaaaccgccatggcgccgccgccgccgtgttgtgtgctagtggtacgctgctgttccggatccctcccttcgccgccgccgccgccgccgcccagaccctctccctccaacaacctcagaatcgccagaaggttaggggtattggcctgcttccctcccttgttctctcttctctggggtggcctggactgattgatttgggatttgtatcttcttcttcttctctctgcgactgatgatgaaatgaagagagtttgtgctgaggagcagtgagctcgccacgctcgctgccatcttccacttgaggtaggtagctaggttaattaggttcccttcagattagttgcgatggttaattaaggtgttgaaccaccatgttcagcggcacgaagccaaggtacctgggcgtgcagaagagtcctccatcgctggctctgtgccctgccaccaacaattgcgtttccacttgtgaggacatcactgactccattcactacgctcccccatggtatatatgctctcttcttccctctcaacatgcattcatatactagtggagtatatgctactaattcattacttttaggaactataaccccaaggacggacgcagggctaaacccatcaccaaacatgaagccatcaaccagctcattcaagtcgtaagtcatccatctgcatttctcttcctttctttttttttctttttttgtttgtttccacgtacatctaatctaactagtaataaaaaatagtatcctcgtgggaattaatcttcaatcatataagtatgttttatggatggtgtcaatcggcaggtcacacaaacaaagcctgacaacttcactcctcgcctagtagagaaaacagatgactatgttcgagttgaatacgagagtcctatattcggggtataattcattctaacaccttcttgctcttcattcagttcacccatcttcttagtctctactccctctatttcacaatataagtcattttagcatttcccacatttatattgatgttaatgaatctagatacatcaatatgaatgtggaaaatgctagaatgacttacatggtgaaacggatgaagtagttgatagtataattgatatatccacatgaactttgcagtttgtagatgatgtggagttctggttccctcctggtaacaaatccattgttcagtaccgatcagcatctcgatcaggattcattgacttcaacgccaacaagaaaagagtcaaggcacgcacgcacgcgcccaatatcgatcatttctattacggagtaggagtagtactcctatctatcattgtgttgatccatgtctcatgctctgttcgatccatctttccattgctgcaggcgctcaggttggcactggaaaacaaaggctgggcttcagaaagcaccatctgaacctaacctcaaggaagccaacccctcgagtctgtactggagtgtggattctaatccctcgagggatatcccctcgtatatctttttcttccaaattcgatgcaaatagttgtgaaaaattctaaaaaaaattgataatgtagagtataatgatacctactagtccaccaaaattcatgttcaaattcgatctacacatcgagaaacaaaaaagacaaatttagatataaacagtacgctattattcatacgctgaatttgtcttttttatatctcgacttgtgagttgagtttgaacttaagattttgtggagttgtatatatgtgttgtatgaatgttgtcaaatttttccagaatttttcataaccgtttagatggtttttgagcaaacaaggaaacatcccctcgagggattaaaatagttttcctctgtgctgtacagactgaccgaccgattggctggtacaggcactcttccttcctggcgcttttaattgcacatttctcctatccttaatggattagtagaccttgatatgcaacagaatctctcaaactttggaccctcatgctattggcaggctgagtacttactcctccctccgtccaaaaaaaaaaaagacaaaccctgagttttcgtgtccaactttgactgtctgtcttatatgaattttgtttataattcgtattttcattgttgttagatgataaaacataattaatattttatgtatgacttatctttttaatttttttcatatttttttaaataagacggacggttaaacgttaagcacggaaatcagggtttgttggccggaggagggagtatgaatgatgcatgtccagtcaagccgatagatataagtcaactggctatggctgtggctcccaagaaaacagaggcaggagggttttcttctctccctgtcatgttctctgagatatactatatatgtagacgatgctaattacttaacacagctgaaaaaagaaatactggccgtcccgtcatgacttgcacttgtatgagggctagcgcgatgtttgtgaattgtgagggggaattgctctggcccatcgatacatgaatcccctgcttggtctactactttgggtgctggccacgcaaagccaatgtttgcattgcaaactgatgagatttagatctaggaacacattacatcaagtaagtcacatgcaaggctaaagcttactaagtactatatagtagtactagtagttagtggcatgcatctgaccctctctctctctctagaatctagattgtgtatttgcgttgcatccattcacagtttgttataattgcatttctctggtcgatcagctaggatgtgatgtgaaaacgcgcattcctgctgtgccggtggctatcaatataggtaagtgttgacatttgtaatttgtttgagcactagctagtcggtcgtgctttccccagcccaggcgcactactccattgacactgtctataaaggctgggaggcagcagaaagacgaaagtcaaaaggactaaaaagagagaggcatatatagtgacataaacatgggcactcgtccatttctggttccggagtcaaactaaacaccaagctaagcaagctatattgatagtgagtagagtgcaggcttcaattcagttgcatcgatgcatttgtgataaatcagcaagtgccttccctgtatatatgtatgacggtggatgcagctattgttagtgccccatgacgagatctcaccttaatactactacttacactagtattagtttttatcctcgctctgtccgtttgtctgctgactgactataactgattaactaggaatagttttgtatataggatgactagcaatagggattccttacagatgccgagaaagttttttaacacatagctatagctgatttctactgctactattttaagttttagttattattagtgcaggtggaggtggagggcttgcatcggagaaggattctaattatatccggatggacacttccattgtttatttcatgtcaactaaataactgtaacaaaattcaaaaaggatgacaaagacatattaatatgaaatatatcaatccacgaatataaaaaaaattcaaatttaacttctacaattgataacaaaaataacaaatttaattgtacgtatacatatgctaattagagtttaatttgttgttttttaactacttatacttaaacttgcatgtttgtgcatcgatataattacatattttaaaaaattacaaccatttaattaacatgacggagtgaacatatggatctaggtaattaaaagagtttcctttatggggtattatatactatctaatgtggtacgctacgtacggcttttaagtcaatgcgtccgtccgtaagtaagaaaacaaactgtacatcgtgcataaacagtaggactccagtatgtatgagtgttgtgtttgaggggtgtgtatgtgttgtgttgtaggtcaaccaatggaaaagcaaggagatgatgatgaatggttatagaggcagggcaccatcccaccttgaattgtcgcatcgcatcgcatccacaccaaatttcactgactactgatcgatcaactttccttttctcctctttctttcttcactaatcaatcaacttaatttgctctgtcaatgtgcatcatgtagctagctagctattcagattcagagtgatgaagtagtatatatttatgtcgccggtgcggtgccgcgtcgtccactggcttgctctactctattattccctttgcattgcattgatcgagtaggagtagtatgcccatggccatcgagtcatggctcaccaaggtccgctccgccatcatctcttccaaacccagcccctcgtcgtcgtcgtcgtcgtcttggaggtcgaagacggtcggtatcctggccttggaggtggccaccctcatgtccaaacttgtccacctctggcgatccctcgccgacgccgccctcgcccgcctccgccaccacctcatcaaccttgacggcgtccgcaagctcgtctcccaccacgacgccgccctcctcgccctcgcctgcgctgagctcaccgacgccctacgtgtcgccgcccactccgtcgccgcgctcgccacccgctgcgcggatcccttcctccgcgatttcgccgacgccttcgcggacttcgccgacactggccgcgaccctcaccggtggg

SEQ ID NO: 76990 - DNA, 607 bp, Oryza sativa
tgtatatgcatacataccttgcacaggttcgtccatgctagctaaatgtcctttggctaaaccgctaagatcagcagcgccgccgccgcatcgattcagcgttaaaaaaacagccagcactcctacatatataccagccccaacaaaacatatgcaatgacagcacaacacgttgccctaggacatccatccttagctaaaaaaggccttgcatcctgaagcccaccagcagcccactatttatactcttgcacacctttaagagcccaacgtcaaacataagcacaaaagcctatagctccttgatatgttagcccgatcagcccacgataacaacagagagatccaatgcttactgctgcacgacctaaatagccaactaaatacgacctaaacagccaacttaaaaagccgttttccatcaattgttacatcggtactgatcaaataacacgaatcggttataaaccgcgcggcgcagcgcgcgaacccgctctagtatatatagcaatgcaacatataatagcactgacatcgagttggagatgaagatgaacatttttataaaaaaaactcgacacatgacgattgatttagctagttagca

SEQ ID NO: 76991 - DNA, 1445 bp, Oryza sativa
aaatcatgtggacatgacaaatttgtactctgtttggacaacaaattggaattgtgcctgtattgtatgaataatgtcaataggaaaaaattacctttctcgcgaaatttcctcttccacttggtgcaatgatgcgaacacactcgcgagggtggccgatcttcatggcagtaggttcaaggcaaaagagcgccggcgtaatccgaacaaaagagggtaactagcgcgagcagcaagaggataactaccagatgcgaccaagtagtgagggtgagaacgatccgaagcctcatgaattccgacccgttgttgatatttcttaacgacattactagaaatataatttccagcaatggcgcagaaatacttctggtatattatggttatagagttcatccgcaagcgtacggatataccattgtagcatttcacccgagagtattccaagggtatcgtatttgtttaatcccgtggaaagattataatagagagaatcgtactaataatttatatattatttgtatcaaccaaagtctaagcaggggttaatataattcatggggtagagtgacactaagcagaagcattcatactcttactcataattatctaagctaagtggcaagaatatagaaagatcctattcctatacttctagtatacatatatattatacatacatctgtcacgaactcaccgagatttcgcggcggaacgccagcttaattggaaattggaaaagaaattgggtttcagatgaacaagaggaagaacaggttggggaatgagacaattcacatgaggagtagttgattttgattgctctttctcgataccgtttccctgacggatgggtcctcctttaaaggttacaaccactcacgcgacgtgaccaccgaacctgcacggcacgtctgcaaactcactcacactcacacggcccaaccggcccaatactcagaacaccacacaacaccagagatacataacattctccaccccttaaagattggcttgtccccaagccaatgctgcgggaaatctttctttcaattgccgtaaattctcccatgtagccaactcatcagggagtccagaccaacgaatcagcccatacggtacaacagatttgcctcgcttgatcaattgtggacgaagaactgcgacaggagtaagctctacattgtcaatgaagcaatgctgaggaatatcagaactcacctgaatgtctggtttgactgccttcttcagaagagacacatgaaccactggatgaacatgagagccagccggtaagtcaagacgataagcaactgctcccacacgctccagaattgtaaagggcccaaaagtatcgaaaactcagtttgtgacaagagcggtgagccactgacatttgcacataaggttggagcttaaggtatacttggtcccccaccgcaaaa

SEQ ID NO: 76992 - DNA, 22423 bp, Oryza sativa
accaaaatatcctcgtcttctacattcatcccttcttccttctctctcctctcttccggccaacaaactccgatgtgctgccgcccgtcccgctggaagaacttggcgagggacctgctcgattggagcaggcagggcagcgacctccgtgctcagaggacacaacattcagggcagcggacggccacgcggtcttgagcacagaccggaaggatgctgcatcaggggacaagaggaacatgagattagttagcacttagtacgacccatttcctccatcaatgaaagaaccaaactgattaagcatgcctgaattcagattaatcaacataaatgttattcatatgacaagataagccttttctattcctaaaattcacagtatcaatcagttggcagtagcaacactagtataaaataaacttgccaaccaacgcaacattccagaaatcactaactacgcaagaaagtaaaaacacaaaatttcttcaaacattgagacccctcagatctgtcaacacaatcgcaacccccaaaaaagagaactttttcatcaccatccacaagcactagcaaaccgcataagccgcactatttactactcctcgacggcggcagcggcaagcattggagctctctctcccccgcggttgccgtaaatggaggcagggacctgctgcagcatgatgcgggtggctgctcgttggagttcattgcctgcaaaagaggagagaaggggaaggaagaagacgggggtattttcgtctaaaagaattgataattgaagtgaaggggtatttagtagcatatctcttatacttatgaaattgtaatggtatacttttaaatagcaaaatagtaatggtgttttttaaaaccgtgaaatttttaatggcatgaatccaattaaccctttttttttggcgatgccccattttacaaggcgtgatgatttttctgctgattttctctcgggagtacccttcgcacacatgcaaatgaccccttgatacctgcgtttaataactaatccattaactatttgccacttttagatttagctaattatttgtaaacccactgaattactcgctgaattcagtgggttggcactgaactgaactgggccagaagagatgagagaaatcgtttccactaaaagttgaaaagggtgtttagtacgtgttagttttttgaagaatggaaaggttgtttccctagctaattcgtttcccagtaacacgagttgcttgttaaaacttggtttttaattttctttacaacgaaacatcagctggttctatcctgtatttttcgccgaaagctagaactaagagcagtagagcatgtagtgatgtacaatggtacaacacttccatcgagattagggtgagttcgaatctccctcttctgaacttatattctctcgttttccaagttgactttcggagaaaactaccaagttggatgcacaacaggcaaaaacataaatggaagcatgaacacacgaacagatgcatgtatcccaaatttccatacacacaaaaaaaaacccaatcttataaacaaatcaggcccaaaacgcatgtttgtagtaagacaaattgaatccagaagaaaacaaagagaaatcgagttggagaagataaaatcaaatacaggctcgaggaggacatgggtctggatgcttaaggggcatgagtgttgcaacatgggtctggatgcttaaggggctcgaggaggacatgggtctggatgctaatcggatatggcaacgtcgacggcgcggcgtcgacggcctggggagaagggaagacggtggttgtggtggaagaggaggtggcgacggatctggctcctaaccatgttgtcatccctgttccgcaccgtcaaccccgtcttcgtcctctgctccaagccgcctcggccagtccgcaacaacagtagcttgacggcggcctcctcgaatccactccaccgtgccgtcggtcatcaacacgcgtcggagttctctggctcccacgctagcaacctccgctccgtcctgctccacgtcattgagcggccatcccgctcgtagtccccgagcttcacgtcggcgcgccagtcaggggaggagggacgccggtcgccggtcgcgggaggagatgaggacgctagtcgggggaggaggagagggagctgaagtcgccggctcgctgtcaagagtgagtggaggaaagtccgagaagggataagggagagagaggggggtggagggggagctttttgtttctggagtctggggcatttggtgtaaattttgaacctctacacaaaagtgaaagaagggactgaaatataaaattaaagccatacctaaagccacttgcactgtggagaactcaaattttggattcgtagccctagcatacgtggcactttgtggcctctcatataagtgagacgcaatgtgaatgccctatgcaaaccctccgactattcctctcctttttttttcttctatcctttttgttttgttcaccggatcttgaatcgtgatgcttaaaagaatgtatgtgttggaaatcaaagctattcactcactcaatctcacaagaacacaagcgcacacacacaaggactcagaacacagagagtttgcaagtgcgtagcactctttttctgtttttctctcacaatgaaactgattacattgatctctatttaaagatgcacatgacctgcttaagcctaaagaaatgcaagaatcctagataacaaactcatccacgtctaacagaattctcctagtcaatcgccgatacgtgcatgcagcgttcgaccgcttcctgctcctgacgtgtgctgatcccttcgccacatttgcatgcatggctaactaattagctagatgtactctcacctcctggcaacacgatcagccactactcactgccaatctctctactcactaagccatgcagcacaaccactaagctagcactcacgccatgtaacacacatacatgtgacttctactcagctactaccatataaataaacatgctgaaactaaaacaacaagattatacttctagtaatcacccccttaatcttgttggctttatttgacaccttccatttttttcttcaaagtagcgttggctcgttgtcggcgctcgcgactgcaagcaacgcctgcttctccttcagaccagcacacttctcctcccatgaataatgcccgtacccttggcacttgtagcagcgcacctttgccttgtcaaaggtgtccttcttcttcttgctcttcatgcgttccatccactgctcttccgtgagcagtaaacggccatatgcttcacttccattgccatcgatttcatacctttcttccacggacttgagacggccggtaagttcctcaacggacagcgtcttcagatcgatcagctgctcgatggagatggccacttgggtgtacttggatggaaccacacgaagaaacttcttgaccaccatctcttcttccatcattgcacccaaggtatggatgttgttgacgaggcccgttagccgcatggcgaagtcgtctacagactctccttccttcatgcggatcagctcgaactccttgcgtagggactgcgccttcgcctcgcgcacacgctcaacgcccatgcgcatcgtgcgcacggcctcccacgcctccttcgcggtgtccttcgacgccaatgttgccaacatttccgacggcaccgcttggaggatggccgccaatgccatcctgtcgatccggtgctcagtgttgccgagctcaacagcatcccaaacaccttgagcttgcatgtttaccttcatcaagagtgaccactcgatgtagttgctgcttgtgagcacgggatagcgcaatgtcaccccggcctcctttacttgctgcacaacaagctcacgactatcgttcctgccatcggtgccgctgccggtcggtgccattgccgctactgctactgcggcggccgggcggcgtgtacactccatcgccagacatgacagtagacactcacctcagctctgataccaattgttggaaatcaaagctattcactcactgaatctcacaagaacacaagcacacacaaacacaaggactcagaacacagagagttgtttgcaagtgcgtagcactctttttctgtttttctctcacaatgaaactgattacattgatctctatttaaagatgcacatgacctgcttaagcctaaagaaatgcaagaatcctagataacaaactcacccacgtctaacagaattctcctggtcaatcgccgctacgtgcatgcagcgttcgaccgcttcctgctcctggacgtgtgctgatcccttcgccacatttgcatgcatggctaactaattagctagataacacatacatgtgacttctactcagctactaccatacaaataaacatgttgaaactaaaacaacaagattatacttctaatagtatggctgcaacttctaggttatatggaaatctctatcgttcttttttcttcttattttttttactcgtcattttgttggaaacagaattgtttttctttgacttagatagtaatatgttaattttattataaaccaaagtagtattcttttgtgtgcgcgatattgttaaatggataacttaaccactcaaataacgaggaggtagctcaactcactaactatgaccaagcaaataaaatctcttttcattcatatccggccaactaaacatcttaaatcagtcaatctgaatgtagtccagcaaccaaacaacccaacatggattaggcaaatgagccaggctacctgttatgttgctcggtggataggaacgaagtggtcaatgggttggaactgagagagacgataatagacagagatagagattgttgctatacaagccgatgattagaggtatgaattttttgagtatttgaaaaatcattctcaatcggcatcaaggatattgaaatataaggctcttaaatatgttgtatttgatgatgatctttattatccgacgattgatggagttttacttaaagtggttatgtgtgaagtgcacgaaggaatttgtggaactcatcaatcgctcacagaatgaagtggttgattaggagagttgggtatttttagtcgaccatgctgaaggattgtttcatatattataagggatgtcaagattgccaaaggttttgagcaatttagagagcacctgcgtcagctatgaacccaataattaagccatggccgttcagaggatggggaatcgatatgaccggccagataaatccaccaccaaggaaaggtcacaatttattttggtggctacatattattttaccaagtggattaaagcaattccactgaagaaggttgattctaaggatgccattgaatatgtcaaggaacatatcatatatagatttggaataccccaaacaataaccacatatcaaggatatatctttgtgtccgatgagtttattcaatttgctaaaagtatgggcataaagttattaaattcttctccttactatgcacaaagccaatggacaggcaaaagcatccaacaaaagtttgatcaagttggtgaaaggaagattgccgaacaacctaaaaagtggcatactatattagctaagtctttatggtcttatcggatggcatgtcatggatctatacaagttccactttatcaactagtttatgggcatgaagatgttctaccatgggaaactaacatcagctcaaggagaattattttacaagatcggttaacaactgatgattatcataatttgatggttgaggagccagaagatttggtataagctagattatgtggaatggaaaaagttaaaggagacaaagaaagaattgtaaggcattataataaaaggttgtgccaaagtctttcgtggaagaaaaacttgtttggaagatgatattattgataggaataagagataacaactttgaaaagtggtcaccaaattgggaaggaactttcgggatccataaatatgtgctaaaaggggcttatatgcttaagggtcttgatgaagaagtttttggaaaaacacttaatggaaaatttttgaagaaatattacccaagtgtatgtgttaactcataattggttgattataatgatgtatgataatagtcgatgtttgaacatcgctttttagatgtccgatatataatatcgcccttagactaaaattttgtgaaatatcgcaagtgtgagataagcaagagtaaaatcggcttagtagctgatggatatattacatgaaaatgtttaaagttgcggtatcaaaaaatatttacggagctaaactattacatcagccaaaaagttctaaacttaacttaatgctacatccgttaagtttgatctattaagtcgtgatttgaatctttaactctggcctactttttgattgccaataagggtagaatcgggggtttcagccgatcttacctgatatagatgttttaatatgtttagttaatctaatcatgcttttcatgctatatttgccattatatatatgtatcacttaagataaataaatttggtgtacatcgagtatatttctgtgacatcttggcccaatcaggatgaggtctgtgtggcccatgtgagctgtgtgcgcatgtttagtactaccttgctagtttagcaagggtggaacaaactcataaggccttttcccttcaaccataccactctcgagttaacctttttacacgaagcgaggacgaaagtataagtggggtggtatgtgtaagtgggtctgcccgtcggatgggctggctacgcggttctggagggagggttgttacaaattctctagattgatatgtatatataaagttgtattagagtattagctaatacattatctttttatccaagtattgtctatgatataaacatatctaatctctgagtccatattgtctcggttaggtccgatctatacagtttgtctataatttagataagattgatttagagattatatgattgtttggctgtggtattagagtattagctaatacattatctttttacccaagtattgtctatgatattgttggaggtacaccacagggcccttcggccggaaccaccgaaaccaagagcttaggtgacaagcccggacgggaggcaaatggcgaaggtcaggaagacaaccacaacgggcgaagggcgcatggcgaaagccgtagctgggaatacgtcaacttcgccaagcggagaccatgtcggagggccgcacgggcgaaggtgaagaggcgaaagcctcggcacagaggcacgggtttcaccaaggtaccgaacctcatcgccaggaggcccagcgggccgtcgagccctcgggagacttcggcaaatagatgggccaagccatttatggcccaataggggctcgtacatgtaaaagacattgtgtacccctgataatgtccctatcataagagtaaccatgtaaattctcctgtaaaacctaaaccctaaagggggagcctataataggattataaatagccccctaagactatgtaatggggggatcaaaaaaattttcaccaagtaatacaattgttcttactttcaaccactgttgagagaaccacgcctttctgcgtgacgcagttgtctattcgacaacagctggcgccgaccgtggggacctctgagcgaaaccactaagagtgagcgaaaccactgatgccaccgaagaaggtcggcaaggagaatgttgccaagcggaaggaaggtggaagcgaaggtgagacggtagctgaagagggagcagagccttcggcctccgagggcgaagctggagctacatcgcctccgctggggccgccatcctacccgccttcggcacccacaacttcgtccgatgtggaagcggtgaaggcggtagcagcggcgaaggccctccaagtcagagacgcggtcttgtcatcctatgcaccatgggcgccttcgatcgctgctttcgcccaaccagcttcgacgtcggcagcgatcactacctcacaagccaatgccaacctcgaagctcaagctgaagctgacatgggggccatgtgccaaaacatggccaaacttcaagacacgcttcgccagatgcaagagcagcagcaagcgtatgagcaacaagacaagccaaggcccacacccaatagttctacactcagccccaagtcactcctccatacgctgcgtatgaaccggtgtacttcgccaggcccgccccagccattgtcgtgcgcctgacacctcaagtgatccaagcaccggttcgcccggcggtgcctcaagtccagtacccgaagcccactcacacaccgcaagcgatgatggaagcagcttcaaccttgcaggctcaattccaagcttttttgcaacaactcaaccagccccacaacaacttaccaagagcttcgcctccggctcaggccgagggaagcacaactcagggtacatcggcggggcagctgatgggacagttcgccttgccaagtcaagtccaagggccttcccctcaaggtccaccttcacagttcgacccaagtacaatggcccaagcaccaacaactttcgcacaagccgtatccccaggatacggaatccccaggatacggaacagcccaactaccgaatcaggcctagaatcaaaccatgatcgacccagccacgacggtacaagtcacttcgacagaccagcaaaatcaggaaatgatgttcggcttaacgcatcaaccgttgcccacagctcaaccacctatgcaagctgtggcttcgccgttcgcacttccatacccacaattgagttggcctgctcagcaaggggctatgatcaagccgcgaactgaaaagggtttgcctctcaactgggggatcaagaatcaccccatcccaccccaattcaagtacccccccagtgccacggtactcgggagagacagatccgaaagagttcctgtccatctacaaatctgctatcgaagcggctcatggcgatgagaataccaaggcgatggtaatccacctcgcgctcaatttcatagctagatcttggtatttcaatttacctattaatagcatttactcatgggagcaattgcgcgatgtttttgtccttaacttccgaggtacctatgaggagccgaaaactcaacaagaccttatgggcattcgccaaaggccaggggaatcggcaagggtgtacattcgccggttttcgcaggcacggtgccaagtgcaagatataaccaaagcatccatcatccatgctgcttcggcctgtttgctcgagggcgaactcacaaggaggctcgcgcgaaaggagcccagaacgtttgaacacctctttcgcataattgacggatatgctcgaggtgaagaagataccaagcgaagacaagagatacaagccgaatacgacaaggcagccgcggctacaacagccaccatgcatgctagcacccaagctcaggtccaagctcaagttgtaagtccaacacccgcccaggctcatccagtaccttttgcgaaccaagtaccgcatccaaggcctaaccaagcacccatgacatggaagaagtttaggaccgagcgagctggcaaagtggtgatggcagtcgaagaggtgcaggccctccgcaaagagttcgacactcaccaagcgggcgggcaacaacaaccctttcgcaagaagattaagaaggacctgtactgcgcctttcatggatgctcttcgcacacgaccgagcagtgtcgaaacattcggcagcaacgcaatgcttaagtgccaaggtcgtagcagccgagggtcgaagaggtaccacgtgaagcagccacaaaccaggcaccccaggcggagcaacgccaagacgtgcagcgaagagtgattcatgacataacaagatttgatcccccctcacaagtgtcgaaacgacaaaagaagatgcaacttcgagccgtgcacaatattgtctcagcaggtgatggggttccaagatacttgtcgcagccaatatccttcgggctagaggacaccgaaggagttcttttcccacaccaggacatgttgttcgtttcggcagagatggctggctttgaagtacggtgcatcttgattgatggagggagttcggctgatgtcatgttcgccgggacatatgccaagatgggtttgccaactttggcattatctcaagcaccgacttcactcagaggttttggaggcgaagcggtgcaggttctgggacaagccctcatcaaagttgctttcggctcgcaagagaacagaagagaagaagagatactcttcgacatcgtcgacatcccctacaactacaatgccatcttctgtaggggcactttgaccaagttcgaagcagtctctcatcacaattacctcaagctcaagatgcctggcccagccggtgtgatagttgtaaagggttctcagccttcggctgtcgcagcaacccctttcgacagggaggtccacaccttagaggtcgaagggcaggaaaaagcaaagtcaataccgaagcccaccccacacggcaaagtcatccagcgacagatagatgattttgaccccgccaaggtcatatcactcggtggagacctaagtgagcaagaagtcgatggcatactagccgtgctaaaaaagaacattgacatcttcgcttggggactagacgatgtggggggcgtttcgccatatctcatcatgcactacctcgcagtcaaacctgaagcaaagacgaagaagcagaagctaaggaaaatgtcggcagatcgccaagaggcggcgaaagtagaggtgaacaagctactgagagcaggagttatacaagagattgaccacccagagtggttagcaaatccagtaccgatgaaaaagtcaaacggcaagtggcgaatgtgtgttgacttcacagacctcaacaagatgtgcccaaaggacgatttcccattaccacggatcgaccagctggttgattcgaccgccggttgcaaactcataagcttcttggatgcatactccggatatcatcagattcacatgaacccgacagatatccccatgacagccttcatcatgcccttcggcactttctgccatctcagaatgtctttcggcttaagaaatgcaggggttacgttcaccaggttggtgtacaaagtcttggggttgcagctggggcgaaatgtcgaagcctatgttgatgaaattgttgtaaaaagctgcaaagcttttgaccacgcatcagatctgcaagagactttcaacaaccttcgcactgctggcatgaaactaaacccagagaaatgcgttttcggtgttcatgccggtaagttgttgggattccttgtgtccgaatgggggatcgaagcgaatcccgagaaaatcgatgccattcagcaaatgaagccaccatcgagcgtacgacaagtacaaaagctcgcggggcgaattgcggcactaagtcgattcttgtcaaaagcagccgaaaggggcttgtcatttttcaagacccttcgaggggcaggaaaattcagtttgacgcccgaatgcgaaacaacctttgatgagctcaagcagtacctccaaagccctccggctttggttagcccggtgttggcgggtgttaaatgtcgattctataccgccaacatctgcataaagatcagataataaaacatccaacatagagataggcacttaatctcacatattccacaggtgttggtgtatatttgtatgcagatgataaaccctgaaggtgggaggaaaatcagactaaagtgaggagaattctgtatccatgcaaggatgggttgtgaacttcatcgaaacatccgtaaatcagcccaaaataccaagaaatggatagaggaggaccaggggaggactcgggccaaaggccacgctagatgggcccagctcaggttcggccgaaccccctggttcggtcgaaccacaatctcagccatccaggctggggtttggcatggacgtcccagatgcatccctgatggcggttcgagggcacttcggacatttccccttcgccaaccgtcatacctattgtactatattgtactatattatataaggacatcatctcactcacttcaacatacacttccaagcttgagctgaattataagaggctctattgtactatattgtatactagaataggaagagagtagagtaggagtcggaagaattccgaagttgtcggtaatcttctcctatttcttttattctgtttattactctgaattcaatataatattcttcttgagtaatttagatttatcttgtgataattatctcttggttagttcctaatcagcatacaggattattgttcgctataatcaactaaagtatagtgattgctttggtgagttataaacactaaagtagatattaatttattagatgtggtgtttaggtaattattatccagtaattgctgcgtatcccacaatatgttgaggtgggtgtagaggtggtgacagccctcgagatcactgaagtcctccctgtccaggtacgtagtagagtgacatctgggaacagcgggttgccagtgcctgaagtattgcattaggattaaaattaagctttccctggacactgtttctcactagtaaatcctctctatcctagcctatcatttgcttggtgtccttggatgaactggaggaagctctgatcaaacacgttcccttggattcgataccgttggaatactccgtaggggaagtgctatatcggtatatccgtgcgcttgcggattttatctgtaaccgtatcaaataccaacaagcatttctagtgccattgccggggaacggttgctaatcatttccgaacccagttcatcttcgtatcctttttcattttttattcttccttcacccctgctatcctagagaagtattcctgtcaacacttctcgactatggagcaacctctgtttgagctgtctgctcctcggggcgaattctatgagccacctccttcatcggagcccatttatacaactggctatgaaattcgtcctaagctaattagtatggtcagggaaaatcctttttctagctttgatttagaaaatccctaccatcatctgcgagactttgaacaagtttgctcatgccttaagattcgtggcatgagacaagaaattgtgctgtggaaattgttcccgttctctcttcaagagagagcaaagcaatggtacacctctaccgttggatgtgtaaacggtagctgggaaaagctgcgagacagattctgtcttgccttcttcccagttacccgtattactactcttcgagtagaaattctcagtttcaagcagatcgaaaacgaatcaatcggtgcagcttggtccagattcactaatttagtgcagtccggaccaaccctgtctttacccgagtatgtgcttctccaacatttccatacgggtttggataaggaatctgcattctatatggacataaccgctggaggatcattcatgcacaagacaccgtcagaaggaaaaacgattttggatcgcatcctagaaaacacttccttcatgacgcagtccaatgaaccccagccggaggcatccatgtccaagatagaggaacctctaaccatcgagccacttgctgaaccatctacttctgctagctcgattgatgagaaggttcctgagcagccgtccgtcgagaatgaagaaattcagacttttgattgtgccgcaattatgtttagggaaggttttgacgaagactacggcaataccctaaactactttagtaagaggaaaccacccgttcctttgtcacctcccgatcctatggaacttgggttcctacgagaaactgtccgggagctgacatccataatgagcgacgaatggctaagggaggcagagcgttcatccgaagtaattcggataaataccgctccccgaatcattccttgacatctggaagggaacgatgtcggcattcgcttatttgagtgataaggcagtgaccctgataaacaaattcttcaagcatccgaacggaaatatcatcgaaggatttgggattgtacaaggcgtgactgtctgctttgaagatagggaggcgatcttagatttccacgtctttgaaatccaagactttgatatcctaatcgggctgcccattgagcaacttctcatcaacacaccccgattaggtagcctcaaaataacactgggagagaatgaattctctattccattcttgcgggcaaggatcaccttgaccgaccctctcccaaggcccttctagaagatgaggtccccgacttcatcaaggaagaagcagatcccggtgagactctcgacctgccaatcgtggaaccgctacctcgacctctgcttgagcttaaacctctacctccaggcctacgatatgccttcctacacaaagacagagaggctccggtcataattagtgacaagctctctgaagatgagactcaacgtcttcttactgtgttggaaaagcatcgttctgttcttagctactcgcttcaggaccttagggggattaatcccgcactttgcacccatcgtattcctattgaccctgagagtactccctctagggaacctcaacgacgactcaataatgcaatgcgagaggttgtaaagaaagaggtcttgaaactgctgcatgccaggattatctatcccgtaccatacagtgagtgggttagcccagtccaggttgtgccaaagaagggaggaatgacggtcgttgcaaatgctcagaatgaactaattctgcaacaaaccgtaaccggatggaggatgtgtatcgattacaggaaactcaacaaggctacaaaaaaggatcatttcccgctacccttcattgatgaaatgttggaacggctggcaaatcattccttcttttgtttccttgatggatatttcggatatcatcaaattcccatccatccggaggactagagtaagactacgttcacatgtccatatggcacctatgcgtatcgtaggatgtcctttggactgtgcaacgctcctgcatctttccaaaggtgtatgatgtctattttctcggacatgatcgaggatatcatggaagtcttcatggatgacttctcggtctatggaaagactttcggtcattgtctgcaaaatctagacaaagtcttacaacgatgccaagaaaaggacctggtgcttaactgggaaaagtgacatttcatggtccgtgaagggatagttcttgggcatcgagtgtccgaacaaggaatcgaagttgatcatgctaaaattgatgtgatagatcagcttcctcctcccgtgaacatcaaaggtatccgcagcttcttgggtcatgtcggcttttatagaaggttcatcaaggacttctctacaatcgccagacccctgaccaatctgctagccaaggatgtgccctttgagttagatgacgcgtgcctaaaatctttaaaagtttctcaaaaaggcactcgtctccgctccagtcattcaacctcctaattggactctacccttcgagattatgtgtgatgcaagtgacttcgctgttggtgcggtcttgggccaaaccaaagataaaaagcatcatgcaatctgttacgctagcaaaactctaaccggagcccagttgaattatgcaactactgaaaaagagctgctcgcggttgttttttctatcgacaagtttagatcttacttagtaggagccgaggtgataatttatactgatcatgctgctttgaaatacctgctcactaagaaagatgctaaacctcgtctcttaagatggattttgctactccaagaatttgacttagaaattaaagatagaaagggagtagaaaattctgtagcagatcatttgtccaggctgcagatcactaacatgcaggaacagccgatcaatgatttcttaagagatgacatgctgatgacggttagcgactctaacccatggtatgtcaacatagtgaactacatggtatccatgtacataccaccaggggaaaatcaacgaaaattgaagtatgaaagtcgccgtcacatatgggatgagccatacctgtatcgggtctgctccgatggcctactacgaagatgtgtgccaactaaagaaggactaaagatcatagaacgatgccatgccttaccctatggtggccattacggtgcattccgcacccaggccatgatttggcaaagtggtttcttttggccaacaatgtaggaagactcaagagaattcattagaagatgcaccagctgccagaggcaaggaggaatcactactcgcgatgcaatgcccctcacatacaatttgcaagtcgagatattcgatgtttggggtatagacttcatgggacctttccctaagtctcgcagctgcgagtacattctggtggcagtcgactatgtctccaagtgggttgaggctatgccgtgcagtgccgcggatgcgaggcatgccaagaagatgttcaccgaaatcatcttcccaagatttggtacccccagaatggtcataagtgacggaggttctcattttattgacaaaaccttccgagaccagtggtcaagcagaaacattaaacaaacaaatcaagaatattctgtaaaagacggtcaacaaaatgggaacaggatagaaggatagattgtcggacgcactgtgggcataccggacagcatacaagacacccattagaatgtccccacatcagatagtttacgggaagccatgtcgactccctgtagaacttgagcacagagcatacttggccatcaggaactggaacatggattttgagggagcaggagaatggagaaaaatgcagatcgctgaacttgaggaatggagagaaaagacttaccacaacacaaagatatacaaagaaaagacaaagcgctggcatgaaaaaaggataaaaattaagaaattcaagccaggagacaaagtactgatgttcaactccagggttaagcttttcgaccatggaaaactgcgcagcaaatgggaaggaccgtttgatgtcatcgacatctcttcgcacggggcaatcacactccgcgacgactcaggtaacatatttaaggtaaacggtcaacgcctaaagattttccatgagccaaacgaaactttagatgaagaagtggatgatatagaattaattgactatgagccatgatcccatctattgcatgcttaaaaccctgtatagttgtcatttttgtgcttagaataggtttttgtgggcctaggaaaaatttgggggcctgccggacccaccagggtttggccgacctgatggtttggccgaaccggggcggcccccgatcggccccaattttgaatggcagtctcccccgctcatcctgagtctgtttagatgcgagttaggaggtagatcagtcgtacctgaaccagagcccctgttcttcctcctctctctcacatttttgcaacctttctctccatctcaacccaattcccttgctccaccatctccaactcaccgatggctggcaaatctttgatcccattcatcggctcctcaaattccacatacaacctcgacggaaagccgacactgacgaatcaattaatcccggtggagcactacacaatggaaggggtaaatgcactgtgggcgcagccccttgcaacagtgccaggctccgtagcaaatttggagcccgtcggcgagctccctggttcggccgaaccaggggttcagccccccgttcggcagcgcgatccctctcccctcgacatgtcgcaagaatgaaaatccggggggattcgcctgcacgatggccgactatgggagagctcggcttgttaaaggcacgatgccttttccaagatgataagaaggccactacgcctcccgccgagcattatgtgggcaccctcttcaccaaagcaagggatgaggtgctccacaagtaccccacacccaccgctactccatctactccaaagggggagcgtttctgtattcagggagtgcgaactctcggcggtgggtatggtaagggtctactccggcctttgacggcatcagagaaggagggggcagcggagtcctgtagccctccacctgtgatggtgaagcgtcatttgatgccccctccaatggtgagggctcccggctaattccaagaggatgaggtgtaatcgctggagcccttgatccacaagctcgccgcacaagtgaagaaactccgcaaggagaacatagaggttagggatcgcaatgcggagctaggggtagaacttgctgaacttaggaataattttgataccctgagtcgcggtttgtgctctaagatcaagcgtgcattcatagagatgggaaaggaaaataagtattatgctaattagatgtttcctttcccatgaataaaatagtagtaggtgcttggttttatttttccagtcatctaagcacttgctataaataatgtggctcattggtgttaaccctaatgtttgccaaattttgtttttttatgtttaataaaattcaggttttgaataagtgtgggggagatatcccagcttctgacgtgcatatgctctgagaattgttgaaatatctcaacacctggaagcactgaactatgcagaaagttgcagagggattaggcactagagtggttcggccgaaccaccaggttcgaccgaaccaagtctagccccaacccttctcaactttcacaggtaagcaggtgagcatgtcttttatctgaatatctccaccatggtgtagtactagagctgaaaattcagaaacaattggttcaagcataagtgaaagataaaatttccaactattgaaattcttcaagtgattgatcttgtatatttattattctcagctgaacttgtgcttgtgaacaaccatccatgttaatggaaccttatgcatctaggtaattgctttatgtgagatgattaagatgaaaggaatccttgtaactttgttgtgactcttgggaatttgttttcaaaaataaaactgttttaaaagctatatcctccaattgactttaccttatacttaccaaggccatatgcaagtacattaatgatcaaccttatcatgcatatgattgcttgacattatattgagcttagtcataattgtgtgacttgtgttagatatctttcatactctcatgatcaaggggtcattatcatttccacatataaaattgagctaaacttctacactggaagttggctttccacacaaatattcattcaattaaactcctacaatgaactatgcattcttctcctagaaaagttcttggcaaaaataaaatgagaaaaggagggaaaggcatggctatgaaaaaaaacgagaagaaagagacctatggaaataaagtttgctctcaaaacattgagcaaagaaaatatagccatgccccctccacaatcatgccaaaagaaccaatttggagagaaagtgtagaaaaaaggaaaatcatctctttattccataattccacaaaatattttacttttccattttccacctttatttaagacccttgatctaggagtatgactgattatcttcttgagtccatatttttggctttgcaatatatatgatgcaggtatgtcacaatttatccctaccaagccccacatatcagccttagaatagggatgaattctggcacatttttgccttggagaggatccaaaaagaaaatatacatctttgagagacaagagagaaagtcaatatgaggaaaagagctagtttgcgaaaattcatgaaaatcccatgagtctgacagagaagtaagaaggactggaatcaagatcgttccatttatcaattactcaacatggtaagatagccactgaaaaagttcacaggtgcaggtatggttgtgaatgatttatatgcttgattcatcttttgaagaaattcattcacaggtgcaggtatggttgtgtgggtggtttttttggcgggtgttaaatgtcgattctataccgccaacatctgcataaagatcagataataaaacatccaacatagagataggcacttaatctcacatattcgataggtgttggtgtatatttgtatgtagatgataaaccctgaagttgggaggaaaatcagactaaagtgagaagaattttgtatccatgcaaggatgggttgtgaacttcatcgaaacatccgtaaatcagcccaaaataccaagaaatggatagaggaggaccaggggaggacttgggccaaaggccaggccagatgggcccagcccaggttcggccgaaccacaatctcagccatccaggctggggtttggcgtggacgtcccagatgcatccctgatggcagttggagggcacttcggacatttccccttcgccaaccgtcatacctacccctatataaggacatcatctcactcacttcaacacacacttccaaccttgagttgaattataagaggctctattgtactatattgtatactagaataggaagagagtagagtagaaggagtcggaagaattccggagttgtcggtaatcttctcctatttcttttattctgtttattactctgaattcaatataatattctttttgagtaatttagatttatcttgtgagaattatctcttggttagttcctaatcagcatacgggattgttgttcactataatcaactaaaatatagtgattgctttggtgagttataaacactaaagtagatactaattgcttagacgtggtgtttaggtaattattatctaataattgctgcgtatcccatagtacgttgaggtgggtgtagaggtggtgacagcccttgagatcactgaagtcctccctgtccgggtacgtagtagagcgacatctgggaacagcgggttgccagtgcctgaagtattgcgttaggattaaaattaagctttccctagacactgtttctcactagtaaatcctctctatcctggcctattatttgcttggtatccttggatgaactggaggaagctatgatcacacacgttcccttggattcgatacccttggaatactcctaggggaagtgctacatcggtatatccatgcgcttgcggattttatctctaaccgtatcaaataccaacacccggtagcagggagcgaactacggctctatctggcagcttcgcctgtggtcgtcagtgcagctttggtacaagagaccgaagcaggtcagaaaccagtttactttgtttctgaagctctccaaggggcgaaggtcggatacattgaaatggagaaactcgcttagaccctggtgatggcttcaagaaagcttaaacagtatttccaagcccatagaatcgtggtaccatcacagtaccctttgggcgaagtgcttcgaggaaaagaaatcacggggcgtctaagcaaatgggccactgagctatcacccttcgacctgcactttatcacttgcactgtaatcaagtcccaagtcatcgtcgactttgtggccgaatggacgcctgcgactgtcccagagcccaaaccggtcgaacaaacatgggtcatgcactccaatggttcatggtctcataagggggcgggcatcgctgcaatcctaacctcgccatgaggtgtcccaattcggtatgcagcaagactgcagttcaacacaaccaacaacacagcagagtatgaagcagtgttattgggcctgagaaaagcgaaagctttgggcattcggcatttgctagtccggacggactcaaagcttgtcgcgagccaagttgacaaatccttcgaggcgaaggaagagggaatgagaaagtacctagaagccgttcggtctatggacaaaagtttcgccggcataacggttgaacacttgccccgaggccagaatgaagaagccgatgcattagcgaaatctgctgcttgcggaggaccgcattcgccaggtgtcttcttcgaagtcctttatacaccaagtgggccagaagatagccaagacatcatggcaattgaccaagtggagccgggcgatgacccaggcgattggcgtacgcctttcgtcaaacacctcaaagagggatggctgccagatgacgaagcaatggccaaacagttgcaaatcagagctgtgaattataggctaatctctgggcaattgtaccgaacagggatgctgcagcctatgcttcgttgtgtttctttccccgaaggtgagtgatgaactact

SEQ ID NO: 76993 - DNA, 8164 bp, Oryza sativa
gcaccctccccttccggtttggtttttttatttgtgttcttgtagtagtgttttctctaggatttggataaaatttgtgtgtatatgtttcagttttccctctcctgttcaatttgcatgatggaattccggatgggattttggttgtgtgtatatgtttcagttttccctatccgattcaatttgtatgatggaattccggatgggattttgggggcggacaattgaggggggggcacggacgaaaaaacagcgcacggacgaggtgacgattggaaaaatataaatcttttaattagttaagattacatgcaagttgacatcaacgagtcttcaggaacaatttaaggctgacaaatactatggcctgttgttagtcaagttgtgtgcatgtatcgtccatgatatatatggtgcctttctcttctctcagctgtgcaacactaactgcaacctagcatgcatgcatatgctgatgttgggttgacccctgaagctaattaagctagcagcgatggcaattcctataccagttgagaacaagcaaagctagcgcgctaacgatcgagctggagtgtgtgtgaatgcaaatgcgcatatatacggtaatgatgcatccacacacacacacaactatatagtaatagtagtagtagtatatataatgctgcatagatagcagtaaattagcgacgatatgatgcataggaagtaaagtagaaacaggaatgatgcatacgtatgtgaataagtgtgatgtgtccgctccatgggaggcaatcgccgggactataaatccatgtttagaatttttgctcctatatatgtagtatagatctttgctcatgcactctaccgcccagcaatccatatcgccctttctatctagtttccatcccatcatacgatcgatcgagcaacttgctaattaattgccaactttttaatttgtttaatgaatcatctagtagtaattgtttacagtctgcacttgacaatgcaagtagctaataggctgcccggccgggataacacatggggaagttggttgagtcgatatatatatgatgcatgaggattccatccatacatacatcacatgcttaattatgcttattcttatgcatgcatatgctgctcctgccctggatcatagatcagaaatcagttttagttagttgcggtagcaacctaacctagcttcatgttgctcctgcgctggatcatagatcacaactcagttttagttagttgcagttgcaacctagctagcttcaggtcggtggatgaaaacagccaaaacaccacgtactggccggtgtggtgtgattaattaaactgcaggcaggcagactccctccctccctatatatccatacaaccaaaaatccaaacttaacttaattttctttcattttattttcattacaaccggccggatcggactagtgttctttcaacagctagctagtttgtccatactaattggtgccaattatatagggtagtaggtctcgtcctccattgaaaatgttctttcacaagctggagtcgatccggaggtccgagaagtttaattatggttggttcacttaatttgttgtcttttttaatattaccaaagtttggtaatgttaaaatctggcacatatattgtggcgtttaccgaattttgatattggtaattgtaagggtatgtttagtttgttacgataccaaaatttaatagggttaaaaatgacaataaataccctaaaacatccacagaatatatgtttttatgctgtagtatctctgaagcagttacagatacagtaatacgtacagttttttttaacggaaaatatattttttttgaacagaagtaacacgtacagtttagtaggtgacttagcttgaagagcgagctcaataggaacggacgattggcttgattaattatatactacttcctctcagtgatgcagctagaaaattttcgagcccggacatactcagatatacatattatttgctataatatttctaactttaatcatttaaaagaaatttcaatggtgtatttgacggtaggcccagacaactacaagccacgcggtggctccgcccctgcttactctgtttcacataataatatgctttagcttttaaataggttcatgcatggcatgaactatatgtatgttcatatttatgtggatgttgataaagagtaaaaaaaaaacatcctgtaacatggatgtatatgtgatggagaggaaagcgccatcttatcttactgaaaaccccaagttatctaatcaggcagggatacataagaaacaaaaggtgcattttttttttcaaactacaaactttaaagcaactaaagagaaaccagctaaatactttaatcagtagtgccaaattaacaggggagataagggaggtaagctaatcaacaaccacagtcgccagctggttaatgttacctctcaaccttgcaattatgcatagtacgtaggagccaccaatataatatcgtgtggtatacttcttccaaagcatagggaccccaattaatcctctcaaaaatagaaattatatatatagctagatactcaatccatgtacctaccatcttcgttctgcatacacaaagcacaacaaacaaacacatgcatatggtatatttgtatggtgctatatatactattaaaatagggtaggtgtgcatgatttttatatatatagtgaatgaagcaaatcattgtccacatatatatgttaattggaacaaattaaaggccaggccaacagagatttatattttgtaatctgggattgcttatatagccagcagttgttgctttaaacttgaggcaacttcttattcagaatagtactgcacaactagacacatatatatatgtgccgacgattaattggagatgaagatgaatctgtgggtagctacatactagctaattagttgtttctactttctccttatgtcagcactaagctagctttctgtaaagtggtatatcaagttgctgttccagcgaaaacaaaagaaaagagagggacgcacaattaagtagcaatagattacaggccaaaatcaagtcattcatgattggtcagagacacctttgacttgaaaacactcaactatatatacatatattaggttgctgctgctatatagtggtagatgagctcgagtgcagtggagagggcagagggacctccaaattccaaaaggaacctagcagattttgctttctcaaaaggaaaccatatagatagcatagatatggacctctttttttgctaagaagaagaacaaattagtctagaattaatagtgcccgggcgaattgttaattctctaactaattaattagagctaggccatgtccatccctaaaagaaagaaaagattctcgatcgtgtgcctggctacagattaattagtacgtacatgacaagatgcatgaatgcataaatagctccaggacatctatccatggctgtgcctatggcgagcaacattattcttggcagggtatataatataattataggtggctgatgactcattgactaaactcaacaagaatgtgggttccaaatgttcccatccaggtggtaaactgagcgtgaagttaggatagatcatattgcttttctgaaaaatgtccagttcacagagcgtgaagtctaggattatgttttttataggacggagggaaggagtacatactccactgtgctagggtagtaccttggctatttactccctctgtttcaaaatgttgtcacatatactacgaattttgaaatggttctatcataggctctgtttagatttcaattttttcttcaaactttcaacttttccatcacatcgaactttcctacacatataaacttccaatttttccgtcacatcgctccaatttcttcaaacttctaattttggcgtggaactaaacacagccatagtagtagtactaatatttcataggttataacattttgggatagagggattattttactcacctcatgtatattaagaccaagtgttcaatgaactttgttagtagtacagtaccatataactgtctgtaaaagggtattaatgtcattaaggtaaaacaacaacagctatcggggatcagcgctctataatttgggataattaattccacagaaacgccaaacacataaagaggaatattgtatatgatgccctctatgactatgagcgagcctatatatgcgcctagtgctcttttggcagttctttaatttcttcctgatagtataaactaagaagacatggtgcaaaacgtacgtatggttcaacaatggccggtatagctttattcgacattctcaaacgttcttcgatcctccaatactgtttgtttatcatctactagctttatgttatctttggtttgttgtttatcgtgtagtctatcgatgtttgtcgcatgccacatgcagaacataaacatgcatcaacaaagtggagtaactaacatatgcatactgaatgcaagagaactcgataagttacttccaagttccactctagtttcttttgttctaacaagaaaagggaaaattgtgagcagcaggcaacctatttccaaaatgttgacagatatgtatttagagaaaagtgcagtgtctccccttcacaaactctctctgcatgttatgtttgacgactcccgtcagtaaggactcaactcaagcaacatatctgcattatctttcatcgtttttttctcttccttcagtgcccacaccgaatctgcgctgtagagggtgaccaggatccaaccacactcattcaggttgaaatagccttaggagctaaccacagcttcacctttttgtccactccagcagtcgctaaaacaaaagcaggagttccacctaaaagaaaatattatcagtgatcagtttagaatctgtaaacacttctccctcggaccaacaatagctttatcctagtatcctcagcctggaaatcttccagcaaaaagcaacacgcatatttgtaaatggcgacaagtgatgcgttgacatgagacatgaagtgcaccagctctaaaatatgaattacatttgcatatggctaaaaaggacaagcttcaaagaaaaacgttttggatttcaaagaatttcacatgtacatttcgttcgcgcggtttgcatacttcttaccatttggaattgttcgtgaagcccaggcaatgccagttatatcacctgattacataaagaaacatatcactgtaagattgcagcatatatctagcaaagatcataacaggaaaaggtgtaaattatagcctaatgtatcagcactgcatatctttatcgagtgaaaagtagttgaattctaaatactaaattacgatcaaatttctgaagacagcacaaagttgagaccatctgttatgcaagtaagtattggtataatccatggacttcatggccatgatctacaagtagtctgcaggatcattgaaaaggaaaataacacatgaacattgaccacagagtacagagtatgatgtatttgcccatggtagtcagttcttaacaactcgggactattgttgaaaaggataggttgtgactcaaacacaaaaaggttcacaagaaaaataaacagtgtcaaatcttctgtgattcagatcttaattactgccgtctccttaacaatttattaggtccatttagtagtaaaaacagtgtccaatctggcaaatcaagaaagaagagggcacataccttcatgtgctttctcagctgtatcaagaactgcaccagtttccacacataaccattgcagcgttgatccacttgtcgtggccagaactttctcatcaggagatacactcatgtgatcatactggcaaacagaaccttttgaatcatggagaggaattggcaaaactctcaaggttttagggtcttcatcaagatggtaccttactacaaaattgacagaatatcaacttgtgaggaaggagagtatctgagaaaaagagaacagtacaaggtgtgcatagacttctataatggcaataccaagaacaaatttattttcatcaggacatttgtataaattcataagtgcattctgtataaacatttggtagtgatcaatcagcacagcatctaacagaaaggaacggcatgagaatggctgggaagcaacttgaatacttgattacagaggattgcgtaaccaggtttgatacttaaaaaaaatgataggtcctctcaacttttgtgaagtcaggcacaaagacaactatagatgcactttggcatactgagcattcaataagtggaaatgaaaaaaaaaatcaaaagtataggagttgttgccgtgatcactttcagaattcaagtaaacaagtttttactgttacaatttatgaacccaatcccaacttattgcttcaagccatcaaggatatggtggtaagcggcatagaacataacattttgattaaaataatagaacataccattaatgttccatactcgaattgtaccatctttggaagctgtaataatctgctcagaattcagagcgaaacacaggcaagtaacagcgctctgaaaaaaggagaccgtcagcttctcatatgattcagaacatgcaaataaattcgtaacacgtccaacaagacaagggggggtcttactttgtgacccttaagttgcataactttattgacctccttcacagagctatcctttgaataaacaatctcccacacctactcaaataaatgggaaaagttatattgcccggatatcctggcaaggatatgctatagttcttcaaaataaacagaaaactaaccttgacatcagcttgtaaagctgcagcagctatgaaacggccatttggggatatatcagccatattatttttcaattgattggtgtcgactgttcccaactcctttccacttttcccatgccaaattttgatatcagttgctgcatgacaactcaaaatatcaaccttagtgtgagataaaaggaaatccatgtagcgtgcacaacttaatggcatataccttcagagcaagaaatcaatattgtgctgccatcaccagtcccataggttgcacgagctgccgcaagattcagcactgactccttgccgtgaatcttacggtgttcccactttatctcagggggagaaagcttgccctgctgtttgtttccgccagctggaggagcaccaacatccgcatacatgtagagagatgagcctaaaagtgcttgcgctgccacaacaactgatgatgccccttgtgagaaagcaatagctgtaggatgtgccccagcgggcaagttgatcctcagaattctgcaaaacccccataatctcatactccagcataaggaagtaataagaaagaataattcgtgcagaattaaaaaaaaaatcttacttaaagctcttgcttgagacatcatcaaccctgaatactctgacagctccatccgcacatactgcaacaggaagcagaaagttatagatgtagacattagaatttggagtagcaatcacacttggttgatgaagtgaaatatggtaaactgtatgtgtggtgccaactttgatttgttagcaatgagaaccacaaaacatgaggcatgatataagatgagaaaataagaaaggcaggacacgaacaaagagaggtcctgcctcgtggtaatatggtgttgagaaagtagagcggaaaaaagctgaccggtggccaggttgcaggcatcatcggagaaatgaagtgctgtgactgaatcagtatgccccctcaaagtgttgacatcaagatgatggtgcttttttgcggcgtcctaaaagaaaatcatgttgagatcaatgacggttatatgaaatttgccgacaagaaagaaatacagtaatatgacattttcggagaggaatgaaatagtaaggaggcttgtgcgtgtaatgcctaaaatttataatggataaacatatcaaatttggtaactcagattacggaatttgcaagcagcaatgaggttacatttaaagtcgtgggtggaagatagtactagtatataggcggtagtaataataaagaaaaaggaa

SEQ ID NO: 76994 - DNA, 704 bp, Oryza sativa
agtccctctcaaagaataacatggtacgcagcggaaaataaaactataacaaactacggaacagctatggcgactccactccacaggcatcctaaccagaacaagcctaatcctccagatcatcaccttcactgagatactcctcttctgatgaatgaatattgcaagaatgagcatatgacatactcaacaagtcacacagcaaatatgcaagtgcacaggataacaaaggatggcataatatagctcatttgcagaaacagcatttaacgaatatttaagagaatagtaaaacagttgtaataattaatcaatattaaataaacaccatacaacacacccatgttgcataggcccaaccacatttgaacaaccaaccccagttgaacaaattaaacctccaaaccaggaattatccattccaaaccaggagtcaaattaattaccacattattaccattaatgagtagtgtgagactaatcacgaaaaacattgctcaactcacccataaccgcgggtacggctattcgaatagtttaaactctgatcagaggtgtaccactgtacccacaagacacaaccccacatcatgtcaccatgtgcctcaataccaccacggtacctcggaaaggagttggggacaataccccttgcacaacataacccattacagcgcacctttcctggatcataatcacccccc

SEQ ID NO: 76995 - DNA, 543 bp, Oryza sativa
caatatatattggagtgtttaataaatacccaagctaggaacttaatcatatttactatatacggctatgtatatactttatatagatatgtacttgtctttctctctagactaaaacgaaataattacgaaaatgaagcccactggtggagatttattgagtgcataattatggagaataatgtgatggtctgaaggagggcaacaatatttttcgttgagagcgtgagaatgacattttgacaagtataggtacaactcacctccccggtcgattatattgcacccatgcattatactatatggccccatgcgttgaataattaagctacatgttccccgaaagtgctacacatttgtctgtgtaaagtgaaaacaaccaaatattgacttttagcttagtgctatatatatactatgtgatgttcacattatttcccgatagatagtaaaagtgtgatatatatatatatatatatatatatatatatatatatatatatatatatatatatatatatatatatatatatatatatatat

SEQ ID NO: 76996 - DNA, 618 bp, Oryza sativa
gatcaaaatatataaaaaaaatacagatttaaaatattatattttaaaattatcacaaaactatatatgtagggcctcatatatttagatgcagtatcaggagatcggtcccttgtgcatcttccccgtcttgacttgctccggttcaattcaaatcacctcgctcgccgtccgtcttcgtggagctttcgaatacgaggcggcgatcgatgcattcccgccaccaacgcctcgcgtcgctgacgaagttgctcacttcccacgtcaacgtcggccgtcaccgggatgctctcgccttcttctcccgcatggtctccgacccctccctcccgccgctctccgacccctccttcgcctacgccttcccgctcgccctcaagtcctcctccgccctccgcctcccctccgccgccgccgccgccgactccctccacgccctcgccgccaagtgtggcttcctctccagtccattcttcgcctccgcgctcgtcgcctcctacggcgcgtgcgcctcccccgccctcgcccgccgcctgttagacgaattgccccaccgcaacgccatcgtctgtagcgccatgatctccgtccacatccgatcgggcgacctcgccgggg

SEQ ID NO: 76997 - DNA, 755 bp, Oryza sativa
  unsure (1)..(755): unsure at all n locations
cgatcctatattattctttaaatgatgatgcatgccatatatattattctgtaaatgataatgtcctgatgtttcatatctagatacctcatttgctgcacattactctctttattcagtaggcttagatacctgatttgctgcatattactctctttattcagcaagttgctcatatctagatatctcatttgcagcacatcaatttgatttcatatggtcatgtaaatttcatctgccttgagccatccttgttcagaactaatgttttgattatgttttattgcagagatcttccttgagtcaggtgatggcgatcggtgcacaaagataaaaagaaaaatccggaagtttgaattaccgttgatacttcaatctagaagtttgaattaccattgatgtgtcgttcgtggtgtcaactagtacttgagctcgttttgtgttgagattgtagcactctacttctactgagatcgntttctcctcctataatgtttaaagaccaatcaggttattattactgtgtctggctgtgtcaccatagcggcattgntggtccatccagttttgatgcggtcttcaattctcccgtctttcggctgtggttgattgcttcatcgtttttgcggctaaagtttttctgctcctaccaaaactgtaggggaaacttttggtgtgctgtctgttctatctcttatgcattgcacagcctggttttttcgctcttctgaagtatagccctgtgcgctctcatc

SEQ ID NO: 76998 - DNA, 996 bp, Oryza sativa
tggactaattcgcgagacgaatctattgagcataattaatccatgattagcccgcgtgatgctacagtaaacattatctaattataaattaattaggcttaaaaaatttgtctcacgaattaactttcatttatgtaattagatttgtaagaagactatatttaatactctaaattagtattaaatataaagttaagtccctggatcctcagttctctgaagttgctgagccatcagaaaacagctaggactgcagcgaagttatacctcaaatgtgatccagccgagcgacagggccacggcgatggtgagagaattcgcgaatttccgatacatttcaagcttcgccgtcatcctcctcgcctgcaagaatcagattaatcacagaattcattgatgattctcgaagaattattcgaattttggtagaattttgaaagtgggaagttcaaatgatgctaccttgagcttgctgatagttcttgacagcgaggtgaagatccagtagatgaacaccgtgttgagggcggcgacggggagaatgaagaagagcctcctcgccggcgagtggtcactgacgatgccgacgttgtcgccgacgtcgagcacctccgccgcggcgaggaacgcggcgccgaggcggccaccctggcgttgccgcagcccagtgcgggcctcgtcacgccgtaccccatggccacgagcagcgccagcacgcggcacgccgcggcgcgcacggcgcccgacgtcgccgcccagaacgtcgtccccgccggccggacgcccgacgcgtcgaactcggcgaggtcgaggtaccaggtggtgacctccaccatgcccagcgcgatggccgccgtcacgaagttctgcatctgcgacacctcgcgccagaacctcgcgtaccgggcgaaccatagcgcggtgagcgcggcgaacgcctactacatggcgccgtacaacggcttgagcggcgccatcctccccgggaggtagccg

SEQ ID NO: 76999 - DNA, 1979 bp, Oryza sativa
tgtgggcaaatgtttggtaccttgagcagataaacatcgctcctgggtggagaagacctaggggtttgagaagagcagtgatattgtgacaagtttccttaattcctcttgctttgtttagtggcagttttacttgtggactaagggatgaccgtgagcttgtaatgccagagctgaagttgaggttttagtgacgtgccactggggttttagcggtttgaaagccacgtgtgtgtcctctcctgattacacttacaccatcactttcttggtcatgtcaagtcaacgacgatgttaattaccgcaataagaacaaatctaatactcctccgtcccaaaatataaacattcttagcatagtgacgagtcaaatgtttttaattttaactattaacagcaaaaaaataaaaaaaaatcaatcatgtaaaattgatattagtagatttatcattagaaaaactatcataatatttaactttttttatttaaaacatcttacttttatagatattgttggttaaaatagcatctcagagaccgtgttagagtaaaaaaaaatgcttatattttaggatggagggagtagttatctacattcactctaatagcttagcatataataaatttataaatatatattttactatcaatatttgatcacctcgcatacacacgtaaatacatgatatattgaaatccgtgtgtcacagctgactatatctatagctcgtttttctcctctctacgcttatctcttcttgacatttacttgtagctaacatatagcctgttgtcttaaaaaaaacatatagcctgtatttgctacgcgttgttatatttctaccggtaccactgccctgagttcttgatttgtagcataaggtacaatatttttttcccataaacgtgatcattgaagaagaaaaaaaagggatattgcagatgtgctgactgagctaattaagaataagatattcaggcataaaccaagttagctagtgacttttgcatgcatttgacatgcataagtccactagcaaatatctgcagccaaaaatcatcctaatcctaataatcaaccaaaaaagtccaaaacaaaaggaaaaggtcaaaaggtactcatcgcaagcctgcaacaagtcgcacagcaagacagaaactcacaccagttgggcaggaaaccacatgaccgtgtgtactgcatgccccgtttggctcacaacctaaccaccagcacacgcctaattagtttaatcaataattaccttaccttgtttttgctttcagaattaagtgatcgtctcgtctaagcttcatgacctttacgcatccgatcgagtgacaagagatcaattggagtagttataaataagcgtgagtattataattaggagaagttttactggtgtttttatttcaaaaataaaaaaaaatcaacggtctaaaatagaagtattatataagggtatttaagtatcgatctaacagatgacatggtgaagggtgtcgacaaataaccatattttactgttgattaccctgttgtcattatttactgtaattttattttaaaaatggaggattttcccatataactatataaaccgatgttcaatgaccgaacgaaaatgggaaaagtttcaaaaaggaaaaaaacttttcgccttcaacggggcttaattcaaacagcccaactatttgcctctgttttttacgtgatttttcaaatgttcaatttcaaaaaaaaaaggtcaagttcaagcttgacatgaattttgaccttgtttttacatgcattttaaaatggaaactgaagttcaaaacataggggagaaagcaatagcctagcaaacaaaaccattttccccctccaattggacctaatttgaaacaacacccaattgaaaatggaatatgtctactttgactcccttaactagtgtcttaacctaatttgtatctttaaaccgtaatagcgg

SEQ ID NO: 77000 - DNA, 2254 bp, Oryza sativa
acatggggcagttgaggcgctgtgaggattaaaggaagttcagcctggggcccctcctcgcttgctccccccgccaaacggcggctgggcgagggcctcggggcaaagcagtgcaagggcccgaggggcatgacgtggcaccccgaggccccgacaccccggccgctcctgcggttcgtggaatgcggggacaggaccatgctgtagggacacgtggtaggatggaaaggtagattcccctcacttcgcatacccccgggcccatatctccgacagtttagggcttagggtttaatagttggagagtcgagatatccggtactgcgattcaagcatacgaatcagattcggcccaataatccagatgccaataggacggcccatcaatccagatgcaatacgacggcccatcagatcccgtccccgagaaggaatccccctcaccgttggatccgatccgacggctgagaccagccacacaaaccctcaatatatattcgctcgccccccgctgcgtctcgccgctcctacaccgcgccgtcgccagcagccgccgccgctgcctctcctcctcctcccctcgccgccgatccaatccggtaagcctcgccgccgcaagctccccctcgtccctcccccggatagttcgtcgcctcgtcaggcatctcgccgatttggcgccgttctgttgttctgtttggtggagccgtgcgcgagatttccggtgtttgttgacctgtttagctctgatggattcaccttgtgttagttagttttccgtcgaatggtgtggcgattaggtttggggggattggttcgtctgtgattttgtagctagattttttgaaatctagggtagtgtgagtggggaagctgctggccttagtggatacatgctgttcgtggtctcctggttcttgaaatcatgatgagttagtgctgtttgaaccttgaagcaaagttttaagttattggagttcctgtgcttagatttgtatactattagtgaagagatgcatagctgtactgctgtagtggatataggagtgttgtttttgatttgctggtgctcttccatagcatccggatgcggtgttcaattgtgtagttgtttatgtagttcaatgcactagaagcttttatttctgaatgcctagttattagttgggtatgaagtccaatgtgtgaaatgctgtcatgtttcaacttttagttaagatatgaaacttgagaaacaaatgaaaggtttagattcagtactgatgtacaacttaagtaacatctatggttgtaaattgtaccatgcattggttattgtgaattagctcttttggttgattgaaacaattctctatgtgccaacaggtcactttcagtcttttttcttgagggggagatggcggtttctttcaccaacgttagctcagaggcaggcctcaaaaagctcgatgagtaccttctcactcgcagctacatctctgggtatatgatcagtgtccactgtccaccttattttctgaattgccatttatgttcactggacttaaacccttcaattatctgtttccaggtaccaagcctccaacgatgacttggctgtgtactctgcattttcaactgcgccctcttcaagctataccaatgttgctaggtggtttactcacattgatgcactcctacgtctgaggtatgcatttttcccctttttttattctcttacattttatgttcagtgttgtgaattttctgaatgttgtatttcagtggagttactgctgatggtcaaggcgtaaaggtcgagtcgacagctgttccttcagcttcaacccctgatgttgctgatgcaaaggtcatacaaccctagccttgtcttgtttgcctgaaatctgtgaagtgttctagcatagtactgtgaattgtgatttgatgctgtttgcaaattacgtttttgtggttcaatggtgctggttaccatctctaatatatcatcatatcttctaatttcaggctcctgcagctgatgatgacgatgatgacgatgttgacctttttggtgaggagactgaagaggagaagaaggcagctgaggagcgtgctgctgctgtcaaggcttctggcaagaagaaggaatgtatgccatcctgcattatactataccatttttatgcaatgaataatacaattattcattttattttattctcatctgtagctgtaaattaagaccaaatcatcactattcattataatgcaa

SEQ ID NO: 77001 - DNA, 1603 bp, Oryza sativa
agtcactaaatatcatggctgttaaggcgtcgctatggcatcgctatagtgctagggcaccctgagggggtcaaggcatccctccgccttagggcttaatgcagagagggagagggagaggtgaaggcggcagcaactacacccttttcccttttctctgctccatgtcatcaccattttgctcccccttagctctggtttccactctcttctctcccctgcgccagattcatcttgactcaagggagcagccgccagatccatccaagggaaggagcacatacagagagaagcacttgattcattctgaatcagggggaagggagcacagatagaggaatagagctagcatgattaagaagagccggtgcgaggaagaagcgatagagccgtgaggaagaaacgacatcgggggcggcgctgtgagaggagagacacacctggtgcgggtgttagggttatttctttgtctttgggctggtatgaaggatattgggcttttgtgggctggcctgctaggctggttttcttctgatcgctgctaaccacataggttatggcatcgccatgccttagcgttttactgctatagccttaccccttaacaaccatgctacatatatggcaatcatcttgatatgataatgttcttggcttattgcatagttagtgcacactatgttgtagctggcttggttcttcatcagctagtatgccccatctgaattgctaccttttgtctactttgttcatgccaatttggctaatctatgtagccaggcttttacaggtatttcatggattgcgtagttccttgtatactgtattcatgccaattttgttcattgcaggaaatgcgtgagctgcaagagctggaaaagagattttacgcattcttgcttcatatagcaacacatgatctgtctacagttctcctaactcctagttgtaggcattatctagagaacataatgcagttgcttttgattacttcatgcagccataaagagatatcacatcggaaggtggggtttaattgatcttgaatttcttatttccacttcaagcgagttacattctccatctccactttaaatagaattgtctattttatactcggttattgttttgtagacatgcgtacagacttttgtcaaccttatcaaagactggtgtagtagctctgaaattgaagataaggtattgttgtgttcagttcttcttatgtcatgttttgaagagtctatctagtacttgggcagttgcattactcataatgtcatgtatttcttgttttcctcagcttcctggcttccgagtgtttatgattgagaagttcgctactggttgctgtttgcagagtgtccttgacaagtcatttaacttccgtgatggaatttcggtaggacctgtcaaccatacaatctatatctatctaaatttctcgtacctgttttactgtgttaaatgtataccatcaagtagttattatactgtttgtctattgcttcattaaattcttggtaattttattaatgtccgtcctgatagggtttataggcatttgattgtgacctccagcctataggtgtccgattggagg

SEQ ID NO: 77002 - DNA, 570 bp, Oryza sativa
atatcccgtattgcagttatgggggtaattcaatcgacctccataattgagggggtaattcgttcttttttttttctttcatcaatgtataagcttgatggctgttcggttcatacactgattgtttgatctgcatgcagtaattgctttcacatgcatggtttggtagctctccagtttacatggccaattggttcgtatgcaaaggaacacagggacagtctttgcgccctggagtaaaatgggttacggggttatgcctcttttttttttatcttgttgtcagaactcaaaacaaaaatactgattatcagaagaaaatagagggagtatatagtttgtttttcaccgggacagccaataatacgttgtataatttttattacacatgtacaatgggatgtgaatgggatgtgagtgttgtaaataaaacaagacatgtttaattttcgctaaggtatatgagagagatcgaagagagagaatgaaactacttcctccattttaaaataagtatactcatctatatcatattggttttaaattaagtgtactattttgatacgaata

SEQ ID NO: 77003 - DNA, 537 bp, Oryza sativa
aaaagatcaccaaatggcagtttagaatggtgggtttgttgattggttcataaaaaagtacttctacattagcttcatcagaaaggtttctgctagaggccctcttctaaatataaaagttttgtcaactgcagatatctcactcaaggaagatatgcttaaataaataaaaataaaaactatgggacgaaaccccgcaaaagtaagagcaactaacctttctgttgccacctccaggtaaaagaaatatgcagaacctatctctatcatcataatcacgcaatgtcgatggttgaacaagcacaccaccagataagtcaccagaataaacctataggaatgaacataaatcagacaaatctgaacatatatttagctattgcagttttgaaacagtaaacagttctcgagccagatttcagttacatctgcaactaacatatgctcacaaaaaaagaaaaatttgagaagtcttggaaagtcagattatcacaggaactagtgagctcataactacttaaagaagtgactaccgat

SEQ ID NO: 77004 - DNA, 1368 bp, Oryza sativa
cctgcttcacctagtaaccttcactctttccattaattctttgtcagtctaccctggaaatcctcgactagtgtctactaggcactagctagtcaactgctagttcccagagggatacagcaatatctgagtgattcaccgcagatatgtcacccatcagaagttgaccatcatcagttactaagagcacccgcaatggtaaagtaaggtgctatctataaaacatgtacatctcagcaatagactcgattaatagtaaaccaccttaatagtatgtctacattggtatctatagctctctcatgcattgtctcgtttttctctatagactatctctaagttagtagatagctttgctctctctcttcatttaatacattccaagtaggaaaatatgctgacatgaatctcttatagagagcctatagataaccattgtgggtgccctaacaccatagattagtagtagataatctataggactgcatgcaatgcgatgatatctaagctcggtgtagattcagaaaccgcatgttcagatatatatgcatttcttttctagccgaaaagcgacacgggattcaggaccacatcgcggcagcttctcgctgcttctctagccttcattctagaactccacacacacccagatgtgtactacttttattttgttcatcgatccaacggtgaatgatgatgggtgcctcttttctgtccagacattcttcaagagtcagagattaatgaatgcacattaatctggactattagctcttgataacaaactctaccagcatagtatcatgcatagctcctatttaagtttatctctcatcttgtggatccctaggatccttcctcatctaacaaagaccaaatgtctcatgagagaaaagggcctcttcatcaatcatccaaatcaagtactccatccgtcccataatataagggattttgaggttttgcttataacatttgaccactcatcttattcaatttttttttcaaatataaaaaacaaaaagttgtgcttaaaatactatagataataaagtaagtcacaaataaaataaataataatttaaaaaaatttgaataagacaagtggtcaaacgttataagtaaaaactcaaaatctcttatattattggatagtgggagtaccaatgtattttagcatactagtagtctactagtagagtacatatatggatatattagtacatctgaacataagatacagtacataaatgtacacacacaagtgagtagtgatcacatatatattcaatggcacatcggcatttgccaaaggtgtagaatgttgcttggcagccactcctggccacctttttttcccaaagttgg

SEQ ID NO: 77005 - DNA, 10215 bp, Oryza sativa
  unsure (1)..(10215): unsure at all n locations
taatggtgtaatcgtgatatacttgttcaatgtttaggacctgatgatgcagaagaattgaggggggcgcaagcgccaccggaggagtctgaagatgccgaagagtctgtcgtgaacaggatactggacacggagtggtttgcggcgccaccacctagcaacccactggcggcctggcggaaggaggtggcaagggagaagaagaaacggtacatattcaagaacacagagagccgccgcttcaccaggttgatgcagaagtgtgccgataagcttggagcagagcccgcgcttgaattctttgggaagctggggagggatactggggctaaggagtttaatgctttgatcaggatttgtttgggcaaggcaaaggaatgcatggatattgactcagcagtggagcatatttatagggcatatcgcctctttgagctgatgagagaaaggggttatcagattgtggaagattgttatggaccattccttctgtatctggtggatgtagggatgtcagaggagtttgatatgttcagtgtgttctttaaggatgcaaatccacggtccagctcgagaatagcttattacgagatgttgttatggattagagctcaagatgaagaaaagattcaagaactttgccgctctgttgaagacttcaatgaagaaggtgactatgatatggcaggtaactaaccaaaatcacaaccaatcttcctttgtcactcattcacaaatgggaaaagcgctgtttaatgttgcacaatttattcgacacacagaacattcttccaactgtaccttattcaagatactgctttacagaaagttatatgctggcctttgctgaaagcgacaggaggctggatttcatcagcttgcttgagtcacttgatccaacaagaattttacgctcaaagtacttattgaccatattccagtctttgggtaggttagaattgaagaactatgctgagaagcttcttcagcagatgaggtcgaaaggtaataactctgtcgttttgccaaaaaatttaaatatccatttgctggaaataagatggacatatgatgaatattggccacaaatatttctattctaatgttattcagttaccccatcagatttccctctgttacgtttcttacctgctaatgtttctgtttcagaatctggtgttggaaaattttcatcgataatatttgagtatgcttcaaatataccaaacatagcggtgaggaatcttttacgatgactactggtaatattcgtagccgctaattatagtatgaacttggagtggactttacgtgtagcgttcttcaatcctgtgcaaaaatggtcttatagcaagatgttaaaaaaaaaaggaatatgtaatacagtactttagagagcacacccaattttgctattatatttttattctgtgcgaaagaagtattctgcatttccataatgcacattgtgtggctaaaaaacatggtgctttgggctaaactagcatagaaaatttataaatttatttctgtgtgattcaaaagaatagacaatccatttttttttattcgtacatcgaaagataaatcatgtttcatcaaattgctaatatgaccacattttatttgatcccaagtggatggaaaggtttatttgctgatatactactccctccatccaaaagtctaagacctattccattctttggcttttccaaaagtctaagtcatatttgtagtcactatgtgctatattaaatttttgagcggagcccaagaagccattttagtacttattggttgcatgttcattgattttgtcacatgatgaatgaattaattactcattggtcttggtgcaaaaagaaataggtcttagacttttggatggagggggtatcttagttttcgtgacttgcttacaaaaactgtggtgttcaatctaagaatgacattatttaaaaaatataactatctgaaccagtgcagttagttatcatgttaacagcgcccttttagctaaacagaatgataagaacactggaaatggattttcttgaaggttgaagatgttatagtatcattcaatagatggcatgagcagtttgaggtagcaccctctatttctgcatctgagaagatcatctctgtttgttgcaaatcgtcaaaggtaagtcaaatccaccggtactttttttttaaaaaaaatggttaagtaattcaatacatgtttttagaaatttggtccccaaacaatatatgatcttttttatgtatgccatgtccatacataccttttgctttgtgttgtttggtttctgctggcctgggtacttaaccggctttacgtttaaagagtccatgtcatgcctaacagcctaacatacctatctggtctattatttcaagtagctatcagtccaccggtagttttttttatttaaaattcttctaccaccacctaggtgttgggaagaaatgcttatttaaatttggatgcagtggaaatgtgtggtcacttggaatggtttattaatggatattggctgatgtgtgctgaacttgtggccaccatttgggtagccaccactgaagtgtagcaaagagcttggagtttagtttgaagcctaacctagtaaccttgctatgaaaccttaggcgtggtacagtttgttaggcaaatatcttgctcatttctgtgattgaactttgccatatgcatgccatagactcagattgtcacttaactttttctacagccatggctgtgaattttgttgcccaaaattagttatagcaaagttttttacaaaccaaataggcctcaatattgtatgtgatacacatattttggtacaacaatcttagtttcaatgtgaagtgtttggatttatcaatctgggccactcaaatcaatattataaccgcgctgtgttccctaatgttttatgcagatcagcttagctcttgatgtagctgagtgcttatgtaaatccaaccccgatatgccagttgaattgtttcatccaataatacaggcctgtgaacaaggctctgaatttcacttggtaagcagttctatatgactatatttagttgtggcttgcagtgcagatgtgtgttcattttatattaattattagggggtattataggttataagaatttgcaacatttaagtgctttgtatggttttgtgcatgactgcatatgtttttagtaacaacataagcatcttgtagaacatgaccttttctagtatgaacacatcccaacctattaaagcactagtacaatcgttaacattgttgtaatgtaataactaactagtgatcttaataagctgttatttacatttgtttgagttgttaaagcataaaattgattgtgaggaagtctctgccacgcatcataagtcataagatatatgaactactgttgctggtctcacaggtagcatctattttaaaaattaactatacatgttctcatgtgatatgtcttattgggaacaatgctaagcatctgtattcactctaaccttttcaggttcatccaatatatgatttgatgcgtcgccacaagatgaaattgaaaaccgaaacattcagaaacatgataaatttatgtgtaaagatgaaagatgtaagtcattatgcaggtcacctgctatgtttaggcatcatatgaaatttactgatcctttttctccccagtttgaaggtgcttaccgtatactcacagatgcagaagagtctggggatatatccactgtaagcctgtataatgctatcatgcttggatatttcagagaggtaaactctcgggttatctgttgttcttttgatttgttttcctcagttaccatacaatccatatgtccattttaattattcaaaaaatgatggatctcctattaactattgtcagcatacttgctcaactttagctgactcgattttacatcatgcctggtcagtagaaatgcataaacacataagagatgacacatgcttgtttttttttgttgagattttccaaacctcttccctcaagtacaaatgcgcaacagtttcgaataagcaaccactgtaacnnnnnnnnnnnnnnnnnnnnnnnnatttcaaaattttttttgaggggaaacactgctggacttacccagtagttatgatttttttattattagcaaaagaccatatttacatactgtagtaagatttaaagactattattccagattgtttgtgccttagtgcctttctccctttaaattcgctatgtttctatatagaaaaaccacaatggagcacagatggtcatggcgcaaatgcagattgccggagtaaaaccagattctgaaacatactgttatttgatatttaactgtgagttcgaagagaaaatctctgaggtttgtcacatacctgattgtttattattaccatttttgtgtgtgtttcaaatagagaggcaactgtatatgttcttgaaagaacacctagtgaaattatatccccaagtaattaattctatttgcattgttaaattctgttggatatatcatcatgcagcatgtcgcatcttccattacatactaacatgcctactctgttcggaaatgctccctccttttctgtttaattgtctcattgttgactatggtacacatatcaatgcaatcaacttttatctcctaaaataaccaaagctcctaggtgagtggaatatgttttcgttatgtataatcgaaactttgaaagaacactctagatatttctgattacttgtatcaatgtcatattgttaaatttatgattggtcctcaaaggacaaaatagggaatgccactgtgacaaatgtatagtgccaagtattctcagacacaaaattatggtcaactgtgacaagtaaaggaaaatggaggaattatctgacattttaaaagacgcgtagtcaaacttctttatctttgaccatcattgtgtaaaaaaatatttagattggtcatgtggaatttcagaaatggtgcaattagagttgtcatataaatcttaatttttttttactaatacacttatttaaagtaatttttgaagttgcatattggagggtttgccaatgtctaaaacgccatatactattgaacaattggcatgattctttaccatagtttacactgacattagaatttcatgttttaaacccctttcaatttatagtttctgttgggataagcactggctgttgaattgtttacagtatcttgatcaattacggcaagatggaatacacatgtccaagcatatatatatgtcactagttagtgcatatgcaagacttgggaattttgacatggctaaacaggtaatgtgcttgccgatcataattctctttgaattttgctgcaccttcaggtgccagatctcacacatgtactcgtgttttctgaattagattacataagttaatggctattattattactacgaagatgctaatgttgtacttgttctattttgctactgaaaacctttgctgctttcttaggttctcgaaaacaaggaaataccacctaagtacctcaatgaaattaagagtgcgcttataggagctcttgcatcaaatgggaaggtattagatggacttatcatgtatgatgaaatcaagcaatctggatgccaccttgagccaaaatcagcaatagccctgattgtaagtaaaactgttacgtatgtttacttctaatgaagaaatgggttgtgcctacacgtttgagaaccacttgttctagtctccatccttaatagtatttttttttctgcaggagaatacccaaacaaaaggtgagctggatagactgtatcaacttctggaagagcttggtgactcaaacatgtggtttgacgggtgcagtagagtacttctgtactgtgttcagcacaatcaccctaagtatgctaatcgatatttaagcacttgtatttatacttctgtttactttttatttttcattcactctttattttcatcatcttttccagtgctgccattggtttgcttaagcagcttaaggagaaagatgaattgagtacatatatggttattgatcaggtattgattgttattcttggataggatagcacatgaacatttgatttcctttttttttttttttggggggggggggggcactgattttgactaaaatctataccttttggctggcaaattccttttgattaagggtacattggatatcctgtttgttctaatgttatccacgttttttttactacttggttatggtcttatctttaggaaatatgctatatgatctcgcttattattctgttaactagttcataaattcatttcagtttaattagggtgacatgatgagaaaccaaacttgattttgattacaaatatctaattgcttttattaattttttactgttcaaactccttcgaattgttcctcataaaggtgtatatgaattgttcctcaagacatttcgccatgaactataccttttccatgctttctttgttttggtacctcttgtttactttcatgaatggttttcaaggtcttcagtcaaatatgggatatggatcctgtaaatttggattttggaatgaagattctccatgctgtgaaagagcttgggcttaatgtttctcggacaagccttgactttcttcttagtgcttgtgtaaaggcaaaggattcaaatcgtgcccagctgatatggacagaatatgaatctgcaggccttccacataatgtactgacttccttgaggttagattcttcctattggcacataagctgattatccagtacattttacaatgttggcttgcttttgttgggcaattcgataccttgaccagtgtgcttgctttgcaaccttgtcaaattccttttattgtggcatttagtagatatactgcatttgtgcctgcaggatgtatcaggctcttttgttgtcccagaagaagaaggcgactaagaagttgctgcggaagataccaaaggaagatgttcatgtgcgttacataatagattcttgtcaaatggcatactgcagccagaatcttaagctaccttctgccagtaggtccagttcaataaagagagctgcttccaaggtataagaaactcattaaatttgccacttctgttataataaaatatactgaaaccaatttgttacctctaggaaaactcatcctgttagatgtcttcattaaggaataatgatcagatgagtccaacattaatagaaactgcatgatggaaattttcgtgaaatatcctgtatgtcacattttgttatactgttgggatagtttcaggcactcccgtcctatgaaagaacatgcaaacagtcatgattttattttggtaaaactttaaaaatttagtgtgagaatcatccatcatctcataaatttcaactgaaaacatgacttatatacaaggacaaagaggaaaaagataaatttcactgttatttttagatttcctcatcagaagaataatttttgtcaatgtgtagatcgagtttagtcttttgaagttctgtgggacgatggataacatcaatatctatattatgatttcccttttcttttctggaatttctcattactgttcaaatgctcttttataggctgggagcacctgtaagcctgctgcttcaggaaccgaggtgtttcgaaatgaagctgaagaggcacatactggcccttgataatagacagacttttcctgaacattgcctctagtttggtgcctggaattacctgcacccgcttcaaggagctacatgtgtttctgtttctggcttgaaacaagcaatcatacatgggagccgtcaccgaaagacggcgagaccactggccacatttgaggcctttggtgtgaccactggccaccactccctgcattgcaattgcattgcagcccccacttggcttaatggccaagacctagctagccagcctctctgctcatagtgcttcccatgtgaccacaaggctagggtttggtcacagtgaaacaatcactgccccacagcctcaccaaccaggaaaaagatctgccctgtttgattttgggagtggagtgaggggagagattgagattggtagggcagaatagttgtactcctcagcctgcaaccaagatatcacaggataatatcttaaccagataggtaacagccacacatttttgcacctgttacagctcaagtcattactaaaaccagcattgttgtagaagttatgatttgtgttctagtttttctttattggggtatgcctttgattacaggtacaatggttatggtgaagattgtcttttgatcttgtcatctaattcatggtatgcaattgcaaaacgggttgcatagctgaatatatgatggcttatgatcagttcctttcactaacagatattgggcactgccattttattaccttaaaacgtgctaatatgtttggatagctcagaaccaaagaggaagaaaacaaccctgtattttttttccttttctccatactttttctttcctataccatgtaaggttctgacaggaacctaacaatggaaatggttcatgaaaattgtacgctggccctagagaaagcaagcaagaaaggagcgcacaccccacacactaactagataagatgaatggtccatgcaaataagagacgaggctgtaatgatccaatttttgctttatggatagtacattatattgtctagttgaagatatgcaaagccatggaaagcctaagatatgcagaaaacgagcggctcatttgtgtccccaattaaaaaagaatatggaaccaacaggcttaacttacaagacggtttggcatatacccaagtcatgctcttggtctccatcacaggtgctttaattaattttattatttgtagtcaagctattattattattattatttggttgcgcacctttttcctttacagaaaaaaataaagaaacattggaactttgagaggttatcaaaatagttaagccgtcctatcagccctggcacgtactatatattccagtctcaagcgagcttttaacctcgtaaaggaagcccagcatttctgtggtgtttgctataaagaactttatgtttttatggacgtactggggcacgatatctagtcaatttgtgttttatatttttgacatgttagagttttgtacatacggccgggtgacacaatctcttcaagttggttagctggtgtaccattacttgcaaattaatttggtgtacttaattagactagtgtattgaatacagataagaacaccttttgtaccaatgtgacaacgttgtcctgccacagaaacagggtagctaaaaagttcatatgtaaacattttcttttagataatggaaatggattacatcttttggcttttgtcataagacacacaaccataagtttaatagtaataaaaagtaagataaaagtaaatcaaaatgagaaataaggtgaatatgtaaacataagtttccaaaagagggtttattcttatagtcatattaagaaaagtttaaacatatagaaaacccttttctcgaaatagagtataaacgcacaagctaatatatacgtgtgaacacttagccctataataaaatcatacaatacacatatcttacttctgtaagcatctctaagagagtgggcttgttttttacgtttatgataatggatatatatatatatatatatatatatatatatatatatatccctaccactgaaaagaataattagccaaaataagaaaaattcttgatgcaatatatgttcagctccaagccgcaaggctattagtgtaaggaatacatgttaggtgcaaaaccagaaaccaggatagaagcatatgcatgcacaaacattggatgcacagagcacacaggactaaggatcagcaggccactaactagcaagcatgcatgcatgcatatgcaacccaatatgccatgccacttagcttcactcccccaaaggtgcacaaccacacacacacacacacaacttcctttttacccctcaagccttgaatctttggtaggagaagggggaggagattctccttttgccatgtggttcataccctacaacaaccccaagcacatatgcataatgtagcttag

SEQ ID NO: 77006 - DNA, 7606 bp, Oryza sativa
attcctgcaccccttacttgagttttatcggttgaatacttttacatataactttgtaatttttatgaattgaaaatttatttcatgtttaggttagaataattgttgtttgaccttttatctaaggaataaatgactttgtttgaatgattaattaataggggaaatgatgaaaacaattggatatatgttgttcaaccttttatctatataataagaaagacatgactacctttggatgagtaatagggggaatgatgaaaagttgaaaaccactggatatcatccaagggatgagacatatatgaaatctagacactccctataaacttttaatattcccacttaaacagggccatgcattgatagtattccacaaccccaataatttcttttcaaggaccactatacatcatgtacctcttcacacactgatcatgagctacaatgccaaacaaaaaccctatcatatatctagcttacattagatataatgatgcatcaaaccctaaactaaatcgtccctaccactcactattcctgatgatcgagctatagtggcatgcagtagccggatcttttgaacggtgcacactgtttgtatgcaccttaaccaccgcatatatacgcagctatgtacatgcatgtatgtatcaaaatagctagcttgcttagcctgacgatatgatgatttataagtctcaatctgtcaccataaagtgattctctgatcgagctctctaggatcacgagagccatgaattatgtatggccactactatactgtactatgtatactttgggccatatctgcaagaaggacagtttaactgacaattagtgtatgaatctatgatgatattctggatctttaatttatccactagctagataggtatatatctcaattctcaaatcctcttatgaagaaggtggagctgaaccaaacgtgaagtgatttagaaacaaatatgtagtggagcagggcctagagcggagctgaaaacacacctgccttttggccctgcttcacaacctcctccacttgatccacaaaaatattttagagttgaaatctagaaaaacactctctccatgcataagtgtagatccaaatacgtggtgaagacatatccgaattactccatccgttacaaaatacaagaacttttagcaatcaaaagttgtcttaaaagttaagacatagcaactaagcctacccccaacctttatataaaatgcacacaaccaataaaaggacgaaactaaacccccatcacgaaacatagaaattagtggctattaatccgtatactagatcatcacccatgttcttagtaaaaaaaatcccatgccacctggtccaaacatcgtgataccaccgcagtagtaccccaaaataccggtttgtggaggatagcccaggtgcgtaaccactgggtaactaaagtgataaactacaaaggagaatacaccaacttattataaaaaataactccgtttctgcttagccaaatggaccaacaaagagctagctgctgcacccatcaaaaacatatttcttatttccttaggaacacatgaaagccaacgcccaaacatatgagtaacatttcgaataagttataagttagaggccatatgaacataccataccaaacaagataaatgataatggaagaacaaatgttgaatggttttgtccttatgacaaaagcaatatttttttactatatttccattttctcttagctaggttatccttagttaaaataattactttccaacataagtaccaaaggaaaacctttacttttagcggtgctttaacctgccaaaaatattaactactgtcgatctattgccattggccaatttaacctatggtatgaaggaaaggacactttgtgaatttgtgaaagatcgacagctctcccgtgggaacaagagcaaagctggatctgaatacgcactacacaacacaagactaggcaacactcgcatgtgcaaggaagtcggcgcgaaagaagccatctcccccaatgcacccaatgccatgcctgcctgatctcttcatgcacgcacctccattacctctacatttttcttttctttttttttcccctctctcctccatatcttgtcgtactaccaaagtaaccagacaatctactactatagtatctgccatgaaagtagagataaataatgtaataccctgtctacatttttttaccttaattactgatcatctcacttggtatggatatatgggtcatgagataaaaacagtggcggaggcaggatttaaacatgagagaggaggtctaagagtcttagggatacataatacactactatttaagttaattacctaattagttaggtgattatgtgtgaaaaaatgttggaggagacatgccactggccgtcccctgtccctgccattggataaaagaaaaggttatattattcacttacagttttacggtcttcttaggtgtagtaagggacttgagtatgggtggacgctgtcacactgaggtggttatgctttttattgagatttattcaaaattaatttattatatttttttctctatcgtctgaggtgtgtgttttttttggttaacaggccaatgaactgaggtagagtgataccaactttattttaaagttgaataattttaaatttataagaaaaaaacagatcaatcgagcaattttgaacagagacaccgagctagcgaaacgagctcattttccacctagctcctataggaaggttgcataacttttagtgttaattcgtggtatacaaagtaaaagagcacgtaaagatatgtgctctgcaaagctaaggcacaagcaaccaaccttttttcagttccagagaaatcggccggcaatggcctgatgaattctaaggtatgggcagggtaaggctagctacactacactgcagcaaaataatgtacactttttcatcacaaaaataattttaaaaaaatgatgcacacttttggctccaacatggcagcatggagaccgaacgctgtgctgtgatgtgcatcactgaatctctgaatgtctctgaatctatctcattatgatgatgaagtgatgaaccgcacacaacacaagagctagcaaaatgcatatatattgcttagcaaaagcgatagcatcactgcatgggatgcctcaagccctcaaatcctttttttaatagattttaattctaaaagttgcagcctttcaggaggaaatgaattaattgaaacccaaaagaaaacaaggatcgtgttctttttgagagaaagaaacaagctaaggcgatcatgttcatatcaaattatcaatcaagtcgagatggatcgataaatatgtgtgtctgtccaacagcatgcatgctagcttagctgcttcaagtagcagctgctttcatgtccccatgacccacactgtgatctgtgatagcttttgtgcatctctctatctctctctctctctctctctcccttgattctatttttcttttttgagagctatctggatctctgatctatatccaataggaatcttctctgactagttaattcactgcacaataattatctgaatttcgtttttgacttcatttttcactccctgtttgatttgttcaggtctaaaatgcaaatcattattcagtgaattccagggctcttggactaatttttacttaagaaataggaaaaacagatgatcatatagaattttgagtagcataaaattttttcattgtactaaacttatgtctaaaaaaaaatctgaacctcaagatcaactattagaaagttatgtagagaatatactgtctcattcaaggagagggtcatgattgtgaaatatgttgtcctggagttgcatcttgcatgcatgttgatttgtagggccattgggtcaatacaatggagcacagagctccagccaataagaagtaagagcggcttgtgtttttctgaacttttcactgaagaaaaaaaaaaggacatttatttactctgaatttctgtgaggagcaaagaacataaaagctacatctactgcctgatccactcgatgatgttattatctggacgggaattatccatccattcttagttcagtccatgaatatgtatatatgtatatatataaatgtctgctcagttgattctagctctgaaagttactgcaagactgaacttgaaagctgcatatgcaaatggctagaaaaactgatatgaaaaaacataaatcaattttctattatgaagaaaaatcagaggtggaacgtgcaaataagtgtgtatgtgtattcaggtacggctatatcaacttggtgtaattgggttaattcaataaagcttttatcataaaaaaaatgtattcgtgttttgtaatatgtgagtacgtacatttgaatctgaatcgaaataaacatgacctgtcaaatattttcttagtcccaaaataacttaatctagaatagaatgtaacatattatagtacaatgaatcttgtccagattcgtgttgaattattttggggaagtagatatcatttcaggatgggagctaagctagctgcagtgttaagctggcatttgcaactatgcatgcaagccacctggaggcatcagagcagctcagcagcatgacagcatctccttggatcggccaggcccgcacgtgcgcccctgcacgcacgcacgagcatcaatggtgaaacactagaagctaacctctctttacttaattaattaattaattaataattaatttgtactggacctacagtggtactacttttttcatgctaagtaatttaccctgtatatatctttttttttttcagacaactttgaatcttcttcttttgtgtgtgtcttgttgttttctgaaatccgatgaagattcgatttgattccaaagcaagtagtgagtgagtgagagagtaggagtggaagtgaagcactactgttctactttgttgttggcaaggagctttgatatgtgatgaatggcgaacgctcatttcataagcagccaacacctcctagttccctattaaaaaaacacaacctagtttcaggatttaagttatcaactcataaatttagactttcaaataaatgtttcttgtttcaacctaaaacttactttgaaaaaccggtgagggaattattcactcctatatatatccattccaaattatccagatgtattgccgaaaatagctataatttttttaacgaagatagtagttactacctccgtcccaaaatataacaacttttggctatgaatctagacacacggttgtccagattcatagttaaaaatacttatatttggggatggatggtgtagttcaatagcatgcgcctattatttagcaaatcatattggtaaaaaaaatcagttcaacatattaccatataatgttggatggcgtacatattaattagcgactcacatcgtcaaaggaagctcatcaattagcaagagaccccttaagcttggatggtacgtactccatccacacatacaaataagcatagccacataggtaacctctattgaccgtaatttttcgtgcagtagtcgttattgaatgccacctcccgttcttgaaggcaagtgacgattagataatgacaccattctaaatatcacgtactatttcacactaatgctacggttctagacactcgtgagaactcgtttaaaggaaaaaataaaaactatgcaaatatatcagtaccattctgaatatttcataatccatggtgcatttatattttcgttcccttatcattgctataaactaaggtgtaagatatacaataagttgccgttaacacacaagcctcaataactctctaagactctctcatgtttttagtgaagtttgtgtatagattatccctgtacgaagaatggctcatttcctcctctttcatctctttcacattattaaaacaattggagtatatgaatatgatcatagtatccgtttgttatactagataggattatatttcatctatatctctagacttacttaagaaccaaatcttgtactcatatatatatatcggctctcaagactcaatacaatatgtcaatatttgcagtaatttcttccccatttactatttagcaaatgtctatatgacatctaaaatcaagtgtttaagattgcttactctataaacaccatatattccacgctaattttaattttctagacactcgtacgtaaagtgaccttaggtaaagagaaaaacctaaacaaatataccgttttgaatagtactctttccgtcctataaaaaaccaacctagtattaaatgcagaaaacctagacaacggtatttcgttggaacgggatactcttctatgagacagtacctgatatctgatacctattgtgataccagctgcatgatacttgatacctgtgatacctgttacccggtatctgtgatatctaggacctgatacctgtgatactcgtgcaagagaatagttaatatgtctatcccattgcaacgggatcccgttttgtagcagctctctgttgaatgtgatacgttctagtactacgaatctacatatcgtaggtttttttttatcgggatggagggagtattttacattcccattcccgggttggcgcgattcccatcctcccctgctctactgccctggaaagagagagagagatgggtgcgtcctctctataaatccacctcgtgttgctgctcccacaccccccctcctcgatcatctcctcctccctaccaacaaccaccaccatcctcttcttggcacttggcatcaagagacacatccagacgcctcgagttgtagctagcaccagtggctcagcttgcccagtgctgctgcatcgatcagtggcagtagctagctcagctctagccttttgccaccgaccgctccgatcgaatccggtgctaggctagccagcctcctcgctctttataaccccagccgccattggagagggagggagggagctagagctttgttcttgttcttgcatgctgttcttgttgatcgagtgagagagggggaaggaagaaaggagggaggcacatgcttataccgttcgtgctggagttcctgatcgatgtcgcctgtgatcagtgagatcctcctctcggggtttatgatcaactccacactccggcgccgcacccatctcgtccagtctttctccgtcgtcttcctctactggttctatgtcttctcataagctactcgccatccatttccctctcctcctctctctctagcttccttctacaataatcgatctcgtgttcgtcgtcgtcgttcttgtcgatctctgtgtgtgttcttcgtcgtcgtcgtgttcgttttggattttggtttcagtttagtatatgcacttcttgttcttcactgctgctgctgctgctaagcttgtagcaatctagtggtgcttgttgttcttcttctcccgaaatctttgcgatcgattgattgatggcatcgtcaagcgggagcggggggagcgcggtgtcggcgg

SEQ ID NO: 77007 - DNA, 3161 bp, Oryza sativa
caaaaggaattcagctagcacattctcatccatgatcagctgtattttaattatacccgattcagagatttcatttttctttcttttaaaaaattatcccgtcatagttatttgatgtttatgacaagattcgattaaacttttaaaattatgatcaaaacttataatatttatagttgtagtattattctgcatattgataacccgtcgatttattcaatgcctttaaaatcctgcacatggggacaagaagtccatgtaacaagctatgcaccacaaatgtataatccctgcatggtaagcaacttgcaatggttcatttgggtgtggtaggtccatgcatgcatgcagttgtcatgtcctttaggagcttgcactgcaccacaaaactcctactacagccacaactaagccaataagctagggttccttcctagctaccagcttgtggtgcaattatgccttgggtactaagaaagaagcagccatgcacacatcaacattgatgcttgggtagcttatctaacctagtggtgtcacctcattgctccagtggtcacacacacatattaacaggatagcaacagggcaaagctagctagcttgagtgatcaaatcatctccaggatctcaaggtgatggtgcttcatatgagcaagcctagacacctctgggcagcttcatgcaccggcctctctccacatatttcatcaccaaaagtatagctagagctactatatgtctagctatatgcattgtgtgccattcatttggacaccttgatgaaccattgagatctgattggaaataacaagtatcaaaatatagaggtgcatgtagccaacaatatataggataaagatttacctttccttatgtcatttctattttatccgatttggtctctctatatatagattaacagcttatttggaatactccttctgtttcatattataagtcgtttgtcttttttcctagtcaatctttgttaagtttgatcaagtttataaaaaagtttagcaccatatgaaatatcaaattagttccattaaatctaccattgaatagagtatgataatacatacatacatacatacatacatacatacatacatacatacatacatacatacatacatacatacatacatacatacatacatacatacatacatatatatatacatatatatatatatatatacatatgtatatatatatatatacacacacacacacacacacaacacacacacaacacacacacacacacacacacacacacacacacatatatatatacatatatatatatatacacatatatatatatatatgaaaatgcagatttgcactcgggttcatatgtaactacaatctacaccgttgatgtgttccaagattcgtgctgcaaaatgtacctaaccttaaccaaatgaatgcttactatagggagaaaagataattaggattaggttggttcacaatatgtataacatgtatgttgcattttttaccaaataaatttttcaataataatcatatatgacatttatatatctagtgcattgtatttctctaatccttattttgtttataacatgatatttagtcaaaatgagaaaacaatatatctactatatcaccaaattgtcattttgcaaaaataatatttccaaaatgatatatatcctaccatcaaaaactacataaacaagataatttatataaacaaggtaaactacataaacaagttttgcatacaagaaatacaaaaattatataaacaaggtattttacacttgtaaaaaatatagtataacgtaaatatcatgcatgttacattttgttagaacctaatatacttgccctaagattcgtgcaagatacatataggatgtagattgtgggtacatgtgaactcgcatgcaaaaaaatcccactcatatatatatatatatatatatatatatatatatatatatatatatatatatatatatatatatatataaaagtttgattgtatactaccgtatttttctataaacttaattaaactttaagaagtttgattaggaaaaaagtcaaacgacttaatatagtgtaacggagagattacatgaattctgatggacggctcacattttgtagtcattgaaaacttttgtctcaaacagggtctaatgttgtgctagaaaagataccaatgcgcacaatatcgatgctaacaacaacaaccaaattctccttttccgtgaggaatcaaaatatctatgtctgttctgtatgtgaaaattttctcatatggttattggccaccacaagagatatatccaacttggatttaatttcatccatctgatccagttgaaaaaaacatataaacagaaaaaagtgaacccatatgcatccagaaagagagaaaaatgtggcgctgatgcatccgggtcagccacgcttgtcagggatcgcacaccactgaaccggccggaagctagcttagctaggcctgacaaatatactggcaggttcaatgaaccgacttgtctttgtcataggccttatttgagccgtggaacattccagaacattagcattcaaggcttcaagtctagcacgccatcatttactgaagttacacatacttcctccgtttcacaatgtaagtcattttaatatttctcatattcatattgatattaatgaatctagatagatatatatgtctacattcattgacattactatgaatgtgagaaatgctagaatgacttatattgtgaaacagaggaagtactgtgcaatccctctaaaaagaattattgtgcaataatatctcttaaggtgtagaaatagattacaccctctagctaaaaaaaaactaatcctagttttaaacttgaaaatatgggtgtctaaattcttagctagaatttgattttctttttataggacggagagagtattgcataaggattggtggagaggtattagtatttgctagattaatattcaagacatctgaaattttgtatttttagtcacctaaaattgcatattgctaactctaaaattacaatgtatgtaatgtacaatttttactttgtatgaactgtgtatatatgttattgcttatatatgggtttactttagtt

SEQ ID NO: 77008 - DNA, 589 bp, Oryza sativa
aatgaaagatagggatccaaggatgatacttgagagcaattatcgatgcaataatgtcacacagaaaaggttctgtgggtccagcaatgcaagaatgctagacacactggtccagccaccactaccatgtgcctcatgtaccagttggcattttggcacctaatgctaagtttccatgttcactgatcaaccatttcagcgataaattctaccacttaatctagattatggctaagcaaagcgctaaccgccaatcaagagcagtgtcagtctgccattgctttcctaaccgctgctcagcaatagaaaatatatcgacagaagaaaggctggtataaagaccgccatcttttcaagcacccacaagactttctagggaagaagcctctctttctttctttcgttctttcttttgttttcactttcttttcttcttcccatcctgatcttcttcccgtcctgatctggagcaatggcgacggaagaagaagcaagggaagcaacagatggccaggtaaccaatggcttctcgtagtctctgagttttgtgcagaacttgcttgtttctgtttccatgcatgcatacttt

SEQ ID NO: 77009 - DNA, 8900 bp, Oryza sativa
cgaggcgcacgtcgcgggagcgcgacaccgtcaggtgcatctgctgcgcgttctgcaggcgcaggttccgcacgctcacccccctgcacgagtcgatggtaaagcctgcacgtacatatgctccccggtcaaccgttaataaaaaatgcttgtgtactatttcctccgtttcacaatgtaagtcactctagcattttccatatttatattgatgttataaatatggaaaatgctagagtgacttacattatgaaacaaagggagtattttcaggggctgttcagattgatggcattttaaaccataccattttttttgtaaagttatcaaaaaatgtctacgtttagtttgttgccaaatttgataaatacataagaaaatcctgttaaaattttaacaatattgctatcttgccaaaatttgataaggtttattttaactataatctgaacagacccccagtttatattataagggtttgtttatatttatgccatttcaaaccataccattttttttatagagttgtcaaatatatgcatacatttagtttcttaccaaggtttagtaaatagataagaaatcctaccaaaaattttagctacaatctgaacaagccctaggttgttttgattttttttaaatggatttgttagaaaacttttgcaagttttttccctaaaactttcaaatttgtaaccatcggatcacctcgagatttgtgcatgaaggaaaaaaaattgctagaaaaaattcacacatgtcacgcataagatcctagtgcttgctaaccaaaccatagttaaatgtaagttttatataagttatatcgtagttaaagtgtagttataattaaactgcaattaaaaaacttgcgatagtttttttagtactccatttttaaattagtatattatgtttaattaagtttatattacaacatagacattaaatatattttgattttattcgtgttgaaaatattgtaatattttttatgaactttgtaaaaggttaactggaaaaaaaaatcaaaacaacttaaagtataaaacgaggtggagtaataacattgtgattaattaagtgattaatcctgcttaccgtaggtgctcctttgcatggctgcgagatgaaagggagagtaactgacggtcagtaacaatccagtgatcagtgagctaagctagagataattagtgaatgtttaattaccttggagcggtcaatcttgcaggagttggcccaccatttggagccggagccgtcgatgagaccgccgccctggatgcgggcgccggcgagaccggagaagaggagccacagccgggggctcgccggatcccactccgacggctcatctggcgccacgatagtgccctggatctgcacaaaatcgaatcatcgatcactgcactcctggtggtgtttgagatatttttttaagaagggatctgcatccaaccgatatatgcaacatttttaaaattagaaacttaacctatcgaacatgtaacttagctttcaaataacctaatatatacaacattttctaaattagaaacttagccctctagtacgtttgagatatattaagatgaaaataaagttagaaggcgcaaaatgagataatattctcttgattaatcgagttttaattatcacaaatttgaaagcctgatatatttaatattttaaagcagtttatatatttttttttacgaaatataccgtttaaaaatttgaaaaacgtgctaatgaaatccgatgtaaaatctacatcttaatccgatgaacttgcagtgtacatgatggattcacctggatgatcatcctgttcttgcagggcccgatgaacctggcagcgccgaccttgtagcggcggccgccggggaccaagaacaccgcgttgttcagcgagcatgccttcttccaagcattcaagaacgcctacaacaccaatatttgataattacatgcattgttcagaaaacttaacaagatagaatgtctggttaattcagaagaaatcgacggaatatgcaactggattcatcaatagatcatgtcgttagcaccgcacaagtgtacatggctactacttgcaatgtgttgagttaagtgaagcaatgtggctaagctagatcttgcgtttcttcttggctatctgaatctctcaacgagattttcacgccttcattaagaaagacgaggatacatttttgcaatctttaaggtttggaggatgatttggttaagctaagcaactgcatgctcaggtcagatgcaagggggaatctacaatctagtggcatcgctatcgaatcttcctttttctcagtctcgacaaagaaaaatatatcatgtggttcgcgtcatcatcagttgatcacatataaagtgtggcttcctggatttgtaaggtccaggtccctgcttttcttcccaacatccaagtggttgccctttttatcctcaaagtaattaaagatattaattgctccatctctgatagtacatttaatattttttttctgactgactctggtgctgtttgtttagaacagtgatcttttcgactaatactaatatggaacataatatatactctgacacttaggtcctatttagtttcatggactattgtttagctctcaccttttagtgttaaattaaccctcaaagatccaaacagataggctaattttgagctaatatgaattagccccgctcaaaacattagcccctccaaggggtgctaatggggctacttttgtgtggggactataaaaaaaacagctctctctctccttctctctcctctctttctactatctctctccaccttttagccttgaattaatccatggatccaaacatgtcatcctaagctaatgtttaacctaccaattcatgactaaacattagctcttaaaattagccctgtgctaatctttcaaacaaggccttaggccaataaaggaagcaatgtgaacttttttttgtttttttgtcatgcgtcaaatttgattaaccacgcgcactgaactttttagagtaaaaaacatcccaaaaacaaaggtgcaatctatctacaggggaaaaaacgtatgctttttgtgaagaaacctcgtgcaatgcgccaatgcaagcacacaccatctaatctgcatggatggatgaacaatggctagcacaatggagaaaagagaagatggtggctgttcgaattcgtgcacacacctccgtgtcgtcggagcagccgtcccccgccgcgccgaagctgtcgacgttcaccacgttcctccccgccggcggccggcacttggccgcccacgccatcacctgctccgcctcctcctcttcttcatcttcatcttcatcatcatcgtcgtcgtcgtcccaattcaggtaatcttccttagcatctgctccgcctcttccgttccaaagcttcaagaattgctcatgatcatggtcatggtcacctccggcgccgccgtcatcgccgccgccgccgctcgccgtcttcgccatggccatgatcaccatcaacgctactagcaccaagaacagcattgttcttggccttcttcttcttcctcctactgcctccattgtttcacttcacacaataataacagaaacagtgtagtatgctctccttggcttgggatacaatacgaggtgtagcaaataattttataggggaaacaagaagaagaagaaactgaagaagcaggagcaggagatggaggtgtggtgttctatgctctttttgtttttgtttttttttgggtggacttgaagtgcaagtgaataatggcgatgtgtgcgacagggcaaggtgtagtttatgctttactcatccatataccctttttcccttggcatttttttcaatcgatgcatcatttcttcttgtccttttggtagctatgtaatgtaagtacaaattaagatgatgatggtgattagataatgctttggcttgaatgaacaatttagacagaggctgactctacaaacgttcttgtttaagacgtgtaaaggcagcagctttggttgagagatttcatgtcaacttcccagttgcaaactcttcatgtttgttgcatgtggttatcatttgttatggttctacctacgtagtatcattattattttccaagaacgggaaaaagattagaggtccctttacgctagctttctgtaaatgttgatggcttaattacgtctgattctaaccaaggtataagctgcactgcacgaatgccatcagcagttcatgattaccaatcgatgattcaaccccatcttccaacttcaattggatcataggcagcattaatcctcactaggcatcgtttggaacacaggaaattttcttacgatttccacaagaatcaaagaaaaaaatcctcctttttccgcagttttcgcatcatcattctccatagcattgagatgtggcaagccacgttcgatgttcatgtgccattgctccaggtgccagcaatcatgaaccttacctgaacggcatgcatgatgcgtgcaacagtattcagtactatctgggtgctgattggggtgtaacttcagatgcactcatcctttccgtttgcacagaagcccctgctttgcctgcccactcctccttaacattgcattgcgtgtgctgttggctgttgcacatgctcctcacattatttctgtttcagcaactgcaatgcaaccccattagcatatcatctttgatcccttttgcttccggaaactaaaggggaaaaagaaaatactcattcctcagtgcaaccaggaaacatggttatcattgtaattgccactccaacgttggcaggatgataaccttttttctgatatggatgtgacatgtaacagcttctaaaactatatatatggttatcaagagactctggaggaccatagcttccatagtcccaatcaacaaatctacacaccatgtaagaatgacaactggaagggggggaggggcagagagatttagctttgtatatacggcttcagtgtaccactgtctaagctgatgattataaggctgttgctagctatgacatgttgatctcaacgctgcaactcttggggaagcggcagacagggcacacgtcagcatttttctcgcaatcagcacacaagcagaggtgtcgacacggcatcaccagcaccgctgcctccttcattctgcacaacctgcatgctcccagcccaccatcagccatgctgttgatgccgaggaggcctgactggaagaaaaccccaggcacagcattgacattctgactggaagctgtgttgtccacttcgctgtcgccagagccttccctggtgagattgctgctatgggctaccatctgcatgagcttgcttttcatgctgttagcgacagactggttgtgcagtgctaccgactgccatgactggacttccaatgcaacctgcctgatctgttcgttcagttccttgctcttcctgttcatggcctccacctcgagttctttctccttcagcttctttcctactcctcgttcaagggatgcaagaaattcaaccatctgcctctgctttacatctttcatgcacttaaccaattgttccacctgtgggaaaagagacacatgatgagtgtaaaaaacttcacaattcttgtagtttcacttggcacacagcagtaaggggagagcagataataatgtgttgcattggaaaaaaaaaacctataaaactttaatatgtgaattccaggctaagttactttacagttgatagcaactgatgactgatgcaattgccacttgagcctaacatatacagatcactccacataataaaaatattaaattcttgtgatcacactttatacagtattgttggatatttacagactatgaggaacttgacgacatgggaaaaaccaaggttgatgcattcggaatatatttggcaatgaggtggccttgagattgaatgtttccatggagagaatatagtcaaacagcaaaactaccaaatcacatttggataaatctgagccccagactattccaaaattactgaatggcatagagtttccactactgagtaaacatttttccataaacaagcactaacaaacatctcaaatttggtcaatgaataaagtaagcattgaatacctgaagtccgaaataacagttgaactctttgttttctttgtctaattcagccatcacttcatcaacaaaggatgccatgataggcaatgatgacatgttaccactgccagatgtgattgaagtgtgctcattgttctcataggacagtcttagcccagttgatacagcacttggattaccaatacgtgctaaccgatcaagattttcaacaggaaagtagttcagggacatctgaagattgagttgcttttcatgaccaacatcgttgtttgtatttctttcttgattcatagcagagaggtggttgtttgcaatgtagttataataaccagtacttcctaccgcaggaactgcatagatgattaaatacatataaattagtttattttgagcgtaacagctgaaagataaaaaataggtgacatggcaagaatacagcagtacaccacaggccaaactactacaataggaactacagatgcctccgtgtataacggaaaaaactagaccgcaaggacacaaagtgataaagcaaaaaagccagtcccacctatcaacgaaacgtgtaaagagaaaaaaaagatgcaacaagagaattattttcactgtcaaatgagacttaaccatcatccctgttggaccaaatgtggttcctctaggcaccgcacacaccatcataggatgctgcacaaaagtaatcaaatccaaacacaacctaatactacctccatcgctaaatatattacattggttagttcaaaaatgaactaataaccaacgtcatataaaaggaacagagggagtagtttggtatttacattatggtggatgatctctacttatcctttaggatgctttagaattcatgagacactagttggagggtgagagcatgaaagcacctctccacaatttaacctactgggtagtgaattgggacaagatgacacggtgagggttaattatcgctgcaaatcttaatgtgctaatatcctacagtgagaatctgcaagcaacatcttaagggcacatacaagtataacacagtttaacatgtcaacaagctagatcaataaatctcacattagagccatcatttttcttttatcctaatacaagacaaggaaatgaacgtgcagattccatctggcacattattgagtagagaaccaaaatatctacccagcaatgctggcttagtgctcaacaactcaagcagtgaattcaattgcactaaatctgaaccacatatgcttaaagacacacaagcgattgcctccgtgaagctaaccaactagatcatcctaccaaagcgcaccaagcaaatgcaagacagtaatcagcgctcgcatcaacagattcatctcacctgcggcgctcccgaagagctgcagctgcagcggcgaggccttggcatcaaacacgaactggctctccttgggaatggaggcgtaggggaaggaaccaccccagtggccactcccgaacatctccccgtccatcctgctcctctcctgccaacaacacgcagaacaaaacacagcacaaatcacgcgaatcccctccaaaataatccgtgccaggaagaacaaggacccgacggattacccccgagacgacggcgacgcgatctctcctcgatcagcgacgaacccgatccgatcctgcgaaaccgtaacctcgtcaatgcgatgggggaaaccagagacaggggtcaaaccacgcggcgcggctgcgggagaatcgcggaagggaagctgaccggagactccgccgactcgacgcgccgccgccgccgccgccgcagaaaccgccggcggtttagggttggggaatccgcgagaggagcggcggcgttgggaaatccgcgatttattggtattttttttccttttttttatttttatttcaccctttcgctttgctctctgcttggttggtttaaaaagaaagaaagaaaccgcaagtgaagaaaaggaagaaggtgtgccagagtgtgaggagacggatgggcgggccttgattgttggctcggcccatttagtttcggtccatctgtgtgtcactacggcctgttttaggttcaaggtgggcccatgcatcagccaccaaatcagcccaggaaaatatacgtgtggcccatgaactaaaccaaacaagtagtcatcatactacttctcctaggcagggttacaatctcgattagttagcgaattttgagccccatcaacacattttgaaccatttctacaatctcgattaatttcgaaaattccagccgctcggaattcgttgagattgtgaactctgcttttatgtaattactttatttagaattacacagtacaacgcaaacactcacaacgcatttgcactcacccttataaacacacgcacgcaaaccctacccctatgagcatattcgaagattgggcctcgctgtcgacgggtacgtcgcctaccaccgaaagcaacaccgttaaatcttggaaaatttgctcccataaggagtcaaacccaggacctcaggtgctactgaggctcttataacctctaggctgcagggcctttcgcctatgtaaccaattttgttcctctggaaaaaaaagcaaagcaatcttcttatgctaattaagggcctgtttggggagtgtaagattatgagaagcagatggttggtagccagcttctgagaatctggaaaag

SEQ ID NO: 77010 - DNA, 14772 bp, Oryza sativa
aggaattgttagttcgatgaccgataattattaacgtggtggtgacccctactcatgaaaattaaatgatggcatctcatcttacaatagcaatatataattctgatgataatatttctgtagccagtcgtgtagtaaaagatttgtgatagtgcagtaagatggtttgaagtgtatactaacaaccatccgagtatcactactagatgttttgtgccaaatactataaggatttagcacgtatgagaagataaaagtttactaagaaaactttattataactaagaaatagcctactggttagtgccatgtggtaatttgagttgaaggtcttgagttctattcccattgaatgcaaaattttcttttatttttttctctctcaaaaaagggagaggtggagggggataaggagaaaaaatgggagaggaggagcgattaggggaggagggcggcgcgctcgggcgctcggggagaaaaaaagggagaggaggagtggggagcgatcaggaggagggcggcacgctgctcgagcgagaaggtggggtgggaggtggggaatcgggaggaagtggggaggtcaatgggtgtgtttggttgtaagccacactttgctatagtttgccacgcctaaggttaggcaaatttgacaggtgtttggttgtagccacagttgtggcaagattcccctccaacaaattgggtcccacgtgtcaatggctcaaaaaagtgtggcaagattcccttaggcttagtaagttgtggctaacaatttgatcacctcaccttaggcaaggtgtggcaactttgttggcaagtaatggtaaagtgtggctgggaaccaaacagccccaatatcttcagatcgaggcaaaatgaacataggctgtgtctagttggatccaaagtttggattttggttgaaattgaagatgatgtgactgaaaagttatgtgtgtataacaggttgatgtgatggaaaaatattaaagtttggatccaaactttgatctaaacacagccataggagtactacagagtggaactgggagcatcctggccgtacacgtgggggccttgattggccattgattcgaagaaagaaagcacatagtccaatgcaaattgcaacaccatgcagcaagaagaagcagccaagcagcacactgcatctgcatggtctccttctcgtcctccgatgcgagttgttaggacagcgacttcgagagcgacgctgtctcttgttgagttgctgtctctctccctctctcttctcttcttgcagctgcagatagaagaagaagaagaagaagaagaaacagtggccattggtgaaacgaatgtagaatgcgagtgaaatttcgaatggttttcaagaacttaagtttggctaacatttattgaaatttggttggggatcgggatccggcacttttaataggaaaagtgaaccctgcatacaccttatcttgaggtcatggatgagagaggtgagattgagaagctaccaatgctcacctcccaattccatggcatgcaggcaaaggaattctgaaaactgaaagccatgccatgtcgtagtaaatgcatatttatgtttttttggagctgatcgatcttgtgatctttattagccacccacacatattgaataaactgaaacatcttcttgcagcaacaaatacagctctgtttatctttgggtccagtactgtactctctggatgccctgctagattcgattatggatctgactgaccttccaacagcgacagtaggagtagttattacatccggtatgctgacagtacattttactatctcacaacacatcagttaggatgtgtttagttcacgcgaaaattaaaaaatttgttaaaattgaaacgatgtgacggaaaagttgtaagtttgcgcgtgtaggaaagttttgatgtgatgaaaaagttaaaagtttgaagaaaaagtttggaactaaactcggccttagtttaactaccttaatttggtacctatggtttgctgtaatcgatacttcatgtactaatcaagtataattaaggcagtgtaccatgtgttcatgaagtggcaagctgtaaaaataagtatgctgactgagcagagctgctgctgctgctttgccttttgcctttctcttttttctctccctttgttttcccagattttgctttgccctttatctgtggagagtgatggctgacctgatgtgtgctcctttagctagctagggtccttcagtccttgcataaaattagttaggattttggaagagagaaaaaaagtatgattgattatcacttaatccctgggatttatcttttttctggttgaattgtttgtttccagcaggttgaggttcccctgtcttggctgttcagtgttgaaattctggttccactgtttttggcctgtcctgcttgtccattcttaccaaaattgttttcttttaacatgttaccaaaatgatcaattttagatgacattttggtttgagcaattttggcataacaaagtagtacaagtttggtatacgaaacatttcctttttctcagtaagcatttgctagtttattatctctctttcagttgtactactacataatcatcatcaaagctactatagcacattgggattcatcagaaagatatcatcagctggggagaatctccactagtcgtaattaataaacaagatattgccctacaaggattaccttgtggagctcatcataatcatcatgcatgagacagtactacgtggccctaattgagaaccccccatctgtttggcaatctcatcacacaatcaattgcataataataaacaaatcaacgaacaaacagtaatccccagaaaaagaagtcgcacatgagaatcatcatgcctccaaaatttcttctcctccatacatccagatacttcttctcttcccaactattagcatgtttatttgcagcatcaattcaaacatttctagctttgacagttaatagcaacaaaaccgtaaatattaatgacttgataacaattttaatagatttaccatgaaacaaactatcataatatgcaactctttctacttagaataatttatcgttataaatattattgaccaaaataacatatcaaagacaacttctaaggtaagcgaatattagggaatgacctaatatcaaatgattagaaggggtgatgcttcgaacccaggtcgtctagcccaccaccttgtgaagctagcgggaagaccctgtacgtttttcacaacttctaaggtctaaaatactttatacttgtattggtggactgagagatagtatctctcatggtaaggatatagctgagcatcaatgttcagaaaagtgcaagaggacaagccattcattgtgcaatcacgctcgtcgtcttgcccaactgctctatgctctctatccccaggtcccctgtcaaattctaaaacagtcatccgatctcgccaaaacgccatcattatacctacctaatgctaattctagcttgcatcacgtaagagctttgccaattatataagataaactagtagaagaaagtttgtcaaatgctagctaggatcatgtgcatgggcctcctctgatctgcatggtcggtctcctttagcaattagcactagcttggctaaggttttagcaggttgatgttgtggagaggagaataataagtggtgcccttgtgatcttatctggtttttcagcatattccaaatcctggccggcaagcttgctggttctgataaatgtccgagaaactactttatttgcccccttagggtgtgtttaatataggccgagcttagatctaaacttttttttctaacttacaacttttcaatcacatcaaaacttttctacacacaaactttcaacttttccgttacatcgttccaattttaatcaaatttttaattttagcgtgaactaaacacacccataatgatggataaatctgcactttctgatcttctaaacagtatgattttcattaaaaaaaacttttatgtaaattacctagaaaatggagttttctaggtaattatttatgataaaatggagtaaatgaaattaaactcgaaaaaatatatatatattcccaaatttattagtaaatgatttttttatgatgaccaaaatggggttaaggaaatattgtgaagtaaatattgcatctgtaaccaaaacattccttgtggtacaagatgcatttttttgggttgagtagcccagttttccaggtaagtactacagtactagtagaatataaaaagaagaacagagccaatactttttctgtcatcttcttcagtttcttcagacagctgttgagattgctggagtcaccactcaccagtcaccacaatttgggtgtgaacagatttgaaaagccaaactgtttcttcatgagcttggaactgaaggacaaaaaaaaactaataaagcaaactgttccaggagtgcttaaaactgaagaaaattttttttcacccaattcttttgtcggtcggtggtggtggctactggttatagcacattaagcaccgtcgcctcagatttttcgacgaactttaaactggatttgacgcgacaaaaagcagccttggattggttccatgcaagtgctcttgcagcacctagcaatagcaagccaaagcaagccatcagagatgagcccatgaccatgaccctggtcaatccaaaaggaaagacactgagcattgcagtagtaccaattgtacacacctcatgtccatctccatccatggccatgggcccctccacaagccaagccttcaccttttaccccccccccccccctcccttcacaaactacacggccacgcctctctttctcatggcaacaacggcgtccaagacggactccgagtctccgatccctcaccgtaacgacaggtgccgttgaggcgcactgatatgcgagaccattggtaccattgaggcacatatgtggactacttctttatttaccacgaacacgtttcccacgttgttaaatactacctcggttttaggttacaagactttttaacattgtccatattcatatagatattaataaatctagtcatatatgtgtatatatttattaacatttatatgaatgtgggtaatgctataaagtcttataatacgaaacggagggagtagtatgtttcgtgtaaaaactttttattaaaaagtttctttcataaaaataaaataactctaacttttaagtttatatatgtcagtgacatttctttccatgaagtttgaaaatctcagccttacctcacaaacaaacgtagcacaaagaccgacacaaaacctctgtcataacaatcagtgccgttgatacatgtttacctcgcttcacaagccacacctctatctcactgtaacaactaagcaatttacagcgacgtccagaacggactcggaacctccgttgtaacggcaggcaccattgagacactgacatgtgagatcatattattgtgatattttattttagtagaatatattattgacagaaataggagatttgtcccatcttatttttttaagcttttttctgttcacttttggatattttggttgtgtgcctacggataaaggacggagatgtaatccatttcctttatatgaaaaaaaaccgtgtcatcgaatcgattcaccgacatgtgggcccatttgggcaattgggcacctaccgttacggcagaggatactcgtccgacccacagagtgagggattaaggaagaagaagaggttgattgagatgttggtaaagaaaaacagtaaacaattgggtatgtgtgtccccatttggggagatgaaggtgaatgagctttggatgagatacatggacacatatatatagatatgtatatatatacagatttccctccaaagtagggtgaagcaaagcatctcattccctcaccccccctaccccagttcttctccttcttcttcttcttgttacctttaatcctctccccttctcttctctgttgcgtgcaagcatctctcctcgtcttcctcctcagattgcttgcttgcttgcttgcatcctcctcacattcaccacgaggtttctgctgctggtttgtctgatgtgtgagatagaaagagagtgtgagattgaggacgaattgaagcctagcttgtgacgcaaagttggcatcttttggtttggagaggcccactgtttcttccacttctcgccttgctcgcattccttccttgcctccatccccatctccatgccatccgtgtgaagcctcgcgccgtttggttggttgcaagaacgccacccgcgttggttgttgccttcgcttctttggttgctgccgtctacaagaagcctctctctggcctgtgctgcattggcctcgatcggtggtcgaacacatgttccacggctcgccggcggcggtggcggcgtcggcggcggtggcggagatgaggttcacgacgggggggtcgtcgacgcggtcgtgggagccgacggtgacggcggacacgtcggacctgcactactggatgcagtggcgcgccgcggtgtgcgcgctgtccgtgctcgcgtgcatggccgtcgcggcgtgcctcgtgtggcgccacgagggccccggcgccgaacgccgccccggcggcgcgtccggcggcggcggcgggagcaaggagcggcggcggccgggggtgctgtacgacgacgaggcgtggcggccatgcctccgggacatccacccggcgtggctgctcggctacaggctcatctccttcttcgtcctcctcagcttgctcatcgtcattgtcatctccgatggtggcaccatcttctactactacactcagtaagccactccatttcattttctcagctactactttttttttacctcttcattaattatctgttcctttcccccaaaaaaaacatgtcattttaacttggaactttggaagatggtgttcttgatgcaaagtttaacttcctccttatctgttttcccccatataacttggatggtgttcaggatgcaaagtttggtgataagattttttttaaaagaaaaaaaaaagcaaggaaatgagattgattaaaattttcattgtgtgctcaagtgcttcaactaggaggaatgtactgtggtcaagaagtttggcatttgttcccctttggtgtaatttagatttttcagggaataaagggtgcttttccatgaagcaattggttttctgaacatgcatataaagaattaatgaaaactgtcaggcagaattcctggcattttctgttaaaaatactatgcacaattgatggctaaaaacggtttgcctgttagcttagacagcaagcgacgcgcctcaccattttggttctattgttcatggtcatgggtagtaccaagatttgtactagcacatctctgaaactgtttttatatgtgacacattacctcaatttaataattacaaaggacctcacatgttatttggagcgcatttaaaaatgcagtcttttgtgcagtatggaatacagtgtcataactgttcatactcagtttattaactaccagtctaccagctagaagtactgaaattcggcattactacctgtatggtcagtagtttttattaatgtttttgattaatggaatggacaacactaggaatacccactccaacttagctacctggtcttacatgacttcctgttccattaaacatttctcacatcaagttaatcaaatactgccttttgataatatattataatatatgacctttttgttgcaaaattctggtgtttatcatatttctcaataaacaaactagtgtatctggttgcaagaatcaaattatcgttacatggatccgctagttgttggtgtttgtcaccctgctcccagaagtagcatttgtcaccagccttcctcctctaataagtggttgttgaactgtcgataatgcaggtggaccttcattctggtgacgatttacttcggggtaggtcccttaatccctcctttttcacaacaaaatagtttgtctctgcactgaattcatgaatctaatgattcatgtcgatttatctttacatcgaacacatctgaagaaaagtttgttttgtggaattgttcagctcggcacggcgttgtccatctatggatgcagcaagcttgctgatgagaatgttgtcactgaaagaacagacatggagctcggctcgtacgtcgcccatggagctggtactaaacccaatttgaatggggaagatgacacaggagagattgctggattctggggttacctgctccagatcatctaccaggtaaagagggattccatgcagccaaagaacttagaataaccatccacttgagcgcctttttttttcttatttgttattgaagagagttatcttatctgcactgacatttgcgtccatggagagggggtctgatctcattaggcttttcatacgcaattattgcactaacaactaaagtacgtttgtggtgtgctctgatgaattggattccgtttctaaagatcagatgtgcccacatactagcatctttgtccggtcacatttcaagggctctcacgtagccgccctacatgagccatcttgacatcttgttggtcctatctaaatattcagataatctctgcaaatctcacatttccttgtacctcaagggctgaatcagctttaaaccgctttgcgaaatgtagggctgactctttttagtagtggcatcaagaataaagacaacatgtttcctttgtgttgatttgcaaggcctaactgtacccaaacggtgactgaataccttcctaggctgaaataggacagaatggaactattgttctgctttgtgataagaattactagatagttctatggatggtagtttactagcgccatgtttagttccaaagttattcttcaaactttcaactttttcatcgcatcaaaactttcctacacacacaaacttccaacttttccgtcacatcatttcaatttcaaccaaacttccaattttggtgtgaactaaacacaacctagatctgtgttgggttactgtgtacactttgccaacaaaattttgtaatatatctcaccttttttagagaaaagaatgggtatattcattaattcataatcgttgtgaatatccttttaaggatttatgctcttattatcaaactttacagaaaactgagtaatttatgtaagttttacagtttactagcaatttttactgaaccagtatctgaccttttatctgccatgacagacaaatgcaggcgcagtgatgcttacagattgtgtgttttggttcatcatcttcccattccttacagtcaaagattacaatctaaattttgtaagtattacatgcttcaggccttccctacctgccatctcatactttgaccaatacagtgctaaaaattcagttactatgtttcgacagttgttgataggaatgcactcggtaaatgccgttttcttgcttggtgaagctgccctgaatagcttggtaagttgataactacttatctcgatcagtcaagtaattttatgaatgaatgaatggttaatttgacaattacccactgaattcaacatatctgcagagcttcccttggttccgggtcgcatatttctttctctggactgctctctatgtcatttttcaatggattctccatgcatcaactccactttggtaactttttttttctaactcccattctctcctaactactaaaaccatgactaagagtagtacttgcatctttctgttactgatcactacatttcatatctatttgtcaggtggccatacccatttctcgatgtttcagctaatttatctcctttgtggtaattccattacctccctacaatgatacttcctcccatatgtcttctcttgcaaagattacaaactgaaatcatcatgaatatcacaactcaaatcatcagattttcaatgaatcttttcatctacacaggtacttcgccgtcgcgatcatgcaattaccatgctacgcggtattcagactggtgatcaaactgaaacaccacctgctcacaaggtggtttccgggttcagtcgtaagaggctcatctacaccataagccaggccgtcatgcatcatcttcctccgccattgccaacagtttatacagaaagggcaatggtgaagatcacaagaaaagaataatggcagcctggtggtgatggactgatggtggcatcgatcaccgactccatttccattcctcctttgcgagattctcttattgcagcaggtgcaactctccgagcgaaaaaagaaaacaggagaggcacatgcgttttacaccaccgtatagtagttctgatagatgtaaattgaagcttacaggttcagatatgagattcagagagtttttctttttctttttggatgtaatggaaactgaaatgaacagagagaaaaaaaagagtgtggtggggttatgtatagcttgactcattgactgattggtcaaatggaggagatatttgttaacattttttttattttgtagagctgattaattaatggtcatttgtatatgtgattaatgctaatgagtaatgaatggatgcaagtgtgtgaatgaggttgttaaaatcgagcaaaatggtacacttatgcaggaagaaatatgcatgaggtgaagggaggaagttgagtacctgacagtgagaaaaaagttggtttgaatttgccatctctattgattacaccacaagatcgttaggtgttgttcgtgaaaaagcatcaacacaaagcatggatggcactagtgttttaaatagcggactaaaaacatttagctgttagtcttctcaaactactataacgggctaaataaagttatagcggctaaattatacatgagagtaattagctagacttttttaaaatagctatagccaaagatttaaaaccttagatggcacctcgactagataggtaaggtcgccggagagaggagctccggccgccgtcggcaataattctgatcgaagcaaacttgaaagaaatcttgtgtaatttcagagagagttcggcccgttccgatacctcaccttcccaaaccgatttatgggccgcaattctttactgggccgaggctggtgaggcccacgccaagggtatttcacgataatctaattctaaaattaagttttaaaattctagctttgattatggctgataagccaaaatccaaacgtctgatgctcaatattatcgatgctgtagctcgataatccgtggcaataatccactcggtaatataaatcaaacggggataaactttatcggattggcatgcatattgacatttttcagtgcgaagattccttgaacagagcttaaatatgtatataacccatgcgaagattcctcgaagcagttcagacttcagatatatctgaacttgcgtagtgtttactcctccagatatgtcaatctaggtagaaatagatcaatggaatggaattttgggaaatttgtggcatcgaagcaatgcttcatatggaactgaacaaatcagtagctcagtgtttccaggctaatatctgggggaaaacttatccaataattcatgcttccaacggcacatcaattccaagcattcaagtctccaactctttatatatatctcaggtttccatcacattcaagaattacaactacaaagagttcacatcagttagttagtttgttcttgtttctgacgaagaaaaaggccatcagttgtaagttgattccaaatgtttctgcagaagattcaatccatcattaaactaacaaatgtttctgttctttgcaggaagaagacgacgaagaagaatcgcatcaatggaggtgaagaaggtggccatggttgctgtctgctgcatgttcatactgctgtttccaggccagcagcagcaggtggctgccatgtccaggatctgcagatgctaccacgaatgcttgcccaactgcggcctgcgcaattctcgctccttctgcaaggtgttctgcggcagctgctgcgtcttcaatccagttcacaattgcactagcaccgatgcggcggccgcggcgccagcgatcgccggagacgactgcagaatgatctgcctgaactccttctgcggcgaggcagctacaggctactgtaagatgcccattttctgcaattaattttgcatgtcatcttttctttcttcattttggacttccctttgctacgcttcccaagtttctaaacggtgcgtctcgtgaaaaaaggatctatataaaattattttagactttagagtagttctcgaaagcaatatttttaacattggagtagttaattcattcgtttgcccttggatttcagctatcgcatctttagcttcctgaatccattacaagcctgcatatttgattgattagttaggagtatttgaaacaatacgctgaattttccatctgtttgattgtttgtcctttgtgtttgcattgcagtactaatgttggtttgtttcgcagcggggcgaaacgatgctgatgctgcagcttgtctcgatggctgcagcaaaggatgaactggttcggaggaagtttgacatgttgtgacgatgatcagtatctgctgcgattcttgaattgactgttagagaatggtcgacaacaactaaatataattaactatgataataagaacaataataatgtatgatggaatctcgatcgtgtgccaccttctctggattcgatacggaattacgtttgctgtaacctgcttgctactgatcattatataacgttagttgtttggttacagtgttcaaatattctcgtattctctgcgagcaatgcaatcttgtttacgaactgaaggatggtgtttagatcatactggatttatgaattttatggtttttgagagttaccgaaacgtaccaatggtttagtgcaaaattttacatgaaaaaattctcaagataagttgaagatatactagattatgtactatttcgcaattttgaatacctaaactctgagcgtactaatttgctaatccgtgccttaacgattaaagataatccaagaaataccattaacaagtgtccaaatcccataaataccatcgataagtgtgagttccaagaaatgttatcgtacaaatgactttatcccaaaaataccattgttgttagggtttcatccattttgcgccgttaagttctataggataaacagtgtatttaacggcgtaaaatggatggaaccctaacggtgatggtatttttgggacaaagtcgttaataataatagagttagctctggcagataaaaccgttgatacgatgagagcaactcaccagtcaccatcctcttgcctttggtgtcgtacaggaagctcgggcagccgttcatggcgacgagcagcacaccggcgtcgtccaggacggccttaccatagccgtggggcttcacctcgccggagtagtaatgtcccggcggcagctccacccggaggaggcgcacccagttctcacctccggcggcggcggcgatccagacgtccatgtacggctcggtcgacttcatcgccgtcaccgcgagcgcgccgtgcatgtcgaacatggggccctcgtcggcgtggctcaccggcggcggcggcgccacccgccggaacgtctccgacaccgtgtcgaacgccgacatctggccgcggtcgtcggtctggcggcgaccccagtacacggtgtcgccgaccgtcacgccgaccttgacgcagaagtgggagcacacccggcgttggtggtccgggacggggccgagccgccgtggctcgctggcgccggagccggtggagaggatgtagttgtcgccgttgcggtagcacaggacgcggtgctcgccggaggggcggtggaagtagaaggcggacgggcggaggcgtttccaccggcggcagatcgaccagctgccgcgtcgccgggttgcagatgagcacgccgccgtcgccgccgccgcccgtgttccgctcgaacagcaagaggccgtcgcaggagccgcggaggctgacgcgcatgtcgcgccgcagcaatatccggcgacccgcgtcgtcgccgtcgcagaaggctgggatcacggaggtgatcaccgtgaacacgtagctgtagggcgacgacgacgagtcaacggcgagccccgtgtaaccgagcagctgcagcggccggcggcgggagtgggcggcgacgaagtaggcggtggtggtgatgcggcgccaactccggcagacggcgcggcaccggagcacggccttcgccggcagccgcaggaggatctccgcccccacgtcgtcgcccatcgcggcgcactaatcttgacgctggtcaggtcaggtctctaccacgtctctagttaataagaactagtgggctgggcttcttttattacgtggactggccttcttttgttcactgggctggacttgttgcatcttgtggtatgggcttcttttgttatgtgtcctgggcttcttttattatgtggattgggcttcttttgttttatgggctggacttgtttcatcttgtggtatgggcttcttttattatgtgggctgggcttcttttgttaaagcgcggccttcgcgacaaacggg

SEQ ID NO: 77011 - DNA, 15984 bp, Oryza sativa
aattcctgcagcccacttgtgcatttcaatcctaccacgtacgactgacaagccattttataacttattgaaaataatttataggtaaaacttttatataagtctttagcgatttaaaatctaatgctaaaagataaacaatgattaagaaacctcaaaatgaactattaaaaagtttcaaaattttaattttgacagcggttgataaaagctataaggcaattcctttaagcccggggaaacctctttttcgtcttccccttccactcccactctcacttcattcaacactggtccctatcccgaaacctaaagtctaaacttagtgttacgcatgggtggagctacatatacttaggctctgttcgcaagagctggttcccaactcgctactctcatttttcgcgcgcacatttttcaaactgctaaatagtgcgtttttaaaaaaaaagtttctatacgaaagttgcttaaaaatcatattgatccatttttttaaaaaaatagcaaatacttaattaatcacgtgctaatggactgctatgttttccgtgcgtactgtttgggtcaggaaccggctggagcgaatacaggctttggggggtgcccaagaatatataccccatccgttcaaatttagcttaaaatttttttagctataatttatctattttcaccatatatatatcccatgcatccaaatttagatacccatatcaagctaaattcgatccaaaccctccggagaagacaccattaacattgccagagcacaaatctcggcgtggattataaggctagcaaatttgactaaaacaattgaaaaattataggcgcctgaaatctaacaatttcattttcttaaaaatcccattccccctacccggtggaccatggcaacattagaatgccaacgacaacaaattcaaaaataaaacaaaaaaatggttcattttgctgcggccaacgttaactttctcaacgttcacggaaacgtcatccaaattagcaaacgaaacacaccaccctgtgaaatttcttttcctcgtttcaagcaaaagtagtgcaaaatcctcccctgcccccacgtgaacggtgcagttgtcccggccgctctgctctactgctttttcacctcaccgacttaaaatccttctctgaatttctcaccaacgccaaaaacgccaaaaatcgcagaaatccccagaaaaagaagagaaagaaagaaagaaaagagagctcttctgcgggcccaccggagaggaagcgatcgccgccgccgccggcgatggtggtggtcgacgggctccacgacggcggcggcggtgacctccaggccttgctggatgacgcggtacgagatggccatggcccgtggggttttggtgattttcgggttttggttagaaagtgtttggttctttcttgcagggggtggatgatgtcgcggcaaggggcggcggcgaggtagaggaggaggtggagcggccgtcgaacgaggacgcgttcccggcggtggagaagatggcgacggcagcggcggcgaaggggttgcagtgccggcactgcgggacgacggagacgccgcagtggcgccatggcccggagggccaccgcacgctgtgcaacgcgtgcagcatgcgctaccggagcggcaagctggtgccggagtaccggccgctgaggagcccgacgttctcgccggagcttcactccaacaggcaccaccgcgtcctccagctgcgccgccgaccggggccccagtcagccgccccgtcccccgcggcggtggcgaggtacggcggcgaggcgaaggaggaggaagaggagctggcatgggtgtcgaacaaggacgcgttcgcgacggtggagaccaccatggcgccgtcgccgcgggtggtggagacaccaccggaacacgaccaccggccggcgaacaccccgaccacctctccagagccgcactccgacagaccccgccgcgtcgtccagctacctcgccgcctgcaggagccatccgcatcagccaacctcgcccatgcagtggcggcgacggcgagggcggggcgagagtgcgcgcactgcgggacgacgaagacgccggcgtggcgccttggcccggacagccgccgcaagctgtgcaacgcgtgcggcaacaagtaccggagcggccagctgaacagcacgaccttctcccagaattcccaagaacagaagaagaagagcaagagctcggcgtgttccagggagaggaagcgatcggcggtggcggcgacggtggtggtgggtggtggtctccgtgacgacgcggcggcgatcgcggacgaacacctcgacggcggcgacctccaggccttgttggatgacgtggtatcgtgtggccgtggggttttggtgatttggcgaggggttttggggggttttgccttagaataattggctctttcttgcaggcgttggatgacgtcgcggcgaggggtggcggcgacgccggcgaggcgaaggaggaagaagaggagctggagtggctgtcgaacaaggacgcgttcccgacggtggagacgatgtcgccggcgccgccggagaaccgaacgaaggcgcccgtgccgccggcggggtggcagtgccggcactgcgggtcgacggagacgccgctgtggcgcgagcgcgacggcccggcggaggcggagcacgtgaggaaggaggagacaccaccgaacatcaccccggcaaccaaacaccgccgcatcgtcgacctcctccgctgctccactgctcttaacacggcggcgaaggcggtggagcggcggtgcacgcactgcgggacgacgaagacgccggcgtggctgagtggtccggacagccgcggcaagctgtgcaacgcgtgcgggaagcagtacaggaaaggtcggctggtgccggagtaccggcctctcaactgtccgaccttctcgccggagctgcactccaacgcacacgcacaccgccgtcgccgagagtcgccggtcgccatcgccatcgccggcgagaagtgagagaaaatgtttaaccccccgggattttgtttagggtagggatggcaatttccccgttgggggcgggacccgtcgggtacccgcccctacgggaacagggacggggtgaaatttcaacctgcggggctgcggggacggggccccggaactatgcgggggcgggggcggggccacaagctcacccgcgggtgacccacggggccccggaatataggatctaaaatatggcatacagcccataatcaaatttaggcccatatagcccaatatatatatacagatcagtaaagagaagccaaccctaaaatcaatcccgtgagtttgtcaccgccgccaccaatctctattctcgttccagtagttttgacttttgacgctatcccacaaatcacgcaacacatcacacgctgcacgctacttcggcgcttcctcacctccacaaatcacgcctcgcgagttggtcccgcaccatcaagcagcggcggtcggcgctcttccacgctgcccgtatcgttgctctcacggacgccgtctccccatcctgccatccgccggcgcctcatgtcgttctcctacctctccagccgccggctcctatgctgttctcctccttctccgaccgttcctctccctccggctgctgcaggttctccacatcattattcccttcctccacccggctgctgcaagtttcccagaccattctttccttcctccggctgctagcagtcgccgctcgcatctgggtgcggggccccggaggggccggggccggggattgattttgccccgttcctcactccggggccggggccgggtgaacccgcaaggatgcgggggcggggccgttcctatccaaccctcacccgccccgccccattgccaaccctagtttagggaggcgatttagttggcccgcccaattttgttagcacactgaatgtttatgttttttgctcttgctaggggagtaggggtttttgcctttttggactaagtagacttctctatggtttttgaaaggatttcccattgactatttgccactcttatgagtggtgctaaattatttgtcactggacccacatgtcatatatatgtgagggcacacatgacatagacaacgagtggcaaaaaaattaattgccatatcttaaaagtggcaagaagttaaatatcccatgcgcatttgtgattaaggagtctagaattattgcttttgaaatgtaaggagatactccctccaaatttgtgcagacatacacgcacatgccacactcacattctcgcaaatacgctctctaacacatactctaagaaacaggaaaacctgtggcatatccgtgatctcgctaaagttctattgaaactttgaagcctacctacatatgcgtaatattaatgggcatcaagatttgaaccctttgtgagaagttatgcacccacaactataccaccacgtcactagttcttactcctttcattttaaactaaccaacatcatatataaatgaaaatgggaaatggaaggggagtgttaaggaagacaacaaattggggggtttctttttattgttatcatttctttcattttctggatcaaacaaggctaacataaaagacctttgcattttgaagatccgcggagttttcaatttcattcacaagcctgacaaaatggagcttatagctcagtttacatgcagatgctttcgtaggtaaagaggccaaacttggttcttagccccccaaaaccaaaacccaacacatggcaaactagcaattgcatcatcgcactcaatcagttcatcgctgccagtctactaacttgggcaacgcctatgtgaaggcccaagtagtgaagcttacaccaagaataactagctggagctcacatagtgctccaaaatgaggcctggtaactcaagtgttcatcatcgaggtgtacccttcacacggatcatcttcaacaggttactgcaagctggactcccagaggccagagcagcaagatgcaaaacataggtctctggttgctaattagttagctacatatattagttactcccatcatataggtctccacctgctaattagttaactacatatactagttactcccattatctagaagggttatagccggagaaggctagccatcgccacgctcctcagagaccacaccacctgcagtatgggttttattcatggttatgaaagcatgtatgagaattggaaagaaaaagaacaagtaaatgtatcttactggaaagagtaatagctatgtttgcttggcgatctgcctcggcattccattccttcatgcagaaacagaaagtggagaaaatcagcaataccaaaaagtatcagtgccttagagatatagctgttgttttagcttgcccaaccaagcatacgctagagacaacttctgtacagaaacatcagatatgcagtgaaggtctaggaagaatgagatgccgctgatgcaaaacgagacaaaataatgttgtctcactgttcatgcttatatcaaatcatcaacgtaaaaatgcaatgcaggaaggaagtttaaataatacccgtcgaatgtggttgatctcaaatgagacgaagttttctttgagctttctcacttccttgcacagttccatcatgttctggttcttcgtttgccatgtacctttcacctatttgagaaatatatgagaaagctgttagcggagaaaatgatactcttgtctaaaatatgtagtttgaatatgtgataacggtatgagaaaaactttctatgaaaaatacttatatgaattctttcttaatttactatattgtaatgggcattgggctgaggtccgaggcccatgactatgccaaagagaggaatggcagatcattttcagtttctatatgtgctttgttcatgatttgatttgaaacatgatcttaaatgtttgcttctaggaacatttagttcttatttcataattgaaagcacatcaagcagcatgacaatcccaacatgccggacaggcagacaaccataaaaaggaggtgacttgattagtgatgaagaagcaaagaacaaaatatacctgataacagactagttgagagtcgccatatactatgattttcttgaaaccatgcctaatagcatatctcaatcctaagatcaggccccggtattcagcaacattattggtaacaataccaagaccctcgcgaagtcgagatatcttcaaggataagtaagcacatgaaataaaagtgaaaaccaaccattaaactttgaagtgcattaagtacttaagtataccactctcccatcttcagtcataagcacagccccagcacccgcttttcctggatttcctttcgatgcaccatcgaagtgaagtaagcataccatctgaaaaaacagataaggtgcaaaacatttatacgagtaaaatagcatgtattaatgaccaagtagatgacttctatgcaaggtgaggtgaggaggtaaccctatggcaacataaatttctagctccacagtttgcctgtagatgtgacagttggattaataagtggaaaacttacatgcaggatctgagcacaattgaaacaactttaagggttaatggcctcaagtacatagattattaaatttattatttcatcatccatttacaaaagattctgcagtaaagcatcctaaagagatgcaagaaataggcacagttgaatagtaattaaggagttaacagtcttaaaagaatgtcttactgatacgacagccttatcaaaacgattctgcaaagcacacctttttcttttggagaatacacaggagataaatttttttgtgattacatggaagatgcacatgcacaaacaccaccacacaagcacagcacacttgtgcgtgtaccccttaacgcagttcaacaggcagaggcccatggtaaatctgtgagcctgagtgtgtaagtggggacatcaagatttgaaccttagtgggcaaagccatgcactcacaacgcatcttttctataaagaagcaacaggtactacaagcttgaaacttcctatcctaatcatgtaatacttattcatgttggaaaataaaaaacctgttatttccttacagataagatgtcagaagttaattaatgaaaaatgaattagtggcagaacatgtttgtgatagtaggcctacctggtcaaaacaatagaaaaacgaagctagtgattaagagcattcaatacaaaagcatattgagcattcatatgtttttctgtttaatatcgaacttaattaacacaacaccttgaatagcacattttttaagaatgcattatagctttagaaatctgataagtcaaaagtattgtagtagatgcagaaaattaatcagcaaaacaagaccaaactttacatattgtttcgagagaggttgtgcatcaacagttccactctgatcaagattattcggtgagaaatggctggaagaactaggtcttgattcctgcaatataaggccatcatattattccaagtaataacaagtgtcttgaggatcaacataaaataacttgaagaatcagtgtatcctttattaagggttgtcaggaacatatgactacatgcaaatgcatttcagcagaacatacatatgcattgtgataccatattaataagcatgaacatgatgccctgctcaaattaaaaagaaaaacagaattaaatctctttatgcatgtgtatgcatgatggaagccacatggtaactcatgattatgtgctcacgcgaatggacattatacactttaaatgtgtatgtactggtgccaccgtcctgcatttacatgtggttaggaagcacttaatcacatgctctgaaaatgaagtgtgtacctaatttgcattatcatcacctgtgccaaatgttgctaccagggaaagtataaactagaaataatgttcattttcctcatattcactcgttatgtctagtggcatgctaggcacatacatacgcacactcgcagtctcaccatggtacttagcttaccagcctgttaaatgcttgtccccgaacagagtagccttggttaatacgctggctatagtgctcagctgaggcttgaccagatcccacggcatcctgtaataaagcaggatgaggttttatcactgatatcttgaatgcttgcaatagcaaaacttacgtagttcagatccacggattgtgccccaggctgatatcttgtattgttaaggacacctgtatgatttagagctgattgatttgaactagaaacagttatctcctacaaaggaagacaaagcatgagtgaataaaaaaacaaagctagttttttttttaaaaaaaattatcccattacacaatattggagcttatattaactttgtcagattcgacatgtcatccagagatggaaaaggcacatataagtgtgttggcacattacctgaaaagtacaggggataagggtaccaaatagatcttccctaagttcagctgcattgattacatatgtagcattacttaacccacgcgaagagaggtattcctccttttctctgctccaagagttacccttgtaggcacttgcagcaggaccagataccttttgaaaacaaatcagcaatctcaagagttactgtccatatacaaagaaagaagcatgaaatttacagtatttataatcccagaatgtattacagacggtgggagaagtagttttcagaggagttgtgcaattcttacttgatatttgaaaatagaagtaaaattcaccaaaatgttgatagttttttagtagaaaacgtgaagagggctaacgttgacttgtttcatctcccttcagttaagctaacgacatggcaagatagaaaaacaatccattcaaatgaatatagaaaacaaaccacaaatgaatattcaaatgaatatagaaaacaaaccacaaagttaaccctttgatacatgaagatacgcaaattgtgttaggaggttgagggagcaaggataagtgcaaagttgcataaacaacttatcctttaccttatcaacaggtaggatcattgtgttctttttttaaaaaaaaaaatttcacaacagcaaaaccaaaaacttacactataaatgagaaaaatggatgaaaacaggaaaacttaatgtacaatcacaataacattagtacaaatacacataccgatgagcaaatttgagcctggcaatcatttaaagatttgtaaacagctaccatctcccccttcctgacaagataatagttgctgccctcttccatcgtaccaaatgcaattctgtcaaaaagatgaagcacaaatgaagaagatcatttcagtgcaaatgtgtcatcaagagaactaattctagtagctacataagtgataagtattgcaatggtcagttacgatgccggcatagttagagaccagcacgaacagcagcagcaggcactcttgctacttacccgcacagctgcacctgcaggaacgctagtggtcaccccgcacgaccgttgtcggcgtgatctccagaagagagtgctccccagaggccagtgatataagagatgccttatgtgaaaaaaccagtgcacaatagtcttttcgtatatgtatttaagttttagaaaaaaaataaactaaaatggggaaaatacctagatatgagcctattgtagctacttttacgaaaacaggtgcgaatcctcaattcatacaaaaataggggcaaaccctgaaggtcccctaaaaatagaagccctaaaaagagaagcgaatactcaattttcccctggaaaataagcctaaactccatcagatcatcataataatgcacaaatgctaccccgaaacgttacatatcaacaaaaacggctttctctaactttcacatattttaacccacttgagaccaaatgctgctgtcagtctaatagtatatcacattacattcgatctccaatggccaatgcaggtgcagctgtacaacagtacaagcattcgaatagatctcctaactttcataggattctacgcggaagggatgctgggtttaacaaccaatcggaatcggcgaacccttgatcctagggaggattaggatacctgaaccctgccggagagggcgacggcggccagcccccgagcgtgagctgccggagcgagggagggcgacggtggagcaccggagggggcggcctggaggagagggcgacggagaggagagcagagggaggcggcgaccggctcggagcccgcgagcgccggccgccggagcgtcgcgccgatgagcggcggcgcagtgagcgagtgggccggcggagtcggaggaggaaatgcgagggtttggctcctcgtgggccggtcaaaaaaaggcccaatctgcacggggtcacgggaatattcggtcctgagtcagcacgccacgtcagcattattgaaaaatatatatatatataaatctaagcttctgttaaccctttgcctataagattaattagttctcaaatttagaatttttattctttttgaatttaattttaaaaataaatgtcaaaaacttatttccatcatgaatgttttgtcacgccaatacttgcatgagaaacaacactaccatattatgagaggttggtcttgcaatattgtttggctcaaagattaagatttagaaataagttttttgattggtttatttttaaatcaaaaaagttgttttaaaaaaactcaaagtgactcaaatatggtctaggtcaagtctttgtatttaaatcgtgaattgaaaaggactttctctaaatctttttatataaatcatggagctaatccgtaaacaacttccatgcatgttgcactttcaaccgtataaataataagaacaagtttaatgatagagctcattacaagctataagcttattgtaaagctatagtttatataagtctaaaacttaaacctaaatgggctgattttaccactagaaatctaaccaattgagttatgctcactcagtgcataagaatagattggagatgcagaatgacaaagttgaatgattttgtcatatgttgtggtcatacgttgttgattggtgaggtcctcaaaacacaaaaaggaatgaaccaaactctctaagctatatatgttgtcggtgatatgggcccggaggtatcgtgtacacagggaggaggccgcccccaaacccccgtggcacttccccaagggggtcgggcccaggatggagcggcggctatcctctcctagttgggggtcgggccgccgggggtcgggccgcccagaccctcttcacgcacctaccaacgtgcgggggttaagtgggcgcgcccaatacccaactaactacatttatggtggatgttgtggccgtgctgcaccgcatttaatgcggcatgcgggaatggctgacaggccgagtgagcttgattgaccagcgtggcagggtgagtgcgcctgccacgctgactgcctgtgtactggcccgttgtcaagcggcgtatggccggtgccgtctagtcacatcaccataataagaaatccctcgccccatgtgcaagccggagataatttcctactctaatttaaatcagggtatccaatccctagtgggaacgggtacctaaagtcttaagatggtagatggggaatgacgcacacgtaccccgtgtcacccgccgtgatttgatagggccatgctggagcgctgaaggcatgatttcctttgtcagaggaataagacgtgtaataaatgtataaaggatgtcttccttcttctctaggtagaccgtttgggcccatgtagtaaccccttgaggtataaaaaggaggtgcaggcctggtgagtgagcgatcgaacacattctgattgaaccaactagtacactgtgtctctcacagaaatcaagcacacgcaggagtagggtgttacgcttcttagtggcccaaacctgtataaacctcttttgtctcatcgttcttgaggggcccgaccccctccacatcactcctggcaccgaacctcgattctaacccgctgcccccggtcgaactgaaagggggggcccttagtcccctgctccaggagttcaccctctgacatatgtgaatatcctaaccctagaatagggagatgaatccttttttttaaaagataatggatagaaattcgatctatatatccaaaagtggatatacacagtcaaatgttacacaagtgcatatgccataaatctcaaagttgagataaatgaaaaataaacaactgaaaagaaaagaaaagaaaagaagataaagagaagactaagcctcaatcttttccttcatgcttcaaaatagggaaaagcgacagctagcccgcccttctactgccacaccttctcaatgacactacatacaccacaaaagctcattcatttcatcataagcaaaggaatgggacggaactagtccactcagcccgccgaccagtctcacgtccctcggacaacctatgaccccacatcacaaacaagtccatgcggccattccattatcatcagagagcaccaccttaccaccattgatgccaaataacatgacatccatcacccccgcaacgtgaatgagcttgccactaccctaccattgttgccgtagagcctcacatctgccgagccgttgaagcttatctcatgaaaaaaccgatgccaccacgctatcgtggctgcaaactacaacctctgttgaactatcgtagcttatctctccagagagccattgccgccactccatcctcgcataccgtgaactccaatgggctgccaacatagccaatcgccgagtccaacgtgcctagctcctatccaacttcttcaccgctagccgccgcccaaccggcaagcctctagctgcctgcaccgttcgcatccaccaccagtgctccgcctgccagatccatatgagccacctgcgccgctaacatctccacaaacgaaatgaaggagaaggcctcgccgccgccgtcctagcggcgaggaaggtggcggtggctgctagggttttttttttaggaggggaagagttgggagggcagccaaggaatcacagtcgggagaggaatccatgttatctcactgcatttcttgttcatgaatataactatttctaacatttaaaatttatccacaaatataagcatttatagagtacaactccctcgggccccggcccaaccaccctcttgttatccaaattttgctgaaatttgtgtcgaccttaacattaatttctgtttaaactcttatgaatgcttatatttgtgaatggaaggagtactaaattacacctaatgggactaggtggactacctttcagagatgacagaattgcttctggaatggaacaaccaactcaccaaacaacgagatgaacatggaaacacgccgctacacttctctctctcacaggaaggcgagaagcatggaatgcttcccctctacgcagtgccccgttaaaaggggcaaagccatcgcaacgctcctgaacatatcagaaccaccactggagctcaccaggacattgctggaagcagatgcagactcagcattccagccggacagaagagggtccttcccaatccacatcgcggcctcggctgcaggtaaggatgcaagcgggctttttttttcccgcttatcccacttctagtttatttttacttctaaattttgtactactgtacgagaaataaactagcaaatgggtttttgtgcgggtaacgggactacccacttgtatcccctagctgcaggtcggctctcggcggtcatcgccttgctcaccatattccccggttccgccggattgcgcgactccgatgggaggaccttcgttcatgtcgcggccaggaagaagaggtacagtgttgttgcacacgcttgccagacgccggcattgtcagggatcttgaacaagcaagacaacgaagggaacactgctctgcacctagctgtagaagctggggattggtggattttcgcctgcctgttcgtcaacaagcaggtggacttgaacttaccaaacagtagtggacataccccgctggaactctctattaacactatcccgacaggactctactgtctcctggtaacacgtcgaattccaaaaattgaatgctttgttctcacatgtttggtaaaatttgagaaaaaataagagaaactaagatttgtacctcctctctgcagaactcgcggattttgatacaggaaacactgatagccgccaatgctacccgcggcatttctcggatggatgctgctggtacggaagaacacggaccccaatctgaagccgagaatgaggaaaaagggtcagaaatagtactacctctatattatattttaatgtatgacgccattgactttttgttcaacgtttgattattcatcttatttaaaaaaaattatgtaattattatttatttaagtgtgacttaattcatcatcaaatgttctttaagcatgacataaatattttcatatttgcataaaaaatttgaataaaacgaatagttaaacgttgataaaaaagttaacggcgtcatatattaaaatacagagggagtcaaattcgacgcaatttctcagcgttggcttggtcttgatcacgacgatggcgtttggcgccactttcgcgttgccagggggttacatagccgatgaccacgccaacggaggaacgccaactctagctcgagcgaagcaattccaagggttcgtgatggcaaacacgctggccttcttctgctcgtcgttggccgtcctgagccttgtgttcgccgggacaccaacggtagagttgccgatgcgctacacgcactacaatatctccatctggctgtctctgaacgcggtaggatccttgccaatagcctttgcaatagctgtttatatcatgatcactccggttgctgccaagacctctcctgcagtcatcgtggtgattctctcggtagggatcctccattccccctcgataaccgagaaatttactaagcttttgttggtgctatgtgttagaccaggagtattgccagtgttaagatctagcatatttaaggtaatgttactcatgttttggccactcatagttatcattggttggcaagagttttcatcgatgatttgaacaagaggactcaagagtgatactgtgatatatggacatatttcttgtgcattctgtaagttttttcgtctcgtttgaaatggacatgctttttatgaacaatgcataagatcaaggagaggagggatgatttatgattcttttttccctgtttccataagagaatatatcatagctcacaacttcgttttctctgagacactctgctgtgcaactataactagagcagtgcctagcaaatagcaagtgtggatataatacagaagaaatcactgacggttcaggacagtaaaattcatgttctaagttgcacctttcaaaaccttcaagtcctaagtgtacaaaatcactaccaagatgcacgttaaactagagtatgatttagtcttgtttatcaataggggccacagaattatagacacacctggaattagaataataaggcaagtcttccgcaaaatcaagcatctcgattctcgataaagagcaatggactgcacttgagacttgacaaaaacagagcatcaatcaggctatcaaacttgctctaaccctcttcctgatttccatcaaacataagttactccaagttagagataacaagaagaaatgcttgcatatctatggaatgcaggctacacaaaagaaagctttaagcttcaagaggatatggacgatcaagagttgcagcatgtgaaccagtggctgaagaat

SEQ ID NO: 77012 - DNA, 5552 bp, Oryza sativa
cggtggctcgggcacgaggcgcgagtgcgacaacgcgacggcgacgacgatggcacgcggggctcaaggcggcgacggcgcgacggcgacggcgatggcgcgcggcgcggggcgcgagctggcgcgcggcagcggcgcgggcgacgacgatggcgacacgagcggcagcgggcagggggaggaggagggctaggatggctaggaaccaaatcgaacacctagggggctaataaacagtgctagccggctatttttgtttttagaaggtattttgcaattaggaaaaatatactattgccactaattttgtcacaacataaaatacaccaagtctaagttattccatcgaaatttatatttaaatttaatattgaacatattcttattattattatatatttttcaaagttttcctatttttcttcttttagggttttggttgatttataaattgagaaaagttgcaaattaaatttgtatttactcctaagcatttgggtgaccgtattaagtgttcaaatgtgaatttgcccaaaatttaatattgtccaatatttaaggtttattaaagattctataattttctaatgagaccgttattaacacattagcacattggctcaatttatttatatgttagtttattttatatggaggggtttaatatattaaatttcaatccctaaatgcaattaggaacttggtgcaatatcgatctacatatcgaattaaatactcccataattctattatatatagagagagctcagtttatttgaatgatcatcatttcatgtgtactcatattatggcacccacctatattattcaaatattttaatatttgataaaataggttaataataacttttcttttatttgattttaatatcttgtgcataattatttgtaggattaaatatattcttgtaaatcatatctattgcttaaatgtagttcttttctttactttcttggtgatcatttatggtttggcaagtaataggaatcataacaaccagcatgatgcaaaagttttaaaaagttcaaaattttagtgatttttattgttgggaattttcaggatgttacagtagctcaactggttaggtttttacggtggaaccaacttaggcatgttcaaattctagacttgatatgggtgtccgcatttatgtggtgagcggctgtgatgggatcgttttcttcctcaaaattttatacctcacaaacgaagttaaatttgatttagatttttacaaggtttccttccatcatctgatctacacttggattttttgcgtgactttagtttgtcatggttttcacgagttttcagcaaatttggggtttctaccatgtattttacctatttagtaacactcaaagagatagaggcccaacattaaatctgcgagtctagctaattttgttttttgaaagtccatcaacatatgtgttactggtgggcaccaatatgcaatccggctttttaatcatgaaattgtatggtactatcactatatagagcctcatcggttccaaagttttgttataagtcgtaacgacttattagtgataaaaaagtattttgtgtttaaaatttttatatatgtgttcttagcagtataaaagctaatgttgaaaaaaatacgtcaaacttcaaatttagtttgaaatttaaattttggctttacttattttttttgtctaggggtctataaatgtaaaagcttcttgaaattcatacaataaaataatatttctattacaaaaggatttagaaaaggttgcatgttcctgggctcaacacgtgtagagaacggttcaacattttatgaacccgatgcttaaacccaagtagaggttttcagaaaagtggacactcttccgttaaaaaaagaaaaaaggaaaagtgggccgggccaaattgggccgttccgatgttccaaggtcgggcttcttccagtcctgcgccaacatttcaacagggctacaaccaatgcaataagttcaccctccatcccttaactttacaccgagtttgttagatatccctaaattatacaaaaccgtgcaatttagatcccgtagcagtatagatgcctggtttcgctgacgtggcatcctagtcaataaaaaaataaaaaaaaagcatgtggggcccacatgtaagtgagagaaaagtgggaccgcatctcttctttcttctcttctcttctcaacttgcttctcttctcaggacgtcaccagcggcagatgcgggagaggcggccgaggcagagcttccacagtggtgacggcagtagtggatcggatgttgttgacgtcgaaggccagcgccggggacgcggcatggacggatgagttcgccgagttcaaggtggggcacgcaatgctggtttttgagcgactccgtggcgttcatcgagggcgggtcgtcggccctagggtccgacaacggcgtctgcgacggcgatgacaagctcgccgcgacgcagacgcgctgcttcactgcatccagctccacgcccacgaacctgttggtggcgttgccgttgagggaggcgttggtgaggccaaggaacccatagtggctaccaatcactctcttcaccgcggcgccgggtgagaaggaggtggaggtggaggcagaggcggaggtggaggcggctcccgcctcgggagtggcagcgactgagggggcaggcaccaccggcgcgtggatccagcagcccgccgccggccatccccatctaggaagagaagaaaaggaagaagagaagagggcggctaacatgtgggacccacataattttttatttttattttgctaactaggatgccacgtcagtgaaaccagagatccatactgcaataggacctaaattgcacggttttgtgtaatttaggagtgaaaatttcttgtattgaggattagatgtcatacaaactcgatataaagttgagggacaacgggtgaacttattccacatccaattaacagcgggcacaagctagccctcgatccattaaaaacgttattactaaattttacttatttatttactagcactatgccctagcttggtcattgcacaacacacaaaaaaaagtctaggtcactaatcaattaggtcaacttaatcacttttatttactaaataaagaaagcatcacgatgctcataggacctcgcattccagccagttttccattcttctagcaagctctctgattctttatttcttatgaacaccgtagaaatattactcctaccttgcttaagctacactgctaatctcctagtacatcacccacactgtcaagctagctacacacacctacgtgcgcacgtccgctccgatggcggcgagtgtcgtgtccgacaagtccagcggcggagcgagcttgctccggccgtcgcgggtcttgttcctcgccgtgctctcgacggcgttctggtcggtgatattctacgcgcaccactccgccgtgcaaggtaacgcgaccatggcgtccgtcttgctccggccgtcgtcgttctcccgcccgctgctgacgtcgttccggctcatcggcggcgggcttgaccggtgcgccggccggcgggtgtacatgtacgagctcccgccgcggttcaacgccgagctcgtccgcgactgcaggctgtactcgaggtccatggacgtgtgcaagctcgtcgtgaacgacgggttcggcccggcgctccccggcggaggcgcgctgccggagcgggacgtgtacgacaccgaccagtacatgctggcgctgatctaccacgcgcggatgcggcggtacgagtgcctcaccggcgacgcggccgccgccgacgcggtgttcgtcccgttctacgccgggttcgacgcggcgatgaacctgatgaagagcgacctcgcggcgcgcgacgcgctgccgcggcagctcgccgagtggctggtgcggcggccggagtggcgcgccatgggcgggcgcgaccacttcatggtcgccgcgcgccccgtctgggacttctaccgcggcggcgacgacgggtggggcaacgcgctgctcacctacccggcgatccgcaacacgacggtgctcaccgtcgaggccaacccgtggaggggcatcgactttggcgtgccgttcccgtcccacttccacccgacctccgacgccgacgtgctccggtggcaggaccggatgcggcggcgcggccgccggtggctctgggcgttcgccggcgcgccgcggcccgggagcaccaagacggtgcgcgcccagatcatcgagcagtgcaccgcgtcgccgtcctgcacccacttcgggagctcgccggggcactacaactcgccggggcggatcatggagctcctcgagtccgccgcgttctgcgtccagccgcgcggcgactcctacacccgcaagtcgacgttcgactccatgctcgccggctgcatcccggtgttcctccacccggcgtcggcgtacacccagtacacgtggcacctgccgagggactaccggagctactcggtgttcgtcccccacaccgacgtcgtcgccggcggccggaacgcgagcatcgaggcggcgctgaggaggatcccggcggcgacggtggcgaggatgcgggaggaggtgatccggctgatcccgaggatcacgtacagggaccccgcggcgacgctggtgacgttccgggacgcgttcgacgtcgccgtcgacgccgtgctcgaccgcgtggcgaggcggcggcgcgccgccgccgaggggagggagtacgtggacgtgttcgacgggcacgacagctggaagcacaacctgctcgacgacggacagacgcagatcggcccgcacgagtttgatccatacctgtagctggagtagctttaatttgtagcttttgctcctactaggtgtattatttcgaattgaaaatgtacttgatttttgttaagatttcatcgcataggtgaaatctaccagaaaaattaaatgtcatccgaaagtctaatcttcagagaaaatcacacacgataaaatagcttacgtacctttttttcagctgctagttagcggaatcatgtttcgaagtactccctccgtttcgaaatgtttgacgccgttaactttttagcacatgtttgaccgttcgtcttatttaaaaaatttaagtaattattaatctttttcctatcatttgattcattgttaaatatattttgatgtaggcgtataattttacatatttcacaaaagtttttgaataagacgaacggttaaatatatactaaaaagtcaacggtgccaaacatttcgaaacggagggagtatcaatcaatgtagtgaacatatcacacggtgaaatctacctaaaaaaaaaaagcttcctaggtgtatacgcctaaccttcagatatcgatcaagtgacgaattctaaagagtagagacagccgccacaaatttggtcgcctatccatgtacacgcagtgtgctttgctagcactgcaatgttagtgcatactctactaaattacatcata

SEQ ID NO: 77013 - DNA, 30967 bp, Oryza sativa
tagaagaaaggacaggcaagtccttctcaattcagtagcctcagttttagaaacattcattcccaatgtgagcccgtctagtaaaacaaggaacagaccatgtattaaagcttgttgtggaccaagatttcgctctgtcacattgataaatgaaatccaggacaacaggtctcgtattgtgagcattcttccagtgtgcaactggttgaaccacatccagaaattaacaatacaatctccaaagcaagaaacctcagcatttgtgaacctctctatagctatgctcttaagttcatcaacattagtgacagcaggaacccacacttctgtgaaacgatttcttaaagctggagaaagctctttctttccatagtcaccacctggattcatcgtcgcaaggataaagaagtttggatgtgctactactttctctagcacagaaccacccttctcagccagtgactacaacagtaaaagtaggagtaaacattaaaatgaaactgaagttcaaaaaaaagttgatattttaacacagccttatgaatcaaagaatttcacgagtggatagacaagtgcatgataagatagacaaaggtacagtcctcacaaacaataacaatcaatgtagaggactagaagtaatcttccattgcttaatggtgggaccaagcaacaactaagcaaaactataaatggcttgtatgactcacgacaaaataggtataagatgcagtatctgacaagcatcttgtttagcaaggacaaaaaagaacttcaatgaagtatggtgtgtaagaaatatgtatcctgaatatttaaactgtgatggttggttcctcttaattaggaggtaaagatgcatttggtgatgtggtaggcttctgaaggtttacataatctttcatgttttaattaagtattaacaaataggaaacatcttacattgacctgcaacagaaatattttaccagaagttctaaggacttcctatacgtgggttccaaagcataccacaaactggcacataaatctataacatggattaaaaccgaacaattcagcaatgcacagattacctgcaggtagattgtactatgtccctaatagttatgttaaataggattgtttctattttatatagtagttctgtaaagtacacaactttattacttatgcccctaatgtgcaatttgatcaattaaatccttcaatctgcaagcctagttccttttctttaacataattatctcgaatgtagtgtgcactgctactttactaaaggataaagcatagagttcaagcagaaaatagcaacccgaaaaagacagcataccaattttctttcaggttctagaacactgttcagtcgttcaagtacgctatcgtcagctaaagaaatttcatcaattaggaaaagatcaccattcttcattgcttgcacaagcgatccatcctgccaaaggaaaattgcctgccacctcttgtgaagttgcatcaaatccaacttaatttgctccatggcggcaaaatcatgaggtggcacttgtgggaacagttccttctcctttatgtatctatcaagtatttcatcgatgtgattcaccacactaacagctccagatatatcagcaggaaatgactgcacatcatggaaaactagttatacatcaaatgtactatatataatctctactgtttaaaaaaatatgatctgggtgatctgttctatgcggaatcattctagatcttatatagacgaatttacatagacgtgtgtgttgtaggattttttttgtaattgcatttgcacgtgtacatgtagttttcagtcaatagtatgattatatgcatgctttttttcatattagagtatagttatattatattttgagacttatctcaatacacagggatgaaatatcatatgccagcaccaaaggaacataccatatctcctgcaacatgaatgaatattttcagctgcttcatttttgtaatcagatgtttgaactccatcgctatttttgacctatcacgtataggacagaatccctgccaataacagtcaaaacatgatgccagtgaaaataatgctaaagcgtgaaacaatgggatataacaaaacagaatcccagcaatgatttcgagataacaacccaccccaatgaaatctgaagtctcggtatattgatggcaatttaaaatgtgtagcttcactccaaggacagcacttaggacctggcaaacagttgttttcccacctccagtttcaccaacaaggaggacaggttcacgtgacctgtaacaacgctcaatgaggaagtatagcctccacatactttccgtccaagtgatgctgcaagcatgtacaaatacatattgcatcagatgaagagaagttaaaaggtgtagtatgttatatgttaaagtataaaaagaactcactttccaaaggtttcttgtactctcagtcttatagattcacgtgacaagttattgtcacagctgacttcctgcagtcacaacgaacctctcaatgatacgacagactaaaaggtcttgttgaagttaaatgtataaggattcaaaagcattgtgaaatatttcatgcaagaagtaatatatttgaaagagactttctgtagtttccaggcgaatgcacatgcaagagtaatcaaagagaaaaacttaggctccctatagtttgtgtttcaactcgttgttatgttttcacagtaaatttctacagtagcttaattaataggcacaacacactgtaatgcatcaaccacaaactcaatgttcaaacggtgctcccatgaggtctggctgctttgacgtcctgcaccacaagctcaccctttgggtatcgttcccaacagttagccaattcgctggaaagaggcaagcagtgaatggaagcatcaagctcccctaggcagccttggctgccaccaaaagatgaacaagctcacccttggtcagatgggaatgtcaactaagtgaaatagcaaacatacaacaaggtgttccagtagcatcacagtaaccgctttcaatgtatgatgaactaaatcaattccaccaggagtaaattcaatatcttgctgtgggctaatggtccagtggcttattttttaaaaaaaaaaaagagcaaaagtttttatcacagaggggtgcagttagcaacatcttctatatatttacaattttgaacccactaagtgcataaaggtattttttgaaattgtttagttagaatgccctagctatatagtgccagcatcacacatcataatatcacatcagcacagcaaagtgtaatttatgaataagcataagcattttttaaacactaatcgtcatcttccttaattagattaggcaaggaggttaacgaaacattagcaatatatcataaagaatgaaatggtaccatgttgtagagattggagatactgagtttaacatgaagatgtcgttccaatacttcttgaacaacagctttctcagtgtcatcccttaatctctctgcgagaagtaaatagccatctttagctaggtcttcatatgacttcccctcaaaaagtctgtaccgatttgcccagcgaaataaatcccgtggtgtaatgaaaccatgtttgccagcaaagactctgctgttttgtcgatgtgtttgtaaatctttcataacttgaaccattcgtgtggcataactgcaggcaattgaacatctctgctccaaaattgtgattagctcatcttctgggatttcatcaacatgcacttcaataaaacggttgcggaacgcccgagacaatattttacgtcccccatagagcacaggtggattttgagtagcaaagagcataaaattagggtgagcaggaatggtctcctgaagctctggcacaaagagctccctgttgtcatccaacagccgatttaaagcttccaagacatcagacggtgcaagatttagttcatccaacacaatccagtgtccctcacgtacagccttcaccaaagcaccctcctgaaattgaagcttcccatggctgtcagtaacatatgtaccaagatattcttgaagatcagtatgctcgtgattgttgatacggacaaattcatgaccagtttgtgctgcaagaaacctgacaaggctagttttgccacttgatgtgggaccttgcaggagaacagggtattttttaatgtaaacagcacaggcaaggttgacaatgtgctcagtgacactgttagttaacacatagctacgcaaaaagtcgtcagattcagaaccatttagtagcttaggcttttcaacgaagtagtcagcaaatgaaattctaggtggcactcttccatctaacaaaagagatactatcaagttgttgatgatttttgcacttggggcatccagcattgtaagaaagaacatacagaagccatcataaagagctttcttgaagccaaattttctctctgcgtttttaatataacctaatgagcgagaaagagacctcaaactaaattggggcttctgattagctccatcctgcagcttctcctcagactcctttttcgctgctttatagaatcgaacaatgctatctgcaactcctttagcagcatgcaggccatccagatatttactgacaaaaagacggagatcatcatcatcaataagatcatctacaaagaattcagtaaatcggctcctaaaggtgtatggcagctctcttttcccagcatcagttgctggattcatgcatgcaaacatccggaaacaaggatggcgctcaatatagtccacatcacccctttcagccaggcacaatgttccactctctccatccagtacagcgccaattctctgaagagtctccggaggtgccaggttaacctcatcaagcaaaatccaatggccatttcttaaagcagatacaaaagcaccctccacaaattgaaatgacatgccaatttctgaaccaatttgactacaagcggcatttagcctggatgaaaaggagtcccagtcagaaataacttgggcaggcaagggcctttttctcttcgaaccactgttagacctagaactcccatcaattagcttctgagctttctcaacacatttttccaaagcacgtaataacttcttccattttttctccattacatacacatcacaatggcgaagaatagcttcattgtcctgaaaaggttaaaagtttggtaaataagaagaagatcaagtcttcaggcttctacagcttatttggtgcagttaaatcacccctgtgccagctgaagtctacaaaagtagactataatacctgctacatttaatttctagggcttatctaatactccctccgattcatattataagactttctagcattgtccacattcatatagatgttaatgaatctagccacatatatatgtctagattcattaacatctatatgaatatgggtaatgctagaaagtcttataatatgaaacggaggaagtacgtaatagagtattgaacttctaatctactggagttacccaataaactagctttcaagctaacagtaaataaggtcaagcagacacacctttccagaaaaacttcgacaaaaaagatctttgaactctatataaagaggaaagcatattgatcgagcatctgcaggcttaaatccaccgagaagatcagaaatatcgctttgctggctcaagttctgaaaacaccaataaaaaatattagcacattataaatgtcaaagattgtgagagaatgtgtaacctgcaatatcaccactgaacatttttgacattctacattggtcacaccaaaagtgggaactcctaccatgttgcaacaaaaaacaaaaggaaaaaaaaggttccttgacatttattctagcaggcatcatgttgcaaatgacctacccatccttagacctgctctctgtcaatgcaccatgtacctgattctacaaggtagtgattgcaagggctcaactactagataatggagtaaaggaatttaggagattatggcatttatgtaatattattttgtttgcagtggcatagaggaaacaaccaagtgaggatagaaaaactcaattaataaatggtttcgcggtggtaaatatcttgagtaggttatgtaactacttgtccgtaccaccacagtaagcggctgtttaagccaggaagcaagattctgcacaagagtagtcttcccagtgccagtttcaccaacgagaagaacaggctcattgaactttattgagcaggctaccctctcaagaacttctaatgcacgccgaatatcagcaaaaggccctttctgaataagcgcctgcatatttgaagcacagtatcagtaaagtagccccaaaagaagttctgcaaatatgcaccagataaagatcggctaattactggtttgtcgctgcactgcagagtaactctaccaacttgcaagtcagtatgccgagcctgtgtattatgaatcattagttctacaaggagacaaataaacaaggtgttgtatataacaataataaacacatacctggataatgggcttgtcagaaggacttatggtttctgctccatgggggacacaaaatagtttagcaatttctcttgctacatatagccttttatccagagatgacaaagaggaagcaaaaatatcaacagcctgaattgaaaaagaaaaagagaaggagaaaaaggtgcctgagagcctggaaaaccaatggctgaatacaacttcaaggaagttacttatcaatgttcatgaacaataaaccatcatttcatctaggaaaatagaacgacaatattaataatcatgtctggaaaatagtttgttttaatacaggcccttacatttgtgacaataatgacagtacacaacttagtcactgttctgaaaaggtggaccctgggcagactaggtgccacaccctgccagcgacctagctctagaatattaaaatagtcctctaatgttatgtaaaattattgtgaactttaaaccctttttggctcccaggaattaacaaccatacatgggctcagaaatcaaaccagaggatcactcttttagtactccctccgtttcaggttataagactttctagcattgcccacattcatatagatgttaatgatctagaaacacatatatgtctagattcattaacatatatatgaatgtggacaatgctagaaagtcttataatatgaaacggaggaagtatgttaggaaaggtccttaaatctaaatttgaaaatgaagagcaataacaaaatagttcacttccataatgctatgttcctaaaatcagaataatactaatattgctattcgtcaaagcagtcttttgatggcatcaaggcacaacttttgagttttgaccataagtttttttttttacaacatagtgatatatctctggagagatgataccatttaggtttttatgactagaccaacccggatacagagtttaaaatgattgactgcagactttccatgatgacaagttgttgtgatcaagggaatatcaaactatatcaaaaggaagagagagcaaaaacctcaaaataaattaatttgcaacaactagatgacaatcctaggcccttgaagttgagatcaactccacgtattctcttgcaccatttgagcaggtccctggtaaataaaagttgtgaaggccgttcttatgaatggacaaataaagaatatatttcaaggtatatgcaccttaaggaaaatctttgcacgagacattcagatgaacctccagctaagttgagcccaccaaactggtaagataccagcaaattggccttttcaaaggtatctacaatacatataactggttattatacaatcacaacatagcaaataaagtaatagaagaagattgcatctaccaatgagtttagcggagatagactccaagcttggatagcacccatgaattatatcgatcatgtcttttcggttaggttcacccaccataacttttctccacagagcactaaaggttagtcttcctggttgaagaaaggacaaaaattgattgcaaattagcacagggcattaatttggtccttattgtgagctcgtggaaatgtagaaatgttattatggactgaaacataatatgcattagttattctgaagcaaaaggtgtaaatcaatagttctatgcaattttcaagtgcataactgcaagtcataactttatggaactattggacaaaccttccagggcatgtgaaacatcattctttgaggtggtgactgtagcaaataaacgaaaattctcagcaacttcaactgcctgcattagacattcaaactagtaaagacctccaggtagttggcatttatgaaaattattgcaaattatttctgaggtttgaagatataaagagaacctagagaaatagttcacctttcaaattataattatcttaaacaaaataaataaataaataaataaataggatattttcacctctgcatgaccaaccgaaaaagaacttgaaccttccaataaaggtaataagattgactgcacatcactgggtgctttgtcaatgtcttcaaacacaatccagaaacctttgataacagcctgctcatcacagtatggtcagagaaatatatgaaaataaaatccaatagtaggattatactgtgaatagcagtccctacagcacagacctgagtaagagaaccaggagaccacttgaattcaccaggtttttctgtgcaaacgtaacttcctattaaggtcctgccatccatttgttcatccatgtggatgaagagcactgcaaataaaaacatgcacagaagattagcagcattattggggatagcgtgattagtaaagaaggcctagaggtatccaagattttgaacaaagtagaaaacataaaaacatcgtcattgaatcatcaatgccaaactgagctattcaataataaaacaagaatgactctgacattatcatagaaaacttgtaagttgttaaaaccagattgcgaatgcaactttctcagatcatatgcacaaacaggcccaatgaatcttgcaactaattttacatttactcaactccctcatttatgctctgaagaaatgataagatcagagttcaaccaaccttttattctgttgtgggaatattccaaatgtgtcacattataattggattacatactcttttttattcatctaacggcaatttttttaacttgcataaaatacttctagcagagtccataaacatatacctcaatttatattggttataaaatagaaagcatatacctcgatttccaccaatctgtgcaagcttgttaattagtgctgtttttccagcaccaacaggaccatagagaagtatgggccacttctggttaactgccattaaagctacctcgtaactctttctcaaagtagcagtgagcacaaatggactaacagagggaacaattgaaaattagtgtaagcaagatgagtgcagcgagaaaaacagaaaaatagggaaataaaggaatttgttcacaccatatattacttccactgccatgctgccgtcccacagaaaactcatgccaatctggcaaagaatcagccaaacaagtgagtccatctgcatcagttttacaatcaacttcttcggcttgaagatacaaagaggctttctccaaggaagtatctgtgcaaaactccttccatctaaaagcataaccagctattataaacttatgttgatcaacatccaggggaaacaatacaagaaaagaagcattagaaggaacctcaagaaacatgtaaatgcttcgtctgctcctagaccaaaactttcaacagcctcatcacttgctttcagaaccaccatgagtatttgtatagcgcaccatcttaaatccaacacaacactataaagtgaatcgtcaactaaactgtagtcagcagtactatatacaaggtctaaaaagcaagaccagtcccattgttcacaaaatactcttggctccaattctagaaaccgatatgatacttgggtggcatcaagcaacaaatgaagtccctgaaaacaaatgaaattaactgtcaacagtcaaattattaagatcaactgatgacccagtaaaagttggaaagttggaaattatgggatcctatgaaaaacagcagatcaacacataagcaagaggatatgtgtcaatggaaagtttacacaaaataaaaccgtagacaatccagaagccccatcgacataaaactcccaaaccaatgaagaatatgcagatatatgtactttatcatgtcgcaaatactcttcctaagaaaaatagcatgtaccaataataatttctaagttttaagtacttcaccaacgccaagtgcaagattagcaggagtgcttgccagtattaaggtgagcaagttgcgatagtggaatgaattatgatgtgcaagcattggtcagataaacaggataaaaaaaacaaggtttcaagaaaagaaaagaaaagtaaccgttgaagatgccgcgggggtgtgaagagaaagaactctcataacattgtgccaatgaattttctcaaaaagaaaagatttgaaacgtatgggtatatcagcaatgattaacctatttgtaaagatcaagaacatactaagttatggtatcaaggggaaaaagttcaataggtggattacactatttaaagaaaaataatacgcctcatcttttttgtgtgtacatcagtgagtgggttggaatacaccccagggactattgcatttcaaacaagctgtagactagacataagttttgcaacaacttaggggataaggcaaagacatttgcttaacacatgaaaacgtacaaccttgattgggatttgtgacggaacacctccagaaagaaacctttggaatggtggtggagcaaacttaaagtagtttagtaaatgcctgccacaaataacaacagacagttgttagatcactgttatatatatggcatatttccacttgcatgctgtagttgcatagagaatcgtaagtgaaatggtcaagagatgaaagaaatagtaataattaggtacagtttgatatagaatttatctaaactccaaaccaaatgtgcactctaattcattatttgtgagcacgtgtaaaaaaaatgctactcgacaaaacagacaaaccagtacgtacaggtttttgtttcaattctttgtcactgatcctggtagtggctttttaaattactctttcagtacatgacatactgaagcataaaatgagtaagctctaaacatagatcagctgctagcttaagatactgagggattttttaagtccaaacacatgttagcttcttactgatccataaaaattgcctgttgcctgtttgaggattccagctcaccagaattgcgaacacaggagagcaaacttaaccctccacaggaggcaaggctttccttcagtgcagtcacttgacaaattagacttttaacacaaacagacctgttgttcattatgtccccagtatgcatcgtctttatactatagattgagtacattagctttaccttttgacaaatgggctttcgagtggttatacatcaccttagaaaatggaataggcacatagctctccactcagctcgttatttacaagtgcacaacttttagtggttcgtgatgcctgtttgttatgggaacatatcctatgcattcaagcttcccgtgcacaccaactagccaatgtcacaaaaaattctacaaaaaattggacatttactcctaatagtattacacatatctgcaaagctcatattcaaattcattatgttttagccgtaacaaaaaagtgaaaaaaactgacagttttaagggtccatgtaggtgtaatactactggaagtatgtgtacaattttttctataattttctgtgacatttgctagttggtgtccacggagtgtgcacgggaagcttgtgtgcataggatatattcccatttgttacacgtgaaattgtgatcgggggaaatatggtgtttgactgtgttgaaccagaccatacatcccatacgtggcagtgttcatcaaagataacaaagagaaagagacgtgcaatgctgccccaacaatcaaacaagcttaatcgacatagccccaaacttagatgaactcaaattcaactggattttgtcagttgtcacaaatattggaactacataaaatccatttaaattgactacagagcatgaaggctcatcgatcatcatagcctatcaaggcttggtgcctagaagaaggggcatttgttccgcaccagattgatgaatgacgagtccaattctgtactaaatgcagctgcaaacactgcccggaacttaaattccacctaaccatggcacgaacagcatacagtagggggggaagcggccgtcatttttaccggagcaggtagggggcgaggtcgagggcccgggcgagcgcgaggcacgcgatctcgtgcagccgcaggcccctgcccctggacaggtagaactccacgacccggaggtccccttcccccgcctcctccccctcgcgggccgcggggtcgtccgagcgcagggcggctgcccccgcggcgcggagcagcccgacggcgcggtcgaggagggccggggcgagcgggaggaagcagccgacgacggggacggtgtaccgcgggtggagcagcggctcggcgagcgccgcggcgacgtcatcgcgggagggccctccaccgccggcggtggaggcgagcgcgaggacgcgggggtccgcgcgaagggccgggcaccgcgcgaggaggcgcgcggcggccgcggcggcggagaagctgccgtcgagcgacatggatggcggagccgcggggagaggggaacggttgggttttgttgatgggagtgtatatatggtgggaaggcggcgggtttagggttttagggggcggcggcgcggccggtcggggtgttgggtcgggctcactgcgtgggttcgtcgtttcatcagcaaccgacatggttgatcaaaatcaatccgtgcatttctaagattggacggttttagatcgtgtcgtgaaggaaaaagttctagtatattgcttttggaaattagatggacgatgtagattttataatttgaattgtccttgataaaatagttaacagataatcgtaattgaaatttacaaatccaatctaaatcggcaatacaaaatagaaagttttaagtatatctgaacttattatcatgctagttgttagaacatcagtaaggggacagagataggaatagggcaactagggcggtagccctactcctggtcctaaatattcattgaaatttttttttagaacttcaaaaactagaagataaaggcaaaattatataaattcaactgattgagctttaggtttggaaaattttggctccaccactggataagatgtatcgagtaaaatataccgttcgctttaagggcatagtgtagagaaaaatgagacttaaagacaacgacaactacatcattttcctattcttttgctcatatcatcccatgttattccccgttagctcttagcccctactctcttctctcccatgcgtcagatccatcgtgagtcggtgaaccaatatcgatacattgagtcattgaaggagtgctgacacggtgacacagaatccatccaagttagaacaatgggagaaaataacataaaacactgaagtgaggtaagacgcggtctacaaggagaagcagcaatgtgaaggtattttttgagaggagagactcttaatatttgtgttaggttatctatttgaatttttggattggtgtgaatggaatttgagctttttatgagtcatattaggctacctttcctccttctcctatccatatcctaatcactattagtcacataaattaaggcgttacctcgcttattgtttaattacccctataaggcaacaaagggggtgtttttaatcatgttactttgccatcaatagtgagcgtcctcatgccaccttaatataacttgtgtagcttcatctacatctcaccgccctttcaataaagataatctagtcactcgatgaaagcacgagaggaacatattaatatgcaaaagatgatacatacctcgtcaatcttgagcttactatagcctaaaaaaacccttatggtacttttctatatctatgggtcatgtgtgtcttcaccacgttaaacaagaagccaagaaagcttattcataacatatagcgaccaaattccaaggccaataaattctctataatcctttcctcccaaacaatttacacaaatccacatccctcatgtaattcggggtactctcgtcgacaattacaaatcagtacattttctcaccgatccactaaggacaaacctctatgataagtttcaaactaaagtaattccttcctaatgtacctgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccccttgtgggttttgcgccgcgtgtatgggttaggtgagcgcagcggggctcacctaaccgcatttattgcggtttgggtgagcacgtcacgccacacgtaatgcagtacagcgcgctcgtttatccggtctgtgactggtcacagaccggtcagattgcgggttaggtggcgacgggcggtctgacgcacgcctcgccccatcccgtcaggatgagagcctccaagcactcgtccctagccggagccggcgtgttagctcctgggggtggcacgttggtcctggtcagatatatgccaggctttatcccaacctttataagcaagacgtttaatgaagaagggcgaacatgcagattgctaaactgacacgtggtggacaaaggtgaccggtctgtgactggtctgacactggttatgtcgccagaagacaaccgtgttcccacgttgcacctgcttccggcggagtggaggtaggtatgggccgtcccatcagaagggtcactcgggcagcagccgttgcaaatctccgcccatttatgaagagatgacagggtgatccccgaggtcagacgaacgaggacgcgtggccacactcaaaaacaggcagtgtttcagcttccaagagaaggcaagccaagttttactatagataggatgggctcccacccaaaaagagagagagggagaagtggtgcatgtggtatccccttgagatataaaaggaggaccttgcccacttaagagagggggctgaaaggggggatgatctggagagggtttttagaataagagctatctggctctccagctctttgtagcttcttcatacacagatccaccagaacacaggagtagggtattacgcttctcagcggcccgaacctgtatacatcgcccgtgtcttgtgctttttccattctcgcgaaccttccacacacagactaggagcttagaatctcacccagggcccccggccgaaccggcaaaggggggcctgcgcggtctcccggtgaggagccccacgctccgtcatctggtgcaccaggtagggggttctgcgtgtgttcttctaagctctcgcactctttcgtgtgcgccaagcttttcctgttcagcccaatggctgaacaagcaaaggcgcacaacctctctccgagtgttagcggtgacgacggggagccaaacccacgccgtcgagctcgtactccaccgccccctccacgccaaagtcctaggcgggaggaggcgctcgagagggtagaaggatctgcgacttcgacatccacgggtgatggagaaggacggcgagacggggagcgtcgcctcctcgtctacggcgatggcagcacgccccagggcgcactccaggctgcgggcgcgctcctgcgtcatccgcccgtcgtccccgatccagagtctccagctcagcgttggctggacgacgtggccaacttggtcatgacggcgcagcagcgcctaggtgccggtgggcggtcctccgccaccaaggcctctggcgctgctaccaccggctccgtgtcgtcaagacggagggcgcggcgagcggcggccgctgttcgctattcggccgccactccttcgtcagcgacaccgacccgggaagatttgcgcggggggccggatgctcgtattagtatcgagcgccggcgtaaccgccgacgtgctgcccacgcaacggagggcgcctcctcgtccggagtgtcacctcaacacggacgcggggatcagccctccgtgcccctggttggtggtgtcggctgtaaagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggtgaatttctttcccatggccctgaagggacaggcacggggttggctaatgaacttgccacccgcgtccgttcactcttggaaggatctgtgccaacagttcaccatgaactttcaagtcacatatccgcgccctggtgaagaagcggacttacatgcagtccagcgaagggatgatgagtcacttcgctcatacattcagcggttctgtcaagtccgcaacaccataccatgcatccctgcacacgcggtgatctacgcgttcagggggggtgtgcggcacaaccgcatgctcgaaaagatcgcctccaaagagccccagactaccgtggagctttttcagctcgcggaccgagtggctcgcaaggaggaggcctggacttggaacccctccggttccggtgtggcagcttcggccgcccccgggtccgccgctcggtcagggcggcgggacaggaggaggaagaagaggtcggcccattccgacgacgagggtcatgtcctcgccgtcgaaggcgtttcgctggccacccgaaaggggaggcctgcgagcgacaaaaagaaggaagccgacgctccttgacctcggctacttggaagagcgaaggtggcgcgcggcccttcgagccgcgcgctaccagcagagcctgcggcgctaccatcagcgccacgtccgggcccgatcactctgcgtcgacgacctcgtcctacgccgtgtccaaacgcgtgctggactgagcaaactctcaccaatgtgggagggtccgtatcgagtgatcggcgtcccccggccgggctccgttcggctggccacgggtgacggcacagagctgcctaacccatggaacatcgaacaccttcgtcgcttctacccctagtgggggtcgggtgtcaggtcttgggctcgggccaaccccgcacccccccgggggtgcagggttggccgggggcttatcttttttctcttccgtatttcaataaaagcattttcgatttcctaaaggctgtgtctgtgcttttgtttccttttgaagaatcttgacttgaaataggtcactcgtgctcaatcctaccctcgggggctcgggtcggctaaaatcgccaaaaggggcccagaaccgagccgtgccccgggacgtggtgaactccgggggggaatcggcaaaaacccacaatcgggtcacccataaccctcggtcaccacgctcccggcctgaccagtctcgacatgtggatctccccaggcactagcctttacccgcgccgtttgaggctgggacctgggcacgagcccttgttcaagccaagacacagaaggaccgtggcacagaccatcctcgtctcatacacagaacaaatgaagttgacacaaaaatttcctctttatttgattgcagattaaatcagcctataacaagaagggggcccgaaggcctcgaaagaagaaggaaaagctattaagattggcggaggcctgggggctcactccgacgcgcctgggtagccggcctcgccgtcgctgttgtccgcaacgtcgtcaccgcactcctcgtcggagttgaaggcaaacgcgagccgagggaccgctcattattgtcggtcggttttcccttgctgatgcgcgcgatttgcgaccgccgggattctgcccgaagagagagagagcagggaggagaggcccccgagccgaacggcggcccaaggcccccgacggccggagctggccctccgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctctcggatggagagcgccctggagatgtggcccctgacgaagaagatcggccccgccgaaaggtgcagcggcccgtctacttcgttagcgaggccctccgggacgctgagacccgataccttcaggcccagaagatgctttacgctatcctgataacttcgaggaagttgcgccattatttccaggcgcatcgggtcacggtggttacgtcttatcctctcggccaaatcttgtataaccgagagggtactggacgggtggtgaaatgggcaatcgaactctctgaattcgatttgcgctttgaaccaagccacgcgatcaagagccaggccctcgccgactttgtggtggagtggaccccagctcccgagctcgtctccgcccccgaggccagctcgagcccatcgcagctgcctcacaccgccctctgggtgatgtagttcgacggcacctgtaggaaccggccccacctgtcaccaggccttagaagtggcgttacgcccgaccgcttccctcggggagggcgatcgccctggcataacgccgggggctactgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccccttgtgggttttgcgccgcgtgtatgggttaggtgagcgcagcggggctcacctaaccgcatttattgcggtttgggtgagcacgtcacgccacacgtaatgcagtacagcgcgctcgtttatccggtctgtgactggtcacagaccggtcagattgcgggttaggtggcgacgggcggtctgacgcacgcctcgccccatcccgtcaggatgagagcctccaagcactcgtccctagccggagccggcgtgttagctcctgggggtggcacgttggtcctggtcagatatatgccaggctttatcccaacctttataagcaagacgtttaatgaagaagggcgaacatgcagattgctaaactgacacgtggtggacaaagtgaccggtctgtgactggtctgacactggttatgtcgccagaagacaaccgtgttcccacgttgcacctgcttccggcggagtggaggtaggtatgggccgtcccatcagaagggtcactcgggcagcagccgttgcaaatctccgcccatttatgaagagatgacagggtgatccccgaggtcagacgaacgaggacgcgtggccacactcaaaaacaggcagtgtttcagcttccaagagaaggcaagccaagttttactatagataggatgggctcccacccaaaaagagagagagggagaagtggtgcatgtggtatccccttgagatataaaaggaggaccttgcccacttaagagagggggctgaaaggggggatgatctggagagggtttttagaataagagctatctggctctccagctctttgtagcttcttcatacacagatccaccagaacacaggagtagggtattacgcttctcagcggcccgaacctgtatacatcgcccgtgtcttgtgctttttccattctcgcgaaccttccacacacagactaggagcttagaatctcacccagggcccccggccgaaccggcaaaggggggcctgcgcggtctcccggtgaggagccccacgctccgtcagtacccaatgtctctcaatacatacgcacatcttatttccaccccacgcatcaaccgctagctcgtgctaatccttaatgttagggaggtcttattctaaaagggataattcgtgaatatctgcacaccatgagcacgcgcaaaacacccgtacttacatctagtaccggacgatttttatttatgggcaattttgtacatcaaatgaaagtttatatactaccaaatttcgatttggatctgaatgtttttttaaaatgtttccatatcaaaagtttctatatacaaatttatatgcctgcgatagcacctcatgggggctaggcgcacctaggggttgtttggttcactcccaaacattgccaaacctccatgctaaacatagccaaatttgtggcttataaattgatggccacaccttaggcaacttttggctaaaagatgagtgtatgacatgtgggcctttgaattgaaaaactttggcatgccacaactttggaagtgaaacaaacaagtatcctagaaaatgtggcaaagtttggcaaagtgagggagtgaaccaaacagccccctagaccagacttaacatatttgagcgccttgacacgtgaacattcgcacatttgaccttcccaatctcgatctgtatacccatggctcagtatgaggtagaacaatgcaacttagtagcatttaattaacccaaggtctgaaatagaccagctaaaattttttcttccttccgtgggggatccaaattagaccttatgtaagcttttgttagcaactgcaattaggcccatgggctgtacccatcctcttacccggataagtaaaacagtgaggggctctctcacccggagaaattctcgaataaacccctcaccacggcggcgccgcttccgcaactctcctcctctcgccgccgccgccgccgccgcccgccgcccgccggagcccgaagccgggcatgacgacgcgcatcgcgcccggcgtgggcgccaacctgctcgggcagcactcggcggagcggaaccaggacgccaccacctacgtcggcaacctcgacccccaggttagggttcctcccccttcttgctcctcccatctgtcgccgtagctgtagatgtgttcctgaagcctccacagggaggggcttgtagcgcccatggctctgtgggcgttcggttggtgggggtttgtgtcgtcctgtcgccacgagcaaagcctgaagtggaaattgtgccgatgttgttgtgagttccgttggtacttgatggattaacgatttgttgagcccgttgagttaattggtcgttgttccgtggcgaaggtgcgtgtccatcgttgatttgttcagctcattgagttaatttgtcacttttcgacgacgaaggtgtgtgcccatgtagctagatttgcgttcgaataagcttaaatgaagtgttggcagttaatttccatgtcggctgtgagtttggaaagcattgtacatgaaagaatcgtggttggatgaactgtgcagattctcctaggtggtctgtttataaactatcgtgcatgatatagcagcatagttggtggaactgttcggaatctcctagttggtctgcttatatgtcctaaaatctgaaagaaatacttgtagtcctagttggtctgcttatatgtcctagaatctgacagaaatacttgtaaattgcttgccaagttagtgtatgatatttaaggagacggcatgtttccatgttgaattatgttagttttggactttattattgtaggaaacatctgatagctaccattctttgccctccctgcaggaaattatgaacactttatctatgtgattatagattaacgcaaccactaaatcaattgtcttctatcaattaacaaagtattatacttgctaaatgattttatcttttgtgtacaaaaaacatattggtcttacctttcgtgtgtaagataatatatgatccctttggaaatcttatttccatgcgctcacgctgataattctaccggtattttacaggtttcggaggagttactatgggaattatttgtgcaagcaggccctgttggtaagtatcagtttgttccttgatagtttgactgattttgctcggaagtatctttcagcattatgtttctgttttatgtgctgtttgtgacttatcgcctccctgtgccagtgtgccacacatcatggatttactattatggagactgattaatggagttcctttttgtcaatttgtagttaatgtctatgtccccaaagacagagtaacaaatctacaccagggctatggatttgtagaattcagaagtgaagaagatgcagattatgtaagtctatcttgggtgaaggcaaatagtacttttctactgtacactttcaatatccattcaatatagcttttctgtttcttatctatttatttttttaggctattaagattttgaatatgatcaagctatatggaaaaccaataagagtaaacaaggtaagtacctcttttataatctcctctgcctcttttcagtacttctctcttgtatttctagccaagggtgctcgtgggtcccttgaactgctgaatttgctgaattttatgacagatggttgatagtttaatattactatattagtgtatgagtttagatgattcttcctcaaaacatcaactgaacagatactctgatttgttagtgcgtgcgatgattttttcagaaactaatattattctgaaatgaacatctgggttcattcaacttaatactgtcacattgtggtttagtagactttatttgcagggatctgtagtttacgttcaattctattgatttttttttcagtatactgcttctaaaactttctttattatatctaaacattttcgaaatataggatttaaatatcacatggtaacatgattatcttttcttattccaggcttcacaagacaagaagagccttgatgtaggggcaaatctttttattggcaatctcgatccggtaaaaacttgtggtctagcttttctttatcagctcgtttgcatgcgaagagtggctaatggctttgtgttctgtgttcaggatgttgacgaaaagctcctgtacgataccttcagtgcgtttggagtgattgtgactaatcccaaggtatcattcaagaaaaccttttactgcatttgtccgcttatgtaatctgttctgtgcacactaggctttagacacttgcatcaagattacttctcttatgatctatagctatgcagtaatctgacttgtgagcattcctccattgagaagtcaagaagcaagcttgaacaacctcttgagtggtgcttaagataacctgatattcctaatgtgttcatcatagttcacctgatattcctaatgtgttcatcatagttcagctaaattctaatggaccttgcttcagcagagtttttgcataacagtatttagttccaaattggcaaattgctaggagcttatcagctcagggcattattcatattaattcttatcatgataatattacagatatttgatatgttagaatcttctgttctcttttcaattgccatgctgcacaggatgtgttcttagtcccatagcatcaatctatcttgccaagtaccacgtctgcttcaatcagataaattaattatctgattttaacatgtactacttcaatcgtttaccatgcagtgttaatagtgtatttccagtgttggcatacagtaatttgctttgattttttttatttatctttatagataatgcgagatcctgaaactggaaattcacgaggctttggctttgtgagctatgactcctttgaatcatctgatcaagctatagaggtaacacaattgccacaataagttctatattttgtttcttccatttattgaatgtgtttcaccttatgtgccacaattttccaggcaatgaacaaccaacatctatgtaaccggccaattactgtctcttatgcctacaagaaagacacaaaaggagaacgccatggcacacctgcaggtattgtgttttcttttttctttttcccatctatttgtgttccttgccctctcagacacaccgatgtgaatattcacttgaatatcttgaattgactctctgttgcctacttggttgttccatatatccatgccaactttctgttcttgattctgaaatgataaatttcccgacattttccatctttgtgccttggaaatgctagggttgagtttgatgaggagttcttttgtggagttgaatcttttgtgctggcatatttaaccctgtttagtgttcaattattagacgttgaaggttcacaaagatgttatataatttcttggattatcttattttattttgagtatccatagattggatcttgatataacatgttacagctattactagacccatctaatttgtcatatggaaaacgattttcattcttttcacttattcaccattgccgttcattcaattgtccattgaaattctgaattctgactacattgcggtttactaaagttttgttccaacatattgttacaatcataatgattgatatattcttgtgttgacagagaggttgctagcagcaaataaccctggttctcagaagaataggccacacactatgtttgcaagtggcccgcctacgcaagggcttgcaaatggtgcacctgtgcctcgacctttttccaatggggcagtgccacctcagattcaacatgttcgaccgccgccacctcctatgcaacaattccctccaatgcagatgaatggtcagcctgtttggcctccgcagaatacacagctaccaccccacatgccacctcaaatgcattacaggcctgcagtgagaccacctccaccaaacatgatgccaccccctcctcttggcatggtaaggcctccgccgcctccttccagtatgccagctccacctatgtggaggccacccccacccccacaacaagctggtggtatgccaccacctcctatgtccatgccaccgccgccaccaccaccttctggttaaacatatgctggtgaaggttccataccatatggcacattgtagctgtagactgagaatgttggtacctttcttatatttccatgtaacttgcaaacactaggagaggatcagaattcagtgagtttagctgacactgatacaaattctcgaggttaactgtattttgttggaaatacatgaattttgtggttaactgtatttttgtgatttcagctgctgtttattaagcttagtgatatggtagttttgtttgcagttctactacctgcggctcttcaatcatcgccattctcgaaagctggagcagtttgctagagcccaagtcggctctgtctgggttggtttaggctcaatactcaagcccagcagcggaccacattcccagatctaaatcagtgcatataaaagcccatacaaaaaattggccaaccgatgaccatgaaaattaggcgtcccaaattatgcccataatcgaaattggtatacacctctgaacaggagcaaatttgcccacccttagaatttaaacgattttgggccacctctcaaccggatcaaattttcttgtcacaagcacggccaaattacggtttctttctagcatttgctcaactttgtttatccattaaaccatagattcgttacccttcgacagagattacagagaggttagagttaatagcttaagttagtctgaataatcccattcccctttgcaacaactacattggctaaacctgcaatattcccatccatgtgctcattacatggtggatatcatctcactgtaacactgttgcctactactccctaagtgtcaactgtcaacaccttttgcttcctttttcttctcccctttttcctaacctttccaattgaatcataatgaagcatcttacaatcacaatgggtgcaagcatatgagagcaaagagtgcaagaaacaatgaagtcaattgcagtgtcaggtcagctcggcagctccaattgccgccgctgccatagaccatcccgagataaccataccccatcccgccggcaccggcgccgccaccgcctccgccgccggttccaactccggcgtagttgacgccggcgtacgccgccgcctcgccgttgtccctgccagatcaaatctccaaaaacattagcaaactatcttatattctcttctcatgtactaccatgagagagctagtagctgccagtatgtcattagcaaaactggcacaagttgtagcaaaaactttcaagtgaaactgtacttaaggtgagatctactactgctgtctgtcacaagtgcatatgcacgctgcagaataaggaattggatgccgaggaacatgggtcttctcctgcagagtgatggacagaacgacaaaaagtgcacgccattttctaatggatcgttgcaaatggaccctcaacgttctcttcttgcttggctccatccgaaaaggtcatcgcattgcaatatggtagggtctccagtacaggacactgtttgagatccaaaacgcccaaagaacacagcttctcgcagtactagaataattcagcaacaactataatgcattgggccagtttgtgtttgtgtgtactagcttcttttgagccttttttttcttttctggctatcttttgcaggattcggcgacaaaacgaaggggtcagtggcgagcaagtggagaagaagaaggcaatgcatggtgagtgattgccggcctaccgtgatccctgggttatgcaatcgatggatatagcacgcatgttgctgagcatgcgacgatcttttcgatcccggctacttttggcatcgagcgaagaggaaaaaagaccggccaccatctgtggattcagttgatggctcatcgacatgaccggctaccaaaagataacactggtccattattttttattcataatccggacatccggaggcagattgactgaagagagtttatgtgccaacgtactagcattgcaatgtattccctcctcgtcgtataaaaaacaaccctaatttccgtattagtttattttttagaaacgaatggagtattaaagtctaacgcaatgatgtacactcttcgttctttaaaaaaaaaaatcaaattctaaagataaatccggtcatgcatttgtctagatttttctttaaaagttgattttttttaggacgaagggagtaagtcattcatgtaaaaatgtactccatccgtcaaaaataaacatatacttattacgaatacgatctatccagattcatactaggtcacatcgttttgtttattttatgatagttggaaggtttttgtaagcttgacatgagtagtctgctcttgtcttgccatggtttcagaggaaagaacgggagaacgaaaatgcaacggcggcagtgcatttgcctgcccgtgctgcccactccccaagtctcgcgtttcgcccatcccacacgagcagagtctagttcgctgtctaaaaagaatactagcactagcagtgtaccagaatacaagtactgggcctactggtagtacaagacaaagttgctttataaacttttatcccggtgtttaatcaacccgactttgtcagtcagccgctagtgttagtggtacggctctctattgagtgctcagccttgtaatagtaatcatctgttaagaatactttactttggccctcctaacctgtcctgccttttaccagctaagggtctataaattgaggatttggccaggaaaataattgtaggattatcgcggtaggacgccgacatggttagctcagttccagtcagagtgcttgtacaagtccacctgcatcgccggcctgcatttcttactgtactgccacgcttgttgctagctagccaaactgctctgctctcatgctctcaggcccgtttgtttctgactaagatcatactactagattctatcctaattttcattagcactttttttaaactgttaaataatatattacgtgcgaaaaatttttatatagaagttgatctaaactagtatcaaataaagtttatttttaagtttataatatctactccatctgtcctaaaatataagggattttggatggatgcgatatattctagtaccatgttgtcaagattcatagtactatagtacgggcctgtttggcacagctccagctccaccccttctagagctggagcttggccaaacagtttcagctccactagaactgggagtggagttggatggagctctcacaaaatgaattagatccactccagacccaactcctctaaatttaggagttggagctgtaccaaacagaccctacgactcatccacccaaaatccattatatttttggatggagggattaaaaatcaattaatgtgtgctaataactctcgtcttacgtgccctttcctaatcttcatgcttccaacgggacctcaatgttaccaaatcgacgagctgttctaccgcaaatccctctctacccatccaggtcgcggcaatggcgccgacaacaactcgacaagcggcgcccctccggcgaccggaggtggcagtttaaaggcgccgctgccgcattaaaaaaaagacggcccaacccaaaagaaaaaaaaatgcccacgtgggccccaccagtcagcgagagggatccggcggatatttcacgcagtggggcccacacacccacgctgctgctacatgtcggattcattcgaccgtgcaaaaggagagcggcgagccggcgaggcgatgacgatgcaatgtaggagggatgggtgggtgccgtacgtacctggggccgccgaggacgccggcgccggcggtgagctggtcgacgagcgccgacgacttggggtcggtgctggaggccttgtcgtagatggcctcgaggccctcgccggaggggacgaagaaggcgccgttgaccatcatgtccccctccgtcctccagttccaccccgcccactgcccctcctccgtgtccacccgcttcgtcacctgcacgttttttgtcccagtgtggggcccacatgtcagcctcaccgaatcttgggggagggtgcatctcatctcatcgcatcgcatcgtgcggtgcacgcgcctgcctcggatgctgctatcacgagggcaagggggaaaaacattcacccaaatttttgctctttaaagaagaggcgctattatgatgatgctccaaacattcgccctaaaagcgtggcaattcacatgaccatagagcgctactcacaccttaaaaacaggtcaaacgacttgagaaatttttctaaatatggtcagattgctctaaatttcacaccccacttaaaccaggaattcatcccaaattggggcatcaaacagctgacaagtgacaacctcagcaatttgagccaaaatgagaagcaaacggaggaaaaccaactaaataaaagacattttttttcctttcataagcaaaccaatgaacagaacaagaaataaccacccaataaaataaaatcatccaaaaatgggcatcaaacatccgacagcatcagcaattcgagccgaaatgagaaacaaacagaccaaaaccaatccaacacacacacacacacaaaaagatttttcttttttccttctgctatcacatctcacgactcacaagcaaagcaacaacgaagagagcaagaagccaagaacacggcaaacaacaatggcgtcgcttgcttacctccttggcgttgggatcggcgggggcgatgtagcggttgccctggctgttgatggtggggctcgcgctccctccaatggcgtacatctcccacgccgtgtagtcgttgttgacgatgtggaagtaccccctcctgcaccgaggcatccgctgcacgagctggatcccgaagtggttgaacgcgatggtcacctgcatcgccgagtccggcaggtacccgtcgctgtgccccagcagcatcacctcgttgtggtgcgagaagtagctgttcgacacggtgatcgccgtggaccccatgatggcgtcgatgaggccgtcggcgcagcgcgacagcgcgcagtggtccacccacacgtcgcgcgccgagtagagcgagatgccgtcgccgtcggagcgggtgcgccacccgtagtgcgtcggcgaggcgcgcacgttggcgttgccggcggggacgcagtcgtggacgtggatgttgtggatgatgacgttggagacgtactggagcgtgatgcacgcgccgccggcgccgacgtggacgttggcgccgcggccgtcgatggtcttgtagctgttcacgaggagctcctcgttgaggcggatggtcatgtcgccggcgaacacgatccagagggggccctcctggatggcgccgtaccggagcgtccccggcgcggggttcaccgggtcgccgtcggaggggtcggtgacgacgtacaccggcccgcccttgccgcccatggcgttgcgcccgaacccgatgccgcagtccgccagccgctgccggtcctgcctccagtccgtcccggcgcaccgccagcagtcgtcgatggggttccccgtcaaacacccccc

SEQ ID NO: 77014 - DNA, 20173 bp, Oryza sativa
ttgggtggatttgggagtggagaactggagatgcagtggatttttatagcaatgcaggagagtgtggagcacagtgagggagtggaaaatggtggatttggagagagaatcagcagctgggtggtgaagttcttgagatttaatttggagcttgggattggacagcaatggtggggaggaaggggagaactcgctgggggaggagagagagagagagaggaggtgaaatggaatcacctgggggagatggcttccttgcttgttaaaagagggggtttgtttgagcctttggaggagggagaatggagaatgtttcatggaggggaagattggcatcaatggagtttgtcaaattgagcacatgatgatgatttgttgtgttcgtgtgttaatgctgatctcaagtcggcatagaagcgctcgcaaatcttctcttattggtgcctggaaggtgaattgagatggcgaatatcagggaaggacataatatcaaataattagaatgagtgaggcttcgaatccaaatcatctagtccatcaccttgtgaagccagccggaagacctctaacacatgattctgacaggaattgaagtgtaaaacagaggattgtaaaacacaagaaaaacataggaatggtcgtttgattggagcgcaggaaaagcgcaggaatcggatgagagaggtggactccaaggaaattttcctagaggtttgagctcttgctaaatttcttctaaaatccacatacaatgtgtcattccatagaaatttcataggatttgtaaagctttaatcctttgaatcaaagagcctttaagggagaatttagcctattgtatggaagtgcttaaaataccggtagatccacgactcaatttacataaaaagtaatgttgacttttcttccttgtttttccaagtaataaacgcaaaacaacatcttcttccctctgtatttccaaaggtgcaccgcaagtccatttcttgcgtggttgaatttccgaccgtccccgtttcagatatctagcgcgaagaaaagcatacgtagcatttggcaccaccgggaaacagaagaaaaagaaattcccccattactaaactataaaacttttcttgtcccaaactaaaaaacgaattccatcgcgaaccgcgaagacaggcgcgcacgaccaggaacccttttcccacccttcccttctaggcaaccgtgcgaagtggagtacaggagtgtttgttttttcagttaccacgaaccccgaagacgacttctgctgctagcctgctactgccggtgttgctttgttcagagttcagacatgcattgctttggttggtccttgttgtgtggtcgactgctcgtgtgcatgcaatatgcaagggtgtaaaattgaaaatttgattgaaattggaatgacgtgatggaaaagttagaagtttgtgtgtgggtgtgtttagtttacgctaaaattggaagtttggttaaaattggaacgatgtgatggaaaagttgaaagtttacgtgtgtagaaaagtttttatgcgatggaaaagttgaaagtttgtagataaaattggaaacttacctaattaagcctaattaattgggaaatgcgagacgaactttttaagcctaattaatccatcattagcagatgtttattttagcaccacattgtcaaatcatggagaaattaggcttaaaagattcgtctcataaattaatcgtaatctgtgtaattagttattttttagcctatatttaatactctatgctagtgttcaaacgttcgatatgatatagtataaaattttagagtgggatttaaacagggccatagtttcatctgacacgatatggattactaaggccgagtttacttccaaactttttcttcaaactttcaacttttccatcacatcaaaactttcttacacacacaaacttctaactttttcatcacatcgttccaattttaacgtgaactaaatacaccttaggcattagggagcatgaacacaggcaaccattgttgctagagcatgtttgctgctgtaatcatcccacggcgaggattactgcagccgcaagaaacccccttctccgttgttgcaacttgcaacttgcaacgtccgattcttcagaaacacacacacgcactctctctctctctctctctctcttatccactcttggcctcttgctatgcccacacattcccctcatccaccgccaccaccaacatcatcttttgccttccgaaaagaggtctccggtattcgttacatccggaccaggaatcggcggcgcgtaagccacaagtcgctttaatttgttgcccatatctcaaaattccaaaaccaaaaactgggagagaagtttccctctgcgaggccgaagaatggcaacgtaatctatcaacgtcgtctgaactttttgggttgtatcttcatctggtgttaaagttggtaactaatatggcttttataaatttccgtgcaaagggagcttgatctttgagttggagccgtgtcagatggaatgctggacaagtcacgcttgtagaacttgacggtggcggcgatggcgaccgttgggtaagtgtgctagcagaatgaaccagtttttcagtttcagtttcagtttcggtgtgtgctagctaaaaaaaaatcaaacgacttaggccatgtttagttatcaaaaacttttcacaaaaacatcacatcgaatctttatatacatgtatatagcattaaatatagataaaaagaaaaactaattggcacagttagggggaaatcgcgagacgaatcttttgagcctaatttagtccatgattagccataagtgttacagtaacccaaatgtgctaatgacggattaattaggctcaaaagattcgtctcgcggtttgcaagtgagttatgaaattagctttttcattcgtgtccgaaaacctcttccgacattcggtcaaacatccgatgtgacactcaaaaatttttatttcaccaactaaacatgctcttataatatgaaatagatgtagtacttgttttgtctgttgagtttaaatcaagtattaaggctaatgaagtccatttcaaaacttcatagcaagttttattagctttcgcgcattaacagacgaggccatgagagtgatatgtagtatactttaatccaacaacattcaatcaaaaaattaaaaagaatatatggacttaaagtaagaaatgccaaaaaaaataaaaaaggactcaaacaacgcccaccgtggggctcgaacccacgaccacaaggttaagagccttgcgctctaccgactgagctagacgggctttgctggtgccctgaaattcacactatatagatttcaaactgaatgaaaatgatcaagcttaacgcaaatccacgtatttggagcagtgattgtttagccttttcgtgcttgctttgaccgctggaacatgctccaattctggcaccaaccgaagtgtcaaatggtgaccgcgaggtttgcattggtctatggcagagcttgagcagaacctacaatctacagaatatatccacttctccagcatgaaaacattatagcatctccaacagatttgctaaaaaaatactcttttggccagtcatctaaaaaattagagagccaaatttgtcttttactccaacagtttctccattatctccaattaaacaccgggtcccacgcatcagtctatcagtcctcttccttcctctccttctcccaacgcgacctcaacacgaagaaatcggcaacgcaacctcaacgcggcggcggaggacggcggcgggcgcgtcggacgacgccgcggaggtcggcggcggcctcggcagcggtcgacggcggaggagccgtcagcgcggcgacggcgcggagatcggcggcgggcgcgtcgggcgacggcacggagttcggcgaagagcgcgtccggcgacgccgcggaggtcggcagcgggacggcggtggtctcggcaggtgcggcggcggcctcggcaggttgtctcggcggaggggcggaggtcggcggcggcctcagcaggttgtctcggcggaggggcaaggacggcggcggcctcggccggctgtctcggcgacgccgggaaggtcggcggcaggagacggcggtggtcggcaccggcgctggatctgggagcgctgagaaaaagcgatgcgggaggagaggaaaaatcgcggatcggacgggagggagagagaatagaggggaaagcggtggggcccacgattggccaggcctttttggctggctatatttggccagtgcaaggggaactttggccagtaggatggcttggccagccggttagccagtctattgaagcacgaatttgagccaaaattgctacaatttaacttagagaatggaataagaaggctgttgaagatgctcctagaagcctatgttcttttatccactttcccaacttcaccactcatttttcatgcatcttatgatgttctttttataaaacaaaatctttagaatagttgttttaaacttatattaatctatttttcaagttttttaattaatactacctccgtttcaggttataagattttctagcgttgcccatatttattgagaagttaaggaatctagaaacatatatatatatgtctagattcattaacatatatatgaatatggaaaatactaaaaagtcttataatataaaacggaggaagtatttaattaatcacaacctaatggataataccgttttctctaccggggagagattacggctgtgttcgggaggcaaggttgacacggagaacgaagcacacgatttagcaagattaattaaatattagcctaaaaaacttgaaaaatagattaatatgattttttaaaaaacaactttcatataaaaaacttttacaaaaaatacaccgtttgacagtttgaaaaacgtgcgcacgaaaaacgagggaagggagttaggaaagaggggaaaagaacacagccgtatacctaaaagaacacagccgtatacctctccttcggaacaactactactactctagaatttcttggtgactggtgtacactgtatacagccaatgtcccagattgaatgaaaaacatgccatgccccaccctcaacacaacaaagaaaatgcagaccatcatgatttcagagtttcagcgcaattcctaattcgcgcgtacgcgcccgcggcgcgcatttttgcccacacggtccacgcagcaccatagaagctggtgtcagtttctctttttttttcccgtgaaattaggcgctagttttgtttttccggtaatcgctcctttttttttcctctccacacgcgcgcgttttgtgatattttataaattgaatattttaccttcaatatccattgagagttttgaatttgacttgaaagtttcttaaattaaagttgaatgttttgaattttgagatgaaagttttcaaatttaaatcgagtattttgaatttcgaggtgatagtttttaaatttgagttaaaagtttttcaaacgtgagttaagtttttcaaatcttgacttgaatttttttaattttgagttgaaagttttcgaatccaagttgaaagtttttcaagtctgagttgaaagtttttaaatccaagttgaaagtttttaaatccaagttgaaagttttcaaatttgaattgaaagtttttaaatctaagttgaaaagtttttaatccgagtttcagaccacgatggccatttgtttcgggtactagacacacgggacagattccgaacctgattaatccgcagccgtcgattcctcctacgtggctcaatcccatccgtccgacggtgccatccagccctccgatttgaacgtcacgctcctcctccctcaaatacccccgtcgcctcccgcaactagccgttacgctttccccttcctccttccgcctcccacccacccaaaacctaaccccaaaaatcccccaatctctctcgcctgctcgatcccccaatccatggagttcgccgtccctgtcccccagcaggtctccagcctggcgctgccggtggtggtggcggaggcggaggcggccgccgccgccgctgctgctccggggaggaggggggcagcgggcggcgtgagctcgataccgaagggcgctggggctgccgcgaggaggaagacgctgtgcgacatcaccaacctgaggccgcggccggcggcggccgtggagcaggacggggcgacgtgtgccgcggacgcgggcggagtcgcgcaggcgcagcttgtcaaggcaagatcgccgatcctgtgcttgccagtttgaaaatctcggggtcgttcgctaacggtgatgttttttttcggaattgtttgtggcattttttcaggagaactcggaacttgtgaggctcctcgaggagagggagtacgtccctgaaatcactgatttcttgcatcatattcacttattatgtttttgagtggatggagaatttgattatatgtgatcttgttttgacttgtttttgcttgatttcgtgcatacagcaagatcatagagttgagtgggacagagttgcagaagttgcggctcgctaactggcagctcgcgcaggcaaattcccagatgctggcagtaagtttgcccctaatttttttctgattccttccactattcagttgtcgtttgaaatctgtacagtcagttattgtttcacccatcttcttgatggaacttgattgttgtctctttttgttctccaggagctcaaccttgggagagatagggtgagttcatggctctctgatcattgtgaatcttgggaagagttttggacttttgattgttgatggcattttcaacacgcatctgattagccaccatctttcttcttttgaagctaaaaaagctgcaacatcaactcgcttgctcgagagctgttatcgcaacaaaaacatcagaattggaggtataggaactgatgctaatgtcgttcttgctccaccttcgtttcataaattccatggaaaatgttgatgcaatttgctgttcttatcctcttattattgcaggaggccaagaaggcgatgaagcgcaataggaacctgccactgccagagaaggctcctcctgcaagcgaaacggcgcagcagcagcagggttctgatagagcggcacagatcaaggatggagatgtcgtcaatccagagcccgccgcggcttcagacgcatcgcatgcggcaagcaccaagaaactcagcaacgccagcaggaaacggatgcaaagatctcgatgtaacaatggccgctaaccattttgcttgcaatgacctgtactaattctcatcagcatggctcactgattgattgatctatgctttccagctctaggaccagctgcaacgacgaaactagcagcgacaccaaaggagaaggagaatgtgcagagaaggtggacgaaaatctctggagtgccaaatgattcagcaaagtaacaactgatgaactgaattgactgaaatcgcctgtgtgtttctgcaggaagtccatgagaacaccggtaccacagccgagcgagcatagggaggacctgttcgagatcgaggacctccagctcgcgatcggcggcggtggcggcggcggcgacagcaaggccgggaccagtgaccctcctgagcaagcggcggtggcggtggcggcggctcagttcccgcggaggtcgtcgctggggaggccgatcaggagggccacggagagggtggcctcctacaaggagatgcctgtcaacattaagctcaggaggtcctagcctagcatcctctcctaaggccagaatgtcttatagtctgatagagctgcgtgctgcaatgattctttgcagtttagttagttagtgtagcatgtcattttgtttgttggaatggttgttggattgaattcttgatgtaccatgtgtgtattctgagctgtgacacatttatttacggttaagagggggtgctgtgtgtgaagaattgctcgggatctgaccaatttggaaatgaaattatgattaagatgcatctgcacttctgcagcatgttcttctgcctgattaacgttgcataagtgaagaagatacttgtgctacactttgcataggtgaagaagatacttattctcccattcagattcaggcaccgagcatgttgcacaagcagatagctaggcgagacgtatttaatgtatttgacatctttaattggttgtcacaacttggtgaagtggcaagaatcgcaacggagtcggatcatcaccaagttcaagctgaaccatcgttctgaactttatagttggcagctgcaaagtgttctttcaccaaagcaagagcttttcccctgtgagatatttgattcttcactgacttgggcatctcagcgtagctgtaatacacgtgtgtcagtatttgaatcaagaggggtgcacagaaggtagtacaagctatcatgaaactcacgtttgatcaaaaccatctggttggaatactgggtcccatccaaaatcagcaggtcctctagcaggcacaatctttccctgtacaattagaattacacagttcaacaaccaaaccgtctaattttaatgtaatctatgttttgtattttttgtaacaaatgtctaaaaggatggtaccacatcctgcagaattatattgcgtcagtgtgacagaataggagtatatagagcttatctgtctgtaccaaaataaatgcactggagttcatccaaagttccagggaaagaatgatgcatggaagtatatgctacattaacaatgcatatggaaagatatctgacaagagtaacaaaagaatctagtctccttggtgatgctaatattttgcatggtacaaaaaaatgtgatatcaaacagtgtttaatataatgatagctctcaaataaaatgcagcaacacttcaaactataaacatggctgaacataatacatcaatatttgttggttttgacagaagaattattattcaacaactaataagcagaacttctctaaaaacttcacaagaaaaaaaatggaataaacagaaaattgatgtcttactgctgttttcccaacgaatgtcattggttcttctcctggtccaagagcaagagaaaagatgcacatagcaaaagcagatttatcttcataggctagcaacaaattgttcaaacctatgatgtgaaaatagtaaacatgaacttacttagtaaatctctgtgaaaaaagtaccatattataaaatgaaacaagcagatagaaaaaaggatggtttatatcaatgaccttcatgcccagttttctcaaggaaccattttctgttcatcgtgtgtcgagaagcatccagaattgcaaattaagaaaaaagaggttagcaatgacatcgaggaccaagatgtgattagatatctggcaaacagtctcttgatgagtcattgaagtgaagtatgtttttgtgtctaaaagtccaaataactcggtgacaagaaaataggttcaacttacacctcgacaggaaaagcacttacatgtagggccctgcatcaaaagggtaaattatgtcaaattgtgcattctattttgatttaacaagtgaagatgaagaagagtgtaaatcaatcacctggtaagcctttgagtgcattgaagcataggcaggtgtcctcaacaagtacaggcccattcacctaatgtgaagtacacagtgcatatttcacacagagtcattaattttgttgattgggtttatgcaatagcattagcatttaaaaacatgaagtacctgggatgcagccattcgtgctttctctttagatatgtcctccggctcaccttgcaattcagggactgcaagatttaacagaattataaacacaaattcaaaacatataataccgtaatagagaaaaaactaggaacatgacattattaacaagaacatcagtcttcagttggaacagtttgatatttcggaaactaaaattggaagttccatagggttatagtataaagtaggagtccatcaacaccaacgtgatccagaactataattgggaacatcttactctatgaaaatctaatgccggttctcctatgatcctatcgctgttcagctccaattctggtactaggccaccatgaattttacaaatcaatgttcatacttcccgaagttcttaaccagtactaatccaattatcccacacttcaaaggaaaaaaaaaactttaggctatgcgatgagcacaaatcaacattcaaccttttacctactcacaaatcacaattcaacctaactcccgttgagaacaaaaattgaatcagatcgaaatcccacaatctccagtctaatctacgaaccacatgctcactgctatcctaggaggctccagttcagtagaccaccaccgtatcacgcggcggcgccacaactgggctgctagccagcctgctactctactaccctaccgtcagccgagcagattcacacgggactggagacaaaagcgagaaccgagaagcggagacggggaggctcacggtcgagcttgagggactggaaggggatggaggagccgaggatggcgcggacttcctccagcttcttggcgttgcccgtcacgaaggtcaccgccttgggcagcgcccgcgccgccgccgccgccgccccggacatgcttgctgcgctccggtgttggccgctgcttccgccgggaggaacggtgatgcggcggaccggaggaagagattgattagcccagcaaaatagtactcactcagtatgacgccgttaactttttaacaaatatttgatattttgtcttattaaaaaaattatgtaattataatttattttattgtaatttgatttatcatcaaatgttctttaagcatgacataagtatttttatatttgcataaaaattttgaataaaacgagtggtcaaagtcaaacgttgattaaaaagttaacgccgtcgtacattaaatacggagggagtagtagctttaggcccattttaggcagatgactttggccgtgtagaactcgaccatgattttctcctgaggtaaattttacacgaagacatcgtggctttggttgatttattaacttctactcgctccgtccaaaaaaacaacatcgcactaagatatgagtacaacaaatttggacaacgttgaggttggcttttttttatagagggagtatggtaaaagtcagatcatcagaaaagatactcttagaatatttgttactagatatcttgtatgtgtattaaaatatgggtctgtctatatatactgtttgattgaaaatacccctaaaaatcttgcaaattgtagacctttcgatttgcttttaagatacatgctaggcaaactaaccacaaaaccccttccttttcatccttctcctcccaacatcccttcacgctgctgccctctcaccaacgctcgatctgtgccacttccgccccacgcagcactgcctaacctcgtcgcctggctgtaagggataacgccatcggcgaggtctcccatcctatcgtcttccgggtctctagcggctctcttccgcccgatccaccatcaccagtcgccgcctcctaaccaaatgcttgttttgttctagctaccaatgtcggcctaccagactaccaccctcctccatcccccgcggcttcaaagctatcgccggtgtcttgcctactcatgcccaccacctaccgccaccccactaagcccgacgatcatccctctcctcctcccaccctatcctaaaccaggaccctaaaccctaacatcattgccttcgtcggggtcaccaaggctagagaagaaggtaccaccagagttggaggagaatagctagggtcgctggagtacgaatcgtgaagcaaatctcaacattagtaatatgcatgattttgacaaaaaaaatctatcatcaactatttagccattttgttaaaatattcatttttagttgagtagaagatagaaacaatataaattgttgaaaatgtttaaaacgcatctaaccatggttgccacattttttccctcccatctcttgtcccctttctatgttgcccccaggggtagagatagagtatcttataggggtgcccagaaactcagtcaagaaaattttttagctatactttacctatcacctatgtcaatttaaactcgatgtaagtaaagtaaattaagcagctgacatccctctatatttcgttctagctccgcccctgtaaacactaatgtggtgcaccaatgtggtggctgccgcagaagcaacgtggcgaggacaacggtcacatgccgctcgatatcatcgacgcacgccctatggcacgagggtatcgagcaatctacatttgacggggaatttccgcacacaaaaggaagaaaatatgaacatgattagacacttgctgatcatctctgagaaaaatctcggctattactcagacatttttccaacgacatgaatacccacgaccgtgcatcaggtcattgctaaccattattatcacaaggacgacgatgtacagagttttgctgcattcattatgaatacggatctctcggacgaccaatataattacgacactagcaataatcataatcgaaagctggtcaagtcaccttcgtggtggtagcccttccatgtgttgggaacgtacgtccacaactaaggctttgttcgctccagccagatcccaacccaaaaacaaaacggaatagtacattagtgcatgattaattaagtattaattattttttaaaagaaatggattaatttaatttttttaagcaacttccgtacagaaactttttgcaaaaaaaaagaaaacacaccgtttagccatttgaaagcgtgcacgcggaaaacaagggagaggggttgggaactaagggtgccgaacacaccctaattaacgacatactgtagtatccatctttggtgtcgatgttggcggcaaaggtgctagtagtgacctaggtgatgaaaaaagacgcggatattagggaatgacctaatatcaaataataattagaagggatgagactacgaactcaggtcgtttagtccaccagcttatggagctagccggaagactcctgagtatttttcgacctaagtgatgcacacgttgttgtgttgcaaggacatcgatcaagggcgaggagaggacaaacatttgttggtcaggactcggacttttactctggaagatccccatgttctcgcataaaagttttttatgtgacatatataccaacattattttcaagcatcaaatatattaataatttttatatgtttcagtgagtcaaaatatgaaggttaagaaattagtagaacgttatgtatgtgagaacaaggttgagttatgtgacatgacaaatacacaccatcatcagttagtactagaacgtagcaattgatttgttatcggatctaatgttttattctctatcagcctcgtaacttatttttatgggcttagtcaatctggtctactactcgcaatttaccattgcttctcctgaagttccttctcctcctcgttttccttttttcgaggaatgaagtccctccttgctgctcattccacagttttcctatggagtgggatgccatcatcagctttgggtctattttttttaaaagggaacttggagaagttttttcagcaaaattataaacagttattttttaagattataagaagcttagtcgtaaaatccaaaaataaactataaatcagaaactatacaacttctctaattttttcagaatctggtaaccaaccatattacccaaatagccacttcgttcctcaccgtaacgaaattccaccaatccggacgcttctcatcgttagagcaagtttaatagtatagccaactagtagctccaattcatctatagccaatctaatagctcattcatacaatagttacatactacactattaatatctggtccacatatcatacacatactatgtcttggagtccgtgctacagctggctacaaatttttagcccgctgctcttctctctcctcatttatcttcttacaatatgtttgtagctggcttataacctgctattgccctgctaccaagccaggccaaaacgccaaaaccccaggccaaccaccgaccccaccgtccacccacgcgtccgcgtcccgcacgccaatcacacgcacggagaagagagtccattttttttttctaaaaccccgcgtgtcccgcgtgcgggcggtctgattgccgagccgacccggcaaacgaacagcccgacgcccccgacgaccaaaacctcctcgcgcgatctcgcctcgcgtcctccgtccgtcctcgtcaagtcgtcacggtcctcacggctttttcacatctcacatctcgcactcgcatcgcagctcccaactccaactcaagtgggctccttcttcccccacaactccacggaaaaaacctcgcagtacacggccacccaccacctaactcccttccttcctctccctagaaatattcccgcatccgcatcccgcatcccgcctggtttgtgattcgccgaacagctttgccgggagaaagcgaggaaggaaggaaggagaggagggagccatggagaaggcgatcaacaggcagagggtgcttctcgcccacctggagcccgccgcgagtcccgccgccgccgcgccggccatcaccgtgagtccacctaccgccgcgttccgccctggggtgtccagatctgcgcggcgtgctgatgtttttgattgttggttttggtttggttggtgcaggcgagcgcgtgcgccgcgggggacagcgccgcgtaccaccgcggggcgtgcttcgcagacgacgtcgtcatcgtcgcgtaagtgagatgtgtttccttccccccgcggcggttctgccctttggccatgccaatggcctggattttatagcttctgattatagataatttatttagatcggtgaaattgattcaagatggatggctgtttttgtgttgaccgtgttcttctcccggtcgatggttgtcgggtcaaatttagttatcagcttattacgaattaaacctggacgaaaatagtaaaggtctttcgaaaaatatctggacgaagaaaaaaacggaattgctatatttgtgtcgctacaattttgttcattttattgtcagatctcagaccatccattgctgctttgagatttgcctgttgcagttgattatcttcaaaattcatgctagtattcactttcacttggagattaaactattatcactcatggataaattactcatactaattacatcgtacttattgtaattttgggacttatattgtaaatacactaaaattacatatgtaatttaggaacttacaatgtaaatacatgccgactattttttggtgaaaaatatggcgtcttaaatatagctactccccccccccccccccccccgcggcaaaaaaaaaagctatgaaagttatgaataaaattgggctacttgtttccgctaatattttgaagaccgcatgttgaataaggagaatgatatataaacatgaaagttttagcattgccaacataggggaaaagggtgtcatagtctgatagccgttgtgtcatatggtctggattatataggatagttagctgccgtaagacaactcgtgttggcctagtttctttttctcgatgtaatttcattgctaaataaaatacccattatctaaaaacatatgaaaaagagagccaaaaaagctgtgaaaaacacatgtgattgttgcttggtttaccgttagattcagtggcaagtgatttttttccttatttgattatcataagtcataaatagaagtgaatcatgggtcttttgtgtcttcagtgcctataggacagcaatttgcaagtccaagagaggtggtttcaaggatactcccgcagaggacctcttggttccagtattcaaggtttgtatttgttatcatatactcattttctcccaacttgacaattagtgaactggttgcttctgtctcgacctttggtctcattctcatatattttgcctcccaactacaggctttgatagataaaacgaagttgaacccaagtgaagttggtgatattgttgttggtactgttttagctcctgggtcccaaagggcaattgaatgcagaatggctgcattttatgctggattccctggtaagagtcataataaacattatcatgtttgccattaatattggactgtcatcattctcaacttgattaatttgttttgtatgctccagataccgttcctcttatgactgtaaacaggcaatgttcgtctgggcttcaagcagttgcaaatgttgcttctaacattaaagcaggactttatgacattggtatgatccgctggtggttaatcttaagaagtcctttttgtgaggagaagtttgaaaaaaaaattcatggtgaactgacttttgttatttattcaaggtattgctgctggcctagagtccatgacagtgaaccaagttcgccttgatgggcaagtgaaccccaaagtatgtgaaacatgatggtcaatgcagcaagataatctttggatgcacgtgtaaagatatttgagcttgatttttttttggctgaaatctcccgctattttaggttgagctgttttctcaagcacgcgattgccttctcccaatgggcctcacgtccgagaatgttgcaaaacgatttggcataacacgaatggagcaagaccaggctgctgtaggttgccttatcaattctttctttggacatgtgtattgatacacagtgaagtgttgcacaatatgattctttcccttattattttcatatattgatgtttaggttgagtcccacaggaaggctgcggctgcagctgcttctggtaaattcaaggaagaaattgttccagttcacacgaaggtaatttagcagcttggttatcttcctaaaataactgtctgaactctttaatattattgttacatgatagtcttctgtttactgtgttatcctgacatgatcattgtgttgtgaagattgtggatccaaaaactggtgaggaaaaggagatagtggtctcggcagatgatggaatccgaccaggcacttcattggcagtcctgtcaaaactcaaaccagcattctctaaagatggcaccactactgctggtaacgtgtaatgaatgtttgttaggcacaactgttgattagttgtattcacctctaaagattagtgtttgttttaacccataggaaacgctagccaagtaagcgatggtgctggagcagtcttactaatgagacgtgacattgctatgcaaaagggtcttccaatagttggcgtcttcaggtattagtatttctctatgactctatatatcatatcttgggtcacaactcacatctataggcattgttttcagcctaattaaaaaagtaccaaagaacattaattttaagtttttaacaaggtggttcaatcttcccttcttagtcatgaaagcaaataggcatatggtacaactaactgtcgcaaaactttgttaagaaactcagcatgagctgaatgtggaaatgtaggagctttgcagcagttggagttgatccagctataatgggtgttggtcctgctgttgccatccctgcggcagtgaaagctgctggtcttcaaatagatgatgttgaccttttcgagattaatgaggtatactttcatccattcatcgagtttctccactagacaacagatctgccttgtaatatttatttgctcttgtacacaggcctttgcatcacagtacgtatactgctgcaagaagttgggacttgatcctgcaaaagttaacgttaacggaggtgcaatggctcttgggcatccattgggtgctacaggtattttcttgctgctatccttgatacttatcgtatagccaaactgttattttagtatcagtaatctataattaagcaaatgtgccaattgcaatgatatttctcatgtttcctcttggcaggtgcacggtctgtcagtacccttctcaacgaaatgaagcgacggggcaaagactgtcgatttggtgtgatttccatgtgcataggtacataaccatattccattggcctgcatgaaaattcaaaataattctttcagctgggagtaacttgacaagaacttctggtgaacaggttctggcatgggggctgctgctgtctttgagcgtggggatgcagtggatgagctcactaatgctcggtgcatcccgacccataaccggctttcgaaggacgccatgtaactagaactatatatatatgtcataaaaattgtgcaactgccactattgtttgaaatatcaacacaagagtagggaataaaacgcttgtgtatctgtaatctcatccagctctgaacttggctagttggagaatccttgttaattaggaaattcatgcataataactcaaaagttgtcccttgtcagcctgttcatctgattaccttttgctttcgaaagttatcagatgattgtctatttgtatcagaaaatgttgtgaagcctgatgcatatgacgcgggattccggtgaaaggatagaccaacttgtctaaaaagaaattggcaccctggtttttttactttcccctgttcaaatttatgcgtaaaatgaaggggggattttctccgggacaaaacatctttgttgctagttcgatgcctaagcccatgcttctcttcaagtagagaatgggaaaacttcatgttccatagacagtgaaaatatcatgggctgtttgcctcttttggacgcattgccataaaagtgtggctaacgaattattggccagacacttttctggtgagatgtggcaaaaaaatgaatagcacaaacttaaagttacgcagggattgtttttgtttggttacatacaacactttgttacgctaaatgtcaggcatatttatgtagcaaatcatgccgtctaaaactctgtccttaaaaaaaaaaagtaaactctaactatgccgtctaaaactctgtccttataaaaaaataaactctagctatgaatctggacacgcatatgttcgggttcgtagctaggattggacttttatatttatgtggcaaatcatgccgcatgaaactctgtccttaaaaaaaaggtaaactctagctatgaatctggacacgtgtaacaccctgaaaatttgaccaataaaagcaaaactctaaaaatacggaccttcgaaaacttttaaattaattgcatcatgctgatcttattcgcctattttatttggatttgatttcgaagttcattaatcgtgagtaaagaatagttaattaggaataaaccctagaagtaaattggtaaaataaatataatttaaaataaagattagtgtggatagaaataaataaaatattatcacgatcatattcgtatcaattaaatttaaatgcgatggaataagaattaaccctaattaaaaattcaaataaattatacaaataaaatatgagtaatattaatctagggtgaattcattagttgagataacacaaatattgagtaaacttcatttatgcaagatttataaattatagaatcaaatttatatgggaaataatctaaaatcgggataaataggaaaatacactgttcattatggcgtaggtgtttgatgcggtccctaaccttccccctcctctcccatctctgcccctagccgccccgagcccgcgccgacgcaccatcgccgcctgccgccgcgcgctgtcgccccgcgccgcgcgccaccgccgtcgccatcgccgccttgagccccgcgcgccatcgttgtcaccgtcgcgtcgtcgcctcgcgccccgcgcccctgcctcgccgcgcgcccgtcccatctaccatgccgcgcgcgcctcgcgccccgagccgtcgcgcgctgtcacttcgccgctgtcgcgccgcgctgccatcccggcgtaccacgcgcccacgcgccccgtcaccgccc

SEQ ID NO: 77015 - DNA, 1293 bp, Oryza sativa
tgtatgcaaagtgctatatattagctcggttctttattagttgacgtcccgcaactcttgctacgtctatatttcaatatagagcctggtcactcatgtttggacgtatctacagttcatgtatgaatattagatcattcggtttaccgtttaaacaattataattttatcattaggttgtaattgattttgaagatttttaaaaaatacaaccaaaatccatatcgtgaaactgtctctctctccatatatatttatacttatattaattaggcactttaatttttacatcatattatcatcaccttagatcttaatctgttttaatattatgggcattgtttaagctgatccaaggggctctaggaaagcccatttaaagttggttgcgaccaccaatccaatttgtcacgctcgtcctagttgggcactttgactcctatattaaccgggaagatttttgtcattggttcaatgaatcatgttattatagatcttaatttgttttaatattatatggtctttgaagtgaatccaagtgcccatttagagttagttgtgaccacccattcaacctatcacggccgtacgtttctcatccccatcgtacctaagccgacagctatgtatatggtgtaggatcgagatgtcgactaggaggggggtgaataggcgatttaaaactaaataacacctaatcaaatctaacctaagttgctaagcttggtgagggtgaattctaactaagcaactaagttatgttttgtaaacctagggtgatagtggctcaaatatatctctaggaaagtaaatcacgctcctatgtcgatgttttgcaatcctagggtgatatgatctcaagtgtgtctctagaaatgtaaattgcacaaatgtaaatgcgacaattaaatgagacaatgagacaagagatttttcaccgaggttcggaaactcgccggtttcctactccccgttgaggcgagcccaactccaccgctcaaccacgaagccaccgcacgcccccttcgtcaaggggtgggcaaggcgggagccggcccacggagaggactacccaaacctcgatcactcggggtagttcttccttcactccgaaggtggtgaactccaaaccactcacaaccggcgccgggcctcctccacaatcttctcggagaggtcaccgggcaactcctccacaagccgtctaggaggcggcaacctctaagagtaacaagcaatgacccggtgtggagatgatcaagtgccacactagctctacaatggaagcaaatg

SEQ ID NO: 77016 - DNA, 13704 bp, Oryza sativa
cttaaactcattgttctcaacaacaagtgaggcatcacaaatagaaacacacgagctagaactagagcaagggctaggcatatccataagatcatcacaagaggtagaaatgctagatgatgcaacatgagcaatatggcaagtagcactatcatcaagcaaatcacaagatatgccaacatcaatgtgagctccatgttgagtagtggaaaggaggttgtcatgagcttccttaagcttctcatgagaaatggtgagtctctcattagaggtctttagctcctcatacaagacatccaaagaagcataatccttgtttagggccttgaacttgacaatctccttctcactataagcatggagctcctcaaacatactcacaagctcttcataggaaacatcatcacaatcatcatcactctcactatcactaagagatgttaccttagaggaaccctttgccatgagacaaagtggagcgaagagtgatggagcctccttgatggcaacaacgaccatcttcttcttcttggagcttgcatcatcaccaccttcttcctcagacccggatgaggcggagctctcctcatttgagtcccattccccgatgaaagcctcaatcttcttcccttccttcttaagcttcttcatgagcttgtagcctccactcttcttcttggatgacttgtctccatcatcatccttggaagggcacttggaagcaaagtgtcccttctcaccatactcaaaacacctcaagttggagagagtcttattgagtcttctatttcttctcctattggagttggagccccttcctctctcctttctcctttccaagagatcattgaaccttctagcaagaaggatcatctcttcctccaagtcctcattgacttcattcaccttactcttgctcttgtcttcaacttcggcttggagagcaatgcacttcttagagggtgaggcttcctccatctccttcttcttcaacttgtacatgtcattggtgttgatcttccccaagaggcttgcgggtgtcattcttgacatgtcggagttgatgagcatggtgacaagggtctcatacttctccggtagggctctaagcatcttttgggcaacctcaagatcggtgtagtttgccccaagccccttgagatcattcacaatgacattgagcctcccatacatgtcattcacactctcatgaggcaacatgtagaatgtctcatattggatcttgaggaaatgaagcttggcatccttgtactcacttgtaccctcatggatctccgccaacttgttccaaatctcatatgcggtctcaaggttgctcactctatcgaactcctcttggctcaaagagttgaacaaggcattcatggcttgggcattgagttggaggttgcggtgatcaatctccgtcaagggtgtgccggtgatggcaaagcctacatacacaatactccaaatatggaagctcatagctttgaggtgagtagacattttaattttccaagtggagtagtttgtgccattaaatatgggagccttccctacatggttcacctcgttcgacatcttctctctaggcggtgaagcccaatcaagagagaccaagctctgataccacttgtacgatcgagatgtcgactagagggggaggtgaataggcgatttaaaactaaataacacctaatcaaatctaacctaagttgctaggcttggtgagggtgaactctaactaagcaactaagttatgttttgcaaacttagggtgatagtggctcaaatatatctctaggaaagtaaatcacgctcctatgttgatgttttgcaatcctagggtgatatgatctcaagtgtgtctctagaaatgtaaattgcacaaatgtaaatgcgacaatcaaatgagacaataagacaagagatttttcaccgaggttcggaaactcgccggtttcctactccccgttgaggcgagcccaactccaccgctcaaccacgaagccaccgcacacccccttcgtcaaggggtgggcaagacgggagccggcccacagagaggactacccaagcctcgatcactcggggtagttcttccttcactccgaaggtggtgaactccaaaccactcacaaaccggcgccgggcctcctccacaatcttctcagagaggtcaccgggcaactcctccacaagccgtttaggaggcggcaacctccaagagtaacaagcaatgacccggtgtggagatgatcaagtgccacactagctctacaatggaagcaaatgcacttgactcttggttaaacaaccctctaacacactagatggatgaacacaaagctcaagtgagtgtgagagaggtgcaaggagtgtatgcaattgaattgggtgccaagagagcccccttgctgctggtgggggagtatttatactcccacccaccaaaactagccgttgggggcgaaatcccccaactctgtgctctgccggtctgaccggaggtatgcggccggtcagaccgtgctactctgcaacggctagaaaactagccgttgtagccctgtcagagggccccatcggcctagccggtcagaccgacatggggtggccggtcataacagcctcggctcggtcagaccgccatcggctcggtctgactgactatggctccgtcggctctgtatcggccatcccgagcagcatcatctcagcctccaggaggccggtctgaccgggaaagtgccgccggtcagaccgccactatgtagccggtctgaccggccagggcacgccggtcagaccgccactatgtggccggtctgaccgcccctggtcaggccgaacccagtgaatttgtgtaatgaaaaagagagcacaaatgaaaatgcaatgacctaatgtggcaattaaaatcatctctttgctaggtcattacccctcttaatagtacggcgaaactaaaattaaactagcaaatttgatcgtcctacacctcgatcaattctaaattaaagcgctagttttaccgtcttctttccctttgctttgcgccgtcaattttaatccatccataatcatccatgcgcgcatatgacgtagacctaacttaaaatatatagctcaaagacaacggtttgtccacaattagtgcttgtcattaattaccaaaattaacaccgggggcctagatgcttcatatggatgaaaatgatcggaaaaacggctcaaccattttcataaccatatttttcttagaaacgaaattggaaacaataaattaaaaacaaaaacggtatcgaagatataaaaaactataaacaagactatatggacagaaaaatgtcggcatcaactgaaaactagtaatacatataaaaaacattaaattgtaaaactacattttaactttgcaaaactatataatataacaaaataaatataatgttacattgaataaatgataaattgtgtacctttctaccatacactcaagttcattatctggttgaggtgttgatggtcctctaaaccatgggtcaaatagagaaatgaaccatagatatgataggcgtatttagaaatacaataatcaacataataaaaagtattttccataatacgctaaaattcgggaacggtcggtaggacagcaaaatcgtttttcgcttctatgtccatatttcttaccattaattttcgttctcatttaaatacacttctacatataatgatacatgtagaaagaaattttcaaagttgtatattaaatctaactccatgcaaaactacgtggggaaatcccctagttaattctattgtttggttggtgaatgtgtgagttttaagaggtattgggaaggaaagtttaagagtaaactcccaccttttaatacctgtatagggataagtaattgggagggaattttcctcctatgtacaacgaaataaaagtcatacatccatcactaaaagttcaattcctatcatacaccaatacgaaactgaaaattcaattcctatcatactcatctgtatgaaactgaaattaattaaaaaataagacttccatgctaggtacatgcaaggaaatagccgaagatgggaaacggtaaagaaatttcaggatcggtgaggccatatgtatttaattccattataacaaaaatttcgcgaatacataaaaggattgcacgtcaatatattagaagaaaaagagtttttgttacacaccgcaatcagccagaccggtttatgccagggaaaaaggagaaaaagcaaaacaaaactgaaattgaaactaggaaaaagactactacggtagctaaatgcaactccaaacagcgggaaggtgtatagctacgctacactccctcaaaaacgggaacgtcaactaaagaccatagatggccctccgagaggatggactccagaaccactgagaccgaagagagcgcagagttgaaaacctaagagtttcgttcctttcacagctaccactcgaaacttaaagctggcgcggagatactcgggtaagcagtccctacacgatggccaccagttctaaaaccagctgccacgggggatttaaaaagaattaaggcaatatgtatatcgtcataattgctcggtgaagctggcaaaatgtttttcctttctttgtacagaccatcggtagcctcgatctttgtgtcgcatcttcatggagggatcgaggcaatgggacggttgcccctgtgggctgtttcgaagcaagcggagcccgtgagattcatgggccggaatctcccccgatcctggtcgctgatgctttagactttggattggcgcaatgtcccgtggatgatgggccgaaatttcttcttagcttcaggtgggctgggttgctatgcggtgaatgctagtgcagcttgctttgttaaccggaggaataagttcactagtggtccctcaacttaacatcgagatcttttaagatcccttaaccacaaatccagaaatgtgcacatatcaaggtcctatggcagtatatatgggtggtttcgctgacgtggcatcctaatcagcaaaaaaatttaaaaaaaaatgtggagcccacatatcagctgcacatcgttttccttctcttttcttctccttctcttctcttttctgtcttctctcttctcttcttcaacatcgaactgaacaagttgaaccacgagatcgatcgatcgattgatcatagtgttggcagcatcatctggagcatgggagccggccgggatcggccctgccgcgacttgaacttcctgatcgccgccttgagcacccgcctcctgaagaatccaaccagcagaagcctcgtcgtaatggcggatatgattcatgaagcgtaaagatggggggatctgtatgcagaaagctaccttggctgggagaggtgatggcggcggcggtgagaagtccagcctcgcgcggcccgtcttgtggaggttcaggaaggagccgtcctcctaccacagcctcggccgccggcgctgcgacctcaacgacctgcccccaatggcggccctcgccctgcgcttcgggttggcgatgaggaagtccctcgagccctcggccccgcctccgccggagtgcggtgacgacgcgcagggcaccttgttcagcggggactagatgccgctctgggagcagtcgaagtcgaaggcaaaggagtccgagaacttgccgagcagccccgctccaggtactccaccgtcaccacgcgctccaccaccacctgcggcttgacggcgggcagagcagcggggggcgagcgcagcagcggagcgacggcggcggtagcgggacgcatgaggcggggtcggaggcgaagtacggcgcgaccggcgaggtcgaggcggggctcgggtaggctgaggccgacgacggcgcggcccacgacatcgaaaacaagagcgaggagaagggaggcgtgggaacgggcgggcacggcgaagttgaggacgaggacggggcggccggcgaggtcgagacggacgacgactggtctgcaccgccggccgccgccttcgcctcgtctcatctctcccaccgcctatgctgctcaagatagatgagtcgaggtggccggccaccgcccttcccctctccagatgcatcttcggcgaggacttcgaggacctgatgccggtgatgactgttgggaatcaaagcaactcacgcgaacacagtggacacaaatcacacttacgcgtgaagagcacaagaaagaagaacacagaacactgagtatttgtggcacaagcacgcaactggtgccttttctcttgcttttcttcttgttaacaaaatgattacaatgagcagctatttataacacagcacatacacaaagctggttgttccgcttctcaagccacacacgacgcccacgtcccgtttacttggccgcaacttcacaagtactgagtcttcgccgacgttcgttgcttgaaccaaccaactaacctgcatgcatgcaaactgaccacttcctactcctaatcttgtgcaagactcggctaatcactagcccataattatgcatggctaactaactaagctacatacatgtgctctcatctactggctctttattggctcactactcactgccaaccactactcactaagccatgcagcacccacgtacatatagctagctctccagaccatgcaacacacacatatgcatatagataaacatgctgaaattaagaaacaacaagattaatttctaacaatcaccccctaatcttgttgtctttatttgacaccttctcacttggattcaaagcagcgtcggctcgtcgtcggcatccgcaaccacaaggtgcgcctgatggttcttctttgtttcatggcacttcttctcccaagagtagtgaccatactcctggcaattgtaacaacggacctttgacttgtcaaacgtgtcgccgttcttcttgcgatttctcctacgctccagccactgctcttcggtgaggagcaagcggccgccatcaacgccaccatcattgtcaccgggcctgtaccgctcctccacagttcggaggcgccccgtgacctcctcgatggacagcgtcttcaaatcaagcaattgctcgattgcaatggccacctgcacgaaccgagaaggaacaacacgaagaaatttctgcaccaccttctcctcctccagtgggtcaccgagcatgcggaggttgttgacgatggcgttgagcctcatcgagaattcatccacagactcactttccttcatgcggatcaactcgaactcattccgcaaggtctgcgccttcgcttctcgcacacgcgcaacaccaacgcgcatggtcttcaccgactcccacgcctccttggccgtatccttcaccgccagagtcggcaacatctccggcggcacggcacggaggatggcggagagtgccatcctgtcatcctggtactccgcgtagccgggctcaattgccgaccacaaaccttgagcctgcaagttcacgcgcatgacgagagcccagtcggtgtagttggtgcgcgtcaacatggggtagaccaccgagccagccgtctccttcatcaccctctgcacgatgatctgctggccgccattgttgccgccatcagtgccgctgccgtcggcgccactgccgctaccgctaccgctaccaaatgttgggaatcaaagcaactcacgcgaacacagtgaacacaaatcacacttacgcgtgaagagcacaagaaagaagaacacagaacactgagtatttgtggcacaagcacgcaactggtgccttttctcttgcttttcttcttcttaacaaaatgattacaatgagcagctatttataacacagcacatacacaaagctggttgttccgcttctcaagccacacacgacgcccacgtcccgtttacttggccgcaacttcacaagtactgagtcttcgccgacgttcgttgcttgaaccaaccaactaacctgcatgcatgcaaactgaccacttcctactcctaatcttgtgcaagactcggctaatcactagcccataattatgcatggctaactaactaagctacatacatgtgctctcatctactggctctttattggctcactactcactgccaaccactactcactaagccatgcagcacccacgtacatatagctagctctccagaccatgcaacacacacatatgcatatagataaacatgctgaaattaagaaacaacaagattaatttctaacaatgaccgggcggctggacgacccggcgagcggcaccatccccgtggagacccctgtggtcgccggtcctgtccttctgggctaccgccaccgccaccgccgggcacgaccatcccgggctacttctcgacggctgggcactcgagtgaatgcctcatctccctccctctcctgccttcgcctcccgcgaaagctgatgctccgttgcggtcgtcaatggccacggcgctctccgctctgcaccgagggagcgacggaggtctgtgctgacgccggcttaggaagaaaagaggagagggcagctgacatgtgggccccatgtactattttatttatttttttgctgactaggatgtcacgtcaacaaaaccaccaatatatactgccataaaaacttgagtatacggtttgtgtaagtttagaggtacacatttctgattttgtagttaagggactttaaaaaatctcgatgttaagttgagggatctccggtgaacttattccttaaccggagttccttaacgttgaattatgtgcagctcaacaacgtcgactattacgtgcagtgaagaggtacaaactacttcctccatacattaagacggtttggtatcttcatcactcatctaaattaattacgtacatataaatctaatcacttatatgaaatgtatttaaaatctaaaacgtttaataatatgaaacaaaaaaagtagaaaacgggtacaaaagacacatagagggaaagagagagcgttcctatacaatatgtaaccagagctactatctcactttctataagcataaacggtacgtctttttaaatattcttttatataaaagttttctttaaaaaattgaaataattttattttttaaatgagagtagctatatttatggtgtcatatttttcacaaaaaatagttaacatgtatttacattataagttcataaattatatatgtaaatttagtgtatttataatgtataagttccaaaattttatatgcaagtctcaaaattacatatagtaattacatgtgtaagtggggtgtaaatttaaatcttactacattggaaaagttaaaaagcaaaagcatgagcagtataggagatgattttgagaagaaatcgaacggtccgaacaagcacaacctaagacatgtagtctcgtgtagtcacgtagagcaatcgtacgcacggtaaaaccgactgagattaggcaaaaaaaatatcgacatatttttagcagtccgttttaaatttgtaatcgttgatccttaactaattatattgtaatgactcgtctgtttttcatgtcgttaaaaagctcagctcatgatctgattcaaacgcatcctaagttttttttttagcttatgaacctcacatattgcagtgtgtatctcgaatgattcccccttctttcccgattgatcgtcgtagtgccaaaagtccaaaatatgacttagcattcataaaaaaaaaaactttcgttactcgttaagatcctctcataatctctatttcttcatcacttagttattgcccaattttttttaaaaaaaaccttagcattcataaatctaagggtctctttgaatcaaaggatttatatagaattttatatgattcaaattctatagaaaatttttctatttggcttttgattcaaaggattgaagctttccaaatcctatgaaattcctatggaatgacacattgcatgtggattttggagaaaatttagcaagagctccaacctctttgagtaaatttcctttgagtctatctctctcatctgatttatgcgttttcctgcgctccttttaaacgaccattcctgtgtttttcctgtgttttgtaattctctgttttacacttcacttcctgttagaattctatgttttttctatttctctgttttttttttctaccttgcgaataaaaggggccttaaatgtgcatttaatggtttggaacaggttgcacaaaatccggagttccggacttctgtcttgtttatttgagcattcctaagctcatcaccgactagttaatgccccttgctcggttaatcctagattcctagtgtgagtggtacactaatcgcccttagagatccacgtcgcgtttgaccatgtccatgaccacctgagcagtgagtgagccagtcagccagtgagctactgagcagtgaccactagtaggttctactcgtcggcaaccgatcttgcctcgccggagaagacaacgcccgcggcggcggcggcggcgacgctctccttttgatgctctcatgaagcggcacaacgcggcggaggtgccggtgccggtgagctacggcggcgagcgggatgagaagaccggaagcaaggtggataagatgggtggtggagcggctaggcggtggcggagcggcggctgctgctcccgcctctggctcgtgctcgtcgtgttcgccaccgtcacgatgctgctgcgccaccgctacgactccggcctcggccatggtgccgccgccgtggtgcgcatcgagccggtgcaccggaaggtgaagccagccgatcgcggcggcgccaggccgtcgttctccgattccggcagcgcgaagccggtcaccgtcgaccacaagtcggcgacgaccgattcttctaccggaacggagtctgacggtggaggcgagccatcgtcggcgtcatcttcgctgccggcggcggcgcacccgttctcgcgcgcgctcgcggcggcgggcgacaagggcgaccggtgcggcgggcggtacgtgtacgtgcaggagctgcctccgcggttcaacaccgacatggtcaagaactgcgtggctctgttcccgtggaaagacatgtgcaagttcacggcgaacggcggcttcggcccgccgatgagcggcggcggcggcatgttccaggagaccgggtggtacaactccgacaagtacacggtggacatcatcttccacgagcggatgaggcggtacgagtgcctcaccgacgacccctccctggccgccgccgtgtacgtgccgttcttcgccggcctcgaggtgtggcgccacctctgggggttcaacgccaccgcgcgggacgccatggcgctggaggtggtggacatcatcacgtcgcggcccgagtggcgcgccatgggaggccgcgaccacttcttcaccgccggcctcatcacgtgggacttccggaggctggccgacggcgacgccggctgggggagcaagctgttcagccttccggcgataaagaacatgacggcgctcgtggtggaggcgagcccgtggcacctcaacgacgccgccatcccgttcccgacggcgttccacccggcgagcgacgaggccgtgttcgtctggcaggacaaggtccgccgcctcgagcgcccatggctcttctccttcgccggcgcggcgcgcccgggcagcgccaagtcgatccgttccgagctcatcacgcagtgcagggcgtcgagcgcgtgctcactcatggagtgccgcgacgggccgagcaacaagtgcggctcggcggcgagctacatgagactcttccagagctccaccttctgcctccagccgcagggcgactcgtacacgcgcaagtcggcgttcgacgccatgctcgccggctgcatcccggtgttcttccaccccggcacggcgtacgtccagtacacctggcacctgcccaggaaccacgccgactactccgtctacatctccgaggacgacgtgcgccgcaacgccagcatcgaggagcggctgcggcggatcgcgccggccgccgtggagcggatgagggagacggtcatctcgctcatcccgacggtggtgtacgcgcagccgtcgtcgaggctggacacgatgaaggacgcgttcgacgtggcggtggacgccatcgtcgacaaggtgacgaggctgcggcgcgacatcgtcgacggccgcggcgaggaggagaagctggagatgtacagctggaagtatccattgctgcgagaagggcagaaggtcgaggacccccatgagtgggattcattgttcgcgttcgcctagctcaccatttctaccaattaaatttgaccttcatgtttgtgaagtgatctatcacaaattaaattatcttgttgtgttttaaaaaaattatttatatttatagtgacatgcaacaacgaaagaatatctcctcgaaaatttagaatagttttcgctatttgtagttttgtagagcaagatgggaggtactaggatagcttctttcttttctttctcctatatttgcttgtcaaccttttgtactaggaagatctctaactaaattagagttcaatctatcgcattcttgccttttagtatgtactctctccgttttaaaattgaagtatttttagtttctttagaaaaactaaggcatagagaaaatattatttctagtcacttttattgccaaattttattttttaaattatttatatttctttcccaagaatcccattagttgaaaatttatgattttcgttgttggatttagtgtcctaaaagtatttatattatggtataaattttatatcacataaatgcttatattttaaaaccagggagtatgttttaatctgttgagcacactcatatcacctctatttcccaagtatatctatgctttcacattgcatactttttaagttgtcacccagtgcgatagagaagctgacagtaaacagattaatattcctgcaaatgtagccatgatactaatggaaagtctattcatcttaaagggatgtcgtttttcatgtctcttgagaagtcatcgaaagatttgaaaataaaactaattagatagattaatatgtgatatgttatttaaatttataaattgaaataaaaacaataaatttgactttgaataaaacgtgtaattcacgatcaaatttggctctgaataatgcatctctctactactaattcttgattaggagtactgtcatagtgttatacacacggcttataacgttctttttggatatatatgatgcaacgcgatgaataatttctaatactttaccaaaagataaacaaacttaaagaatttcatatgttacctgagccgagtcgaagcggttctaggctcaaaaaacttgtgttagggcctccatcctactgtacgcactgctcgcctgggccaagcctgctgctgcccgctaagctagcttacagcccaatgacaaagccgaaaggaaaatcagcaagctggcccttctcttctctgttttcttctactttttcatcagttattccagggctttagctttacacgcgcgacgggcttgatcccaatttgatagtacgaactacctggcatcattttcctaatttttgtttttattatg

SEQ ID NO: 77017 - DNA, 3054 bp, Oryza sativa
tagaaaactagccgttgtagccctgtcagagggccccatcggcctggccggtcagaccgacatggggtggccggtcagaccggcctcggctcagtcagaccgccatcggctcggtctgaccgactacggctccgtcggctctgtatcggccatcccgagcagcatcatctcggcctccaggaggccggtctgaccgggaaagtgccgccggtcagaccgccactatgtagccggtctgaccggccagggcacgccggtcagaccgaacccagtgaatttgtgtaatgaaaaagagagcacaaatgaaaatgcaatgacctaatgtggcaattaaaatcatctctttgctaggtcattacccctcttaatagtacagcgaaactaaaattaaactagcaaatttgatcgccctacacctcgatcaattctaaattaaagcgctagttttaccgtcttctttccctttgctttgcgccgtcaattttaatccatcgataatcatccatgcgcatatgacgtggacttaacttaaaatatagctcaaagacaacggttagtccacaattagtgcttgtcattaattaccaaaattaacaccgggggcctagatgcttcaatctccccctttttggtaattgatgacaaacaccacaaatatatataatcaaacatagagcacatggacatatattgtattgacaagcaaaagctccccctaaacatatgcataacaatcacaaatagcaaatatgaagccaatgcacaattcaatttcacatttcaacatatcacaaacacaagagcaatatctcaatgtgaacttcaagaaatattcattcatgagcataagatggtcacaaatatatcaatgtcacaccaaccatccatcatagcacaagttcacattaagactacataaagggctcacaaataaatataggctattacaagaccacgaagggtccaaatgacatagagaacaacaaaacgaaaaaggaacacacaatatagagtaatagcccatacccataccaaatatagcccaatcctccttaacctattaaatatgaggtgactaacctcactactactagacccaacccacaaaacataaaacacgctattctcccccttttggcattaagcaccaaaaaggtcttcactcttgtggaggagaaggaggacgcgccgaagtggaaggatgagaagcatcacggcggcgatgatagacaaaagcttgggtactctccaaggtttggacgcgagaatccaatacacccaccctagtatgcaatcttcccaccgaagtattcaagttgccaacatcggtgcgcaagccacgaatatcctcatgcaatgcttcatgcccggtggataagcgttgaatgctttcacttagggtattaatagccccaaggaccgggttgaagaagtcatttggttgcattccaaagtaggcatattgtggatggaataaagtacttggatcatacccttgaggaggagggggggctgcacttgagcttgcaccttgatcaaaagttggttggcgcacacgaggagctctaggggaggagagttggagacgaggcttgtactccttatgttcttttaaattttgaccaatttgtcccaacttgctttgaatcaacctcattatgtaggaagcataatagattccttgtccaatagtcccctttgagatggcaatctccttcatcataaggttgataacatcaaaccgacgaccatccataatggcatcaataacatgccaagcaactccgcgtatatcatcattgttgccgcatcttgggaggatggtggcccttactatgcggttgatcacacttgggagagcccttaaacccgccacctttccatatgtgtgccttcccccttcttcataaaactgagaaaagtgatcaatggggaagggattgtgggtgtgctcatcatgaaggtcatccccgttgttgaagcgaatgtgcaagagctccttgaattcacggcggttgatagagcatcggagggtccccgacatccacttcattgcatcacaatcgccggacacccatacggtggcatagaattgccggatgagatcttcatcaaaaggttgcttcatggtgacaattctatcaatcccaacggtccggaacatctcttgcaaattctcaaactccggtgtctcaccaatgtgcctccaagagatccatttgtgttcggcgaaggctttgttggcatacacttgtacatacacggacttttggaaccgtggatcattacaatcgttaggcctccggaattgatcatgatgacagaggatagtgtattgttgagcattcctcaaattaagcacaaattggatggaggaatcgagaggactcccatcatcacttgcctcatcatcttcaccatttccactctcattgtcatcaccatcatcacttacctccatctcatcaccctcaacattttccatattgtcctcatcactttcaacatactcatcttcgcttgattcctcattctcactaacgggatcgggcgtgggagcacgacgaccatgccgagtgcggggaggcatagctgaaaaacaaggagcaaaggatggatgagcaacaattttagaaaccacatagtgaagtgagaggaagggcaagtgctgcctgtcaggggcggtcagaccgagagccacggccggtcaaaccgacggctcaaggccggtcagaccgacggctcacggccggtcagaccgcgtccggtcagaccgccactgacacaagcatacccaaatccttccacaatccacacaaatgattctaaaaattgctagaacagtgttgcacaagattggaactagaacatcaaggtgtaggtctattgaagcaaaggggaaactacccttaaccctaaagattgaaatagaccgatttgagagcaatgcacaaaagggagagggatttaccagttgaaggagttgaatcacaccaagaaactaccctctattggtgcaaatcgatgagcacctattccttcacctagggttcc

SEQ ID NO: 77018 - DNA, 750 bp, Oryza sativa
atttgcagtttacagtatgataattcagctttgccggaagaaagtatgaactgataatggatatttcactaagcaatgaaattgcatccagcctttccatctggatgcgcacagaaccaagaagaaaagaaaaacgattgattgataaattggtgatgcaataagaaggatgtaccctgcaacaactgggtagacagcgtttctccactcattctgatggtgtgcaggtcagagtgacaaatcccacagtacagcacctttatagcgacgtcgtcatctccagttttcctgaaaaatggcaatatatagaacacaagtcagaaacatatactatttctctactgagccaataaccttttagcagaactgcagtggttattacttcagcattgagagttcagactctcaagtacacaagaagagagagcctaaacaccatgcttcacctcccaagattttaactaagccatgaactggtagaactgaaatttttcttttattttgctttcccttttactttatctgaagtatttcagggaactaattcagtaccatcaaatcaacagccttgaactgctgaagctgaaagaagatgcatgcttacaacactagcaagtgaattggcatacagcaagatcctcaatttaccatcacacagatggctgtaaacttgtgaaaattcacataggctcgacaaaaaaactggtaacaaaaacaagccatgtgcagcaagccgcctactgcttgaaa

SEQ ID NO: 77019 - DNA, 583 bp, Oryza sativa
tcctgcagccctgtttgtaatatcgagaacagtcaaatggtttcaggctacaatgttatatgctacttagattgtaggaagatcaattatctaaccttgaccattgtcatttgcccgcaagacaacaaaaacatacttcagaagaggaatgagggtaagggtgtaaatgatcaaggaaagagcaccaataacatcctcttcatcgtctactccatgaggaaaggcatatagaacacatacaatggtgatgtacccaagtcaccaaagaccacccccaggctctgaaatgcaagccgcagtatcaaaagcgacgaaaacttctgtattaaggaaaaacagtcaatacaaattactgatttaccagctcacttacttcaattagaacagtataaacatccagttttttcatgccctacaaatggcaaactaaatattcgtgcactaccatccatctaatcagcaaattcattatctaaaaaagttagtagtgaatctgccaatgaaatgaattattcacatgcagagaccgatctttacatctacttcaactattctgaaagccctcatttgtgcaaaacaaatc

SEQ ID NO: 77020 - DNA, 681 bp, Oryza sativa
ttcctgcacccctgacgtgcattgtgaaatggagggagtagttgtgattgattagaaagagaatgttgatggagaaattgttatattttgagacaaattctaagtactataagttgttatattttgggatggagggagtattattttagcctgtgtggataaaagtttcggctgatctgacgcgcttgatctgtagtgtgaagatttaagatggaggaatgaatagtggtcttgcatgctggtgaaaactaacctatacgctgcacgcgcctctcgttatcttgtttcgttttggatggattaattagcgggtccatcttttatcatatgattatgtttattcatacggtttgttagcaactaaaaacttgtaataagaataattttacacgtgttgttaacgattcaaagcaaatgataaataaaactcataaattaactttaaaaatttcaattttagcataaagtataagtatagacgaaaagatgatgttgtaattaacctgcgatcttttgaaagtgagaatttattataatatggttttaaatccattattttaattttataatagctatttcattatctttttttatgatttattcagccagcaatcctcagtcagataagattatcctccacttcggccaactcaatttggagagcatgacttgcagcagcag

SEQ ID NO: 77021 - DNA, 977 bp, Oryza sativa
cttatttggaccggacgggggcctgacccacgcagacgtaaacgccaggagggcaacccgccgctggctcgctttatatcccgcgtgagctccacaccgagcgaagcggaggtccggaggaggaagcgcgagagaagctcagctaggcagggcgacgggcagaaacgcgaccacggcaacaaaccccgccgcgcgcgcccaccgtgccggttacatgggagtagaggcgggcggcggctgcggtgggagggcggtagtcaccggattctacgtctggggctgggagttcctcaccgccctcctgctcttctcggccaccacctcctactagctatacacacccatctcaccataacacacatacatagatagatagatagatagatacatacacacaaacataagtagctaggtagagaaagagatcatagcgttaggtgatcgatcgatggctgctgctgaggcggcggcggcggtggggaagcagcagcagaagggcggcgggggaaggggaggaggcggcggtgggccggcgccgttcctgacgaagacgaaccagatggtggaggagagcgcgacggacgaggtgatctcgtggggaaaggaggggcggtcgttcgtggtgtggaagccggtggagttcgcccgcgacctcctcccgctccacttcaagcactgcaacttctcctccttcgtccgccagctcaacacctacgtacgtacacattacacacactcgatctcttgctccatctcgatactcgatctcctaactttgttgatttgatcatcatatcatcatcctgcactgcatgcgtacgtcgaataattcctgtatctgcgttctgtattcaactgcaggacgccttgaacggcgtccttttgggttagatgacgatgtacttgcagggttgacgtttcttgtctgtgggcgagctttcgctgtcgtggccgagctgtgttcattacgtttccat

SEQ ID NO: 77022 - DNA, 865 bp, Oryza sativa
cctgcgccccagaagctgatgtaactccaaaccaaaaggaccaataaccaattactaactaactaactagtatcataatcactaactaattaccaagtaagtaagtagtaattactaacttgccaggtcagcatctttagttcttttcacagcttcagaaaggcacaaacaaaccaaaggcttatatcagccagaagcagcagcagtagccagcagccagcagccacagccagcaaagaaagaagccaagaagcgccaaaggaggaagaagactcctctctcttctcctcccttggctgcaattgcaatactgcaatacagcaaatccatatccagagaagcggttgaattccaggagccgtgtttgcgcagagaacgcatgctgcttctggaatcgtttcctgcctacttttcttctcctcccgtttggctgggcgccgctgctctctccgcctcagctcctcctcctcctcctcgtcgctctcttccctgtcgcggctgttgcgttttgccagttagagcccgactgcgtcggagccgtggcggggattgttgttgccggtgccaaaaatctgatcttggcgaaggttttggggtggaaagattgggttttctttggctgggattttcatggttataggaacctgtggcagacaggatttggagttctgagtttgaagtacttttgatgtgattcttggcgcttcggagatccatttttgtgggtttgttgcgaggctctgaagtttttcgctatcaaaggtgtggaagcaatttatttttccagtacagaaggactgttagtactgtggagatttcgttgggagctcaaatgtttgtctgattagctaaagctccaatcatt

SEQ ID NO: 77023 - DNA, 534 bp, Oryza sativa
cggactgggcgacaaatagagggatccaaagtgaacttattccaacggaagaggagaaggcccataattcatagtgggccgtacttgaggactggcccaaattttgccgttcgtctttgcattgcaggtttttctctgaacctgattcggctcttgccgctcacagatccagccagcttctttcaaggcgaaactgatcaatggtactgaccaaaatatgaatattttttttattttttcatgaagtaatgaagagaaaggtaaaattaaataggtggactagtcgtaattggttaagatgaaagagtaagtaaagaaattaaacaagagatacattgtgtttgattgagatgaataagtatgccaagaaattattatattttgagataattttaaaatgctagaaactgctatatcttcggacgcagagcagtagatcatttgtcagattggatggattgtgctactgtacatgcatagtgtttcagactttcagcaggtggagcaaaatggattcagaatgttgtcaagagt

SEQ ID NO: 77024 - DNA, 683 bp, Oryza sativa
ccagttttgaggttgtgggtaatgattgcgcaagaaaataagggaggcaaaatagacgtatccttttggattctgattttgaatgagagaagaaattgacaagcaatatcacgagccgagcccatttgcccctctgtttcctgtgactagcaagttctgttactgttactactgcgtctgaaagtctcaatgaacttttgctctgagataaagcctatataaaattaccaattcatgtcagagtagcaaaaaataaaaactgtcttggctcttgaatcttgcacggatttatatcaccaattcaaaaacaaataaacaaaagagaaatggagaagatgaatgtagagcacaaccatctctgccgagtgccgacttctcgagcaagtgttgattatgcagaatataaagttgatagtgataagacaacactgtggagtagtagttaagattaattatttgtaattgataatgtcttaagttcatttgttctttttttctcaatgcatgacgaccacttttctgtttatagaaaccaattggctacaaacgttcaaccgaaaaaggacagacagatctaatcacaaacagctgcttcatcactcatcagtgactgttagaacagataaaccggcattaagttgctgtattataatcaggggaaggacatgcgacatgacgatcac

SEQ ID NO: 77025 - DNA, 800 bp, Oryza sativa
cctcttcttcctcctccgtaaaaatccagagagcaccactgccaactgcatgcgtaatgcatattcctaacacgtgtggccgtcatgaaaatcaccatttttcgttggtctcataatttaagagttgatataatatcatacttagcctgaaaaagctgtacttttttatgggctttcatgactgattcaattatagtatatcgagtgaggatgacaagtcagtgccactacatgatctaccgtagtatatttaagtcattaagtgcaccgagaaggaagagtagttcgatgtttgtgttacctatctctctacctcttattcaagttctgtccaaaatcacagtcaaaatttctgccagtgacggctcatcatctacttaattatcttcttcttcttcttcttcctcggttctcctcatcctgaagaaactgtagctaagctgcccattatcatcctctctctgtgattgtttggtgtgtcgcttcttcgatgtcaggggaggatgaagcgaagccggtgaccgtgaagatcatcgagacggtgtacgtggaggccgacaccgccgacgacttcaagtccgtcgtccagaggctcaccggcaaggacgccgtcgccggcgatgcaccggagctgaatagtgcccagaggtttggctcagggagagaggccagtcgccatggcgatcacaaggtaggctcctccagcgaaaagaagagcagctaataaagaagctattgctgcatgaataagcatagcataacttgcatgctacctcttcaattattattttttagtaaat

SEQ ID NO: 77026 - DNA, 608 bp, Oryza sativa
ctgggcctcactcaaagacaagctgtgatttagctttcaggcgaaggcgcaagctagtttttttgaagatagggtgagtccccacccaaaagaagagtaggtagaagtggtgcatgtggtatccccttgagatataaaaggaggaccttgctcacttaagaggggaagaagggggagaagacctgagctcgtagagaagagaaagaggaagagggtttctagagtttgaactctcttgctctccagctctttgtaactccttcatacacagatccaccagaacacaggagtagggtattacgcttctcagcggcccgaacctgtctacatcgcccgtgtcttgcgctgtcacgcccggaatttctatccaaaattccaaacgcttacatgtgtgtgaaccctcgtctaggaatcagccgaggcacacaataacaaattgataatagagtacaattattactctaattaataagcgaataaaatgtcattacagaggtagatagttcctctcaatcaataaagatctaagcagcggaaagaaagataaacggcgcagacgactccattccacaggcagcttgaccagggctacacctaatcctccacac

SEQ ID NO: 77027 - DNA, 12216 bp, Oryza sativa
agaacagggcaacagctattaacattacaatccatcatactattctagttacagcaatcaattggtgaatatgaggacaaaggattcagacaatcccatcacagatgaaagggaaagagtggaaaggaaccttcaggtgcaatattattcagaaaataaaaaagtatttttattggaggaaagcaaccaacagcatataaagggaactataaggttgaaaatcctatgcagcccatggatgttaaactgtcgtgcatatacttgcagttaaatatggcgctagggatcgttcacatattagaacatgcatatttgtagccatatatgtatgtgcacatcctggttaatcattctggtattagaccaaaaaagaagaagagagaaactgcgctgaggttgagcatccgaggttttttttggtctggacaagagttggtactgactcaatgaatgtacaagtgtacaaagtatcatcaatatgccaatatgaaacaaataccacgcaaagattatgtgatttcgcagcttgataccttgagtgatgtgagcatggatggattgagcgtttggccatttgccactctctcaatgcgtgagcttccaacaatcactccaacggcccaggggctgcagatcttcacaacatcacacccagcaaattgcgacaaagtgtttctattagtgtaatgcttaaaattggaatgctggaaaaaaacgaggaaaaaataatcaatgaataggaatcatggatcaaaccggaacaagaactgaagcgtgaatcgacgtttcgccctccctccgagtcaccgctgtcccgcctgactccccacgccggatctgaccggccgacggctaccacctgagccagatctgtgcaggcaacgtcggccctcgcgcgaaacctggctgccaagcctttctctctataagacctggccggccgacgaccgggaaccgctgcgctttccgccgccgccgccgccgccggagctcgtggtcggcctctcgagctcatcgtgtgaggcgaacagtgtgcgaggtgagcaagtgagccgcacggcccattatgaccaatggcccaacagatagtgggccaagaaggtggctatcagaacagcccaaatacggcagaaggaaatccgcttctcttttttttttttttgagaaggtggaaatccgctataggtacggttttcctagtacgtctcggattggtttcgcaatcgcattgtccgtccggtccctatatattcagtagatccccggcatcgaaagcgtactagaccattagtagcttgtttgtcgatcaatgggttctcttgtgtctcggttgatggcgacttgtgtacaagaggaaaaagaactagaggagaaagaagaagaagaagtagaagaagaagacgaaaatgaagaagaagaagaggaggaggaggaggatcctcagccttatgtgcctagccgcccgcttccatccgaagagtaagtacactagtacgactgatttgattatatcggggtatgtatccctaaactgttaaaaaaaattgtatttgacggcaaatccccgtgcattaatttacagggtgcgcgacggctattccattcgcgaggcccacgccgctcttgactactacaatgccaatcatacggtaattaagtgtatatgaatttactactagtatttaatgtttatgaatcacttgcttaattatatagatgaaaagtgaattgatatattattgatctttcgctacgtaattatttagatgtgtgtctgatcgatatgatttattttataattaatttcagggagcggagtatgaactcgtcaagccattgatggcggcctgcgttttcttcaagcgtcgcatgtggtaccacgttagcttgttggcgcgcaggaaggatcagaccactgcaccacccatcgaatacttcttcgccgagctacgcgagggcgcatccgactccttcatcgttgaagcatgcaccatgatcggtaagctttccgtgtgttaatttctttctaataacaatgcttaataatttgatgaatgtctccatcaatcaatgtgtctaagaaaatcggccaatcatcctaaattcctaattcagcttaattgatatgttttctctctgtcagaaaatccgcaaagctgctccgggaacaagtgttcactttgccctactcgctatgagatcgtgcaccctagcgaagaggagcttttgtgtggaaaggaaggagatgtcaaggactttctgcggttgaggaatttgtccccgttgccgttcacatgccccgtcacagtgcctgaaattgaaattgtggttgaaaaatagtaactactagcaaattagcaactgctcgcaaacattcttagcgacctgtttatttgcacatctgacagctggacacgatcgatacatagatcggtgtatcatgagggtgccccggctttgtggttaatctcgggcatgtagtggcctctatgatgccctttgtaatattaaaacttattttttctctcctcataagctattaacacgtcaggcaaagttctttgatatcttttcaaaaaggaatatatcaattcaaattcaggtatcatcaaacaaattctaatcgtagctgtgcttaggtgtgcccctcttcttagtaacaattcctctttttattttagctttaagatacaagtgagacgatccattaatccacctacagattgaataaatggatttgcgggtccacccacttactcccttatttgcccatctgttttgggtacgtgtctgctctccttaaaacttatttcttgtcatgctctaaaaatctttaataacccacaagtcagtacaactgtttacagtgcataagaacagctcgcaggcattcgaaagttaaaacttaaaaatgttgtgacaactcggcgattactcacagaaatctcaacatatgagctagtactagaaaacaatccatgggcgattgctaatcaggtagtgtatatcgaaaaatatatatgattcgttatacgtgttttgatataatcaatgctctaaatctccggagatttagaacactggatataatacagtacaaatgaattgcaccaatgatgaattagtagagtacagaacccctacatgaatcttgcagccgctcacgtgtgtcgggcggcggcgcagatgccagataaagggatgcctgaactcgccatccgtccccctctggctcaattgctggtgcgtatggcggtgagcccggccggcgtgtgcgtcctcccaatggtcgacgcctcgacgggtagcctagccgctgcacctcaagctagctgatcctcttgctcggcagaggcagacgtggaggaacacgctgaccccggagcgacgcacgcagcgatgatcatcgatcaagtgctagctagctgatcctcgtcggcggccacgcttcgccgtcgtttccttgaggctgtgctggtggtcgcgggaagccatgcggcggattcccatctcgatcggagcctccaactccaagttccaacacctggatcgaagccagccgccgacgcagagacgcagtcctggctggaggagataacgagagaggaggtcagagagagagaggagaataaatagctttgatgtaaaaaggtgggacccacatgtaagtcgtaggtcgagatgtatacacgaatcaaggaacataatcaaacggtggggaagcacttcttctcacgaatctccaagcatcccaaccctgtttaaagctgcttgtttccctcctcttcttcttcttcctccttccgccccttcctcctcgtctctgttttctccatcctcccgtcaacctccgcctcgtctcgtcacctcccaggatcggaggatccccacctcggcaatcgagaaagaacacgacggtgaagcaggcacctccgttccagcccatcgcgccaccggcgttgagttcttgcccccgcctgcatcttcccgtcaacctccgcctcgtcgcctcccagggccaggatcccacctccggaaccaagaaagggcacgagggtgaggcgggcgccaccggcgttgaggtattgttgctgctcgtctcccgccggcgaaccttgtgacgattccccggccggtgaattcaagaagccaagaacttgaccaagaaacacctgatgcgatggaccgggttcacggcaaggatggcgcagaggaagctcccgctggcgcttcacatcattcctcctgctactgctccttctcctcctcgtctccgacttctagcgacgatcgtccaggcgtgagagccatcccctgctccagccatcatgacgagagagaaattgcagaagcagactgctgcgctggggccggcgccggtgtacatctctccggctgctcgtcttcgccggaaaacgctcttgcccacggctacattagctggaagcttgactttcctcccgtcctcatccttgtggcctcctgccccagcgatcatgttgggttttccggcgagcagcccatccagggagcaagaatacaagtagccccgagagacacggcaagctgtgccatttcctctggcgaagaccatcccagcttcatcatgacagtcatcagcgagtctgctgagttccaatctggccatcccagacgagaggtaattccctaacccttgtcagaataatctcttaaaaagccatcccagaaaccatcatgttgccttgcaaatataagttagaagaaatatgaatagcgtcactatttctgagaagaaaatgtatactgacctcttaggaagtactatcatgtctctgaataataattcgttgattatgtatagcaccccaaaatccaattgccttagccattactttccatgtttatttcccactgtgaataaaccatatcacaatcgatgcattgcgtttatccttgaatattttatgaaataaaaacgaacatcaaattaggacgctaaattatgtgccaatgataactaatttactgaaacaaatggatattgcaggatttggaaaggaatttatattcagaaaatgatgaactgttcgactcaatttgcaatagactatagtatgacataaagaatgggcgtgaaaatcaataattagcagactgtatacagtgatacagattagttcataggcactgaaagttggtatgccttttaactaacctgtatcactgcatgtactggtacaacaaagattagccagaccaaagaaatagataaaatacctgtgtggattccagatgcgatgataagggatggatcttcatatgtgcaaataattttgccagattctatatcaaaattactcctttatcagcaaagagcctcatgtggtgtcttggacatatcatgaaaaatgtgcatgccactctattccaaaaaaaaaaaaaactgcaaattagagctaccatcgagtcaaatgcaatccagagatgcattttacctacacctggcttgagcaccaccaataactaagcacttaatcagttaatccggatcagaagcactgcaccgtcaagaatttgatgcattacagccttcttttagaatttcctctgcaggcacaatagttaaaagtttttgttaccatactgaagaaacatgttgcaaaaagtttttttcaccactatgatgccattttgtgatatgtgtagcattgtggttatttataaatcatgctaaatctacaatgatattcttactttgtaaatcttacttaatctaaattatggtaatgggacaggtaaaagcaaaacaaggaacgccacagctcaagcttggttttaatgattgtgatgaaaatttagctgccccaaacttattacacttgctcatggacaacatcctaagggatgtattggaattctccatcagttgggtcacactacgacggtatcaaccaaaacttccgagtgaatggagttggtggatggcaatgggttcactgttcattcagatagatggttggttactgtccatatcctctcattaaaaaattttgataaccgctgaacaaaacaaatgtatgttgactctattggttactgatcttgttacaggaatatgctctatagctgccagtgttatgtgtgtggaagcacaacataggctagcctttgagatcctacatggaattggtaggttccccttaaaagcaaagagactcaagggtgtaaagaagaaatgcataaacaaaaaaggtgtggagccctgcagacggagcatttgtagaggatgtgctgaaggtggtggcgaagggaaggggagtggagacaatacagggtatcttcttaccaataaatggatatcatatgtacaaaaatgtccagaaagacgtcagtcatgaggcagcaggtgcttctcttacttgcccatggtccactgctggcaacattgtgggtgaatgacgagtacatgatctgcacaacaaagaatgatcttgtctaccgtgggagcagcaacagggaaaaggatcccaatcatacggtggtctgcttcgcttatcggtttgttggcgaggaattacgagtgcatagatgaaatccacctgttgacactaaaggaacctttaaccaaagaactcatcgacagatacagaaagaagggacagactgagagcttcttgtcaaactctgcaaacaaagtaaaggccatgctgattcgaagactaatgactaagtactcagaattagagagcagtcagggatctagcagttgtggtaggcagagttgggaaaaatagtcaaacttgttcaggtatacacattgaacaacggatcttgtattgaactcggaagcaaagtacatgagttacattgcctcaagagtagttctgaaagccacggttatgcacttatttgtcgttcagtctcttccagatgaaacttagttttattattattatttcttttgtgttgtttccacgatcaagttgttctgcttctttttattctctggactctttatagatttctcctttacccatatgctggaccattcacttcaaacataatatagtgaacttaacaagttttcagatattagcacacaaactatttgaactaacgtgacctctgctcagcctctgttatacacaaccacagaaaaaaggatttctataaaaagaacctttaaaaaaaatggctctgtaatgaaactgtagcaactaatcatggtgcaagcagatttattgctttcccatcacttaattcagaaacacttgctattctgaacatattacagtatataacaacataactatttgtatgttctataggttgattttccatcttggtggtatttatatatattgaaagaaaacaccatatgtttatagtacacgcaacataatcgatttaatgtgatacgcacctcttgttgcagcaagatcatccttcctaccttccaattatatcaccaatccaggtagttaggtactgtctttaactctttataactaatctgaaaattcaaaaatcaggtcaagtgtttttttaaatcaccaccagaagcaaaagatatgttatatgttcaatcagaacagggcaacagctattaacattacaatccatcatactattctagttacagcaatcaattggtgaatatgaggacaaaggattcagacaatcccatcacagatgaaagggaaagagtggaaaggaaccttcaggtgcaatattattcagaaaataaaaatgtacttttattggaggaaagcaaccaacagcatataaagggaactataaggtggaaaatctatgcagcccatggatgttaaactgtcgtgcatatactttttttgccgggttggccgaaagttcggtcgaccaatttcattaagattgggagaaaggatcattacaatagaagcttacaacgacgaaatgattggggaaaaaaccccaaccatgtaagctatagttgtatgctacagggattacaaattaatcattatcgccattacaagtggtgaaaattcctgccgacttccaaatgaggatctcctccttgatgtcgctcactagctgctctgtgcttcaaaatttctgctcgaacactcgcgcattacgctccttccacaggaaccagcaggttagtgcgaagacgccgtcgaaaatgtccctatagcccgtccaaaaattcagtctcgccgccatccaccattcagttaggcttgtatcgttgattgttggtggcgcaaagccgatgccaatccatctttgcatcaaagtccagactctcctggataaatcgcaggttaggaaaagatgcaaacagctctcctcctctcgctgacataagtggcaagaatcgtcgtgcaaccaccctctcttctcaagattatcagctgttaaacaacgacctttggccgccagccacaggaagaatcacacccaggagggagccttgatatgccagataagttcactgaatgggcagatcttccttgccatgtagaagagctcatatgccgaagaggctgagagctggccatcggcagagaacttccaccgaatggtatcatcttcccgattgagaaccacctcctgaatctcgtcccatagctgaaagaactgcgctatagcttcatttgagagtgcacctcgcaggtctcgcacccatctattgttgctcagcgcctgagatattgtaatttgggaccggcccacataagtgtaaagggtcggccatctccaagaaatgctgtgtccattcaaccagtttgctgtccagaattttgtgtctttgccattgccaacacaaaactcggcggcagaactgaaaattcgctccacatctaatcccaggcgatatcctgccatggcccaaggacggtttttctgttctatacttttgactagccacttgagtctcagcgcctgtccaaaagcatccaggtttcacttgagtccccagtcctccatttgtcaccggcacacaaacatttttccaggccacgagaatatatatatatagttaatttaaacatgcatatttgtagccatatatatatgtgcacatcctggttaatcattctggtattagaacaaaaaaaaaagaagagagaaactgcgctgaggtttgagcatcggagggtttttttttttttggtctggacaagagtttgtactgactcaatgaatgtacaagtgtacaaagtatcatcaatatggcaatatgaaacaaatactacgcaaagattatgtgatttcgcagcttgataccttgagtgatgtgagcatggatggattgagcgtttggccatttgccactctctcaatgcgtgaccttccaacaatcactccaacggcccaggggctgcagatcttcagttcttcacaccatcacacccagcaaactgcgacaaaatgtttctattagtaatgcttaaaattggaatgctggaaaaaaacgaggaaaaaataatcaatgaataggaataatggatcaaaccggaacaagaactgaagcgtgaatcgacgtttcgccctccctccgagtcaccgccgtcccgcctgactccccacgcctgatctgaccggccgacggctaccacctgagccagatctgtgcaggaaacgtcggcccccgcgcgaaacctggctgccaagcctttctctctataagacctggccggccgacgaccgggaaccgctgcgctttccgccgccgccggagctcgtggtcggcctctcgagctcatcgtgtgaggcgaacagtgtgcgaggtgagcaagtgagccgcacggcccattatgaccaatggcccaacagatagtgggccaagaaggtgactatcagaacagcccaaatacggcagaaggaaatccgcttcttcatcatgatacttaacgcctgttcactttgatgtcatttttaaccttatcaagttttggtaaagttgcaaaaaaaagtgtctatatttagtttgctgccaaattttggtaactatataagaaatcattacagaattttagcaagttaccaaaattttgacaactatgccaaaatttggtaaggttttttttggcatcaaagtgaacaggcccttacttttcatcaagtccactttgcgtcccccaactttacgtcgaatctataagtactagaaatctctatccctcaagtgttcaaaaccgtataaaataggtcatgcaagtatgcatgagtagtttcgctgacgtggcatcctagtcaacaaggagagaattaaaataatgtggaacccacatgtaagtcacacgaaaaacatataaaataaaaacttatctcccacctctccccaagcgcacggcggcaacgacgcacctttctctccatcccgagcttcagccgcgggcgcagggaggcagaggttgaggcggggcgcaaggaggccgaggacagcgctgccgacgaggtcaagacggacctatcactcgctgcaacacaggaataggcggcggatgcatcctcctcactctcctcctgccatcaccgttgagcccaaccccaccgagccggtcccaacggcattcacctccatatccggagtggcggcagcccaggaggacagaatcgacggtcgtaggttctccatagtgaggaagtggtggtgttgaggacggatatcgaggtggaggctatcgagccggtaacatcaaatttggtaaagatactcgaagttgaagtccagatcgaagcggatttgaaggagataagattgtttccaaacagaatagcgtatcgtctggaggctgtatcagttgatacggaatcagattcagttagccgataggggtaggaaagccaatacaagcagtgttcaagatcaagttggattcagattaaaagcttcagaggtattgccgaataagagttgattttgtaatgggtaattatatctattaattagggataagagttagttgtttccattaagaaatttgtgggaggaatccgcctagggattcatttgtttatcgtactttagcaagtttgagtcttgtccgatatggacatggtttgtatgttacgggtataaatatatgcctaggggcttgtaaaaaaacaatagttcaatacacgttttcggcacatcgcctcacctttgttttacttttctcgacgagttcttgtttcgaattgggctacattggtttcgctctccaggaagaggtatagcttatcatagcggtttgtatcggcggattagcacgtcgttttagatgttttaatatatcttttctaattgttggttatcatatatcttagttaatttagtccaattattcgatttatttgtattaacggaacctttcttaaggttttaagattgtacaatatctcataataaaagcacagtgaaatgatatggttctcctaattttgtgtattttcaagtggtagtgctgtgagaatgggaaaaaaaaatacacatgtgattttctacatatgtcaaagcaatttttttcaatcataggtaacatgtcatatgtacaaggtatgctcatgtggatagttagatgaacaagtaactcacttgactcattagtgacctacttgatgcacccaatgaccctccatgcattttactcaattaaactgcactacagaaaaggggtggtaagtgaacttattcttttattatttttacatactcttttggtgggccttctgtcggcccactaacgtcgtcttcccttccggctggctgcgtctcctgccatcgacgacgacatggatcaaatcggattggaaaggaaggatataggaccgaatcggagagcgtttcggattctttctcctccttatatactactggtccgcagccaaggcgccacttcgatcggaaataagagatcgatcagacgccaccagaattatatatattgtgcgaagaaatttgatcagtccagttatcatattcgaaaaaaagtagtaataatctgttctgcccgatccatgggtgctctcgtgtctcgagctgccgctgccatgctaggcgatgcctcggatgaagcggagttgaggagatggatggaggaggatgctagacgtcaggccaggaagaggaagattatctgtgcacccgcccgctaccatccgaggagtacgtataaattgaaattgatctgaatagtaccggcttaaataggatggcaacggggcggggcggggacgggttggataagaacaccc

SEQ ID NO: 77028 - DNA, 18966 bp, Oryza sativa
ggggggtgagggggagctcacccccgcatcacccggggtgcacaaggctgccaatgttgaacggcaactcagaaagaatgaaagatggcatggggtgtaactactccactactccagtcagtaatcaatatatcacaaatgcacaattagtagtaatatgcattctagggagccggatgcccaaatacacataaacacaagtactaatgtagttaagtcctatgtatgacaaatacacaacaaccaactcacaagcaaagcagcagccagccaattagcagtatactagtagctttgctcgaggttgaggagctggccgcaggagtcaagctttgctcgagattgaggagctggtcgcaggagtcaagcactcggacagtcggacggcatgcctgcaacgcgcggcgatggcgctccactccggctcgatgttgcgggctccggcgctctggtcgccagcgtcgcgctccgcttcgccgccacgccgccgccgcacgcaatgggcgcccgggagctaccaaactaatttagggttaggtattcttcagatttttcttttatactatgctggttgggctgttgggctgacctttgtgggcttctttctcataatttttatcgactgggctacatacctcggggccccgcaggtacccgcgggtgggaatagccacccgcccccgcccccgcataattccggggccccgccccgatggacccgcggggtgaaatttgtacccgcccccagccccgtaggggcgggtactcggcgggtccccggccccgcggggcaaattgccatccctaggcttaaactgtttttttatacctttggtttatacttgatgatttgtattgtattgtactaactactatcgtccttcaatcaaaaaaaccagatgcaacaggtccctcaactattaaaactggtgtagataagatccctcgacagtttagatggtggttttggctgacgtggcgcctacgtggcaaattcgacttggtcttcatctgacgtggcgcttacgtggcaatttgatccgaaaaaataataaaccatgtgggacccacatgtctgtttcacatacaaaataataaaaatggtgggacccacgtgggccccacatgtcatcctcctacccctcatcttcttcccgttatcctctctctcttcttcacgatgtgcactagggcagcgggcgaagtggggcgaccgcggcccggagcggtggcgcgcgaagaccacctccaactgcgacgagctcgaagaccacctctacgttgccgccgccgccgcggcagccagcacacccactgcctcatccactccgaccacgaccccgccgtcctccaactccaacctcctcctccacccgccggccggcgccgcgccctccaagtccaaccgcatcagcctccctaccaatcccaatcgcaaccccaaaccctagccttccctctcctccatgcctcccgtgatggaggtcgagatcaagctccgtctccccgacgccgctgcgcaccgtcgcctctcctcattccttgtgccccgcctccaccgcgcaccgccgcctctcctccttcctcgcgccccgcctccgccgcaccaccgccgcgcgccccctctgcgccgccaccgccgtgctccgcgtccgtctctacggcctcgaagaccgggccgtcgtcgcactcaagcgccgcccgcgcatcgacgccggcgtcagccgcgtcgaggaggtcgaggagcctctcgagcccgccatcgccctcgaggatgaggaggcgttggtggcgagtgggggaggcagtggttgacgcgcgtgacgaggtaggtggtgaatcggtgggggcgcggggcgccgtgacagagcatgtggacgcggagcgcgtcgcggatttctcccgctcccctcggcctccgcccgtggctcctatacttccgccggccgagcacacgcgccactcctctcctccctccggccggtgcccacgcccgcgcctgcgcaccgctcctctcctccctccggctgacgctcgtgtgctgcttctttcccagcggccgccggcgataggctcgagggggtggaagcggaggaggtcacgcctctccaggccgtcgttatctccgccggctggcgagactgcgagaggagggaggagaggggagagagatggagagaggaggaagaagaggaaggctgggagtatgacatgtgggccccacatgggtcccaccattttttaatgtgaaactgacatgtgggtcccatgggttttattattttttccgatcgaattgtcacgtaagcgccacgtcaatgccacgtcagacgaagaccgagtccaattggccacgtagacgccacgtctgccaaaaccacccttaaaaccgctaagggacctaatctgcgccggttttgatagttgagggactcgttgtgtctggttttccgtttgagggatgaaaatcagattcattgacaagttgagggacctcagatggactttattcctttccgcgcagcgagcggtaaatcgttaattaacttgagtgctgggccggcggaagtcaaaatagtttctttaggccgtggtgctgtggtgggttaaatgtggccgagcggacgctttcggcaccgagtacgagtgcacgcctcacgaaacaacggaacggagggactctacgattggtcactcgatttaaaatggagtcggttcacattagatcccttaatttgtcaccgagtcggaaattcattgctaaaccaaattatcatatataaccgatctctcaatttataaaactggatcacctgagatctaggtagtattgtgtaaggttttaactgacgtgacaagctgacttagcatgggacccacgtgggccccacatgccagtgggtagcactttcattctcctctttctctccccttctccctcttcccaatcgttctggacgtcggctgcccgccagccaacgttttcgtcgtcgtctccttagctcctgctggtacatacgcatcaagacaactagatgaaactccgcacattgttgcgggagcttagtatgataacaataagtaaaaataatgtgtaacataggtacataacataagattacgtaagttaacgtggtttatgataatttaattttaatagtatatagaatgatgattaaatgtaaaagtaaggtgatatgattttatgaaagaagaaaaatattgagatagtttgggcctatttgaaagtagaaagacttatttggaaatcatggatatacacggtgatgtaataactttgtaaattctatctctctccctatttgtaaatattatttatatatatatatatatatatgcgcgcgcgcacatggtggcgctacgaaggaagtagcgcgcctctcagcgctcgccttcctggcttttagttttttctgggtccaacttcggatttctcgcttttctcatgtgccgcatcctcatggaccgcttttactactaccaccgcctgcaaaggcttttcccatcccatttgtcccgagttaaaaagttactcgtctggtgatgtgaacgcttaatgagtaaaaaaattatacggcaagtaaaaaaatcactggatcatctctcctctaatttgcctgtacaccactcctagtatatattaattgcagggtgcgcgacggctattccatttggaaagctcgcgccgctcttcaccattacaatgccaatcatccggtaagcagcttatatgtgtgtgcatcactttcttcgctctttacttatacgtagatgtgtgcttatgttgttcacggattaaattaaattaaattcagggagcggagtatgatctcgtcaagcctttgatggccgcctgcgtcattttcagaggtaaactgtggcatcatgtcagcttcttggctcacaggagggatcagctggttgcaccacccgttgaatacttcttcgcagagctacgcgatggctgctccgacgacgactccatcgtcgaagcttgcaccatgatcggtaagtaaaattaccctattcttacaaaagtcatctacattcagattcagaattattcttattcaccagtctaaaagcaattattcttattcagctttctttctttcttactttcgatcttcccatttcagaaaatccacagagctgctccggaaacaagtgttcgttttgccctgaacaatatcaaattgcgcacccgagcgagcaggagcttttatgtggaaaagaagaacatgccaaggactttatcagactgatgaatatgtccccgatgcccttcacatgctccaccgaaacgcctgagattggaattgtgattgaacaatagcaatatgcatgaaggcattattatggagcatgccttcatattagggtccataatataataaaagccttcatgcatcatcaagtgtacatattatggtcatgatgtaacaaatgcatatgttattggtttgatgctattcataagagaacagaaacggcacctgacctgcttgcacaaaagctgacgttgaacctcgttgcagatgcacaaacatcgatatgatcaaatttccacataatattttttttaaaaaaagagaaggtcgatcattcattctccttttactactagagaaaaatattatcagataattaatcagaaacaaaaatgcatttttttccctttaatcatgttggaggcagccattaaagtggctcgctgttatttcagtttgttcagactattggatgatctgttccatgctttttttttaaaaaaaaagaaaagaaaaacgtactatcttcaactgtgtagtgtagctgtgtagatcacttattataggctatttcttaggtttcaaaatatttaacttatacatgtaacctaatcagtaatccgtagcaataatctcaatcaatcaagatctgtttaactattcttcttttggttagcagcgatgtggttttcattgatatggagcgagcagtagcaaaaatgagatctttcgtttagacagaagagagatcctttccttcctttctataggaaatgactgatattgctaagtcatcttcggctgctcttgcattatcccttttccaattctttttgtatggctcggttgcatccgactgatcgatccctagtcactgattacatacatgagtattggctttggcaagcaagtcaaggaaagaagaggaaattaagggcctgttcactttaatgccatttttaaccttaccaaattttggtaaaattgtcaaaaaagtggctacatttagtttactgtcaaattttggtaactatataaaaaatccggccaaaaatttggtaaggtttttttggcatcaaagtgaacaggccctaaaagttctcttgagtttgatggtactaagttagatgtcacaaatagaaattcatggtctactgtatgcatgtatgtgctaaaagaatataaaaaatcggggaatcacttaataagaaattctaactattgttcaaaactcaaagtaccactgaagaaatagaattaaatggttaactaagatttttttttgactggctatatggagcggatttaacgtccctctacacaccatcaatagaaagacacgagagatgaggtaagaagagggagagaagaaaatagtagaggtctgaaatttagataagtctcctctaaattttattctcgatccgctctatgcatgtgatttcttatgttcagcaacatggttttatacaatttatattttacgaaatgaaaagctataccgtcatttatattttgaaaaagatcttttttttaagaaaaaactaaacgacagagatagagaagggagacacgtgttggtgggattgggattccacatcctctccttgtcgattccaaatccccttcttcgattgcagtgttgcgcctcgcgaattccaaccccgatcgctcgcacggccggccgccatggagagccccacgtcgccggcgtcgcggctggacttctacgacttcatcggccgcatgcgccgccccgccgccgccgacctcttccactccatcaggaggtccgtcgcttcgcccccctccctgctcccctcctcgtaggcccttgccccgcgtcaattctgacctgagattcaactgcagcttcctcgcgtccctctcccagggcggcgagcccaacgccgaggtcgacggcggcagggtccagaccttcttcgcggagatggagaccgccatcagggaccacccgctttgggccaatgccaccaatcaggaaatcgacaacgcgctcgaggtgaccccgccctaacccttgcgcttgatttgctttctgattcaattgaacatcttgcgtctctcttgttatgcgcgattaggggcttgagaagtatatcatgaccaaattgttcgatcgagccttcgcttcatccgcggaggatgtgaaatccgacatggagatttcggagaagattggtctcttgcagcactttgtcaggcctcatcacttggacatacccaagcttctgcacaatgaggcagcgtggctggtaagacaacaatgacagatctttgagtcattatttcattgttccgggtgttagcccaaaattcagaacttcccatgtgatttttattgttcctgcacgcggcctgtacaagttcacaacgcattgttacctaatgctaatggtcaatagtctgcgactgtaacattgtgaacaatgaacttatgagttatacttataccccctagtaatatttttagatgcactctgaaagctttgtatattgatcacggtgtaaggtaaattgcaaattatcgtgttgggttactttgaattatctcttatataaaaccagcattagcttgcattttggtcaccatgtagaatatatgataaaaatgcatggggtcaacatttaagcgattatctttccctgtattcttcctatgattggttcattgctgtaattttacatctgcttgacataaaagaaatactgccacctgccatcaacacaccaatgcccaagttaactctgaccttgggatgtttatgccattctagcttgcagttaaagagttgcaaaagattaattccttcaaatcaccacgagaaaagcttagttgcatcatgagctgttgccaagtcatcaataacttgctgctaaatgtgtcaatgtcaaatgatcgaacactatcaggggctgatgattttcttcctattcttatttacattacaatcaaggtaagcttacttttgttcctatttattctttctctaatttttctcatccagattgacatgattacatgctgacagatcattgagtacttatgggggaaactattttgattcctcgaggggatgtcacctcgtttgcttaaaaaaacatctaaatgattatgaaaaattctggaaaaatttgacaacactcatataacatatctatacaactccacaaaatcttaggttgaaactcaactcacgtcgagatataaaaaaggacaaattcaacgtatgaacagagaacagtagcgtactgttcacatctaaatttatcttttttgtttctcaatgtgtagatcgaattagaacttgatttttggtagaccgatagatatcactatactctacggtctacattgtcaatttttttcagaatttttcgtaactatttatatcgaatttggaagaaaaaggtatacgaggggacatcccctcgagggattagaatccaatccctacttatggttcaagttttacaatcataaattttatgaatctcgtatcatatgtacagttaacattagggtgtttttacctttattctgtacagctaaattgggtaacattactgataaattgcattttgttacttgctaatgtgacaatgcctattttttacaatgtaactagtatagatgtttggtgtattaatgggatctaatggtcttatggtgtaaatttgattgtttctgtttgttattagttaatattactcttatatgccgcattgttaccaaagcttattttctttttggttcattaaggaatatgagtttctctagagagcatatgatactagtcagttgaaagctgttagttgtcaccaatgtctctgtgttactttgtgcattctacttagggaatcctatccctaatatatgcaactttttactatatggagttcaactgaccaagcacctaaaaaattgatgtaggccaatcctcctcagttgcactcaaatctaaagtttattcagctcttcagaagagaaacaaggcttatctctgaagtcgaatactatctcacgaacctcatttcagcaaagatgtttataatgaatgttaatggacactcactgtccatggaggaaagtgtgttccagacacatatggagtctgcaagacttggtaaccacatatctgttgctagcactaatagttcacaaggattgggtacatccacaccaggacagaacgaggaatctggtgatacagaaggtctgtttttaacattagtggatcagtttgtttcagaataaagtttcacctcaattaaagtattagtcttttttgcacgttcatggtaagtttccttctggacttcttgtctcgtctaagaatcagtttagttagcagctatacaagagcattctgtcaaagtatttgaggtgtctaccgtacctatgatgttcctcaatccatctaaggttgggtttagatttagttttcctggcttcagctgcataatcacgatgcttagttcatatttaacaggattgaaattcccattcatggactctgaaactgaaagcttgactccagcggaagtcaagcaattgcacgagctctacaggcaagtagtcaccagatatacgctgctgtctaaagctttaagaaagttatcggtagatgaggatcagctccttaattcagtagatgattgatgaagccatgtaaaaatgctgaccagagatgacatgtcctattaaccacataattgatcgagattgtacacgcacgcaaagttttccattgactgtaggaaagcaaacgagttccaggcatctgcaacatggttccagggattccaggatacactacaggtatggccaaatgatcatcagagttgagaatggattcttgtgcctttgcattgcaacttgcaagccctctgtaatagcgtccacttctgtaatttttagttcctgtctgccccactccttggagctagcgtagtctctaggtgtgcgtgaggaactgcatatggcacatgttgctgttgctgatcatgttcaaccgttctacctcgtacttcgtatgttatacagcaaatcttctgtgctgaaaggtatctgtttgccttggtgcaatggtgggtgaacgtggtgacattgtgagacatatgcatgatttgctcatgaagtcattatggctgtgttttgcaaaaagtttctatgggaagttgttcttaaaaagcatattaatctatttttcaagttttttattattaaaacttaattaatcaagcgttaatctatcgctccgttttacgtgtgttcccaaccccttcaaaagaacacagcctattatatccgagttctctgcttcattgttgagcagaacagtatactgatgctgccacaatctgctagtgcttgtgtaattaactgacaactggaagcatggggcaaccaatcatacatggcttctcttgctagaatagtaatatgcaaatatgactaattcagaatattcggtgatcaattctgagggttgagcttgaaggttttcttgtactcgtgaaagagtgattatacagtatcatgacaaaaaaaaaacagagacagtttgcttctgtcatgacagaacaaaagttcaaaaaaacgtggtcggcaggattcgaacctgcgcgggcaaagcccacatgatttctagtcatgcccgataaccactccggcacgaccaccttggggttgcaatcacatactttttttactaattgtttcatacaacaacactgcaatttgattcatattcgctacagatatcgtatcttttattcaaacaccgaccaaatcagttcatagatatcacagtcaccaccagatatcacacagcaatatcatgcgatggcgcgaactcatgttcatacatatatcactgcatcgtgtcatctgcgcacagctgcacataacgcacgcagctagcactgtcgcccaaacttgtcgtcactccagcttgtgctgctgggcggcgcgcccggggctccgagccgacgggtactcgagcagcgggtggagcggcggagccggcagcgcggcgagctggtggcgacgggcgctcgccggcggcgacggcgatggcgtggacagcaggaggcggaacgtccaggcgaggacgtcgggcgcgaaggcgcggaagacaaggaagacgtcgtaccagttggggtgcttcacgtgggcgtcgccgcggcacgcgccggcgaccaccatcctcgcgtacgcctccacttgcccgccggcgagcggcacctaattacatatgattaatcaatggcaagttaattaatcgacgagcagctatagcatttgattgttgaactaatctttacctctcgctcctcccctttccattgcatctctgcgccttcctcgagcatgaacttgccgccgctggcctcgccgccgatccagccgtgggtcgccacgctgatgcccacctcatcgcccacctcgtaccggagcgactcgtagaaatcgatcaccgccgccttggccgcctgcaggcacacacatgacagttttcagatgattctgaagaacttgctggtgaattttgagtagaagagagatgggttattacagagtagagggtcatcctgggcatgggcagccagatctcgacggcggcgttgacgacgacacggccatggctccgccgcaggtaggggagcgcggcgtacgtcgggtacacgttcccccagaagttgacgtcctgcacggcacggccggatcgaacacagttattgcagcagcagctgatgaaatttgatcaagaaatcgtaggcgtaccatgaggtgagggaacgcgaccgtgtcgccggcctcctcgaagcagaaatcgtggcccaagctcaccgtgttcaccagatggtttactgcatgcatcaatattaataagaaattcagaggtttgattaattgcaagtgatgcgtggtacaggtgactgacactggccgaagaagctgatggtgtcgccgacgagcctccggcagtcgtcctccttgacgacgtcggcggcgatgacgaggacctggccggcgccgagggcccgcgcgttctcccgcaccgcgaacagccggtgctcccgcctcgccaccagcaccaggttcgcgttcctccgcgcgtactcgtacgcgatttgctgcatgcaaacaccacaccgatgatctttgacgttcgccgaccgggcactggttatatgcttagcttaattacctctccgatggcggaggaggcgccggtgatgaggacgaccttgttgtgcatgttctccacggtgagcgtcttgacgacccactccacgccgcgcaggaaggagagcgtcggccacgcgaacgccagcatcaccatgctcgccggcggcaccaccaggtccagcaccgcgttcaccacctgctccatctcgatcgatcaatcaatcgatctctcccacactatacagttcctcttccgatccacagctcaatccaatccaattgaaagaatggatcaaccagcccgcctctggtttctggggttcttgggaggtgaagaaccgaggaggaggaagaagagggatcaaagatcgagtctctcaatgagtttgccaatttggtgaggacgatgagcagataaggacaggagaggacggacgggtgcaggcgtgcatggatggcagctgcgcaggcatgccgccatagacacacgtcgagcaggacgggaggcgccacggtgagaccacggggggaagaggcaagctttggccgctttcaaagccttgttccatatgcctttctcctccgatcggctgcatatattactcctccaccttaatccgcgcctactacaacatttacagttctgatcagatacaatatgcatcttgatgtgaaatcagagaaagggcctgtagcctatggttaatctccataatttgccttagaagatgttgtactgtgtaatttttttttttaaaaaagtcaatctccaggatttgacacagtgacgaagacctgctgagcggtgagtgactcatgcatgttagtcctccctcctttttttttaaaatagacgatgccgtttatcattcggtctaatttaaaatttttgtgcaaatacatatgatatcaattatgcttaaagtatttttagtgataaaatatctcacaacaaatatttttttaataagacgaataatcaaacgtgtgcttaaaagtcaaagtgtcctttattaaaaaacaatggtagtagtatttgcatgtgactaaaataataataaaaagaaattggtaatatcaattaggatgatacagacaaatatacaccaataaatttgatctacaaataaagaaataaaagtaataagatcagacattgaacaatacctatacaacgtaaataaaatttattatttttaattttttatgtatagatcgaatttagacttgtatatttatacaatatcttatatcttatatcgcgtgcaggcgataacagttagacgtagaaaatatttccctgtttacacagtgtgtaaactgtaaagtaattttgcacagcaacccttcgtttaccccgtattattattttcacgcccgtattctggatcgctaccactcgtcccgtttaaccgttggattttacatgggcggcctggatcgagaaggaggagggcggcccacgcgtatttctacgtgagcccttcccttttggaataactattatctttcacgctcctcccaagctttcgattctgaaccagaattccacggtgaatcgatcttccgacgccagatcgacgcgagttgagagacggccgtgctcaggacggcggagcgccggcgagatgcggaggcggcggcgccgccaccacgcgcgctcctaggttactttcctcttttttttttctctctttttgatgcttgtcttcagatgttcagagttcagaggagttagccaggtagggctcttgtgctacgtctgtgagagcttgtgtttagaactttagatcaaccattttatgtttttttttgggtgaaacaattgttgtagcagggagacaacgccctctctcctatccggtcgaaacatctaagatggtttatggaaagttcctaagtgtaaaacaaggaaaacactctcgagttggaaaacactctcgagtggaaaaacactatcgagttggaaaacattctcgggtggtttcttatcacttatatgtaactcatcttgtttggagatgatttctgaatacatggcaggtgaatctggcgatcgggaagttgttgaaggatgtgcaaaccctcaatcatagaagacattcggctaagagagctcgaaggaaaaaacctgctcgagtaaagatccggtcgaatggaagattctgtgggggccgtttctcaaccactcttgccagctggagccaaaagactagaatgaccctgagaatgtactaaaatacccctagggttgctgacatggcaagggcattataggaagatcactaaagcccatgagggtagaaatgtaacatcacatgtaagaccgtaggctataaaagccggtcaagtccctatagctagaggagacattttttaatacaaaaagtaatcctctaaagtggtgtttgctgtttgagcttatttctaaggataggtaggaaaatacttctttccggcctatccccaatcttgttcgtgacctaaggtcacaacaacaatcaatctctttttgattggagaagaaaaaaagaacatcgttttcttataaggcattgctgtatcataatccatacaaattggtctggcaagcctgaacaaattcttcttccgagcaaagcctgaaactgagaatatggacacatagcaagacttactttatgttgtaccacagtttcacagtagtaggacaaaatatttcaattttggcaatagtataacagcaactgcatcacccatgcatagcacgagtttatgatattcagatccaaattgtcgaagcggctgtactatgttactcttatgtacagaatgaaaaatcttcatctcctgaatgtaatcctttattcttgttgcatgacaccacattttgacaattacaaataggatcacctcaagcaatccaatggaaacgatatcgatggccactagaaagagcaacatcttgatgtaaaactgctggaatctgtcgcggagacttggatagattggccctctctgacagcaccagcaccagctccagcctcatctgcagccaatgccttcttgctgatgatccggtagatctcagtgagcactgtctgaaaagctttatccacattcgtcgcgtcgagcgccgaggtctcgacgaaggataggccctccctctctgcaaagcttgttgcgtcctccaaggacactgaccggagatgcttgaggtcgatcttgttgccgatgagcatgacgacgatgttggagtcggcatggtcacggagctccttgagccacctcttcacattctcaaaagttgtggcctttgtgacatcatagactagcaatgctcccactgcgccgcggtagtatgcgcttgtgatggcccggtaccgttcttgcccggctgtgtcccatatctgtgcctttacaatctttccttcaacctgggtcacaaaattgaagcaatttaacaatggacctttggggaaacaatagtactgaacataaaaataaaaatctgtgatatcatggataacagcctaacaggatcataataaaaatctgtgatatcatggataacagcctaacaggatcatgtattcatttgttgtatgcagctaattaggttctctgattatgctttaaagcaagtgagccactagccagtgttagtttcctgtcaatctaaattcgcgtgtactgcaattcagtttgtacaaaatttcaacaaagaaagaactatcctttggccattttatttttttttttaaaaaagaattctgctttggcgtaagcaattgcactgtacccatcgatgaaaaccaaaaggagggactgatttccaagagaaagcgaacaatagttagcaaatcaaatagagaaacttgctgaattcctctgtcttctactagctctgaattctactgtcaagcatgggtgtcaaactatcaggtcagtcggcgatcgtggtcaagcccgccggcagcacgcatgcacaagggcatcatccaattcgagcaactcaagaaacattcagagaaagcagtaacagcgaagcaccgaagcagaacacaaacagagcaagcactagtaagcagaggagatcaggagaagcagaggagaagctagcactagcaggcatggtgacctggatggtgcgggtggcgaactcgacgccgatggtggacttggagtcgagggagaagctgttgcgggtgaagcgggagaggaggttcgacttccccacgccggagtccccgatcagcacgatcttgaacaggtagtcgtactcgtcgccgccctgctcccacggcgccggccgccgagccatcgatcgatcgattcaacctcccttctccttcctcctcagattttcgcactttcttgctgctttcttggagcctccgcctccgatctccgttccctcctccttcccgagaagctagctagcttcttcttcttcttcctctggctggctacttgcagctttggtttcttggctttggacgggaagacgcggaggctgatggcgacctgatcgatttttattggggaagagagagagagagagagagagtgcgcgtgcaaattggtaaggccacacttgggttcaacgctaatcttttgttttgtgtacgatttgtaattggatttgcaaaggtggagcatgttgtctagtcgttggctgctatagaatttttctggagtggtcatgagtacacaggcacgtacccaagaatgtcactagaacagtggattatgtcactagaacagtggattaagggctcatttggtttggtgccctaccaaatcattggtagtgtcaaatcatgggcaagatttgatactaccaatattttggtatagttggtttataggagttgtattaactttgttaaattttgacatcaatccaaacatctataaggtactattcaaagtgctaattatttggtagggcaaattttggcatcaaaccaaaacagccctaagtactactccttccattccaaaatgatcaaatttgaactaaaagagtgtacttatttcaagacggagggagtagatcagtaaccaaataaattttaaatcgtaaggtttattagcgataaaaaaatactttgtaagtaaaacttttatatatgtattattagcgtcttaaaagctaatgttaaaaaataaattatgatgataaaaacatcaaaatcaatttaaagttaagttttaaaatataaatgttagtgcggctagcaagccgaagagcaaacgctggtgttattgtgtgaatcaaaatgatcaaaatacagtggcggagccagaatttttccaaacctagggcccaattagttgagtgtatatgattttgcctttatcttctagtttttgaagttttaaaatggaatttcaatgaatatttagaatcaggagtagggagtagggctgcagccctagctgccctactcctgtctccgccccctgtcaatatagcaattaaaatgactagagatatgaaaaaaactatatataggtactgtcataatggccatatgttgaaaatatttatctcgggtgcatgtaacattttttttctagaaaaagatgtagttactatataacaatttacacctatggtataatgtgttttcagagtagtttcgcaactttctaattcaattttaactcccaaatagcattgttgacacggttatcccttgcaccagtaccatcaaccttccgcactaatggcaaccatggtaattggatgtggacacatcagtgtaatcctaccaatattccactatgaaaaagaaaaaaaaagattccaaaaccaaaggcacaattttgagaccaccctatcaaggataattctgccattctgctgagctgggaagaagatttgatcagttggaatagggaagatggtattggaatcattctaacttccaaacagaaacacacaggctctataatattaacttcaatcatgacttgacctcaaactaacaattaaacaaactcccttctgcctttgtttccgtgattgaaagagttatggatggtcgatgaacaggcaggaagaaagaaagcaatggaaaagagcaagagaattaacggctggactggaagagaacttttaaagacacgctttcgatgagaaccacacaaattgcccggcttctcacgagttaacaatctgcagcttgcgtgtaaataaaaaggggaaaaatggaaataagaagaggggaagatgccaccgtgtcaacccaagtatgcataaaaatggcgagggctatcatgcacatgaaaagtcaaaaacacacttgcaatagcattatccgacacaactcatcactgattattcgttcaataatagcatcactcacaagcatacaagcatacgtttgttcctttaataatgtttgcataatcatagggtatgtttggctagccaatagagccgctgcacgcagccataactgttgcagctacagacacaaacagtacactgtttgtgttggctgcacaacagtgaagttaagtgcagccgaacagagccaaaatcaacaattaatagtatcattttttaaaagacccaattactccgtcagacagacagtagcatgaaacggaccaaaggaagcagacttgcagaatagtgacattagattgatgaaggccaggagcagaagtgcgtgtgcgtctgtggtccgtccgatcgggcatcggacggtccagatggcgcgggaggttatggctggcgtcttcgtgcggcggccgcaccacacccacccgttgcgttgcggcggcctctctctctctttctctcctctctctctgcggctgcgcggtctccacggcgcggcgaggcaccggcggagggatggtgggctcggccgcgtactccgcggcgtcggccatcgtcgtggtgatggccaagggcaaggggcggggcggcagaggcggcccctctggcgccaacaaggtcagctcattcctcctcccctcaggtaccaacagtttgggtaatgggtacagtatgatcgaattcagcgcggggagtttggattgaactgaatgtgcctgtgaatgaacattgctgcaagggattagaggaattatcagttacgaatcattgcttcacaaaattctggggcacccacatggaaggggaaaaacggctgctgtgcgtgctcaaccatgcaaaaaaaaaagagttattcatgaggattgagttatgttttttttgttgttgtattaatcagaacatttagtgtggtacattctcaatttaatagcacatttgttggattatcaacaaatggaagatcttgtattggacccatgggtaacaggtcggctttatggctttgcgtcctcacacatgacacgctgcctatttatgtgtaggtttctgagcgacggcctcctaggataacttccaatgtgaagcagagcttgaggattctaaaattttggaaggtg

SEQ ID NO: 77029 - DNA, 513 bp, Oryza sativa
atctggtttggaatccctcaattgcatttccagcatctcccttcctagacattcaaccgaactagccgggcccttgaatccatgtcccggccgagaggagctcccaacgccgccatgccttagtccagaataggccatcccccactacccgagattccccaggtcaggacaagaaaaacagaccagtattcactccattgcttgcagaagatcagcccgccattgcaatgccgtttcctccagcatcacttcagcaacagctgcatacacattccataaaaatgtgtcaagatcgagatgaaccttctatggcatagtaggaaatttttcttgtaaaagttgcttcatcaatttataactgatgaagaacatccaaaaaatcttcaggaagtaagtacactgcactcaagtacgaaacacataattcgtctgttagtacactactccaaaaggcatccggatttccagccacacagcgatcaagaagggccactaaataatcatcaagaaaaa

SEQ ID NO: 77030 - DNA, 22984 bp, Oryza sativa
  unsure (1)..(22984): unsure at all n locations
aaaactcaaaatcccttatattatgggacggagggagtaaatcgtagatgatgctgtatgtttgcatgagtttaaatatataattattactagtaggtaatgatgtggcatggttatattttgagctttagatttggtggactataactttatataaagtatatattaaagccctgacttaacaaatgctaagaagtgaaaatagtacattttaatttggagtactatgtatattcatcgaagttacacaataaactagatggactcatttttttcatttaacaacaaaaaaaattgtatcctggtgtagtgatttgttttatattaaacgtaaaaaaaattgtataccttcacatcgttgctataagctatagttctttgaggtggccatgattaccattgaacatttatcggagctaaagaaaataagctcgttctaggattaggtaaaggataatagaatgttattatgattcgtttcgatgtgcatgaaaacacgctgattttactctgtacatgcatgttatacgtggctaggggactgtcaggacgactgagagacagcaaacagaatccaaacatgtgacttcgcttgagtaaggaagtaaggggttaagcttaattactctgcaagttaacgtgcgtaagttgtaaccaattattccgcacgttgcccatggtttcttgttactactatagctagctagctttctttgatgagtgcatatgcctagtttgtctcatcatgtggcaaactcaatcaacgacaggcatgcatgctccattgcttgttcttccagccaggattagaaggacaaggactactacaacaaattaatttagattacttaaccttcaatttatcaccaaagtctgcaagtatgcatttgaattgtatacatacaaaatctcttgtgctcttcaagtaattacatgattcaactatgtgttgttcttttttagttcatatacaatatattgtcatcaattatcacatccacacatcattgcaaattctgacagaaaacacaagtgcaatcaagcaggtccccaacaacgagcggacatcattaagcatagtacaagaagatctgctagataaacactgaaaaatcaggtttgagtacacaccaaatcaaccagtagacttttattttgttttatgtgtaatctgtcctgcttacttgtgttctaatttctatatatatgtatatatcgagggaaacagctgtgtaattgcacatcatcatgccaccagtttgagtacaaataaattagacctgtcatcataatggcatatttacattaattaattagttagtgtaagagacagccataagctaacttttgtggattatgacagtactccctcaattctaaattggtctacatatttcatatatacactaagatcaagaaaagctaataactctctcatactatatttactctaacaacaaactcgatgcatgcaccatccatactattttctagccaatagcaaatcaagatattacatgtgtgttataaatatttatgtgcatgaatgtatgcatcaatatccatttacttcaatacacaaataacgaatagacttaatgaatgaacaaatatgtagatcgatttggaatggaggaagtactttttaatcacaagaatactcccttaaaccgttgggcgcggcaaccaaaaatacacgttgtgcaccaatgtcaaccagagtttcatacgacgtactaggaattaatagcctaaactttttaattcctctttttttcagggcaaagtgatagcgtatgtaaattcaggaaagggatcggacaacgctttgtgacaggaatcagaagtttcagaacaatcaatccgtcctcggatccatccagcaggagaaacaggtactgtatgcctgaacaatcataacttgttaatgtgtcacattctagtaccagttcagttttgtaggatggagagagtatattctgaatgatctgatgactaacctaagaacacaatattaaggaaatctagtagccagtatgaacacccaatgtgtgctgtcatgcgtcatgcggcgcatcatcacttcatcagtcagtattattattattattattattattggttcagagtagtgagctccagaataatggcagctgataggctcatcttcagataactacataattaagcaatgctgtctcaagaaccgttgacatcgcaaaacaataatcaatgaacgatgatgacaatgatgatgctggccttggggggtgatgtgagactcctgaaaagttaagcaatgaactgcatgctactggagtagtagctagccctagctggccgatggtgataaacttgatcttggaatattctgatagggttggtgctctgtaaaatatacttcactagtcggtggacgaggtattagctgactggagtatatgcaaatttgcatgcccttgaagagttgacgtagatttatttcaaaagaaaaaggacgaagaagtagtagtagcttgtaaacttgggaaaacccaaggaaacgtaacgcaacgcccttgttgtttcttcgggactgttcaaattactaccaaaatgaacattttaaaatttggtcatacccaaattttggcaagttggtaacattgctaaattttggtaggatatattaaatatgttattgtcaaattctttaagcagtaccaatatgtgataacaaactaaatgcatccatatatttattatttgttttaagaaatggtatggttcaagttcatgttatttctgagtgttttgagctcagcccacgttctcatgccctagagctcacattgggccagattttgaagcccagccccagcatagccgagcgaagcctatgggccgttttcctgtcagcccagataagtatgaggctcatatactacagcccaaagaagaagcccatgaaaaatctcggtggaaagcccagctacctcgcgaattcgtcgttttcggcggctcgagctcgaagcctcgaacggagtagttgcacgatgaatttttttcgtttttagattttttttaatatttacagaaataatctatcgaccaaaataattgcagaaatagcccctgccgccctaatggtgggcggcaagctgacgtggcagacggtgggtcgaccgcgccgtctgccgccgtcggccaaaattgcgattaggcccttgccgcccatacagagggcggcaaggggctaattgcaattttggctgcccataaagagcttgcggccgtactttttcatctggatcccttgccgccccaatagagggcggcaagggacccagatgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggacgtagaaacattatatggacttaaacaaggagaattatgtaacatgaagaaatagtagtacaatttgaacatgatacgactatttgcattgcggttacatagatgatattagattcgaactagaagggaggtagtgcaatagttgaacacaacgacgatgtagtaatgggacaaggaagcatgacagtagaaatttcaatatgccaagttgtccgataatagctaacccctacgtgaggatccctctcctctctcaaaccgtgctttagtaaccctgtattgctctggtagttcaagctgcacaacacggctaggtggagttagaacccttctggtgtctatctattctctgtattgacatctccttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgaccttcttgtaaacaagtggttagatcgagaatgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagctattagttggcatcgatcaccgcataggcagcgaggacgctggcaccaaggtggtagtaggtatacacaaggatcgctacgccagtttggatcctcaacaccccggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacacctgattggcgccgaaagatacatgcatgatcggcgccgaaagttacattggtcgtatgcgccaaatggcgggcaaatactcgtatcacacgcgaataaaggaggctgcatcggtgcggcagaaagtagtcgtgcatgcgccgaaaggtatcgtgcatgcgccgaaaggtatcgtgcatatataacaacaacgtagtcattacacaagcatacagtactggaaagtgaagcaagtaaacaaagagaagactgctctactggccctgccccgcgccgcgaccacgcttggtcctccgggcctgtgctcgcacgtggtcctgggagtaggtgaaacgatccggtggcatagcacgggtagcacgagtgtcccgcggaggagtggcctgcgcctggtcctgcgtctgcaccggcggtgcgcctcccagctgtgaggggccgatgatgtcctctgtcgagcctgaagcgaagtcgaagtcagtgatgtcgaagagcaaggtggaaggcagcaagcggtccgacgaggtcccagcatggtccagtggtggaccctgactcgacgtgccggctgcctgtgacgaagtcccggtgtactgccagaactgcgctgagtgcgaggtcgacacagctgcctgagacgctgaccctgcagcctgggagaagtgggcagcctgcgtcatagcgaactgggcgaaacctacacatcgacaacgggacccttgtaagctaagacataaaatgtatgtaaattgattgtcgaagtaatgttgtttttttaagtacctgtggggggcacaacagaaggcctagccgaggaaggcggggtgttgaacggtgcacgaaaccctgaagcaatcggcaagtgaaacggctcacttatatgtgcgaggcatgtacagaaatagtaataaaaatacttacctccgtgcggagggggagtcggcctaggaacgtgagcagctggatggggactagtcggtacgggtggccgctgtacagctacgtctgcccgagcaatgtcgtctgcacgacaggtgagcactcggagaatcgagcgcatcgactccaccatccgcgtgtacgtcgtcaggtgctcctctacgggtaccggaatccccgcgcctaaacgttggatcgtcgttgaaccgtcaacgacgacccggttgatgtcgtcgacctgcatggttaatttgttcgtaaatatttgtaaaatttgacgaagagaaagacatgaaaacataaaggaatggtgcgatgcagggtactcacagcacgagcgaagtcctggtcgcggtgcctggcatagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccatgacctcctcggttgcgagcaaccagtcctcaacaaaagtcgccaacttggcgggccagtcgccagctgactgctgacccttgcgcgagtacctgcgaattaatgtgtaatattagtgtgaaacgacagatgttacaaattattgtgaacaggcagattttaatgcaacaacggaaagcgtagtgcaagatcttaccggtgaacagcagctgggacggtggtcggaaacggtactggaaagggctgacggaagccgaactgccgcattacgcggaaaggggcgtgaggctcaacgcagatgtcgaagaccatcggaactgtagtcatccagtacgcctggtccctggtgcagagtgtggacagacccaacggcgcatgagcctgggtagccgcggcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgataagatcgatgcaacgtacctgacgacggcaccacagagtacccatcgtaggatagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcacggtacagagccgccaacaacgcggaaccccagctccactgaggcacctcgcctaccgcggcgtcggcgatgctcctggcgtagtgcacgagtcccttgtcgaccgcgtgcccgtgaccgccacagaacatcacccagccaaaaagccagagcaagtacgcctccaaacatcggctgtaggagtactcgtcggcctccgcctatagctgctcaacctgcaagccgtcgataaaatgttaggcaccttaactacggactaaatatgtaatacgattgtcatttcggtacaaaaacactctcggtgaactgaagcagccacctcttcgtaggtccggtgttgcggtggtgtgccaacggctcgagcgggaggtgcggtgcgcgctgtactagtgcgaaacgtgccgtcagatcgtcctgccagtccacagccatggtcactggcccaacagcgtctcccgcgagcggtagccctaacaagtacgatacgtcctgtagggtaggggctacctcaccgcacggcaagtgaaaagtgtgcgtctttggcctccatcgatcgaccaaagctgctaggagggacctgtccacagtccatcgtctggctgggtccgcgtcgccggccgcagcctccaccagccgacgcatcggtaggaggccggcctcacgtagcctgcaataacaaattaatatgtcattataaaaaatattacagtgcaactaacttatagtaaaacactgttcgtacctctcgacaaaggagtcatgaaccgtgagtagctcaccgcacgtccgtgcccggaacgtcccaagctgagccccctgcaccgtagtaaggtgagaccggtgtcggtgatctatcgccgggtccaacaactgaggtgtatcctgacgtgccatctctgaaaaatatagtgtttcgtgttagaacaattcaaaaaatagtaatgtaaaacaaaagataacttgcaaaattataaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacgcctaggacgtggtcgagtggaggtagtgccttcacccgtagggcgagctccatctgctgctgatcctgatagtcctgcctccgtcgcacttggtttctccttgtctttaggacaatgcttgtaggtgtgcccatgttcatcgcatttgctgcaacgcttcaccatgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcggcagcaatgacatgggtgcatggcctgtggagcagcttcggctttgcacaagagcaatgacatgtgccgtcggctttgagaacacactcctacttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagctgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactcttctatcactcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatacagagaacaggacgacagttcacgaatgccatcttgcatacatgtagagctaagaacgccctttgcagcacactcttgctaggatattcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacaagtaatgttcctgtggtatttctaaacaccaggtagaaaacatgtatgcttggtaacgactgacactgtccaataatccttccatttccccttatacgcgtgcactctctagggacaaccatctttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctaacgaatcaccttcctctacacgctcgttgtcagaattctccctctctatttcatccacaatggcaccgacagtctccccctcgtcggccactccacctggttgaataccaactggagctactacgcccccgtcctctcgtgcgttgacctcctccacagaagtctcgtttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctcaagcccttcattaaccatccttttatagaaggtacactcctctcagccggtctatcaattcccctttctgatacaataaaatctgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattgattccaaactagcatatctacgtagttactaatatctacaatacgcacttctagattagtacaactaaaaccctaaaaatataatgcattttttcaaacaaatttttaaagaatacacactatttaactcaatagtcacatataggatctatgaatattacctgaaattggcgtctgaatccggcagggcttcgccccttcttctcttctcctcccctctcttcttttttttttcactggaattgaggagagaagaatgagggctgggggctgggcagcaggccttttataggcagcgaggcctgccgcccggccaaagggcggcaaggggccgcctgcaaaatagccggccccgactggctttttttgcattcgggccccttgccgccccaccagagggcggcaagggttttcctgcaaaaaaccctccctccgtcaccgcccgttcctcccccgtttgccacgtcagcttgccgccccagagatggggcggcagggtctatttttgtaattttttttggccgatagattatttctgtaaatatttttaaaaaaaatctaaaaccgaaaaaaatccattgcacgatgatgagtcgatgagatgacaaattcacaaatgctccactcaaggaagagcgccaccgttcacaaacctatctttctgctttcctaacctgacatgtattattgtgtagtactccctccgtcacataatataagagattttgagtttttgtttgcattgtttgaccactcgttttatttaaaaaatttgtgcaaatataaaaaacgaaaagttgtgcttaaaatactttagataataaagtaagtcaaaaaaataaataataattctaatattttttaaataagatgagtgaacaaatagtgtaagtaaaaactcaaaatcccttgtattatggaatggagtaatacgtactactttcgtgttgtctgacttgttgtctgcctgtaatttactatttacccagggtcaacaatcagtttgacattttgtaaattgtgatccctcttgcgttgatcttccgttgtcacagattttaattttcatacaagtactaatacatgtatttcagccgtcaaaaccttccagatatcgcacaactcgctagcaatacagaagtagtaatactgtaacttccaagaaggattaaggaataatcttctctgaaaggtcaaatatcaaattctgtcccaaaattcagtagcacaaaagacagtcgtacaagaaagggagaaggaaaagaaacattcgtaattaattctgaattttaatctcactgcttatgttaattactaaaccgagtgacacactgacacctgaagaagatgaatcattaacgaccatggagagaaccacaacgaaaacagcaaacgataatgtggtctgaggatgatgagccgcccatgttgaccaacctactccactaggctgaccaccactgcaaccatcagctcatcaggagcacgagcacgaggactcatcaaggccgtccatggtccattggacgcctgtgattgcttcctgagggagactgtcattcgtgaacgtccacataccgtgttgcaacagcaaagtcgatgtccatcctgactcggtctatttatgctcataaaccatggtctcttgtttttctctctttctttcgatgcttcgacgaacttgactatttgcttcttttacttcttaatttaaaaaaaaagattatttgcttcttttcttaccaggaacagaaacaattgattagtacaaaatggtacttcctccgtttcacaatataagactttctagcattgttcacattcatatagatgttaatgaatctaaacacatataaatatttagaatcatttatatctttatgaatgtaaacaatgctaaaaaaaattttacattgtgaaacggaaggttgtacaaaacaaaatacatcttaaaaaaaatcacttggggttacatctgagaaaaaaaaatcttaaggattaacaaaccagctatgctctcattggatgtactagtatcatgtatgatatggaagcattttatgtaaactaattgagcacttgaggtgttgaagtggcgttaattagtccaataagcagacgatttgaccctaatagagtcattacaaggagcagcccggtcggtcagtgtgtgtcactgtctctcaccctcccaacgcttagacatttcaacgttctcctccacagcaacagcagcagcagcagcatctcctcttcttcaccgcatctgccagcctagcgagcctaatcaggtcttcgtcttcttcttcctcatccccgtgccaataccgatttcgcgagctccgatggattccgcgagagaggagacgtcgccatgagaggggaagccgagctgtgcgtgtagctcgctgcaatcgctgcgccggtcaagaaaccagccggaatcggcggctgattccggtggaggaagatgcggcggaaggcggccggagatgctgctctggtaggcggctgcttcttgctgctcctccaccctctcctctcccatggcgcggacatgccgttgggctcctccctctcgccggcgaaccaggcgttgtggtcgtctcccaacaacaccttctccctctccttcacggcgtccccgacctcgccgtccctcttcgtcgccgccatcacctacgccggcggggtgcccgtgtggacggccggcaacggcgcgaccgttgactccggtggcgcgctccgcctctcgtccagcggcgacctccagctcgtcaacggctccggcgccgtggtctggtcatcgaacaccggcgggcagggggtcaccaccgccgcgctgcaggagagcggcaacctcctgctcaggaactcgtcggcgacgttgtggcaatcgttcgaacaccccacggacacggtggtgatggggcagaacttcacctccggcatgaacctcacctcggcgagctaccaattctccctcgaccggaacaccggcaacctcaccctcaagtggaccggcggcggcacggtcacctacttcaacaaggggtacaacaccaccttcacggcgaacaagacgctgagctcgccgacgctggcgatgcaaaccaacggtatcgtctccctcaccgacggctcgctcacctctcccgtcgtcgtcgcgtacagcagcaactacggcgagagcggcgacatgctgaggttcgtgcgcctagacacggacggcaacttccgcgcctacagcgcggcgcgcggcagcaacgcgccgacggagcagtggtcggcggtggcggaccagtgccaggtgttcggctactgcggcaacatgggcgtgtgcggctacaacggcacgtcgccggtgtgccggtgcccgtcggagaacttccagctgagcaacccggccgacccgcgcggcggctgccggcgcaagatcgagctccagaactgcccgggcaactccaccatgctccagctcgacaacacgcagttcctgacctacccgccggagatcacgacggagcagttcttcgtcggcatcaccgcctgccgcctcaactgcctctccggcagctcgtgcgtcgcctccacggcgctctccgacggctcgggcctctgcttcctcaaggtgtccaacttcgtcagcgggtaccagtccgcggcgctgcccagcacgtcgttcgtcaaggtctgcttcccggggatccccaacccgcccctcggcggcggcgggtcgccgtcgggcagggcgtcgggcgtccgcgggtgggtggtcgcggtggtggtgctcggcgcggtgtccgggctggtgctgtgcgagtgggcgctgtggtgggtgttctgccggcacagccccaagtacggcgcggcgtcggcgcagtacgcgctgctggagtacgcgtccggcgcgccggtgcagttctcgtaccgggagctgcagcgatcgaccaaggggttcaaggagaagctgggcgccggcgggttcggcgccgtgtaccgcggcgtgctggcgaaccggacggtggtggcggtgaagcagctggaggggatcgagcagggggagaagcagttcaggatggaggtggccaccatcagcagcacgcaccacctcaacctcgtccgcctcatcggcttctgctccgaggggcgccaccgcctgctcgtctacgagttcatgaagaacggctccctcgacgccttcctcttcgccgacgcgccgggcggcaggatgccgtggccgacgcggttcgccgtcgccgtcggcaccgcccgcggcatcacctacctccacgaggagtgccgcgactgcatcgtccactgcgacatcaagcccgagaacatcctcctcgacgagcaccacaacgccaaggtctccgacttcggcctcgccaagctcgtcaaccccaaggatcaccgccaccggacgctcaccagcgtgcgcgggacgaggggctacctcgcgccggagtggctcgccaacctccccatcacggccaagtccgacgtctacagctacggcatggtgctgctcgagctcgtcagcggccaccgcaacttcgacgtgtcggaggagaccggccggaagaagtactccgtgtgggcgtacgaggagtacgagaaggggaacatcgccgccattgtcgacaagaagctccccggggaggacatcgacatggtccaggtggagcgcgcgctgcaggtgagcttctggtgcatccaggagcagccggcgcagcggccgtcgatggggaaggtggtgcagatgctggaagggatcatggatctcgagaggccgccgccgcccaagtcgtcggacagcttcttgagcctgacgtcggcgaccaccgccaccggtgtcagcggcagcggcagcaccagcatggtctccacgtttacttcctcggcggcgccgccggcgcccacgccgtcgccgaacgtcgacgaggtccagcaggagatggccgtgggacgctcggcgtcggccaggatccgcgaccgggcgtctcgttcgctgctggggcaggagccatacatgacaatgtaaaacttcatcttctcatgaggtgaatagcaaaatgattttgctttttttttttgctccagtaaatgggaaaattgctctggttagtgagcaattagggagttgatctggttgattttgttttggtggaacatagaagcagctgtcggtggaagagaagtgcttttcactgatggtgagcaatttcgtacttctacttgagaggatatctatgtgcctgatgagctgaattctgcaatttgtaagtacagattagatcaaactcaatggtatattcgcgttgtaacttgtacaaataattcaaatgaggcgatgcattgataaatggagtgcaaacatagatgcaatagcttgtctgattgtagattatggttttggggaagctaaagcaaaggcagagataagcagatcaataaaaattcagctacttcagtttgttcagtactgagaagcagcttgcctcacactcacatgcatactactggtaagagattgttttggcatttggggcaaggcatgagcaatctggcagattgatagtacacaaaaacatgtgcaggaactttcaacaaacttctctatcaacctttattccattaaattaaatgcatgggacccatgacaaccctttccaaagatcaaattgcctgcatcatgtgtcatcactggcaattgcatctccatgtccatggagagcttgcaattgcgtagtagctgaggaaacatgtgattaaggcttatactgggtcttatttaatgctagatttatgagcacacagctgttcttgagtcttggccccttgttcagctattcattcagaagcagtcactgaagaatgttgttgagcttagactcactgatttataagcttcctgtttagcaagcagactcatcggtgttacattcagaaaataccggcacattccaacttgaacctagatttattggccaattgctttagttaagaaaatgaagtaaaatggttccatagtgtagtggttagcactccagactttgaatctggcgacctgggttcgaatcccggtgggacctttttttttagttttactaatctttttgcatcactgcatttaacatcatcactgtctaaacaacttcttgacgcaaactgcatatcctttccttttcttaggtgcatttatgcgaagttactgatgattatgatgttggagccataagtttccaaaacaataacaaccttaccgacagaattcctcctaccctcaaactgttgaagtcattttcttgatcaaaacgaactaagtgtcatgtccttttattgttggaccacttatcgtccttatcttagcttctcgtagtttaacatgtgacaccgaagaaacattcagccatgataagagcagtccgaactaagatattcgccagtctcacccaccaccaattgaactgtcatatacggtctttctccaggtctcctgcctcccggtcagccaatgcccaagaacaattagtgtaaccacacaagtaatcatcctcagcttttccaatgtttgtgagcttggacaggatgaacaaaaggcggggttcaaatgtcaatgaataactttgaacatgccctgngtttaaaataattccattcttaccagttctgcacttcaattcggttgcaacaacaaagttggcagttctagaaagtcattcagaaagacccaagcacttcaaattttcttttgaagaaaaaggacagataacgaagaaaagctgtggaatactttacagagcggggagttttgcgtggaaaacttacagtgttgtaatccagtattgtaggcaagaaacttgcccacctttatctgtacatgattatcagatccttcttcattgaagtcagatgataaatttgaaggaccgtattagtgaagtcctcctagttagtactcaatccaattagcatccagatccttcagcttcaggagccatttctgtttgtccggagaaacgcttggtttgtttggcttgcttgcgtgtttatttgttatggcatatgaggatccagccttactctcatcatcagagttggctcgccttctaggtcgtctgagttcaagagaaagaaggcgagaaacctcgtgtactccaccccatttttccaacgcccgagcaatgtcataacgtcctatcattaacaacaaagtacgagcattattcataaagaaagattgtgagttcttgacaaaagagagaactggtaaaactagcatgataggaacccaggcaataaggttgttacaaacatcagtctgacataaaggaatggcatccatgaatgctatgttgctatgtagtcaactcctcaattcaccgctctaaaaaaactactgaattcaccaatcttaacatgtatatatatctggcctgacgatcgagaattgacggaagtgttaaaaatgggaacatggtgaactttgggtgctattaaagtgaaccggtaactttcggtgctataaaaccaaaaacgtgaactttcgatgctatataaccaaatttgccaaaattttaatatgattagaggaaactgaacatattttcatgccccagagaaaaaaaagggtccaaggtttccaggtaccttaagcaagcatgggaaaaattttgttcaaaacacctcagtcaaacatggcttcaataattttgaccagaaaaaagtcagaatgactttgtataactctataaggtttatcaactgccagataaactacactaagaaaatatagataataaattgaccatagcaaatatttagacaaaaataatcaaatacctgctctctcaaaggactttctacttggcatataagcagggtccatcccccaattcttctggaatcgcctgatctgtatataatggttactgttaataacatgtcaagaatgaaaggagtgctcattatcactcctcatgctggaaatctcagctcacaatttttagcattctgaactactaaagccctgtagaacacagtgggaggaggggtatatacttttcattacctcttcttgcaagttctccagattatcccaataacctcttggtttccggtttttataagaaagtgaaagattcattatgctggcaatcttcctgaacccacccatgcgtgttattgccttctcgatatccacccttccatgcaaacgaaggtgttttctcttaggcatgaagccatcctgaccatattttgcaataaatttctcaagttcagatttgaggacctcaatgtccttttgaaggcctgggacttttggtctctgcttcacaggactcgaagaacatgacgtggatgcttgttctgattgcctaccttctgcataatcaatagcaatagtatctgcatttgatgctacaatagagctacttgtggagttaccgctctcagcttctgccttttcaatataatcacggattgcacataagtttgatggaagatcttcatatatgacctgaggtacgtaatcaaaatgtttgttttcttttagcaaaaaaaaatcattaacatgtttatcaaagcaccatgaccatgcataaatcagcttttgataagaagaaagagtggcaaaaaatcataaagctgcattcattcccctacataccccccctccccccccccccaaatagcatcaagtcataagattagatatccttaaagaatgtgacggtacaactaagtttaataaagcgcaatgtctgcgtcatgaggatatcttataaaaagctgtttaaacaagtttttggtactgacgagagggggaaaaaatccatgtgaggttatccagagataataaaatatggaactattattcttgcactaaccaaatgaagcaacgcaggataatacagatagaggatgtgtgcttatacctattcagaatttagagattcattcatttttcaggaaggtgtttatttttactgaatttctggtgaacataaagactaaaagttttcgcatgagcacaatagcacgatgttatgctcaactagatgatacatccatcagaaagttgctttgaaaacttaatcaccaagcatcaaaaccaactattatgaacatatacccctggattaaatagtattagtacaattggtcctcagtgaaccacaattgaaattcaggggcacaacaaagcgtattttaattaccatttttccacttcataacattaacgtgttctctatatttattgataaactacatgcatataaatttcttatacctcttcaaggatagactctgagagaaaggtatctttatgcatcttagtctcaaccatatacttcaataaggtgtgctgatcaccaagttgttctaggcgccattttcctttaaatgagtagaaatcaccttcaacttgctcaaagcttatctcacgttcaagtttctcgcgaagatccataacaacacgggcatgaagcaccatataaagtagacccttgcaaccctcctataaaagatatgagatgttgcagttcttgcaaagctcatgaaacaaccaaattgaattaaattcttccagaaaaagtatcttttgggaggagaaggtgatctttcttcccatttttaggacaaaagctaaattccatttgtttagtattctggagtgataggtgcataaaagcatgaagttgcaagacttggtaaaaatgatagatcacttggtagcttggactaaaagtgaaaacctaagctagctatcaaccagaaagtgaaattgaggattgacgctttctatagaaaaggagcaatcccacctctagacttaagatgctaattcagtaacgtatgagataagtatttagcaaagctcccacctgcagtatgcgaaccttgttattatcccgacgaataatcctactgatagccagattcggcacaaatctgacagataactttgttagctcatacttgtataacaagatatctgaactgtaaaaactgaaggaagatagaactactaactcaggcaacttctcatatgcagtgagaatattccatacttctcgcactggcgctttcacagtgatactagcaaacacaaacctgtgagccccttcatgttccttcaatcaaatcatttcacgaggggaagacaaatctgtcagtgtgcttcccatcaaaatataagaacccaatgataattcttagatgcatacaaatttagtaagttaccaggagaccatcaaatcttcgaagatggatctcatctaccacacacggcctatcaagtctgcagacatttccatatactccccatttgctgttcaactcagaaggaggtgaagcaagcacaccaccaagaccagaaggaggtgtttctttgaacttactaggagcaatggcatcattctcagtggttgcattacggaagttatgaaacctggagcctgcaccactaaattttgcagttccatgtctttggtttcctaaatatatgttttcagctctacaggccaacgctccaagattcacaggaagatccgaccttatgatcctctcaagaaatattgctgggaaattaaatcttggaatcacattaacttcatacaacaaaattgcactagatgacctgtcataaaacgaaacaaaatgtcatatgagacctctaaactggcattacttttttgctagctaaaacatgaagatgtttaaggatccacgaattctagatcagagcatcatgtggctgccaaaaatgtaagtaactggtaactcagtaagcaaacagtctggacgatcatcaaaggcatatgcaataaacaagacaagacgatgaccatgaaatccccaccttggaccagatctgatggaccatttcccttcgaacttcttaaagtcaccatcaaccatggagaagtggagctctcgtccattaacctggatgttgactgtttaataaggaagaatagcttgatataataactaggaaattaggagaatcattcaatagtcaacacctctttaaattcgctatctaaaatttatacaactaaacgccaaatatggtgtaacatcaagatagtttcaccacaagaatcaacgcattcagaaaggttaacagtagaagatgacggctaggttcgttcatgccatgggttgtcaggaacaaatctacaaatattctcatgcattcagctcaaatgttcacctaacctaaccatctatatgtttcaattgcatcttaattacctcgtgaaaaacgaaaatcacgactaatttagttgcaacataacaaaaacgaggttagggtgatcacttcacgtacagcatccggaacctccttgagatccaacacgacgcgtgcctcgatatgccagtaaagcgcttgctgcagccccctctgctcgagccatactcggccctgatgcgggcatggaatcctcccactgcgttgccgaacgacgcacaaatttcccccaattagaccctcaatgagcatgcgagaatttgcaatgacacacgagaaggagagatggaatgtggacctgtgaacgaggttggggatgaattcggcgagccgctcgtagtcggtgatgacgcgccacacggtgtcgacgtcggcggccaccgccacggacgcgaacacccgccgctcgcgccacgacaccacgtccacgtcgcactgcacgccggggcccgcggcgctcttcccgccgcgcccgcctccgccgccgtggtactcagcgccccagtggtcgccggtggcggcggcggccgcggccgtggtgaccgcacggccagaatggtgccgccagagcgccgccccgcaaggaggcgcgccgcggtggctagggttcgcgcaggggttcggaattcgcggcaggaatgc

SEQ ID NO: 77031 - DNA, 7045 bp, Oryza sativa
gcccgcgcgccgctccgcccgccgtccgccgcccaccgctcgcgcgccactccgccgcctgccgcccgagcgccgctccgcccgccgtctgcccgtgcgccactccgccgcccgctgcccgcgcgtggcttctccccccgccggtgccatgaagaggagagaggaagagaggtgaggggagaggaagaagaggctgacgcgtggggcccacgtggggtgccacgctgagtcagctgccacatcagataaaacaagactcaaaaccaccgagggatctagtttgcactggttttataagttgggggacgccgaatatctggtattgtggttgggggatgattttgtaacttgatgacaaagttgagggacctccggtgtactatttcctatttgtacaccaccagcaacatgatctgacatctagctccaaaacatatgtgcattcgtctataattatccattcacataaatagacaagtatttgtacagcgtagaattgcatagtacagagataagcacacgtcggcagtttaaacaagattaattaaggagaaaaaaaagctgaatcagtgtgctacacaatcacccaaagcacacgcctacacgcagcaaaagaacatgaaagcacgagaaattaaaattaaaaacaccgagcggatctcccagcgaaatcgttcgttttgatctcatcagctgatgccgtcgaagttgctgctcatgagcgacaatgtcgcgctcggtagcacccggttcacctgaggttgctctgcgaattgattaaaccaaacacaccattgcgttcagttcgcatcatcaggatctgacaaaactgtagctaaaatcaccaattaattaatttgattagactactcactcttaaccgcctccagctccgacggagtgagcctcgccgagaacccgctcacgacgttcttgtagttgtatatgattgcccccttcgccttctcctcgctgaattcatttccagattccaaatcatttatcagaagttgcattaattcagaattgttaatttggatcggttgattttgatcgatgcagcggcgaggatggtatactattacctgccgagcgcggcggcgaggatggagagctggtaggcggtgcagacgacgccggagggcggggggtcgacgaagacgaggtaattagctgcgccgccttctccggcggcgacagccgcggccatggcgacggcggcggcgaggaggagggagacggtggcggtccaaggtttcatggcgagattggcgaaggatctcagcggtgcctctcctctatcggattgctgtttatgagcagcgaacgagaggtccgtattaagctgcgggatgcattagcattagctcctataatagaatgtgaatgtatagctaatctgcattttggaaaaaatggagcttaattaacaaaatacaatattacacttgtgttcattcagatcaagtaaggatacaaaactacgtatgtatttttacaaactaacaaaaatacagaaccggactcccctgaatctgcaaagtgcaatacctaaaaactccacacgcgcgctgttaaatacacgtaaaacttgaacatagattttcataattaacgagtagaagcaaacacgtagtattaatttctgtgtgtatgaatttcttgaggttttcatcaggtgacagcacatgcaatgtcatcgatcatacgacgacgggcgcaacggcggcgtcggagccgtgcttggtgacgtcgtacatctcgccgtcgccccagagcgcgtaggcctcctcgccgtggacggcgtcgtcgccgacctcgagcttgtcgtcgggcatgcggagcgggacgaggaggttgatggcgaggcagatgagggaggtgacggcgacgttccaggcgacgacgaagaggccaccggcgatctgcttgccgaactgggcgccgccggcgccgccgtagaaggcgccccgggagtcggcgacggggaggaagaggttgcagagggtgggctcggcgaagaggccggtgaggaggccgccgaggaggccggcgacgccgtgggtgtggaagacgccgagggtgtcgtcgacgcgctgcaggatcttggagcgcttgtggaggatcatcatggtgtaccacgggatgctgccggcgagcacccccatcaccagcgccgcccacccctgcaccacccctgcaataccaatccatacaacgtttgattcttcgtcttatttacttttttaatgataaatattcttattgttattagatgataaaacatgaataatactttatatatgtctatttcattaaaaaaattataaattttttaaataaaacagatggtcaaacgttggatacagaaatacaaaaatgaacttaatttagaacggaggcagtaattcagtactaagttgctatgttttgatacgaaaagagtactttctccgttttacaatgtaagtcattctaacattttccacatttatattgatgttatttgttagaatgacttacattgtaaaacagaggtagtatatgttttattgacattcatgtatatattgtatggaaaagaaaaatcataatattatgctctattgaaatctgtattatacgcacgaatctaaaaacaaatataacgataagggggtgtaggtgtgtgtcgtaaataaggacacggatcctttgcaatagcagtgacggtggctgatgtcatcgattgctatggagtactgtagtccatcttcgccgcgtaaatagactttgaacgaagtcaccgacggaatgggaggctgtaaaatattctacttttattttcagtgtgcttttcttggctgcttgcgtacaagaaaaactcagaaaaaacaaattggcagtgtcagacgactttgactttactagtactacgagttagtgataggtattgacataagcacgaacgacaaataagattcctggtttccgacgaaatatgtactacctccgcccaactttaatcattcgttttatttaaaatttttttataattagcaattttgtagttataagatgataaaacataaatattactttactcgtgaattatgtttttaatttttttcaaaaaattttcaaataagacgagttgtcaaagttgaatgcggaaaaccatagctgcacttattttgggacgaagtgattatgtatcaaccaacctagattccgatgaacgttttgtatttgttcacattaggtactgtagtgaccagtgaccggaaattgagtatgaaaaatttacgactcttcgactacaagagagagagagagagagagacatgatgaatcagttgcgtgtgcgtgtttaattagttgccacaaaatggtaaacggcgtaatctacggggaaaatgcagattatttggcaggcaaggtaacgaacctcctgtattgttggcaacgcagacagtttagaattcaaagtcaaaacaacctgggcgtgaaggatcattaatctgcaaaccgggataatctaatctaattaagaatcgatccgagctcgtcacgcgcgccatcacgttatagttcatcgatcccaaagttaattagagtactagacaacaatttgattaatataaggctatgttaggtactcagtttttccaatttcaactcctttgttttgcatacacgtgtcttcccaaactactaaatggtacattttcgtaaaagttttgtatagaaagattgtttttttaaaaaaaataacaataatttacttttaagttattttagctaacacttaagtaataaggtttcgttttctgtgtagtgtgatgaatgacgtacctgcagcgggggtgatgcagacgaggccggtgatcatgccctggacggcgccgacgacggagggcttcttgaagaagatgacgtcgaggcatgtccagacgatgaggctcatggcggtgcagatgttggtgttgaggacggccatggaggcgacggagttggcggcgtacggaccaccgccgttgaaccctgcccaccccatccatagtaaccctgcccccgtcagcgtgaacagtatgttgttcggcgggaacctctccctgtccttctgtgcccttggccccacctgccagccacacattgatatatatgtacacttgtcagagccacttcgacgtcggcggcggcggagtactattgtttagcttattcgtgaacgataagtaattcgtgaataaaacttttatatatatgttcttagcgaacttaaaaaaggctgaaaaataaacttcgatgaaaaagctccaaaatcagctttaaattaatataaggttaaaaattttaatattggcttatgagtataagcataagcgaaaagatgagactggtggtacggacccagtaggcggcggtgaagccggcgatgccggcggagacgtggatgacgtagccgccgcagtagtcgatgacgccccagtggaagaggaagccgccgccccagagggagaaggcgccgacggtgtaggagaaggtgagccagagcgggacgaagatcatccaggcgaggaagctcatgcggccgaggagggagccggcgacgaggatgagggtgatggcggcgaacacgcactggaagtacaccaccgtcgccatcgggtacagcggctccaccgccgccgtctccacgctgccgtcggcgcggtagtggaccgtcgccggcagcgcggcgcggccgacgaggaggccctggtccagcgccggccgcgccttcccccagatcgggaggagcttctccccgaacgacatgttgtacgcccaggtgacccagcagatccacacggcggcgaaggcgtagagcgccatgaacgccgagttcaccgcccacttcttcttcaccacgccgccgtacagcaccaccaagcccggcacgctctgcagccccaccaccgtcgccgccaccagctgccacgcgttgtcgcccttgttcagccagtccgccaccgacgccgacgtgttcccctggtacgccagcggcaccaccgtcgccgacgacgacatcttcgtcgccgattcaacacacactaagcttagtatgctttctttaatttggtatcctagttagtgttagttaggcagcttatatagagatagagagaggatgcatggtccaggtggcgatcgattaaccattttgactcgctagctaggactgtacgtactagcggttaagataaatttaagagaggttaaattcgtttgtttaattagggaaggaatcatcaacgaccagcatgtacaccacaaactcgtttgaagtagccatgagcacatgactttggctgcatgtagtacagatcatcatccacatcaactaattaatatatttttctcatttttacccagcagcagattcctggctacaagcctactacaaccctagctttgtccatcaagattcaataatgattaagaaatgatcaagtatacttgctgttttgactaaagaaatctgtacttgcactaagtttacaaatactgtatattttggtctgttagtagtgtgcagagaagtgcagcttagcatgatcaagcaatctaattggaggttgtgtcgtgctggtcatatacatgaactttctgcataataatctatgctgcgcaaagattcttccggtacatcataagttctagtaaatgtagttttctgtttcaatgatgcaacctacgatgcaatggctattccaatcgggaacatgcagtacaagtgcgatcttcatgttttcttcttctacgtgactactgatgaaaaaaaaactaaaaatatacgctaagttgcaaaatgagtactcaaacctatatcatactagtaatactgatgaaattaataccgaaaaatacattaagttttagcagacgtactactggcatgagcatgacaatgctagcaaggacatgcatctagaaatctatggcatgatatctttgactaaacgctagcaccagtgttattgacctcaccaacaaatctgacagtgcatagagattcttgtagctctgacctcagttaacacaggcccatgtatacatttctactgaacactagtactccgtactacttttcaccaaacatatatattcgatcatgtgtgcaaatactgggattgctacaagtgtgtttcatatataaggcaggtgctaggcgcacgcgtgtattcttatgtgagcacatccaaaaactagaccaatataccttaagattattaaagttaatataaacatattgctattaacgggtacatcacttaattaccaccaaaagaatagttaataaaaaatacgagcaattaaacgtgttgagtctaatatttaaatatggctggttatatcagtgggtaggttccactacagaaaacctagcgagctaagctatgctaagtttgtttcctccatttttaaatattcaatggttgatttttcgacataatgtttaactatttatcttaatataaaatactatgaatttaataaaaagactaattcctaaaatacatcgcaacaaaacaaaataaatggttctctaaataaagaaaatgatcaaatattatgtctaaaagttaacgtcttatatttaaagtggaggcagtattatcgcagaacattttgaccgtccctttccatgtatagtgctacaatgaccacttaagttatactcataagttctcaaaacaaaaaaagtcatattcataatactctcgagcatccctctcctattagttttaggagcttcgtatgcatgacctcacgcatacgacccgaataacatttatttaaattagtattcttaattatagagtactcttgcatttagattattgcgctggtatgcttttttttttaccttgatccatcgatataggcttcgtaactgggcgtacattagaatcttagaaactaggtgattttctgtgctttacagcgggaattactaagcaattctcaatatatattttttttcgacaatcaagttaggagtaaaaagcaaaaatataat

SEQ ID NO: 77032 - DNA, 22396 bp, Oryza sativa
aaaatccctccaaatacgaatggccgtgcataacgcataacgcgtaacttgccattagcacattaaggctgtgtgcttagatcaaggcgtaaaaagttttaacttgtcatattagatatatggacacatatttaaagtattaaacgtagattaataacaaaaataaattatagattccgcttataaactacgagacgaatttactaaacctaattaatctgttatttacaaatatttaatgtattaccactttgttgtcccgctctcgacgcttgggattcactctaaattctcgtggatttattatacgcttcttccaaacacgaggagattatggcctttttcagtgtcgcaacaagtcaatggaacactccctccggtctcattttaattaacgttttagacaatgacacggtctacaaaatatatatttgaccttatttttctattataatatatacaataaatatatgtatgtttacttttattatagtgatttgaaatacaaatctatatatgttgttatagttcctttaaactaaatatttttaaagtttttgatggtcaaaattataaaagtttgatcttaatcttgtctaaaacgtcaattaatatggtaccggagggtcaagattcttctttaattcttcggtctacaaaaattttacatcccttcacatcaaacgtttaaacatctgcatgaagtattaaatataggctaaaaaaaactaattatacagattgtgactaatttgcgagacaaatcttttgagcctatttgctccatgatttgacaatatggtgctacattaaacatttgctaatgacagattaattagacttaataaattcatctcgcggtttactgatggattttgtaattagttttttttattagtgcctgaacacctcatgcaacaccctatataatatctaatgtgacatgccaaactttatacccctggatctaaacactcccttcatccagagatagattaagttcattctagatctcttaaatttgacatcaaatctgaaattcattcttgaactgaaataccatatataacacgttcttcaacttctaaaaccgatacaaacatggtcccaccgtcttttacgattgcaagtgccacgttaacaccacgtgagacgaggacctaattaaaccagccacgtaaccgaaaaccgccatcaaaaccatcaattaccccggtttaggagttgaagaacgctttatatatggtatttcgattctactagtcaaataaaaggacctaaagtgaacttattccccgagaggttactaattacggcctgcttgcatttggaaggccagatcgaggcctaaaattggtacgtataagttacaaggccgaaaagttttcacattgggctgcttggtgggttggttgggcccaatccacgacgaaagaaaagtccaagtccgggcccagtgcgcttgcctgctttctgcggacgtgtcgcggagtcggccacaaactcgcaaaccaaacccggcgacggcacacaggttttagcaccggacgggagctctccgccgtcgccgacgacgccgccgccgccgccgccgccgccatctccggcatgctctccagaggaaggtgcgccgcgcgatctctccgattgagccttactgcctcctcctcccccctcccctgctcgttgcgcttgaatttggattattccttactcattccgtgggttttccctctccccccttccaaaccagatgtttcccggcggcgagtcggatccggccgctggtcagggccttctgcgacgtgccgccttcgctccaggatgcggccgccggggtgcccagctcgcaggtacttttaccactggagcgtgccgattttgttgtttagggtgttgtgaactgctctgtgtggaactgaactgaggagttgatgtggaacaagcgtatactggtgttgactctggctgtaaacttgtaggatcacacagagaaggttgatgatgtgaaagctagacccgacgagctcgacattgctatcgttggtggaggcatggtgggattggctgttgcttgtgcattgtgtaggtattttctgttcatgttgtgcttccttgttttttgttggctctgcttactgtcagtcgttttcggctgtaaagaagacttctcccttattgttgtaggctatgatattgtctagaaaaaagtttttaacccagatgaaaatagttctcaacgatcctcaccgacctattagtgcaatttgaagtgctattaatgattcttttttttcattggtattggtatgagtagcttttcatgctatagttgaatcgcaccttagacatgtgaaaatgacgattggatgtttcaaatcagaaacacctgtcatttaaggatcaagtttttcacatgcttatttatccacatgcagccaatatgccattgactaaacatctgagggttggcatcattgatagcaatcctgcattgaagtcaagaaattatctgaagaaagatggtgtacctgattcaagggtcagtactattactcccgcgaccatatccttcttcagaggtacagtttttaatcgaacatgcgttgatattatctgtacgtgttcagaatttttcaggcgcttgtactttgaattaagtttttcttaacatggttgggtactttgttgatgacgttttatgttggttttgagcagatatataaacataatgctataatcgtttttgtattacttctatgtctccatcattttgtaaagttatctagttacatcattagtagtttattttattatcttcctttttactcttgtggatatctgcttcattatataaattagttgatagcctaccgcctacctgggatgatcactatgcaatattcggctgaactttctttcttttggagtacgtactacagtaccgtatagtgataagctgaagcgacttgtgaactccattgatctatatgctcaccatttccgttgcagtacagttgcatcatattatatatcctttctcatgtgtgatcttcacaattttttgctaaggtttcagccctatttttgcacattaaggctgggaaattgcatgcttgcacagtacagcttgagaattgctgtatctgtatttctcccttcaaacgtgcaaataagctacttttacctactagtgatggtagcgtaccattcaacaatttcttcatacttgtaccatgttatattgcagatattggtgcatgggatcatgttcaacagcaaagacacgctttctttggtaaaatgcaggtgatataccttgcttgtcctgatgaaatgatttgttctgtatgtatagtgaatatccttttattttcaatttcacctttactctatttttgtccaacacatttaactctatttcctctttgagcccacttatttctttaaagttcaaaattctgaacatgttgattcttattggactaggcggctttgttcttgcctttatatcaatatcaatgaaaaactaagtcagcctctgaattcatctactgcaggttccacatcaggctagcaataaaagatcattgtacttagaattttaaaatactcgtaatcagttctcaattggaacatagaatagttgtatacctatattatgcttctgtttgcatacccatatttttagtagtctggacccatacatgcaagtattagaacttggatcctttaccttttgtattttcttctttgatgttgaacttgcacaaaataagagcagtttcttcctccagatagtgggcgcttcagtttaagcactaactgcaattctggatgtgctcatgtgctatttgctaacaggtatgggattacactggactgggttacacaaggtatagtgcaagggatgtgggaaaagaatatctcgggtatgctctatgaaagcagctgtgatttatgactaatttctgtcaccaactcattactaacttcttatttattaattcaatgtttagatgcgtggtggagaacaaggtgctttgcaactcactgttgttacgattacaggtttgtcttcaattgacatatttgattttttttagtatctgcatggagcgtgatgtttgaactcgtctaataccactttaatctgtaaatggaattgtatgcttccttgcatatatttggaatagaacattcttaccatctatgcattcaagacagctaaatttatgaggcctttataaacacacacacacacacacacacaccattttatggttcctttcctcttggttaaccaatatagtttattagcagtaaaggttttgtgataataatagagtaaattgcattagcggtacatgaacttgtcaggtgggtgcactttagtgtatgaacttataaaatgctcgttttggtgcatgaacttgtttgatacatgcaaactaaggctaaaatgacacgacaagaccgatttttctatgctgaacattataaattataaattagtagatgatgtgcgtgcacatagtagaaatgttatatttgtaaacttactttccactttatctttctttgtttctatctcttacatcattactcggttttttattttatgcaatcgttatgcctatatgtttatccttcttagacacatgtttacatagagtttaaatcaacaagattaaccttgatgtgcgattttgaccttgttcgcacgcaccaaacaagtttgtgcaccaaaacaagcgttttacaagttcatgtactagatgcacccatctgacaagttcgtgtacctctgatacaatttactcataataatactcccacccatgtgtaggacagagtaaacctacatagaagttgatggtcgggttatttgcagccagataatcttacctttatttttagtaaggctaatgcttaaagatttttgcttgatcaggaggaaaatggagacattgaaaagatgatctaccctactagactgatttctcttgctttgccatcaaagagcagacaagcaccaacaagggaagcaatatccagtggttaccctccagaagaattaaatcgcagcaatttagttaaacttgagctaagtgatggacaaactttatattcaaaactagtggtaattgcctaccatcttcttttgcatttgttcaaacttctgtctttgtccattgccttcagttgcctacttaaatgtatggttgcaggtgggagctgacggttccaagtccaatgtaaggcaaacagcaggcataaaaacaacagggtggaattatcctcaaagtgcaattatttgtacagtggagcatattaccgaaaacgattgtgcatggcagaggtttctcccttctgggccaattgctctacttccaataggtgacaactacagcaatattgtgtggacaatgagcccagaggagtcattgcgccataagtcaatgagtcctgaagattttgtgaagtctgtgaacaatgcattggattttggttacggtccacatccacactctggtagtcttgactattacatggaaaagttattttctgacattggaagtactgctgcatctacaaaggaatgctttgaagtacctccaaaagcaatcggggtagtctgtgagagaatggcatttccattgtcgctgaagcattcacatgattatatttcaaaaaggttagcactagtcggtgatgcagctcatacagtccatcccttagctggccaaggtgtcaacttaggttttggagatgcagctgctttagcaaaagttatcgctgaaggagtttctgtgggtgctgattttggggatgtaagtacctcttgctgcaatcttttggttaacattttattcaaatactaacacaacctggattctattagcaaatatatcatcatcttgaaagttgaaacttaagtacttgactagatacaagtgaaagaaccgatcatgctgcatctgaaatattgtaattcatttcccctttagtgtagtgtaattcttgttggagtgcactataaacatcatatttatcatcacatcaaactaacatgataaatgattttatttgacagatttccttgctcaaaaggtatgagaataatcgcaaagcagccaatgttgcaatggcagcgctgctagatggtttccagaagatgtactctgttgattttggacccctcaatgtgcttagggctgcagcgtttcacggtgcccagtacatatcaccactgaagaagaacataatctcgtatgcaatgggcgacgcgaaatggccgctgttttcatagacagtagatccggaaactttaaatttgttagttgttactgcagtgtcgatgtgttattctaaattagtatagtgtactttgtctccagtgttctcatccagagtagtaatgcatcacaggcacacgttgcagagaagaaatgtagctagaaagaaataaattggatctcctggtgatctaggattaccttgaatgtactcctcttgcactccagtaactcgcttctgttttgacccacaaagttcagatctgtgcaaggcaagatgatattgaagtgttgactgttgacgaagatcagtcaatctgtgcaggttgcagtctagcacctcctttgcacgtagatattctttttctcgatttctacgggtactatatcaatcaactcgtgtgaaagttctataaatatttgggtggggttactgaattttaaagaacgattgttcagctgttttttttttgtgtgggtttctagattttagattttcgtttgtatgctttattaagtttgtttcgtgtaaatttttttttcttagaatatctttctaaatcattttttttactttgtgttaggtaatccatttgtctgtaccctcatatagctatcatggaaatcatataatctatcaattcgagcgaaatggggctataggtaattatgcttagaagtccggttcatcgaactttcctaggcataattgcaaaaccagtctgagccatgtgggtcctagcggctaatgtttccgatgataacatcacaccaccattttccgatgataacatcacaccaccattttacctgctgttaaaatgacaaaaaaaatgaaaaaaaaaacagaaaataagcaagaacttttacctgctgttaaaatgacaaaaactaaaaaaacacagaaaaaaaaccagaattttacctgctgttaaaatgacaaaaaaatgaaaaagaaaagaaaaacacagaaataaaaccagagtataaactcctactagcttccttggtggcgggggtgtcaaatcggatcgtggccgtggctgaagaaagcaactcaaccagctgccctcccaaatttctctcctcttgccgacgactcggaaaaaaaccgcggacaccgcgtccgctcgacggagggaaggggatgagctcctcgtcggcgtcggctgtgccgccggaggacgacgtctgctcggtctgccacgaccgcttccggatcccctgccaggccaactgctcccattggttctgcggttcgtctcccaatcttccctcgcccttaccccccccccccccccccccgcgcgcttcctggaacctcgatccacctgtttccaccgattaggttgggagattatgcgaaactgtaggttttcatttgattccggtcgtttttttttggcttccgctggatatagaaatggtttgtattggctagaattgacaaggatgttgtagattacgcggtttttgagttggctgcatgatgagaaggctctaatttgccggtttaggataatttgtgtatgtgtgtgtcgatgccaaatgagggtttatggtggttttttggtaggttggttgaaattttggaactcatgtagctggaagactgggagtagtgtgtaatacattctacatgaactgatggaaaaccaggtcagatctaagattgtgccatacacttgaataccaatgaacaccacaattgctcatcgagcaactatgtggaaaagtcaacttcatccctaaagccaatcaaacaccatctcagtgcttgtgcgcattcatatttataggactgaattaggtttatacattaggattatttgggataaccaaatggctcttacccccttagttcaatggtattacttgtcatgttatgaaatggtagcattaattttattcactccaaaagagcaatatcttctatgatgcatgaatcaggctcaacactatgaaatcagtatgatatgatatattatactaccactttgtcttttacaacagagctacccactgcatcagttattctttttatttcagtttggccataagacctggtagcgcatatgctttttgagcatgtatttcctacccaactatacttccttcactacttctctagtattactgaaagtattagtagtaactatgctaattttgttgcaggagagtgcattatccgtgtttggaatcatggaccttctgtacagccttgcaagtgtcccatttgccgtcgccttattaatcttctggtaccagcaaatgtatcaatagataatgatgatgatccgcaaattcagcatgttctaggagaggttcagcattacaaccgcatatttggtggaacaccccgcaacctgactcaggtttatacattgttcacgaaagcttacttattttgtcttcagatttggaaatttgaatgtacataggactaatcaacatcaataaatgttgtatttgcaaacacacacacacacacacatcaataaatgttctccaaggggatatgtttcattttctcataattagctcattgttccttgcttgcatgctccccaaattcttttataggattcatagtgtagttttgattcctgcacaggttatgattgagaaatcatctgtcttctaactcctacaatgcatgcacatttcagatactggcatgcaaatgggcctctgcaccgttgagttctaaaaaatggtagcatgcatttaatattgttgctagataatctctattaggtcaggtttcataacacctagcattttatgcctttctgttggttcagtatctttagctttctatttctttgtgattgtgtatccctatacagagtaacatccatttttacataatcaaaccaacgctaatagtagcttctactcttgctctgaaaggcagtacttcaacattaatcagggtaaaatggaaacatgaacacggttactctgttatgttggaaagattatagataatagtgtgacatacccttattcatcattactctatttgtacatattgactagagttgtcatagttgttgtacgaggaatgtgactaaggtgtaacatgttgtcatatttaactatcttagatataacaaatatgagcatatctagttgactaactgcagtagctttggtagctaattacttgatgttttcacgatcttttttcagaggttgcaagacctaccctttttcatcagaagactgttcagggaactactggatccccagaggaccctcccacttgtcttcagggcgaggatggtcatgatggtaaggttttatgccattaaagtgccttttgttatctgtaaagctactatatgtttgtggaagtaaacattgtttctcactgattaaaatttgcaggtagccctgagtgcaatttatgtcctgagccccatcgacattcttcctgaaagtaagttcgatattcttctccgcgatctgaattccagtaccactgggcatacgattgttaaatgttaatgttttgaatatattatagacgtgctggggctgtttggattcttcgatgacttcctcgtgctgctgatcgtgttcctccaccttgctgctgtctaccgttctctgctgctctaccgccacggaggccactgaattgctgctgcacattacgtgatggcagatggagtacttgcgtccctggctgacgttctgagacaagagatatttcatttgtgctggaagagattgctagctaaagtcgatgatgattgatggtacgaatgatggcggcagtagtttctctccccctgtgtattctatttcgctatgctatgccttgtttggtgatattcacatggtggatttaatgagaccgattgctttttctttagtttgatatatatactcacacgagattagcaaatagcaacaacagtgagcacttgttcatccttgatgagccccaatggcattgctgctccaacaactatggatgggcctatggcctctgccagagaaagttttcttttcttttctctttattttttcttccttttctgaggagtggaaagaaacatacactactccctccgtcccaaaaaaactcaatttttaggtttttgtgtctagcgtttgaccgtccgtcttatatgaaatttttttgtgattagtattttcattactgttagatgataaaccataaataatattttgtgcatgacttatctctttaaattttttcataattttttaaaataagacggacgttagacacgaaaactcagaaattaagtttccaaacggcaaatacacttttttcttttattttcctttttttcaaatacacgtatttagaaaattctcctcatcaaataatagtgtatacattctaaaatctgtcgaaattctatagctcgtcacattccgggggaaaaaaaattgttcgtagtcgtggcgtggctcttgctgatgccaagtactccagctccccagtagtgtgaagggctaggctacggctcgcctcccatcttgtctctctctctctcccctctcccaccggcagagacgcgctcctgtggcggggagggagcagattcattcagccacacagacacaactcgtcttctcctcgaggagctagcaaccggctagcggagcaagagcaaagccttcaggaatcaggaggcggccagattcgcgcgcggttcctccctcctgtgcgtgcgtgcgtgctctctctctctctctctctctcgtcctcgaatttatctgttgttttttactactagtgtctagtacttgtgatttcaatcggctgctatgctcgttacttgcttcttcattcatagaccatatagtccctacctctctggatggatgaaattgtgtgagtaattgcttgtgctctggtgtcaaagggaaaggaattcagtcgcgtgctacagactacagagagctcttttgatcggaagccaatgaagtaatggagggtatataacctggggggggggggggggttgtgcgagagttcatctagattgaaatctgactcagaatttgcggccccatttatctccttaggaaatttctgagcaccaagaccatcaaattcccccttctgtcacctgtatataagtgtctgcctttcctccatgccattaactgttttagccatttgattgatatgcaggatgttggcgaaatccccatcattgcctttcttaactgctactgaaactgctgcgatcagcctctctccaagcgtaagatgctccactttgtccggtgatggccattcatgttgtgtttttccagagattctcaccttcatttcctgccatgctgaatcgacaaattatatagttttgcactgttaatattgagcatgtgcgcctttcagtgtcggactatatttattggcactctttatatgaacgtgcgccccacataaggattaaatgtcttgttcagtgaaaaaaaaatattgtgccagctgactacttatgtatcatatactatgacaccatatgaatttgatgaaatggcctctcaaatgcgtttaatgaaacagatgtgcgtggggttcttcagtcatccagtggttagatacttagatatacctttacacctcgacacgttcagcaaattcagactgcatttaagtatttattttggttaggtccctggcagcattctcattgatttgatgttcaatactagatgcttttctcaaacatcatttaccaattctccatttgttcaaaaatctatgttttcagtgaagggccatgtactgtgtttctgcacttggagttatgtaataagttatgcggtgttttatacttttattatgttacctctagtttgtaacaagcttgatatctccattaggagttctctatttctatatgtctatcttttttttccttgaaaaaactggttcactatatcacattcagttccagcttgcttcagattgatttaatgtattttgatgaattttgagtgattcatgttttgtgtagtgtgatctctttagttcaccaaatgcgagattttccaagaagaaatatggaggaagattaactatccagccaaacattgaatttggaaaaactcaaaatagtaggactcagagaaaatggaggacattctccgctgatcaagctcaagctaccgttgtcgatgctggtgacaacaaaacatgggaagaagccaaacagatactaacatcactggattactccattgaagacgccgacaaaatgctgaagaaggcatttggatggattcattcaccatactggagtgaagagagaaagaaggaggttccaaatgctgaggtggttagtggagtactgaactacattagaactcttgggctctccgatgatgaccttcgcaaattgctgaagaaattcccagaagtacttggatgtgatcttgacagcgaggtgaaactgaatgtaggcaagctggacagtgactggggaataaatggaaaaacactccggagtcttcttttaaggaatccaaaagttttggggtacaatgtggactgccgaggggactgcatggcgcagtgcacccgttgctgggttaggttctagttctgctctacgttaatgtgcagaacttacagttgaattataggttcccagctatttgtctatttctatatcggttactcaaaacctctcttaacataaacaaaacacatttatagtagatggattagcctcagcatgttagttttgtttacatcttgaacagcaccttttccatactatctgtatcagggatgtaaaaacaaatatatcagatacctgaatttctgtgagtgcttcaacgtttaattgttcttttcttttggtctgttgaggcaatgagagtacttgaattgtgctgttctgccattcttgtcattgtgcttgatatataatcagtatctcatatttgtgtattaaaaaaaatcagtttctcatttgcatctgattacctgatatatgtatgatgaacaagtgtttcacggttctgagtaatgaaatgcaatatgatatgtcagtatctgcagatggaaggggtctcagattccccaatctcttgggttgtttcaacatgtgcaggattaaggtatgtccagtctaatgccctcttctgatttcccctttttagagagaaaaaaaatgtttctaacatgtttcctaagtgttgtacatgctagtgtcaattgattaagcttaagctttgacattattcatcaggtttgagagacagttcaaagtttgaaaccatcctctgttctcaaaaatcgaatgctgctgctgcaaagagatcaattccatcgaattcacagtaatcgagccccatcggcgagaggcttcctcgctcatcctccatgctgcctttgatcatcaatccatcggagaagaagcggttcgtgtccaccgttctgcccactgcctcgccggcggcgtgcggcagctgaccggaggcggcgtcgtcgtcgtagtcctcgggcggcagcgccggcgagtggccgtcgaagatggcgacgtgggcgaagagcttgtccttgcgggagaaggaggtgccgcaggagcagacccagcggtcgcggccgcagtgcttctcgtgggtgcggaggtcggcgacgacggagaacctcttgacgttgcagcggcggcaggtgaagctcttgtcgcagtggctccgccggtaatggttcttgacgcaggtgggcgtcttgagcggctggaagctcttgtgctccctgttcctcttgcaccccacgtacgggcaggagtagaagcgcctcctcgccgccgcgtccgccgccgccggcgaacgcgacggcgaaccgccgggcttggccagcgcggccgccgacttgtactcctcgccgtgtccgcgcatgtgcatccgcaggttggcgtcgcgcttgaagcccttgccgcacacgccgcagaagtggacgtgcggcgccaggatctcctccttctcgatctggaccacctcgtaggagccccgcggcggggcgcgctcgccgtcgccatcggcgccctcgtcggcgtcgctgctgccgtcgtgcttggcgtccgcgtccgcgtcgtcgccgccgcggcgcgccgcggcgaggttcttggagatggagacgagctgcacgacgatgcagctgagctcggcggcgacgatctgcggcggcgggttcggcgtcgacgagattatgccgcggaggtggccgatcttctgctccagaaatgtcaggtacgtcagcaccgccctcgcgttcccagctgctgctgctgctgcttcgccgccatggcgagcttgcgtcgtgctactcgcatcaaaatcacacagctccatgatcatctgggagaaatcttcatcttgctccaagtacatcgcctgattattattattgttgctgaaatgatcggcactactactcatcatcatcgtcgacaacaacgatgaatatgatccttcccctgaaatacatgccaacaaaaattgaatcaatgatcaagaacccaaatggacatgttcagagtggcattggcaatggcataacacttaccctgagatgatgagaatgacaatgctgatcaaagaaaggtaaaaattcgatcgagtgtcagatgattttttttgtgctcctgatcagatcacttctgcttgtcggtgatgaaatgtgagtcgagctgacagctgagctaatcaaggcagtaatatatactccaattgataaggtgtgtgggctccacggcggcggcgactaggtcgacggcatggtaagctcttgcgtcactaaagccgaagcattggcatggaaatgtaatgtgcacgagttggttgactggtttcttcttcaggatctcgtgctttttcttcctggctcttggtgctctgctttggtcaggaaagccaccaaattttgcccttttgaacaacagaaagcttacatattataatcacttttttctaattaaacttctttaatattttttacacaaaacaaacatattatcaaaaaaatctatcaacagatgaatagcaattccgtatatttaatgttagaaaatatattcaatgttagatttaatgaaattaatttgatttttaagatgttactaatttttatgtaaatctagctaaacttaataaaatttgactagaaaaaaagttaacgacttataatataaaggggatggagtattttataattttactgggtacacgttgcgttaaaaggccccatggatgtgttgacctcacttgccgatcaccattccttcactgatcatttttttgcctttcctctgaaagagaacagcaaggtcaccttccttccacagcataagtaacaaggtaagcatgatgcatatgcttgggaagttgggttgatgtcaccgggtattaccgtattgtgttcctcttgagtatctgtgagtgttcacaccaaccgattttattaagagcgggctaaccgcatatttgtgctgtaacagaagtgtttacacacgatacgtatgctccacagtccacatacgctactggtacttattttgttttggagatctctaggctttagataacttaaaattgtgagaaatttcgctcacctccaacctctaaatcaagggaaataggagaaaagagagagggaaattaatggcaaaggactcaatggcggctgcgatactaagttagaggttagggggttgaaggcagaagaaacagggggattccatgaacttggaaggatgacgggaagcgctgaggacatgcgatcggccgtggacgtgggcaggtggcttgaggggttggaggagccacggtggacgaggtcgacaatgggtgcttccgatctggagtacttcctccgttttatattataaaactttttaatattacctatatttatatatatgttaacgaatctagacatatatatgggtttagattcattaacatttatatgaatgtggacaatactagaaaatcttataatatgaaacggaggaggtagttagaaagatgagggtggcagtggtggcggtgtctcatagcacaagccgtcgggaaaaaaaacaagcagggtgggggtactttaccgccgcttgggctttaggaggagcaagaggaggggaagggagaaggccggtagggcaagccttgttgacaatacgcaaggggtaggaaaaagcacaaattataacgcatgtggctcaatcagatctggagtcaggggaagatgtccgttactgtagtagcacacacaaatattgatgcaatctagccatgcataacacaacttaaaattatgggtagttttaggtgactgaaaattacacaaccacatttcttttatttcttttatttgagattagtcttaaatgtatcacacttctctcgcatgttgtgtgcgaggacaaggagacactaaaactaagtttttctctaccaactaatttgttgcatcaatagtgaagattaaaagtaaagtaatatttcttttttttaagaccaagagcttgagttttgtttaccagaaaaaagatacaatcatatgcgaaatcgtcaacatatataaagctagaccaacggctataacactctagataattctcgctaaaaacatgatggaaaaaactgcatagttggattatacattatcggttagtattgtgtaaacgaaccacggaacaaggtgtgtagaaattagtaagtcgagaggggcgaccaagtcaaaacgaagagcgaaatggcagcatgcagtgcaccgtattcggacatgcatgtaacagcgtccagattaagtgacagtgtgccacgtatgtccacgtacagttgcgctctgcttagaagcaaaaggcaaattttactacatgacatcacgactttgtggttttagttgtaaaacactgcacaaactcatttttggggggaaacactatctaacactgcacaaactcatttttggggggaaacactatctaacactacacaaactcacttttggggggaaacactatctaaacgtggttatttgtttgctgctggacaccgcgcgcattaaaatattaatttctagttgagtaggagagataaagagtgtgaaatgtcaaaaataccccttgccccacttgtcatattcttcctcttcctccttattttccctttctaatgtcacggcagcgctccaccgcgtcgtgggtgcactctggcacggcggcattcggcggagacagcgctttggcagtatctgtgagtggtggcgcctgcatgaggagatggaggcggactcgtggcgcgtcatcgagctccgaaacgatgggaaggcggcgctcgacgacgggcggcatctgccgaagttgaggaagagagagagggaagcggcagtgcgaaaagagaaggcttcggcctcggagcggccggagctcaccggcggcggcagcggcacgggaatgacgtggcagtgacgatgtcgcagctcgaggcgacggcatgaagtagcggcggcgtggcttgggccggctcggagttctccccctctttgtgctaatccacaagcaaccaacatcacggagtcaaatctctcgtctccaatttcttcctttttccattgagccaaattgcaacactcaaacaccaaatcgtacagtagcaagccacacacaagcatagctgctgctgccccccatcgaaccgttgtagagtgctcaggcaccactggctagagtgctcaggcaccgttggcggcagcttagccgtggtatctggacgcggcgcacctagcaagaggtctcgcccgacgaccacggcccccggcggttgggactctctcgcccccgtgcttgccatcttgagccgtgggcgcatcacctgtgagacgccgtggtgggagatagaggaagagctaaaggaagaagagaggaagaggaaaagaaaggaggggcaatttggtcacttcgtgtaaaattttgagccctctattgactcgtcaacacgaatacactattttaatggacgaatactctattgactctggcaaataaccacgtttagatagtatttttttcccccaaaagtaaatttgtgcggtgtcctacagctaaaaccacaagtcgcgatgtcttgtagcaaaatttgccaaagccaaattaacacggttagtcctgtcgatgttattggcttacggctccatgcacctactgacacaaagggtttattgaagtttctgatagctattagaagcgatcatgtaaacattctaaattttcattttatttttttttaaaaaaatatagttgtagaattaaaaaataattaaaagtcggaagctaattataaactactatgagtttcttcatattctaataagaatcttaagttcttaaacaaggacaagaaagctagtgtaacttgtttgccctttcatgtaactaaccgaccctatgcttgctgccgttgaactgtcaccgactgcacgtgtctgattactattcttgcctatattttgaaacagcttatccaaacttagtagcttacgtggcagaatcttgaagctttcacaacacacaacgcagctctcaccagacaccagccatgccttggtcgatcagctgtactagggagtatatccttcaacaaacactgttgttgatggttgttcttgaaaaaatcgaacacaccggtctaggagatctgcttagctcctgtgcaggtttaaagattaatgagatgcgggcgtaccagttagtttaatcctacaactgacaagatttacaaataatagatcaaacagccgatcggctgacaagccgatagagtagttccagccgatagtcgataatagccgatgccgataccagccgatagcgataggtttaagcaatcggctatatgtccaatgtagataatgatataaagacaatcggctgatgataatataatatagcaatataatccagtagaaaccaatcggctaacaatatgaaatagtagaacaaatattgatccgaaggttaaagcacgcatcggctggaggtccgatgtcataagatccacaagattatattaaacagtgaaacctttgttgccatcagctaaatccaacttatatgtatatacaatccctacaagccgatgcaacgtccagataacttatcggctagcaccccgataaaatattagcatgaacctatcggcttaacaagacttatattatcaactacaatctagtagatcgaacctaaccgatgcagcacgagattgtatatgataatctaatactcgatgagccgatagatctgtctaatgtgatggatataacaaatctatttagaacaacattatgattgtagagatatatcggctaagataggggatcagacctaaccgagatagtcccaactaaaccgatgcgtctctaaacacaatgcaattagagatagatttgagatatcagataggcaaatatatcaaccaaaccagagtgatccaagagatcgaatcgatgcagccttgaacaacaccaacatagccgacagattcaccagggcccaacagaacgtaggacttaccccttcgttggagatcgaaagtcgatgcagccctgcgtcaggtgcccaagttccgccggaagataagtgaaaacctcagggaagagggtggcgatgtgccgagagtattattgatcgatagattgatagattacaatgaccccgggtgtacatatttatacccatagggagatactagtccttgtcggacaagaaagaaactaaaaaggaaaagataaagttcttatcggacactaaacacactttcctaaagataaaaggaaactaacaaactatacctaattaatagataataagcttcctttaattgatccgactccaccaagaacacgacatcgtggcgacttgactcccatcggctgattctagaactttgaagccgatactgactctaaaccgatggtaactttgggcttaccaaatttcactgttaacaatggtatccgacatggaatactattattagagcaaatttaatagtatagtcaactactaactccaaattatctagagctaatgtaatagtcaatttatacaatagttgcttactatactattaatacccgattccacctgtcatacactcgttacgttgtgaagtctgtgctgcagttggctacatatctgtagtccgctgctcttctctctctttatttgtctatttaaaatatatttatagctggcttatagcccgctattatacatgctcttatcatattaagagtggcttcgcagaagctgcggaaaacaacaaaagcggatctctatgattgcgaaacgtaactatgaccgttcgtgcgggaaagagtgttgtctttgtacagggccccacccccacgggacacgcaccagctgacagtccaatgacggtgagggctatgggccttgggccgcacgcatggcatggcccaattgctggccgcggccggacaacgaagccgtgagccgtggcccattaacaacaagtgggccgaactaagttgttgggccgtagccaagttacagggaagagagacaaacaaaaactaacggaaaacggaacacgtaaaattgcacaccatcagcaacatgatctgacatctcccagatatatgggcatgcatttacctcgaattatccattcacgtcaactatatgtactactattatataatatataatataataatcgcttactattaatatacggtacctacatatatattttctccgtctcaaagtgtagccatgagcattatgcgtgaatttacacgagccagtgatttctttctttccttgttttttaccgtccatcactccatcaggtgaggtaagtagcaaattatcgaaaaagtagtgcacgagtattcgccattagttgatccggcgaatcggtcgacggaaggagaaatcggataaacgtcattttcttccgttttcaattttctttttccttctttttacgagattcttctgtaatatgttgcaagtatcaagcatttctgttttttttttcacttctatttatttctcagattttttttgttatatatagtttttgggatttgctataaaaaaatttctagtttttttatctttttaacggaaattttctatataaaaagttttcgtgaaaacttcctatatatgtagggagattttttatacatatatatatatagactttgtatatgtaaactttatatagaaattacatcatacttacaaagtttagtgcagaaataacaaaatgctaaaggaatgttttttaaatgaataatatccttagaaaatttctataaatagactttttatatagaaagaatatatgtaaactttatgtatatggactttgactacgtacacttcatatgggccgaagaagttgtagggtcgtatccacgtagtagtaaagtatatttgtacaagaaaaagtacaccggaggtccctcaacttgtcatcgagtttcaaaattgtcccctaaccacgatacgagatatccggcgtcccccaacttacgaaaccagtgcaacctaggtcctcggcggttttgagtccggttttgtccgatgtggcagctgactcagcgtgggacccacgtgggccccacgcgtcagcctcttcttcccctcccctcacctctcttcctctctcctcttcacggcgccggcggagggagaagccacgcgcgggcagcaggcgatggagtggcgcgtgggcggacggtgggcggagggcggacagcggagcggcgctcaggcggacacaaggcagaagggaagggcggtggcggcgggagcacgggggagatcgaagaggacgacctcaagcacggcggcaagcatagtggggcgacgacgaggcgaagcggagcggcggcgcggcagtgaggcggcggcgggcagagaaggcaggtggaatggggcgagggcggcggagcaaccaggcggagtgggacgacgggtactggagctcgcagatggccggcggcacaagactgcggcgacaacggtgaacggcgccgcgacggcgag

SEQ ID NO: 77033 - DNA, 1640 bp, Oryza sativa
ggcctgtcaatttggctcgatagaaacaattactggattattttcttttccggtggaggacagaaggaaaaacatgcaccttttgggttcaacacaccccgcatagtgtagtacacatttttgagttttcgtacaagaactcgcatataggaggaagatataaattgtgcttcgtatgattctaatcaaccaggttacagcataacactgttgtcaccagaaaccaagtagttctgatactctgttgcttgtatctgtggtctgtacacaaaaagaaaagaaaaatcacaaagcaaaagattctgctttcttctatatttacaggtacagccgatacacatgcaaatttgcatttcacatgttcctggcgtgatggacataatccggccaagagtaatctacaagagaaaaacacggatttaatgattgcgcagattactaagatgcccgtgcctcttcgttttcatcgagcaatggcctgaggtttgatctctcgacggcagggacatcatgctcactctgttcgttgaaacgatcaacgctacggacaaatatgcctgcaagacaacatctcaactcagtgcaaacagagaaatattacatccacaccacaacgcactactagtcttctatccgcatcgatgacaaccgacagaaaccgcctgaaatgtttctatgctaaatttcattttagtaatataccagcaaaaatatctgtacgttattacataatttaaagaaacatattggcttaattttagaattaattagcagtttttggtttcaatattgtgtgttccaaagtctatacgtgacttctactgttctatattatgtttggtttggagtggcatgccagaattttgggtatgtttggtttggagtggtatgtcagaattttggggagctggtggtggggtgattataaattcaccactcaccaccagcacaccctttcaaaggaatatagatattattttagataatggattaaaatctggcctctacatccaaaatacagccaaacaactaacagaagtacttacactcacacccttacaaacatgtttgacacaacaaacaactcaccacgagcacttaggcttcccaaattagcttggttctgtcttttttctgtttggatgtggttaaaggagtatagatatggcatgtgatagtggcagatttacaattgttacagggaataatagacaacagaaaagaaattgggcctgcggggttgtaaacctgtaacaagacgttataattgttgtgctaagagaacgtaccaataaaccaaaatatagctgcaatgaagaggatagatgtcaaggtaagagctgtcgatctccagttatggattttgtcctgcattcaacaagttcaagcagtaaaaccatgagctttgaacacgatgaatacccaaattaactgtcatctaggaggtattggatgcaattcagtgtcataacgcatcgcacatagcaagaatctatgtactacaaagatttgtgcaacataatatgtgcactacaagggccagtctcatctaaaatgaacaaatggatttattcatgggaaattcggcaattagacaattattcaatattcaaaattacaaatttagtgtgaacaaacac

SEQ ID NO: 77034 - DNA, 5566 bp, Oryza sativa
tcattcctcgtaccttctctagccaaacaggcagtgggagtttgaagaacggagttgatggtgggattggtcatagaagttatatttttagtccccatccgttgtttggtttcacatcgaatttccttcaaagtctcacgaatcaacaggcatccctcatatgagagattggtggaaattggatctcttaattctctatcccaaaccctctcgaattttaaagtcttccaaccaaactacaaacttaaactctcgtaaactctcgtccccatcaccaactccctccaaccaaacaatcaagaaaagccctaggctggtgtcattaaagattttaaagttgatcaaaataattaattagaacggcccctatagctcagtggtagagcgtcagtcttgtaaagtgaaggtctgcatgggggcattttattacattttgttttttttccaaattagttagttctcagtttactctctccatcccatccgaaaaaatacgtcccatctaaccaaaacagggcatattcttgttttttttccaaattagttagctctcaatttactatttccatcccatccgaaaatataaggatgtgccccatctaactaaaacatggcatattctcagtttccctgctagtctctctatccgaaaatataaggatgcgtcccatctaaccaaaatattttattactttagggtgctttgttttttttccaaactagttctcagtttacctgttactctctccatccgaaaatgcagggatgcgtcccatctaactaaaactcattatatttattgttttagctttcttttgtttttatggtccaaactagttttcagtttacctgttactccctccgttcaaaaatataaggatgtgtcccatctaatcaaaactagtgctcggttgttaacttgcaattattattttagctataatcttgttcttttttttttgtttggtgttccaaacaaattctcagtttacctattagtactatataagattactcagttgttaactgcatatatatttattttagcataatgggataaatattccaggcactttgggcgatccttcttcccaaaatgggagactgcgggcttacatgcaggtgaacaagaccaactgcagattacacagaaaaaaaaaaaggaatcgcacgtgaacaaggtcatttgcagattacacataaaaccaggattttggggtaaaaacgcaaaaaataggcagacgaaatgcggtgagcgtggatcgaacacgcgaccttcagatcttcagtctgacgctctcccagctgagctatccccgcttttaccatccattttaactaatttgaactgacactcaattttcatggttcaccctccatcgacacgtacactggagactggagtaacagtaaccccatgagtagcatactcttgaatgccaaatattctgcactttacagtgacagcaacagttcaagaattctgcgagcattgcatagtgagtaaaccatatcggtgtgcagaagaatgcatgtaaacatggtcctaactcctaaggtagggcgcctttacagcccaaatggcctacagcttgactcgaattatggccagaggaacagcctgaacctttctcaggggcaaagtggcagcggccgtgacagagcagggcagggacgctgcagcttttgccccagtgcagagataaaagcaattcactgaaattttgtgaagatcttgttcatggagatagtaacagcatatggatcatatcgaggagaggataaaagccccccgcgtcgtgatcattggtttgcaggaaagtgcagtctgggatgaaatagtgcaaccattggacgtttcatcattgtttggcagttgggtcagcagctgtgcctttcttctcaaaacatcaagagagcaaactgcgcttaaacgctttccactctccatgacttgcaatgcaaatcacaatttcacaacatcaggctagtcacacaggaataacataccaccaccgtgttagaccactaatagaccagttgccatagcaacagtgacatgacaatattgctaaaaggttgtgtactgattactgaaccaaacaccatcgtcatgtcacagatgacagaaccatggcaacggcacacacacacactgctagaaaggacagacaattaatcgcaatttcacaaacccaagaatccaaaagacttggtatctacaattgctgcctctgatgatctatctgatcacattcttgattcttcaccagctacttactagtattctccggcctaaaatcaagcaaattcacacaaaattcacccatggaaacaccagcggaaatgggaaattaagtacggcaagccatacacacaagacaaagcaagactagctccaagtacaaatcaaccccgcgcgcgcatgcaatcacgtcgcaaattgagctgcatagctgcggcgcgcgatcaccgggactcctcctgtgctggccgtctcgtggcggcgccggagagcgcggagagtaggttgaggtggtggacctgcgccaccgacgacgcgtacgcctgcgcctcctgcgacggcgagacgagggcaccccacgacgacacggcgggccgcggctgttgctgcagcgcctcccagaacgtcggcgcctcgtggtcctcctggcgcgggcgcttgccgaggaggaaggaggaggaggcggtggagggggcggacgagcaggagaagacggccggggtggtgccggagccggtggcggcgaggatggacggctcggcctgccggagcagccactcgatggtctggccgtcggacttgagccccagctcgcgggtgagctggaacacgcgcgccgcgcagacgatcggcatgcgcacgcgccggccgcgcccgttcaccttgctgtgccggtccttgccgccctgcgtcgccgccgcctttcggggagctgggagcacggcgtccacgagcgccgccgtgaacggcattgtgatctgctgggacgacggtggcagcgccgccggcgttggcattgccatgggccggtagacctggaaggtggcggcgtcgcgggaggccatggctttccgtgcgaattgaacactgaacaggtagctagggtcttgttctctaggccccttcccccttggggttatatatttataaatggactttgaatattaagttgcattttaattcttctaagtgtgtaaaaaatgttctgctggtagtttgtatggtttcactagttatatttatggccccataattgctacacgacgatagcattttttccccccgaaggaatgtaatccgataagcatattctgtaatcgactgatgtctcgagttttgtagtattattattattattattattattattattattattattattattattattattattattattattattattattattattattattatgtctcgagtagtaaaaagaatgtagacagataaaaaatgtatttatgaaaataatagtaagaattgtatactcaaatataattctatttttgaaatctagttccacgcaaaattaaaaattatgctaattttaatcattacatctagtctctgcacatatccaaatgaaaattattaatcaatcagtctagatagtaaaaaggtctggcaactataaaaaaaagggggggggggttaaatagtttgtttgcccgtatactacacttgggagcctacgagtttctttacctctggatttactttgaagaacaaaatactggaattttttgtgcctctttatttattccagcttgacacacaatctgaatgatgaataacccagccttccggtcttccagagattcttgcaattattgggaaggaaatactcctagatgcagatgattaactttagattttttttttcctctagagtatacccaggacagcagcagcattgcagggacaggcatgcagttctgtactgtagcagtagtgcagcactgtgagcataggggggcagggcacatggggagctttcactttgatggagcccgtggcctgtaggttttcactttgctggagctgtaggctcatgagcagtgcttccatctttcagtcgttcaccgctacccccctacaagacttgcaagagggctcttctggatcgagcgatttccatatgaattgaaaatggaggatcttttcctttagaggttacttggattgtaggatttgaagttgaacatttcctcggaatacattcctaagcctcaatttcataggaatttaaacatgaggtctaacctcatgggtttttttttccttttagaattctcatgcattctctttctttctctctatactcttactcaatataagtacgtagtaatatatatttttcttgtgagccatccaaacacatgttttgagtacttcgtgtgtttttgtttcttgtgcgattaaacatgttatggcacttcaatcctacgtttatttattcatgtatttttagattcttgcgtttcaaatgagcttaaaagaagagctgtaacaaaattatggtattagtattcaatgggatagataggtaatccatgggtacaaaaaacataaagttcttgggacgatgaggttgagaagcaaggatcaaggaacgtagtacgctatttgctagaggcttttacaagttcctgttttcctaggacggggatgatgttcccgcgtagaggaacgctgtctttgacctgttttcctgtgactgcataatattactccgtatgattttatgtttttaaacttttgatgcatatgagtgcagcacctgttgactctcgtagtctttgttggtcttcttcttcctcttttctttttttctatataacagtgctttacaaaatagaaacgtcgtactcctcatttgtgtataaaagtttatttattttagagcggaggaagcaacatgtagcatgacataagaattaactgtccttttttttatcaacttttcctagccatttgagttgtgttttcttttaaaatgatgtatgcccagtgaaacaaaataactgcacctgcatttccccgcctcccattttcaccgtttgcgttggttcagaggtcagttgagttcaggactagataggataggctctgatgtactaatgcaacaaccatgaacaaggattgcatggatgccatggatgctactccagtctccagctaagcttgtagacggcgaccaagctacaggcacgtcattttcgctcaaaaagccagaactgatacacagcgcgatcgagactcgagagcgtttgttaaagtcgttttcaagcaaaaggccacgctaagcatgcagcaaacggtgagatacctgtcccccccagaggttagctttgcggatgctgaattgctgatatgtgtagcagagtgaacctgtgattgtgtacgttgtacgtactctagatggggtagtatgtcaagtaagcaacttgatcattgttgggtcccggaagaagaagaagaagaagagggagaggaaaaaaaaaaggatcaccgggaggattgacg

SEQ ID NO: 77035 - DNA, 639 bp, Oryza sativa
ggagggggaagggaggctatctgctgctgcggtggccacaagtttccgccgacttggcgtgcgcgctcctgcagtagacgacaaacgttggcttgtgttttgtggggtcaagttggatgtgcgtcaatgttggatggctatcggcacgcaccgtacgtggtgcgtctttgagcacagtcgtaatgtggaatttttgtccattttctatgttttattttatgagagcctggtatttgctctaggaaaatgcttgtttcttgttactcatatttttagcttctattttttgagttgtgaaaaggttgatttctcaagtataaaaatttggagtagataatactagtgcctatgtattatggaggggaacataaaatacagggcatgtttactttgacgccattttcaaccttactaaattttggcattgccaaaattttagcatagttttcaaaattttggcaacttaccaaaattttggcatgatttcttatatagttacaaaaatttagcggcaaactaaatgtagccacttttttttgacaactttaccaaaatttggtaaggttgaaaatggcattaaagtgaacaggcccacaatagactcgtataaattctgacaatcaacatccaccgcaaatt

SEQ ID NO: 77036 - DNA, 8163 bp, Oryza sativa
cgcttggacaaagagcgccccagggatgtggcccctagcgaagaggatcggccccaccgaaaggtgcagcggcccgtctactttgttagtgaggccctccgggacgccaagacccgataccctcaggcccagaagatgttttacgctattctgatagcttcgaggaaactgcgccattatttccaggcgcatcgggtcacggtggttacgtcttaccccctcggccaaatcttgcataatcgagagggtactagacgggtggtgaaatgggcaatcgaactttctgagtttgatttgcactttgaaccacgccacgctatcaagagccaggccctcgccgattttgtggcagagtggaccccagctcccgagcccgtctcagtccccgaggccagctcgggcccctcgcagccgcctcacactgcccactgggtgatgcagttcgacggctccctgtctcttcagggcgccggtgcgggggtcacgttgacctcgccgagcggagacgtcctcagatatttggttcgccttgactttcaggcgaccaataatatggcagagtacgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggtgtatggagcaccattttgacgggatagagcttcggcacgtgcccagacgggataacacggttgccgacgaactctcacggctcgcttcctcgcgagccgagaccccaccgggcgcctttgaagaaaggcttgcccagccgtcggcgcgacccgaccccttaggggagacggacgcgcctgacaggcccccgaggcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccaatatccatgaaggcgaatgcggagcccactccgcctcgcgcaccttggttggcaaagcctttcgacaaggtttctattggccgacagctctcaatgatgcggtcgacctggtccggcgatgcagagcgtgtcaattccacgccaagcaaatccatcagccggcccaggccctgcagatcataccactttcatggtcatttgctgtctgggggctcgatatcctgggaccgtttaggcgggccccgggcgggtttgagtatctatatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcacctgcccaccccagaagcaacggccaagtggagcgcgccaatgcggaaatcctcagaggccttaaaaccaagaccttcaacatcctcaagaagcacggcgattcgtggatcgaggagttgccagctgtgctctgggcgaaccaaaccacgccaagccgagcaaccggggaaacgcctttcttcctcgtctacggcgcggaagcggttctcccatccgagctcaccctgaggtcccctcgggccaccatatactgtgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccatatcgagtgatcggcgtcccccggccgggctccgttcggatggccacgggcgacggcacagagctgcctaacccgtggaacatcgaacaccttcgtcgcttctacccctaaagggggatcgggtgtcaggtttcgggctcgggccaaccccgcacccccctcgggcgtgcagggttggccgggggctaccacatatgaatattcttatttctcttatatctgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcatagtgaactccgggggggaatcggcaaaaacccacactcgggtcacccataaccctcggtcaccacgctcccggcctggccagtctcgacatgtggatctccctaggcactagccccgacccgagccatttgaggactaggacctgggcacgagcccttgttcaagccaagacacaaaaggaccgcggcacagacatcctcgtctcatacacacaacaaatagaattgacaaaaaatttcctctttatttgattgcagattaaattagtctatacaagaagggggcccgaaggcctcggaagaagaaaggaagaaactatttaaagattggcgggggcctgggggctcactccgatgcacccgggtcgccagcctcgtcgccactgtcgcccacaccgccgtcatcgccctcctcgtcggagttgagggcgaacgcgagccgaggggccgaaccctcgaagctgtggacgatatggtcggcggcatcccggacctacgcgcgcgcgccatcctcggtcccgggagggaactcgtccagcgccgtccatggggagaagtcggggtccctggcctggtaactcgccagtacgagctccaccgctcctcgggcgaggtccctcgaggatgacttaatcgtcccctcgagctcctcggggagccgctggagagtcccggccatctccgagaggcgctgggcgaggcctccctggttggcggcgtacttcacagtccgcccgccccagagacccgcctgccgcccggcgcggtctaaacgggacacggcgtcgcgaagcatgctgggccctatctcgcctgctaggcgaagggcctcgacctccccggtggacgaatccagcgcgccctgcagatccgcgatggtgtgttcggcagctgcgaggcgggcggctaagtcgctgtcgcccgtggccgccccgccgctacgcgcccttgcatccagctcccttgcctgcgcctcgagttcagcggcccgctggttcagtgcggcctctcggcgcgggcactttccagattgcgacgcgcttgttcctcttgcgcagcctcgcggagggacaggctgtccgccagccgttgcgccgcggcctcggcttcctcgagagctcgctcccgctcggtgagcgcgtcctcgcggaggcggagcgcggactcttcttcggcacaggcggcttcgtgcaccgccagtgtgacctcccgaatagcaacggcggcctcgcgatccgccaagtccctctccacggcgcaggcacgctcttccagcgccatggcacgggcctcaagggcttcttcgcgccgccgggatgccacctcggtctccgccgcccgccgttctcgggcagcggcagcgtcaaggaccatccgggcggcgtcgagctttttccctagctccgcctcccagctcctgtattgaaggcggagggtgtcctgcgcctcgttcatcacggtggtggcgatgagggcagccccccgctcctcctccacctccttggcgatctcccccagcaccttccgacgggcttcgagctctgagacgtgccggcggtgtgccttgcggcccacctccaccatggcctccaccgagcgtcgcccctcttcgacacgcgcccatgcggcgtcaagctccgcccgctctgcttgcagggcctccacctgggcacttaacccgtccaacaccgtggtgtttgcgacggccaaggcctgcagaaggggttctgcgctcagtggagcaacggaaggcgtggggaagagccgcctcggtgaggatgccgcgcggctcggcccaccgatggacgtgccggactcagggatgtcccccggacctggcttgtcctgagcgtcgcccgagggagtgggcccaagcgatgcgcccgcggcctcgtcgcgagctgcctcggaagtcgtcgctgtcacgcccggaaattcactagtaaattaatgaacatttaatataaattctgataataatttattaaataatttataaatcctgaaacgaaaatcagggtgtgacaaatctaccccccttacaaagaatctcgtcccgagattcggaacggctagaaagaaaagggcataggtaaactgcagtctatcttattccataactccgataattattctaaggctttaaagaaaactactgctgctttgaaactggtagctgagctgtaacacttgaagacgcaactcttgaagacgcaactggcactgcattggctcctgtgacgacaatgttgttgacttgcggctgctgatgcttcggcttcggacactctcttacaaagtgacctggcttataacaattgaaacacacccgctgctcccttccattactgttatcttctcgagactgatcctgctgaaatgacactgattgagtagcttgctcatcattgtcttcattgcttgcattagtctctgagttgatctcaccattcatgcccaactgttgtgactgttcttgacctgcagaaaaagattcaccaatttggagtggcttgatacgctgcctctggctactatcctgtgcctcctggaatacaattattttccttttacggttatccatcctgttcttcttgtcttcaagtcgaattgctttgtcaaccagctgctgaaaatcaacatagtcatgggagatcaacgtaactgacagttcatccttcaagccttccaagaacttctcctacctttcctcgtcagtacacacatcttctggagcataacgtgccagacgattgaactcatgaagatactctgccacggtatgatccttttgcttcaatgctctgaactcacgcttcttcaaagcaacaactcctacaggtacgtgtgtcttcttgaatccttcggtaaactcttcccaagtgattggttgtcgttctgctctgttcatccggaaatgatcccaccattctgatgcagattagaaaaggtagaaggagaggggttacactaaagacaagaccttaaccaggttaacactgatctgatgtgtgtagactattatattgttcaagttgattaagcaagcaacctagtatagttacacactcatcaatgaactactccaataatgggaatgcaaccatacctacacacaaagcaaacaacaagcgttctactctactaactattcttcaaagacactttggcggcataggttctaaggtaggatccaaacttcattccatcttgaccacttggcacctcggttcttcctcgatcccctttacttaacctccataagtagtcctcattggcgtcttcaagtttcaatgtcttagaactactcaagttgaaagagagagggaagtagacaatgaaacaattttcaaagaattctagataaggaagaaaggagaaattttcacaaatcatttttgtcagaaaaattcgtccttaaagtttgaccatttggcttatcctacagtcgagatggctctgataccaacttgtcacgcccggaaattcactagtaaattaatgaacatttaatataaattctgataataatttattaaataatttataaatcctgaaacgaaaatcagggtgtgacagtcgccgcctcggcctggcgaagtctggcctcctcccgagcggcttcttcagcttggcgagctcggacggccacctgggcggcctcctcggcttcccgtaggcgatccgcggcttctcgccggtcagattcccgcctccgagcctctgtggtcgccgggtcctcggccttagactggccggacttggaatggcgggagggacgcgacgggatctcgctgaaacagaagaaagaccagaagacaaacaagatggatgagtgaaaactcgcgttgagagaatgaatacggccacgatgggagtgggacgaacctgcgagggggtcggttaaacgaccaccttggaggggaaatgaggtttccccgggatggttctgtcccccccatcttgcggagccgtttcttcttccgctccccctcgggctgcgacgtcggcgtggccacctccgggcgcctgctgctggcacgcgccgccccgccccctcggggaggagatgggggaggggttccttcctgcttcctcttcccccgggtgtcggcagggcggccgctccccgggcccccgtcgcggggcccagaagcacgaccccctcccggggtagattgttcccccctgcggctcccgcccgctccatcgtggcctcgaggagcccgctcctccgacgccccgaccgcctgcatgatggtcaggatggaggcgcggtctggatcgctgcagagggggaggactccttgaggaatgagggatgtctccatggaactgagattcagcacccgttggaccactatcttgaagtcctcaggagcccagtcccatctgaccccctggtgggtcctcatacagtcctcggacccggtgtactcctaggcgccccgggcgcgccgctggagtggcgcgatccggcgacgaagatagtcgccgaacaccatggcccctgtgagcccctgggatcgcaggcccgccaggcggtcgaggacggcgtcatagccatctcccagatctaccggcacccgccagctgtaggcctgcgctagaggctggctcggaagtcggaggcgcgcttcgtcggcgaggggggtgtagaaccagtcgctcttccaatcatcccacttcttgcggaggacgcagggaatgtagcggttcagcaccggcccccgcagctggaagtagcaaccaccaaccaccgacggcggcgacaccggctgtaccccgatgaacatctcgcacaggtgcgcgaagatggccaatgtcattaccgcgttgggggtgaggtgcgccatctggagatcgtaaaactccagaacatccatgaagaaaaaagaaaatggcggaaccagccatgccatagcaaaagggaggaagaagacggaccgccccgggtagtgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccgtgccatgatgccggaagaagagatgtttgagagcgagcgcgtgtggcgaaggtagggcacaggaaacaaggagttagggcgcaagcggcgaagacaaggggaataatggcgagaggaaggaagcaaatctcttcctcggcgactttatacccttgccaacgctgtgcccggctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccgaagcgccatcaccatatctccaggaaaaacgaaccggcttgtcccgatttttagaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcggggggggggggggg

SEQ ID NO: 77037 - DNA, 733 bp, Oryza sativa
tttcagtcgccatatccacttcattgtcctgcatgttttgtgatggttatacttatatcttgataattcttgctgatatagggtttttttgttgcaaagtttattttacctttgtagtgaaatggctattttttgattgatacagctcttctattcttgctgttgtattctgccaaacaataagttcttgttaatcaatagtgcaaaatagcttaagtctaaacaatttgaagtcaatattttagctaaaatcacctcagcaaaaggtgtgatgtatttgttgttgtaaatctgatcaaattcttcatagctccagtgtgtagttgatatgtgttgctcatatgtcatatcctgctgctcttctagttctggagaaaatctactggttgttaagatcattgaattctgcaatatcaaaaaacagtagttagtactgatttaaatgactaattagggaattgttacataagtattcataattttttattcttacatcaaatgctggtgtccgaagtagacttgtaaagctttcttgtcctccctgcatattcatagtttacatatcaattcatttattattttctcttttttttgtcaggtatataatgtaagttgatatgcttactgtttgttgctgtatggtgacagttggactatgaattatttggtgtatgaggttagtgtagctcaactgtccttcctgcacagttatatgtttattagtttataactg

SEQ ID NO: 77038 - DNA, 636 bp, Oryza sativa
gaattcgagctcggtacccccgatagtccaactgctagagatagagatattagtgtacaccacgctgacatgtcaacgtgttgtgccacgttagttaaagtggcagaaaaaaatttaagaaatagtcttatctctcccgtctgctaaatatgtaacaacaaatccaaaagtgttatttgaagagtggcacagtttggtattgtaataaatactgtagttaagccccccacagtagctctaataaaaaggcagccagtatatatactggatatagctggtcgtcgtctttgcattgtctccttgtccggtacgttggttggctctagcttagctggtgctcgatcgcgaacatcatgtggaggctgaaggtggcccagggcggcggcgctttgttgcggtcgacgaacggcttcgccgggcgagcggtgtgggagttcgaccccgaccacggcacgccggaggaccgagccaacgtcgagagggtgcgccgcgacttcaccgaccaccgcctccgccgcccggagtccgccgatctcctcatgcgcatgcaggtatgtgttgtgtgctcctccggcttgataataattgtcgctttggagaaggacacggtcatctacagaaaacaattttgaccaa

SEQ ID NO: 77039 - DNA, 2419 bp, Oryza sativa
tatgtcactctacccttggattatgttaacccctgcttagaatatgattatcacaagtaatatataaattattagtcaagttctctgtcacgaccggaaataacccaacgggcgttccttacgtgcgtgcattattccttgtcccaggaggcaaggtacaccaaaagttgatacagttcagagtttaacaagcggaagcgtaaatagataatttattacatgggcagcgaaggcccagcacacacaaagacaaacgagaaacagcggaagactagggcgacgaccacaggcgcttgacggcaggcacgagctagacaccaaagccttcatcttccagggactcctcttctgggtttgggaaaaattgagcaagactgagtacaaccaccgtactcaacaagacacacccacaagtgcagaataaatgcaagggagtacaagggagttataatataaagggttagggtttgcagtaaacagcattaaaagacacttagttgctcaaagctattttgtaaatacggtcctagagctatacaatattattaaacaaagccgtgaacccacacgaacttgccttaacccaaggcctacgaagattcagaccgaactggcaacccgaccctgggtcccagctcgtcccaagccaacccaggccaaccattccacattttagttgttaaacaggttttaagaattaaaacactaacttgggtacattgctcggcttgcccataaccgagggcgcgactattcgaatagattatactctgatcagaggtgtacatctttacccacaggacacatcttcctcacgtgtagccacgtgccacataccaccacggtatacggacggaagacgtgacatagtttccaacccatcctagccatagacaagagtaccgacccaatcccacctacggctggaacccccgggacaggtaggcaggactgagcccctagcagcaggacaccggccctgtgccatgacatctcgactaccgggccgcagctcatgtagccttcatttgccctagagatgtccatcgacccccgacttcgtccatctccatccgtgtacttttgtttataaccaggctgagccacaaactaagccttaccaactagacatgtggaagtacggtagtgctttgcaacagaggcccgaagaccggtccttatatcgccgaggtgctactatcaaaaccatgcaccccgagcccagcctaaaaccattgtgggaattttgaatagagggggcggggtgaatccaattccacaataatcaaaccattccatagtgtccaggtgatgagaaaattcccaaagtctagagatgtaaaaccacctaatgttgcctaattaaccagcgaagcatctacctaaattcataccagtggtaccaagagtagagtgtccacttgttggggttttgtttattctagggtgaacaaggaaataataacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaagttttaattaaaaaaaaggtttattgcgtcagccgaggggagggggcgcgcggaccgggtccacgggggtggttcccatgcggcagcctcacggtccacggtggactgggcgcacccgggctcgcaccggccggcgccgtgggtcccacgcgtcagccgcacccgagggcgcgggcggctgacggccgggccccacgcggcagccgctcggtgcgcccgaaggcggccacgccggcgcaaaggcgggaggcggcgcgcccgcgcccctatggtcgccggcggcggccataggcacggcggagcggcggccgacagaggggagggaaagggggaaatgaagcggcggtccacggctcacccctgttcgacggcgacgacggaaacggcgaccggagcggaggaaggcggcggcgcggctcgggtggacggggtccacggtgctccggcggtcggcgaccgaaacggagaggtggacgaggtcggcgaggacgcggcgaagcccaaggaggcggcgcccaggtgggaggtggt

SEQ ID NO: 77040 - DNA, 3440 bp, Oryza sativa
atccaatggctaaaaacattggttttactggtttaagtaaaaaccaatgattggattttcttttccataagaattttaaagatttaatctatctcattagagcgtcacctgatatcttagaagtatttatagaaatgtcacgtgaactagaatacttcatagaattttactatataactaggaagataacatgtgcattcacgcgggcatcgtattatttagtttcgaaaacagatataacaaaataagttaaaaactaaagtatggtattttccctttttaattgaatgttcgttgtttatttttcttaagaaatcttgacaaaattttagctaacaaattaatttttttttaccatcatgctggaatataaatatcttagatagcgcttctctatgacatgagggaccctacgctatttttaagaaaacacatagtcaacatgagttttaaaataataatttattggaaaaaaattgtaaactttaatcatattgtcataagaaaggctactgattttgtattgccaccttagtagcttatatgtgcaagatgtggagaaacctatggagctactttaaaggacatgaattttttgagttcgttgattcataattgaaatatggttaggagctaaaataattttttttctatagccaggggagtagaatgacttaatactatcttgtgggtgaagtgctccactaaatagttctatatacaaaagctgcaacgcaatctcgtgggtaagtactgcactaaaatagttttgtgcaaaaaggactgcaaaagttattttcaaaggcggcccatgagcgtaatgcaagtggctcgccacaaaggaggctacacatttgagccacatgtgtaaagaatgctcgcgaaaatcatttgggtaacattacaatgaaaataattgttcatgcaattaaaaataagtgtcttaaaattatcattttatacattggttgttgataatccctatttgaaaatagtgatacgtacaaatatttttgtccatattattccttaccaacagccgatggcaattgatagttcctttcggtatgtagcaacattggctaggtatttttacaacttactattgtatccctttgttaagatgcccttgctattttcttatatgctagattttctccaccttggatgcatgtgacactatatatatttcaaataaaaggcctcgtggagttcaaattgatttcggattgtaggagactactcactgtttatgcagagtgcgtgagacttcacgtggcctagcaggaatataatttcctagcaaaaaaacaattccataaaaataatttttattgtggtgtggactttttatgattgccatcatgagttaaatatttttactctaaatatgatttatatacttcaaatgatcactctttataattttcctttagctaatgtgcattggccatttagtaagtatacataccctatacacacaaaatttttgtatacacaccgtgcacaccaactacaatcacaaaaaactgtaaaaaaaaactatgcatgtactttcaacagtacaacaaaaactgaaaaaggatgaagaaaataagatgatcttaagagataaaaaacgaatctggacatttgtttagaaatatttatatgatattgaatgaactatttattaggagataatatatgaaaagttggctagatatagtaagttgatgggctttttaggcccataaaaaagtatttaattttaatttttatggggattaaaaaaagagaggaacggtagttggagggatcgttgcgcaccaaggctgatgtccggacggagattttctttccttgtgaagtaaatctaacgtccaaaattaaaggatccaccaatttaaatgagaatcaattgtcttgtcagatttttactattttgttatagtgacacatgacgatttgagagtatttataggatgccacatgatagcctaggaacgtttgtagtaaatttaatggacttttaatataatagatagataatatatacatggttaaaattaaataacactatgatatctactacaattataaatgggagtacctatacatctttcgaaagatttttattatcgtatcacacagatttttaatctttagattaaaatccgatagatataataaaaagaaaaaagcaattaagaaacaccataatggacactaaattaccatatcctcaagaaaaagaccaaatccaatacaaaatttaaaatttacatgcgaagattcaaaaattatagtgtaacaaaagttacagtataagtttcataaattacactgtaacttacaagaaaatgcactgtaaatttgagtgagaaaatcgagtgagagataagaaaaaatctttcgagtgagatatagcaaaatcgattataaattcgaaagttattcaacaaaaaaaaactatcgaattacaatactgcatatgaactctttattcccagcaatttctggttccataacgaaatgcggtgattcttcgagccctctacttatatatatgatgtgtcccctctgtccatgatcatattcaaatccaaagtagaagatagctagaggcagtgtcatggcgtccactcaaagcaacgagcacggggctggcttgctcgatgctgagctctagctctacgtgaacaccttggccgtcatcaaatccgtggccctcaaggccgccatggacctcggcatcgccgacgccatccaccaccacggcggcgccgccaccctgtcccagatagtcaccagggtcacgtcgctgcacccgtccaagatcccgtgcctgcgccgcctgatgcgcgtgctcaccctcaccggcgtcttcgcagtcgagacgacggagccggtagacggcgcggcggccgacgagctgccggccgccgtctacgcgctcacgccggcgtcccgcctcctcctcgtcggctccgggaaccaccaccagcaggcgtcgctcatgtcaatgctgctccacccgagcttcatcgcctccttcctccggatcagcgactggctccagcgcgagctgccgggcccgtgcatcttcgagcacacccatggccggagcatgtgggagatggccgacgacgacgcggccttcaacaaggtcgtcaacaataggatggtctccgacagccgcttggtgatggacgtcgtcgtcagggagcacggcgaggtgtcccgcgggatcagctcactggtggacgtcgccgggggccacggcacggcggcgcgggccatcgccgaggcgttcccggaggtgagatgcaccgtgctggacctcccccacgtcgtcgccggggctcccgttggcgccggccccggcgtggagtacgtcgccggcgacatgttcgagagcgtcccaccggcaaacgctgtcttcctcaaggtataatgtt

SEQ ID NO: 77041 - DNA, 2818 bp, Oryza sativa
tgcaggggaaaggcgtgcaaaggcaagtttgcgggaaatcttggtacaaaggcaaaggcattcattctaatccaagtacagtgtgggggaaatctcgcaggcttccagtcacgtacgcaaatgagattcccatatctatgctacaacatgatttgggaaccacacaagaaaagacaaagtgatcgggactaagatgtggtcggccgaaccacccatgagcaatggtttgcacaattcctcactgaacctcccagaatttttagtttaaatggttcttactattgaaaaatatctggaaaatcaaactcaagattacaataaactaggacgtcttaactagggtatatgattttccttgaaatgacttgcatactctttattcttcacataatacttgttccttgtgaacataaatttataggaatatatcttatctaagtaattgatgaataaaagatggcctgataaaatgaactttgctcttatgtgttgagtattttggaatttttatgaagaaaaaggtataactttacaaacttctcaatgatgcattattcctaccaaagtcgtatgttgatcatattgacataccttacacatgagctgcatcttattacattgagtttagtcaaattgttgagaatattgtaagattctttttatgatttcaagatcaagatcacggacacaccacaaccatatgctatatttctacactggaagttagcaacctttgcccatccaccaaataatgcctccgtatacctatgatcctctctccaactatccatccaaaatgagacttgtgctaaagaaatgagaaaaaaatagatatatgctcacaaagatatcctcgagcgtgaaaaataaaagagaaagagaaagcaagcacccatttctcgaagtgttgctgaaatatttgtatgcaggatgttatatatgaaaatacacctgccatgtgaagaaacatacctccggccaatcaatcatgagcacagggattgaagacccacaaataacagcaaaccgacataattgaggccaattcagtgtgtcatgagagcccatatgtcagcctcacagaagaaagttggtggctagtgacagtggaagtggttcgggcgtcacgtgaagcttcctcattggttccctatgacggtaatggatgaaatggacttaaccacgttcgttagtaactgttattaggcatcaataaaagaaggaatgagcttcaatctcaacacacaactcaagtggagatctctaactttcattcaaggctactctctagcagagtgttagaaaatatggagagagtgagggcaaattccaacagcagtctctcaactcttgtacctcggcagatgtatgttttataaaaatgagtactcgatatttgttctgggtttttaaattttcttgtttaagtaaaatatattctcatcattgcagcttcatcgcttaatattttatataaagtgctccaatactcaggctgtataaagaaggaaattcttgcaccaggctagctatattagtaatagataatgtagatgtagtgtttatgttaaggattgcctttgtttgttgcgtgctccacaggttttagatgtaggtggtaggttacggcagccttatttgtcctttatagtcttccacggttgggtgtgtcatagagctataaaccggattgacatggcagaccaggagaaacccggtgcccaaaccaaatgtgagagttttaccttaacttaattaaaaaatcgtaacccatagcaaatcgtctctaccatacgcctatcatttagttgttatccttggaagaacttgttccttagattttacacacacattcactgttactcaatacccttggaatactctaaggtgaaatgctacaacagtatccgtgcgcttgtagatttatttcagattgcaacaaataccaacatgcccaaggccacgcgcgtcgaggaagagctctcggatgacaagctgctggtgtagcagggacaacaaggtggcatcctcctcatcgtcatcatcattctcgcctgacgccaagctcctcaggatgttgaagttgctttgcgccacaatctcctgcttttctagcaccccgtcatcacaaagcaagcaagcaatcactcgaacactttctggtagattaaccacccaaccgaccaaaaaaaactaaacaacgcaaacaaaaatcaccgaagctgtggctaggtcagatcacaactcgctagagccaacgacaatcaatcgcaatgatgacggcttggattggatattatagcgtggagtctatttcgagaaaatgaagtagaggaggaagagatagaagtagaagaaggccatgttcagtcctagtcttggacgaacatcgtattctcctcccaccatgccctatgcaggaggatgtgatcccagctgtcgcctcgggtatcatgaaatgggggaataatttaccactaggttcctctattggctccatcgctttccgcgagagaagaagcaaaggtgggtgtgctcaaatgtgaggtaggaagggaaggttgtggtggggtttgggaaggtggttgtctctggcgccagcgagtgatggagcgtttgagaggaagagaaaaaaaggggtggggggtttatatatagacggaaggcagggctgcaggtagtagctgttggaagccggtgttactcctgctttcctagctcgctgaggtggctgaactcggagcccaccaccagcgctggcaagcatgcaggagacaagtggaatagaagaggggaaggcaagaagtggaagaaggcg

SEQ ID NO: 77042 - DNA, 4535 bp, Oryza sativa
tctatacacagtgaaacattgtgagtacactaggtgaaatattttatgtggaacaacaaataaaacgaattcccttaatagagtatttccaaaatatgtgggtgatttgttgcaacgtggtgcgtggtggggacacgtggcaggagcggcgcagtggtggggatacatgcacgggcgcaggcgcacgcgggaagcgcggcgcgtggagggatcgcccgattgtttggcgcacggatcgggagttcgggttcaagtattttcggatattttatcaaatatcggacgcccgcccatccttggcgtctggcacatccgtcaggatgcgcatcgtatgccgtttacatgttggcttgtggcgcttgcatggcgtatgtcacattcatgtatttttctactttctctctcttttcctttttctaaaatatgtgttcaatatataattctattacaccattttattcgtcataattagatctttataacaagatctcacatggatatattttgataaaaaatatttattaaaaaatcaaacttatgttgcaccgtctaaaaaaagtttcatcacttgtgcagatgtgtcaacccagttcataaaatgttctagagatgcaacatataaaaagtattgactgcaacagtaattatcactacatgaaacattatgtcccaattagtaaaacattgaaaaaaaatcgtgtgatacaatacatttgcaaatatttgattttgttaaaatatttttgtatttagcttgcatcaaattgtaatcgttgaaacataaaaaaaatgtttgctgaaacatataaaaaataatgtgcaacattgctaatgcattagtgaaacattaataaatacttattggaacatatattaacaatgtgtgcaacatttaaaaagtaaaaaaaagtgatcagagtatagtcgtgtgatatcttgttataaaaatttaattataacaaatccaacgatataattagtttgaaatacagataaatagtttgagagaaaaaaaaatcattttaagtttaaaatatgttttgcgtgcatgctcagacttaccatgcacctgctgctggtttgaattgaggcgtctgattttttttcttccgtttaggacggctgatggtacggaactttatacctcagtttccaaacctatacaatttccgaaacttccacagccgcaaccaaccgcatcggagtcgatctccggcgcttgctcctgctttggcctatcgcacgtgggccgacgtggtgctgctcctgcggctcgccctccagccagctgccaccgaagcccaccgagctttcacacatgcatggcacaacacacgtgcatgctgtactacatcctactgctcctgttgatcgatcccatcgaccaagcagcatacgcatgcatgctacagtacctcgccgtactgtagcaccacatactcctctctagtatcttccaatttccttcggcaacaacgacacttctacacacacattgtgaaacccgttacgaagatctttttcacacggtgtccatctatcatgtgacatctcgtatccaagttcgtcacccggtatccttgaccgtcaagaccttaactcctccctgagtctagtcccgatccccatcgttgggcgaagttaacctctaagaatcctgactctagtcaccttctcacatggtatcctaaccacactagatctcttctcccttagtatagtcccggtcctcaccattgaccaaggctgaccttaagtcacctgcacacaattagacaaaacaactatttctggacacagagatcacaacctgacccacattagtcacacgcactcacaccaacattcacacatactctcaaactaattctttaattaaatcatttgcaaagccaattattctcacaaatattaatcatgacaatgattttacagttatcaagtggacttattcttttatagcacaggctgaatctgagtggtgggagtatcacggctaaacgtacgttttatttgttttctcaaatttgttttgaatttctatttaaatttgtaagtacaaaacttatatgtacaaagtttctctgcgcatatatacaaaattgtctatgtataaattattctatatgtaaacttttctttcgctgacacgccgctcaattcatttcaattctatatctgcaaaatttatataagcgtaaaaagtttctatgcccaattatcagtgcagagaatgtgtatatatggataaacctttttaggctcaagagttttatagttttgtaactgagtgtggctgagacccgcacggtcgagcatgctttagactaaccttatataatgagcttgtaataccccgagcaaattacatccacggcgcatcaacttggcagatgggcgcaatttagtacaataacttaaaaaatgagcgttctagtgcaacaacttgacacataggtgtattttagtataagaactttataaattatcatataaatgcaacaacttgcatgataagtacgattttgatacaacaaattaaaaagttacataacaacttaattatttggagcgtttttttatataaatttaatttttaagtacttatttttagtatatttatatttttaccctaataattaatactgaaagtcaattaaactagatttagaaattattatatttcggttgatatatgagaaggtgaagaaaaaaaattcttaaaggtaattggatgtaaatttcactactatgtgcataattcttaaagattaagttcaatattataaggtaatatctgtatgattactttgtaataggatattgacatcgtgagaaaaaactcgtctagcatatgcttagccaagttgataccaaggtactagaacgcacctacttgttaatttgttgcactcgaatgttcaattctcaagttcttgcactatatcgcacccacctgcaaagttgttgtaccatgggtgtaatttactcaaaattcaacttttgaaccgttctttgaatagacgatcagaatctgtggatgtgtagagctcgtcgagttaggaaaaaatagactataagttgatcggagtccggaggaatttatgttgattgaattaatgtgggccgttgatcttcattaggctctctctatttaacaaacagaggaaaaaaaaaagggcaggggataggggattgctagcagctacccgtagcctttgtcgtcctcatcctcgcgtctgttttgaataagacgaacggtcaaatatgtgctaaaaagtcaacgctgttacacaagtgaccatgtgactcctcctccccccacccctctgaacttagggcatgcagatgactgctgttttgcaccatcttttttatgtagtatttgctacgtctttcgttaatggcaggtggatataggccctgatatcagtgagatgtccaaggtaaatagggatcccgagaaattacaaatgacaaataagaaagtggcacgtatacataaagtagttcgactcacacataattatttggttgcgtcacaatttcagaacacaactgagcttgcacacgcttattccaagcctcagcagcaacaaattaacagacatgctccacacactacaacagaaacatcatataacacttttgtagaggcgctttggaaattgcctcttagatcatcagttttatagtgtatagacactttacagaggcactataaaaattgcctagaaaatttttactctagatatactttagaaatattttcagtatattttattagattttatcttgtagagatattctttcggcagtttaaattgtgcctgatatgtaaaggcattttcttgagacactttaaactttgtaaagacacttcttagaataaaaatatgtactaaatgactaatataagtaactcaaggcaaaaacatacaagtaatgagtggggttgagttggttagtgccttgaagataagtatgatttgtgcaattgatcataagtttaaggattgggaaaaacagggaaaatattttattttatactagtttttcatatggttgtagtacaatttaatgtctctagaaagacattttacaaaatgcctcttttacagatacaattcacataaggtacttattaggtattttttaaaatgcctctatagtattgcaaaggtatttgaaaagtgtctctacactgacacttggcaataatcattgtcttttttaagggtaaacctcaatgattgacctggagcctagaactggcatgatcttgtagtcactaaacccggcttcgacgaaaaccttcttccactcttgctcgtctcgctccacaccattgataagcatgatgtatgcatcaaacaaggtctgcatctctaaatgcttttgatcaggtggccctactccgaccaccatgtctacgactattacctttcctccagcatctctagatggaatggctttcttgcagttctttagtatcttgacacattcatcatcgccccagtcatgcataatccact

SEQ ID NO: 77043 - DNA, 831 bp, Oryza sativa
agctaagtctgaaaatatctagcataccacttagtctactttgcacctttactaaaattagaccataactcgtttagtaaaaccctttgatcagcatgttaaaaataatgcactctaccactatatgaaattacttaatctaattcaaaatataaccacatgaaatgacatatataagttaaacagtacatagagatgcaatttttttatttttatttcatttttttgatatttttttcacacttaggagaacataggaaccaaccgtataaaaaataaactcaaacggacaaaatatgtgacatgtagaattttccgaaactctatcaaaacggacaaaatatgccatctattaaaataggcgtaactttctcatacggactcggaatcaggcaaataatatatgtacggacatctacagaaaaagttatatccgattctcctccgctttgccgggttcggcgatattaaaacctccaaattccgcttgcaagattgtgttttcgaggagagaagtttttcggtggagctttggaaaattccacatgccacatattttgtccgtttgagtttattttttacgtggttggttcctgtgagttcctaagtgtgaaaaaaatatcaaaaaaataaaataaaaataaaaaagttgcacatctctctcctctgcactagttcagagagaggagaggagaggaaaaattctacatatcacatattacatccatttgagttcaatttttctatggttggttcttgtgtgtccctaagcgtgaaaaaaatatcaaacaaataaaacaaaaataaaaaatttcgggggggggggggggt

SEQ ID NO: 77044 - DNA, 1955 bp, Oryza sativa
tggacagaaagctcgtggctcgttagctggctcggctcgtgacaggctcggcttggttcggctcatttgaattttctaacgagccgagctggcattttagctctttagagataacgagccagctcgagctggctcgcgagccttaacgagttaggactccatcacagcccaaaagcccaatacaacaaaaaggcccaagcccaagacactgcaaaccctatcctcactcctcactcaattccccactctccccagcagccgccgccactctgcctctcccccagccactgccgctccacctctcccccagccgccgccgccgctccgcctctcccccagccgccaccgcctccgccgccgctaggagatcgagtgcccgccgccgctcgtctctgcctctcccccgcaagcgcccgccgccgccggtctcctcctctccctcgccagcgcccgccgccgacgggaaatcgagcgcccaccgccgccggtctttgcctatcccccaacacccgccgccgccaggagatcgagcgcccaccgccgctgatctccgcctctcccccagcaatccagcgcccgctgccaccggcgctcgcccccagcacccgacgctgccggcgaggggtaccgagctcgtctcctccaagtgccggcggagctgcgtcgagttcatcccctccaccgtcgagctcctccctgtggtcgccggcgagctcgagctattttcctccgccgtcaagatcctcccctcctccccgtgcttgccggctacgtctcttgcccctagcttgcgagcgctaaacgcgctgtctaacgcttgtgacaagacccgccccactatgggtttaggttggtaggaaacaagccgagccgaggtagctcggtttctaacgagccagccgagttagctcgttattctaccgagccagaccgagccgagccgagctagctcgacatccacaccctaacgacaacataatatttgctatcatcataacaataattagtcaaaaatacgatcactcgtatcgagtagtaaacatgatccacaataatatagataagctacatgttagcataataaatagtacgtactactgcaatctgcatataagaatggagatgaatttatatacatcattgtcactatcaaagtatcccacagtcaaagtttaacttcgatatgatcacaagacaaaatcatgtcttagtgccgtttaacgaactaagattatttcagtagctctaaatcatgccatgcaggtaggtaataaatatttacttccgtactgcactagtaataatattaataatatttttactagcaatacagttatacaataaacactgggcgtgctatatatatatagtagtcttacagactattataccatgtatttgtattcatgtagctctttttataagctgttaggaaaaaaatgttcacagtttaaagaatatagaaattacaagtataccactactggagaaaccatctttcgtgggttggccaaaatcaacaatagtcccggttcaactaaaaaccgtttagtcccgatttaaaagtgcaaagggactatatgatgtttagtcttggatggtaaatctttagtcccggttctatttgtttctgacgatgtcagggcgccaaggatatttagagataactagagacttgacttcctcatccgacttagattccctcatcatcttctctcgctgagatttttagtcccgagaccagatcgagatctccattctccactggatttttcacattttgatccttttgaaaaacttatttcgcaagtagatctctagaaaaacttatcccaaaaatggtcctttttggggcgccagagtggctggcgccatcgttcaacaggacggcgccagcctctttggcgccgtcccaccgccgacgtggcggggcgatgctaaggtggctaggggga

SEQ ID NO: 77045 - DNA, 2144 bp, Oryza sativa
ccccaagtccatcctgaccaccccaaccagcctcttcatcccggtgacaatgccacaatgcccgccacgccggccaacgtacaccgcgacctcgaggtaagacccatgagctccgaaacaccccggtgccgacagcgccttcagttcagattcgtcgagggagaagacggcggcattggtgtgtggatcaaggttgaactctgaataattgatcagagggacaggagctatctggacagggaatcctcggagccggatctcgcagtggaagctccgggccgccttcctcgcattcgcaccggggagtttcagaccaagctgtccaactgaaagtctgacaaaaatctggggatccattcttcgtgtcactgaagattagctacttccatggcacatgctgaaaaattcacaaatcattgaagtcagatataatttgatgtaacaatcaattgtaggaaaagaaatgaattctgcaaattagcactaggtgtgcagctgatcttaaaattcttccaatagtagtgtatggtatgacagtatatgctccaagtgatatggaactatgaaaaagactacatagtagcaaatccagaaagaaatgcatagagcatgtttcagtatcagctatgtgctataggaatggcacatgaaaagtagcaacattgctgttgcatgaagatatcactttcagattccattcaaaaaattacatcacttttacccttgtaggtatgaccaaattctacagaaagtaaaagcctaactccgtagccagattcagctcatcacttcaaaatcataggcttaaagcgccagatagaagctgattgcattagattagaccatagccaaattcagctcatcacttcaaaattacagatcacaggcacaatttctccatctgtaaccaagttttattaggtccacctaatctaaggtttaagatcagccaaaaaaaaacttaaaagtaaaagaactaattatttaggaaataaaaatgatttacttagtaagttagctgttttttttttctcaactcaaagtagattttgccagcatttggaattagcattcagacatgtctttaatcgtgattttgatctaatagaaggtacagttcaccttaaacattccccactaaaaaaagaacacgcaactgacgcctagatgcttgcctttcccccattttttttgtgaaacctttgggatccttgacaaaatttaaagaaagatgaatgttgatcaagtagcatattcttcccctttgacaatccctagtgcaagcactaaaaaaggcaagcattgctaatgccactcaacacctcttagcttaaacaactgaaagggagaagaaaggaagaaagaaaaagaggcatctggtgctttgcaatcatgccattgagtggttatcaatggcaattgccaatgccattagcatgccacctctgttcaaagctcctgtcatcagtcaggcactgacagtgtcactgcaactgcaaaaaaaaaaaaaaaaggcttgtgcaaccaaagaaaagcatccaagaagagcagcatcaatggcgcggcgcgacataagctagcccgtgtgtcgcgaaaaggggcggcggccatggcagcaatggtggtgcatgggtgaggtagcctattatcagaattctccctttgctcccatttctttaaccctccaagcaaagcttcctcctctgtcgtatgatcagcgtgcaaagtggagattccaaaccttcctctccaccaacaagtcctcctccggcgcaggcacgccacgccacgccacggcgtggacaaggccgagcacataaggcggccgccgccgcagccgcagccgcagccgcagccgcagcaaaagcttcgctgcatctcacaatgttaagcgcggcgaacggcggcggcgtccaccatgatcaccggggtgattacccccccgaccagcggtacggcaacggcggcgaggaggccagacaacagcagccttcgtggcagccgccgcgggaccaggtgacgcaccacccgcgggggcggagggcgcaccggtcgggcccgctggagtggacggcggcggtggtgttcacggtgctcgccgtggtggtgctcgtcgcggcggtggccgtgctggtggtggtgct

SEQ ID NO: 77046 - DNA, 883 bp, Oryza sativa
aagcccaaatccaagagcagctagctagctaaccatcaaaagaaaagatacttcatctttcttgctccaatccaagttctccatggatttctgatgtgatcaagattcaagaacatgccactgcctttcttggattaattcttcctttcatccttcctttcttcgttgattcagttcatgtatagattggtcaagaaaatgacaactacacccccaatttgtacaattaattagattgtgtaattgatttgaggtgtgcagattaagatcatagtaggtcctaattaaggggaaagaaagggtagtggaaacagtctggcatggtaaagtaaaaactgattaggaaaagatgtagtcttgttgcaagattgaacaagaccagtgacttcttttcttgcaagctttgttgcttggaggaaacaaattccatggaggggaggaggaaaggggcaaaaggataaaaagagaacaccatgaaaagaagcaaagctactcctatgtaggaaggaaatgtgcttttggtaatggagattgtggccctagcgccatgcatgtgcttcttctcctcctttccatcccttgatccttgtcatgttctttcgcttgcttttgtttcaaggattatctagaagaataagtgaataataaccagtctcagatcccaagaatctccaactcatccattattcaaccacttctctctgaccggatacatctttgatgtagaagttggattgattaattatccttatcggaataaaaatcctctcaaccactctcaagctcaaacgacacactaggaagctaccaatacatttctatgtaaccaaaaaaaaaaaacgaccaatacatatacatacatcaacatcatgcagtatatact

SEQ ID NO: 77047 - DNA, 1761 bp, Oryza sativa
tagtagttaatactgtgtgcctctagttaacgactattgttgctaggcacaactaaaatgcatggtctaaaaccagttcaggcgtttatggtctgtttaacttgctctgaaaatgatcatatcagtagttcagttgtgaagttcaacttgtttcgagtgatacttttacttgcaatagttgtactgcttgtgtatcatactgtcaatgatttgtaaccgcatgattcctttgctatggctgcagcggataatcaattgatattcccaagtgtcagtgaaattgctgtcaaatggatcaaggcgaaccaagattgatttagtgaatccttttgtgctgaagttttgacaggctcagggaactcgacagaagattagtgtgttggttagagacatattgagtggaattttcagttcagccgattctggaatacagtttcatgtttgctctcagctgtagagtagctgaaaaacctcaaattgtcagggtcttcaatgggtgtataaccacggtttacgtactttgtgaacagggtttcctgacgaaaatatttgtccaattagtattcattcctagtatggattgatgacaagagtgtgcttaactactgaaatatatattgttcaagataagtgaactctgatgagtgttctgaaatctgatgcatggacgcgacatgctatgtggaatcaagttagtagtatttcttgttgttccggtgatcaccttaaaccaatttttagatcagcaaggaacacaagagagttcttgaaaagttaagagcacatcaatgagtctaggacatttcactgttagaatgcagatttcttgacatttttgtcatggctaagtttgctatactagcacaatttattttatgatttgtattgtggggatgcaagccggctacagtagtggagaaccactgaaatcaacttgaaagtaacaaaatggcatgcagctgaatgcagcgagtgtgacttgagagctagttcagacatcgttttttttttcatggaatcactgcaccagtcgatcgaggccgcactctgacttatctgcatttgttcgtggaagtcagacatgcatttttgatgaacttctgcaattataactattactgtaagaaattagaaatgtgcatgattatgaattctaatgagtgatgacagtaactgaatgttatgagttctgaatcactggacccgatcgattagcaatccacggcagctagttctgtaaaatgggtcgattgaatcactggatcctcctaattgtgtaaaaactaacagcttgaaaggattgaacagatttgttttgtttgcagcagcgatcagaagttcagaactctgcattttgtatatgagcaattctatggttcttgaggaggtactatgagataccaaaattttagtgtaaaattttggtactttatggtacctcgtagtacctaggtatcaagaggtaccaaatttgcaatagaaaaaatggtacctccttaataaccgtaaaattgctctttgtatataagatttgcagagtccactgaaatgcaatcccgaacctgcgccgcgtcatttgagcaaattctgtaccacgaaatctgctgcactcactccctgtggtcgggcccacccgtcattgactacggttgaccaaagttgaaacggggacccacctgtcagagagcgacctgcgtcttctcgcgacgccttcaaatgccaccgcctccctcggctaacaaactcttccacggctacttg

SEQ ID NO: 77048 - DNA, 1171 bp, Oryza sativa
tacccataaacatctggggaaagtttcaggtggaaccccctctttcagtgaaaccatggaacctcaactgagggtgtgtttagatccaaagttttcatccaaacttcctacttttcccatcacatcaacctgtcatacacacacaacttttcagtcatagcagagaaacgacacagttagactcaggcagtgtggtacaatcataaaagcaatagtattcttgagagtaaaaactgggcaagtaattctgcaaattaaagatgctgaatttcacactaaacactggcatgatcattttcataacaaattgaaattaacattcataacatatacaaaaaatattttcctcaaatgaaaatatacagaaaataaagcattgaaggtgtatgagaccattcatttcaggtatactggagacaatgtcaacacatcatttcagctacaattctgtttgtgtacaatattcagataaatcctactcacagagggtattcccaaagtgcatacaattttgtcctgatgagtcctaaacttgtgttgttctacatgcattctcatcaacagaaaattcctcagatgagtcctaaactcaagtcaacagtatatttcgcttgtgttctacaatattcttcagactagtcctaactcaagaatcaaatgcaggattgcatttttcaaaaaattccacaacaagcacaaacaatctacagcgatgcactaacaaacaattacccgcataattgttcaacaattactagcgatgcgttcctttgacagcaaaattcagaatctacagtcatgcactaacgaaaagaacctggagaacggaaacactgccagcatgctaggctgcttaactctggtgttcagaaccacattaacagtgttcagaaaattcagaaagagatcgaactaggctgcttacctgcggtgttggacttgacaaggacgacgtgcagggtctcccagctgcgaggcaggtactcaagtctctgacccatcagcatcaagaattgccacaattagaactcaaatcgatataatctttggcgcaaacgagttcaagaatcgcaagaagagaggggacgaggaggaggagctcacatggcccatggccgggatgtctcgcctgaagagagttgtggggacgggaagcacctcccactgcatc

SEQ ID NO: 77049 - DNA, 712 bp, Oryza sativa
cgcgacgccggcgaggcacgggagccacctctcgttgacgcgcaggtagcgcgcggtcgtacttgtcgtgcagcaggacgacgccgtcgccagccgccggcgcccagcccgacggcacgccacatgatggcgtcgacctcacctcctccctgtcgaagtcgcgctgcccggcggcgggccagaagcagaagggcgcgcccagaagtggctgatggcgtcgggggcaccgagatagcggccgtaggcgccgcggaggagcacgtggcccgggaggaggacgccgtcgccgccctcggcctcggcgttgatcgtcttcgctggcgaggaggtacctgccgacgctgccgtccacccgcgaccgaagccggacggactccacgtcctggaatacctccattgctcccgccgccccgccggtggtcgcctcgcgcgcgcgggcgctcgcgtcaccaagcgggctcctctcctctcatcggcgacggcgaggcgtgggcgcgtggcgtgcggaggaagacgagaggaggagtttgttagcgacggttagagctgggacatgggccgttccgggctaggcacggcccagcgtgcttcgtgccaaatcgggccgtgccagcacggcgttttcatggacgccgcccaagcaccggcccaatggcccgatgggcctattcgtgccgggccggcacaagcacggcgcatgatggatggatga

SEQ ID NO: 77050 - DNA, 1888 bp, Oryza sativa
aagaagtgatgactgatgactatgaagtgaggttagaggccaatatatagggttgggcgaatttattacttctaaccttggaagatttagatgtagggtatattaaataaatgaattaatgatttctaactttagaatatttagatttaggttattatataggggccatttattgtactcatattaaataccaattcttggttttttatttttttttcttgtatatcttatttttattaaatgttttctaacttcgtggttgccacgagttaggtgttctatgaggtggttgccactgaaaaccgaactttttggtaaccacgaaacttgaagaaaaacatttaataaaaagatatacaaaatcaaagataaaccaagagtattgaaatttgattagaatccaataaatgactactaagatgtaagatgtagatactgattttgatttacgatgcatttaataacgcaaatctaaattctctagtaagaaaatcataaatcttttcaagttgaaaaatcataaattcagccctagcctgtataatggtctccaagtctcacttcatagtcatgaatatcacccaaatagtatatctattctgaatttgttgagaaaacgcatttgtgataccctagccccgagccaaacctcatactccctctgtttcacaatgaaagtcattctagcatttcccacattcatattgatgttaaagaatttagacatatatatctatctagatttattaacatcaatatgaatgtggaaaatgctagaatgacttacattataaaacggaggaagtacatcagagcaataagtctgctcctgacattaccatcgtcattaccactgtctttcaaagcaccaaacttctataagccactcagatggaaatcatttaataaaaaaatacaatcagagataaaaaccattattactggtattcgataagaatctcagaaatggtttagatttacaatgcattattttgtaaaatgccctcaccatactctatccgcaaaccaaacctcatatacaagtccacttttgctattattaatggggtcgtttgacggtcaaggcacagcatgctgcgcaacctcgagcaaccgaacatccccaattaccattgctgtttagggaggcgatggtaattgggaatgtttgaatgctcgaagttgcgtagccaacgtaaacattataggtatttctattcaatgataagatttagattagatttaccatagatttatatatagctcataaaagaagaatagcaaagacaacaaaaaaggcaaaaaacaacagtaaatcagcattgtagcatatccaacctatataaatcatgttgagacaattggaatttttttctaccaaaagaaaaaagaggaaattaattgaggatttgcttaccatatctaacgattttgataagaaggatagatgcccctccccttgatgaggcctctgcaaagaccatttcctttgttatgcttatcatcatcgaacctatcaaatccgcgttgaaagtaaataccttttacctcgagcaagaaagtatagagattgttttcttgagaatacctgagaactttcatctacaagtgttctttctctctattgaagcctctacaacaatattaacgatcatagacttaaaaagtgactctggtagcccatggtaactacagatctatggtatatgatgggggtgggggagatacgtgcacatatgcaagaaagaatggtaaggttacatagtagcaacaatggcttctagcgtaactatgacggacgactgcatctatatataggaaagagtgaaatggaagatcacaaatagcactggcgtcttctatgtgggtaaccacatcgacacatata

SEQ ID NO: 77051 - DNA, 9952 bp, Oryza sativa
gaaacgtacccagtacaaccgctggtgctgcttgtgcctcctccgcagatgcgtggttgacacgagcctggataaaccttggcccagcacgcctaggcttcgggcatttgtcagcgaagtggccaagctcaccacagtgaagcaggaccctggttttgctccagtctccttcttggcttgcgcgggcgggcctgactgtgccggtgccattggtgggcgtggagctgcaccgcggttgggctgacctccatggtggttctgactgccactggcgccctgaggaaagttgctaggattgaacgggcggtactggcggacgatcatggtggtaggtccaccctgctgtccgggagtgaagcgcggcctctggtgacttccctgaggtgccctgaactgtgcggccttcctcttcctgtccatcttgttgcgttgatcctcctgacggattgccttgtccaccagcctctcaaaatcagcgtagtccccagatatcagttggttggtcagctcgtcatccagacccgccatgaacttttcctgcttctcggcgtcggtgcggacatcctctggtgcatatcgcgcgaggcgattgaactcatggaggtactctgtcacagtcctgttgccctgatggagcgcccggaattccctcttcttttgtgccacgaccccatctggcacctacgccttcctgaagctacggcagaactctgcccaagtgacttcagtacctggtgggcgggtggccatgtgattgtcccaccaagctgacgcaggaccttgaagctggtgtgtggcgaaagcaaccttctcctgatcattgcactgcaggagattcagcttcttctctatggcatggagccagtcattcgcctccatagggttggtggtgctggaaaaggtgggtggcctgacacgcaggaactcaggcaacttggactgagggggagggggaccaaactgttgatgctgctgttcggcgtgctgcagcatccgctggtgcatctgctggtgctgctgctgcatctgctgcatcatggctgccatcatctgggtctgatgtgccattacttgggctagcgtcggattctcgggaagtggtggcggaccattgccagaatcgctgtggggatgcgccccatcagtgcgctcttcgccgttgctgccctcgcctgtcgcgcggctaccattcctggtgtagaccatctggaggaaaagcatacggggagaagaagaaaaacagatgctcagaaactaagctttattacataggaatttaaactgcaattgttctgatctgaattaaaacacttaaagagcaagcaaaaatccttattaagacagccatatcataggcacatgatatcgaccgtcgactgaccccaaacaagcaacctaaacacacaaactaacaagcagaagctagacagtcgataaactaatggaaaacgagcctaatgctcggaacggctccttcggtcggtggagtcgaaggcgtcctcctgctcgtcacccggtacctctgagcgactcccggagcctggcaggtaagtctcgccgctgcctgactgtgagccactggagctgctgctactgagatcgcggctgccactgggagtagcagacaaccaacttccggtgccactggctggacctctggcggctgatgctggagcgaaggagagagcggacgcgggagctggagctggagctgcaggaactgcgggcggaactggaggtgctgcgggagctgctgatggaggtgggttcctgggcgcaagctggatgcgcacgggtgccgtcgtcgtcttgcgggcgtagtgcggatccggactcctcctggcgcgggaagaccctttaactgagcattctccctcttcaggcgcgctatctcgtccttcagagtgacgatcctcatgagcttcccatcgttcaaggccttggtcgccttgtgcaggtccgagtgcatcctatccaatcccctcatcacagcacacatgtgactaaaggtggtgtcgttctcgccggctgtcggacggaaggtactgatatcatcaccactggctcgacgagggtgaaatcggtacgccgtgtcgtggaagatgtagttgtggcgctcccgtagtctagccatcatcaggtatgctgcctcctgacaggcgtgatctgttgagcctccggatgcctcaaccaccatgttagctaggcaggtacccacgtagccgtggacctccaagcgaacacggtgaggaagctcgccactgagcggtggaatcgtcgtgtactctggcgcgttggggtagcccaccaccagtgtcatgcgtgccaactctgccacaaagttgatcatgccttctccgcggtggttgggtgggtgaccggccatctagagaagacaaaggggtaggatcaatgcatgctcaaatccaaatttaaataaagcaataaaagactcaaataagggaatcgaataagagcgaaatttttatgcatagatcattttgcatgagagcgaataaaaaagacagactcacataacgataaaataatgagaaattagatacatactaataataacaaataaagcataaataccttgcaacccatgttcctgagctaggacctaatgcatttcacccatcaaatcccaactgactgacgaataaatcccaatagttttactaaaaccctagactgactcgttttgaaaaatctcacttaaacgagcgaccaagatttttcccttgaaccacaagaacagatcccaattttcccggaacaaatccaattgcaaagaacatatgcaatgaaaaggattcagagggctcttaggtttttccatttggcttgtcctacggtcaaggtcggctctgataccaacttgtcacgcccaaaaattcccgaatagaatttcaagcagaatgtgcattaaaatccccgtccaggaccggccggggtacacaaacgacaatgttgacattcagatccacgtcttacaaacatcataaaagtcttacataaatgcagcggaagaaaaaaaaagacaacaggagctaagccttgactaaaactgcagcgggaacaccactccacaggcatcctcgacggcacggacaaagcctactcctcgaagaaaccttcatctgacccgaactcgaactctggggttgggaaaagtagagcaagactgagtactacccactgtactcagcaagtcataccggaataggggtatgatgcagggaatcatcaaagaagagctgaagtggttcatttgcataaagcgagcatttataaacagaaattgaaagatttaaacagttgtaataattaattaatattaatcatccgctgtccaacgctatcccacgaagtcacacagatcccaaacaaccctttgagcatgttgatcccgtttaaagctattgtttcttttcaactattgcatttattttcgaatgtcattgggtggaattaacctattcattgttatagcccttttgttcttgattactttattccttgataccttgggttattataacttgactagttgggctatgtatattggttcaactagatattagatataattgcttagctctgcttagaaacattagcacactattgggataacttatgactcactattatttaatgatggcttaatgatagttcacgatggtcaatcgtgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcgtgggcaacggctttattttttgtatagcatggttcattgcggggcaccagactgagaagtggcggagataagcccacgggggtcgctggggagtccatgccttgtttataagggggtgattatgatccaggaatggtgcgctgcggtggattgtgttgtgcgaggggtattgtcacagctcctttccgaggtaccgtggtggtattgaggcacatggtgacatgatgtggggctgtgtattgtgggtacagtggtacacctctgatcagagtaaaactattcgaatagccgtgcccgcggttatgggcgggtctaacaatgtctttcgtgattagtctcacacctctcatcacaataaaagatgctataactggtaataatttgattagctcctggtttggaatggtatattcctggtttggagatagaactgtgcagccgggatggttgttcagaatggttgggcctatacaacagggtatgttgtatagcgttggattaatattgtttaattattacttaactgttgtcatgcccggaatttctatccaaaattccaaacgcttacatgtgtgtgaaccctcgtccaggaatcagccgaggcacacaataacaaattgataatatagtacaaatattactctaattaataagcgaataaaatgtcattacagaggtagatagttcctctcaatcaataaagatctaagcagcggaaaataagataaacggcgcagacgactccactccacaggcagcttgaccaggcctacacctaatcctccacaccatcagcatcactgtagaactcttcctctgatgaatgattgcaacgtgagtatatgacatactcagcaagccacgcagcaaatatgcaagcgcacaaggataccaaaggatggcatagtagggtttcatttgcaaaagcagcatttaacaaatatttcagaatttaataaaacagttaagtattaattaaacaatattaatccaacgctacacaacataccctgttgtataggcccaaccattctgaacaaccatcccggctgcacagttctatcttcaaaccaggaatatactattccaaaccaggagctaatcaaattattaccagttatagcatcaataattatgatgagaggtgtgagactaatcacgaaaaacattgttagacctgcccataaccgcgggcacggctattcgaatagttttactctgatcagaggtgtaccactgtacccacaagacacagccccacaacatgtcaccatgtgcctcaataccaccacggtacctcggaaaggagctgtgacattaccccttgcataacacaacccaccacagcgcaccgttcccggatcataatcacccccttataaacaaggcatggactccccagcgacccctgtgggcttatctccgccacttctcagtctggtgctctgcaatgaaccatgctatacaaaaggtaaagccgttgcccacgctggcttgtggttggcacggttaatgtttcacaaccgaaactcgtgaaccggtccttaattgccatgagcacgactctcaaaaccatgtgctcacaacccaccattatcaggttttagttggcaagtaattaattaaccaatcacgattgaccatcgtgaactatcattaagccatcattaaataataatgaatcataagttatcccaatagtgtgctaatgtttctaagcatggctaagcaatcacacctaatatctagctgaaccaatatataaagcccaactagtcaaattataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaactcttcaaattcttctcctgcgaaaacggactctccggaaacgtcggaatctaaacagaaaagagcaaaaaaaaaccaaaacagcacataaacaagcatgaacagtacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaaagggatttattgcgtcagcggctagggtttgcggtggaccgggcgcacggcagcggttcacgggaacgaacggccgagatcgatcctatccaaaacgaacggccgagatcgatcgggtctacggcggctcacggcagacggccacgatgacgtcagcgacgacgtcaccaccggcggcggctcggcggctcggtcgcgcaagctcgccggcgaacgacggcgcgaggacgcgaacggagggcaccaggacgtagagcgcgacgtggcgaactcaccgatgaccaaaacgtcggcggaagatgaacggacggcggcggcgtcgaggaagaagcggcgacggtcttcggcttgaggacggcgacggtgctccggcgatcttcagtgacggcgaagggacggaggaggacggcaacgatttggcgaccacgatggcgacctccccgagcgacggcgacggctggaacggcggcggcgcacggctggagctgcggtgacgacggcagctcgaggttgcacggcgctagggcgcttccgacggcgagagacgaaggcgagggtggcagcgaagagaggagacaccgggggtccttataaaggggctagggcgcggcggcaaaggcccacggcgaccggcgacgcgaaggaaacctcgaggttcggaggaaagagaccgatccgattcgacctcgaatccacgaacttccaaagcgagatagacgatgattccaaaagagaaaaggtagaggagatccggaagattgtttccccccaattgatttcaccggaaacggaaagacgcggccgaatttggaaggagacgatggcggcgcggcgctagggtttcgggcggcggcggccggaggtagacgacgggcctgacaggtgggcccacctgtcagcggcagcgagcgcgcgcgagggcggctgcagctggacttgggccgaggaggagagagagcggttttgggccgactttcggcccaaagacaaaagaagacttttaaaaacatttttcaatttaaattattcatgaaatgcaattccatttattaaaaatacttccttagctcaaataaatcccagaaaaatctaggaattatagaattaagcaaagtatttaataaaattttatttggccccattttatattggaatttattaattaaaattagatcttctcttctaggcttttaaaatagattctaataattccatttaaacaacaatttatataattaggatttttagggtgtgacacatagatccaaatataatgcgtattcaacagaaatattttgctttgcttattagtttcattctttgacaatccagatcacctcacgctctctttcacagtagaggactcatccctctagctgctcatgatcaattaaaatctctcgaactatatcactctctctccctctctcttccccagtataaaccatgctaccactgccaaatatacatactccttccttccctaaatgtttgacgccgttgactttttaaacatgtttaatcgttcgtcttattcaaaaacttttgtgaaatatataaaactatatatatacattaaagtatatttaacaatgaatcaaatgataggaaaagaattaataattacttaaatttttcgaataagacgaacagtcaaatatgtttaaaaaaatcaacggcgtcaaatattttaggatggagggagtatttcattgtcaaccaatgtaaaacaaacctctataatacccaagcaatatatatttcatttgccccatcctcctatccctagtgcttcttatctattaatctcaagtcggcttgtttgccgctgccgattggatcacgtgtccttttccccctagcagataaatgctcgatggaaatcatccaacaaaaaaatcacatatatatcattggttgagtggagggccaaataatcgtgcgacacatgccgaaatagcgaagtcgttgtgcttctagatttttagtcatgcacgcacggtcggtctcacgcggtcatgctgcccttctagattacaaatcatgattcacgcgcctacacacgcatgagccaaggcctgctgcaacctgcaagagcagctcgatcacctaacaaactactccctccggtatttcaatgtatgacgccgttgacttttcgataaacgtttaacctttcgtcttattcaaaaaaattaatgtaattatcatttattttattgtgacttcatttatcatcaaatattctttaagcatgacataagtatttttatatttgcataaaaaaattaaataagacgaatggtcaaacgttgattaaaaagtcaacggcgtcatacattaaaatacggagagagtactatgaattttatccactctggtccatgggttgaacctagcttttccgtgaggaaagaaaaaagaagagaaatctttgatagttgtaaataaagaaacaaaccaccagaaaaataaataaagatcaattagccaacgtgagaaaattttgatcaaagcatatgaaggatatattgaggatgtccccatcaggagaaaaagagatagcaatacatgcaccagataagcttatgaactgctaacattctggttgacctgaggtgtttgccatttgctttaccctataacaaacccaacgtttttcagctgagcagtgatgcattccatctctaacactcaatgatgccgatcgcgataaaaagctttaccaatcgataaaatgatcttactagcacgacaccaaaatgatcttactagcacaacactacataattaaatacatatatatagcaattgttataaaattgtacttatcaatgagggaataatgggatgcataaacgaccgagatgtgtcgatgggggttcggtatgattgcgatgacaaccttctactctaaaatatcaacatgaattcataataaaaggggtagcgcacgagacctaaaagtggatggatacggagacaaaggatttagacaggttcaggccctctcaatgagaggtaatactctactcctgtttggggatttgaatccgccgggtgtatattgatctgacgatcaggttgtgtcatctgccacctacagggcctcctgcccaccttatataggatagaaacattaactaatatggtatcagtttcctaaatctactttacaatattatcaaatcaggactttaggccgttccataatatacaaggaaacgtaatacccaagtcatgatctgttacatattccatagatataagttatcccctataactagtcggataaccatgccgtgtgggtatggggtacctataatctccacagtagcccctgagaccttcacagtcgaaaagataatcttctcttgaaccagattactctaaagccgagtgcttcaatcatctttgcaatggtctcccgagtacttttaccaaatctgaagactgtggagggctgaaaaaaattgaatatagacttaggtgcatcgactagatgcacctaataggtgtagcccacgactatgtgattagttgaacaaactaaacatatagtcaaggagtaaataatccaaccaaccgagcggtttttataattatagtcaaccaagtaacttaatattaatagcatatgcggtgtgaatccacgaataacatgatccaagtgatatatctactgcttggaaaatgaccaaatatataatcagcctaagccataatattggtcaataaaaatgcacacttacatggcaaaaagcaacaatattgtatcctatcaattgcttgataaaacaaaacagccgcctgactatataaaaaagtcagcgggcagttatttaaagctttactg

SEQ ID NO: 77052 - DNA, 4778 bp, Oryza sativa
aggatgttcgcagccattgacattagctcgtaatcaatcttgacgggttgctccgttcgaagatgtcgaggaatctgacgatgaccggatgaggttgaagtgaccttgagcccccccaactggtttgagtcccagtcagagagagtctgctagagtattcggcgacgaggaggcaaaaaatctaccaaagcgaagatgaagtgagcgacttacgaagttgattccatcgcacttttcgacaggaaactcggcgtcacccctacctggcgcgccaactctcgaaacatgaattcggcaataataaaaggggtagcgcacgagacctaaaagtagatggatgcggagacaaaggatttagacaggtttaggccctctcaatgagaggtaataccctactcctgtttagggatttgaatccaccgggtgtgtattgatctgacgatcaggttgtgtcatctaccccctagagggcctcctgcctaccttatataggacggggggcaggattataagatagaaaccttaaccaatacggtatcggtttcctaaatctactttacaatattatcaaaccaggactttaggccgttccataatatacaaggaaacgtaatacccaagtcatgatttgttacatattccatagatataagttatcccctataactaatcgataaccatgacgtgtggatatggggtacccataatctctacactaatctccacaccttaagtgtttgccatttgcgttaccctataacaaacccaacgtttttcagctttgctgtgatgcatgccatctctaacactcaatgatgccgatcgcgttaaaaagctttaccaatcgataagatgatcttactagcgcgaaaccaaaatgatcttactagcacaacactacataattaaatacatatatatatcaattgttattatattgtacttatcaatgagggaataatgggatgcataaacgaccgagatgtgtctatgggggtggggtatgattgcgatgacaaccttctactctaaaatatcaacatcaacctacagggattcttttccatttgatggttaatatctagcactactctttttaatatcatcttgatatattttttagtgcaaaacttctacatcaaatcctttcaaaagcttgaaattaaaaagaactcattagataacacacgggctataaaaaaagcatgcacgactactttctagtattaaagctaactataaaggtagcccgtgcatttgcgcgggcttgtattttagattgcgtttgaaaaacttatatagatggaatatcaaccgaatgacacctgtcatttttccaaagcattatttcgccataaattttcttcatcctcgttacttagatactatttgttagcttttataatatataatattttaatacatcgctataaataatttataattatctatgatcaattttgggaggtgaatttttcttaaagataattaaagggtgttgcgatttcgcataagatgtatccataatactgacatacttataataaacataggtttttaactgtaaatttattacataaataatctgacaacataaacttacactaccacataaacaatttattacgtaaataatctaacaacataaacttacaataccatagaaacatggataggtaccacttgggaatccgtcataggtgttcgatttcccattcggcatctaggaagcggcaaagatgagggaaatcaaaggtgcgggttccaaaaccgggaccttagagaggttttaggaatcaaaaaaaggcatcgagcagctcccattcaccccgccgagaacacatcgaagaacatccaagaacgaatgaacatgaacatcaagaatattcttcccaactactgggaaccatcaaaactactcatccccatcaagaacacaattacaaaaaacacatcaagaacaaatagatagcacaaagagccaccgctcgacaccaccgccattgccgccgcctcctctcgtgcgccgccgcctgccaccacctcccctcccgccagatctagcggagcggaagacgctgccgccgctgccgggccgagagagaggagtgcgtgtgtgcgagagaaagaggaatgcgctcgagagagagagagcgcgcgttagatagagagtgagaggagagcgagactatcggtcttatccgtgcgagagagaggggcaccgagccctctcaaccttatccgctcaagaccaccgatcggctcggctcgacttttaattatccaacacttatagtaaattaaaggtgttagttttttttaaaaaaaaatacatctagctatataatagaaaactgacacctacagtctattaaaggtggcagtttttttttttttgtattttcaacccgcatagatgggaaatggtatatatgtgccggttttattacttccagcacctataacaccgagctctatgtgccttttttaagtagtgtgatcaaatcatatatgtatgatatagttactatataaataatctaacaacataagcatattagaatacatttatgatttaaatgctatagttgcctaaatgttttttacgtaaatctctgtgtcttttttagcagtgtgatcaaatcatatatgtatgatttagttactatataaataatctaacagcataagcatattagaatacttttatgatttaaatgctatagttgcttaaatgttttttacgtaaattctgctttcttttagaagaaggaaaataggagagataaatagataatagaatgaaaagagaagaatgggaataggagcgtgcagagttcatatgtatacgtgcatccgcaagaatatataggggcccaatttagagttagattaggatggatggattactcttttttctacatcttatctaatggtcaaaaaggatgggcccacctatttaaatgaaaattaagggttagatgtttctttaccacatggcagcttaggagcacttgtagagtgccatgtggcgacatatgagcatttgtagaaagtttaatggacttttagtatataataatagatagatagatttcagcccatgcatgctgttatcactttgtatctaaaaaccaaacaaagataaaagaaaggtgaggatcaaaacactcaatttggaactacgaaatatacttatattcaatagataaagaagaagctgcaaactcttccttttctttggagtatgacaccagattgcagtagttctatcctggtagacatgaatatacactcgacttcatgaaatagtagttcccatcaaataataatttttggatagacattaattcaaatagtagttttcattttggacaatcgtcaatacaacatagtatttgccagcaaagccgagtatacagggccagtacttacccatagaaaaatgaaaccataatcagtacgtacacaatcgcatgaatttgatagaaataaaacaatcataggaaaacaaaccatccatgacacctacagttcgtgatatacccggctgaaccttgtgataactccgcatcagactcataggatggaaaccatccaaacctaaagaacaaaatacactcaaattctaacaaccgtaatgctagtaaataaataccgccacttattcttccaataaacttttaaaccgaaaatctagaattttgaataaaccggtgaaaaaacttggccccactactttaattgtaatatttgaaccacataaccaaacttagcaaataataatgccttgcatatgtactgaaaattatctgcagctttcatattaagtgaaaaatctaattttatttccaaccatctcagatttaagtaaaagaaatcagctgcaccgctagaaaaatatcgacgagacctacgacttttgcgtacagcacaaaacataacttctaatggattaataccactatttcagtctacctagaaaattaaaatcgatctatggcaacaaaattaaaagtaaaattagaagtagcaaggaactagttttagtttacccttgcggccattataattcggtaaatctttcattctcctcaaccttccctttttctgctcctctgtttttgtcagcagcagtgcgtagagcagtcgacagacgactagccaatcagctgggaaggcagcagccagcaggccatgctgggtaacaacaggcagcacagcagatcagcagagcaacatactagcgtctggcctcgccacctgtgaacaccgtcacagctaatttgatcaaatggaacaaatagtgctgttgagattataggcataaaatgatttaatctatttcataaataaatcatgacattacagatgaaaactagcatgaacgcatcattagatctacacatgtaaactacacagtataacatgaacagatcaaatatgcgcaacatattgaatacgtaccgaggtagcggaaagaccggctgctcggtcgaaacttttcgcaggcgtctacgaaggcacgcagcacgcgagcgaagaggaagacgagccgtcgcggacaaacagggagcagtcgcgcaaagcgcttcccaaaaatcttattgccgccttctcccggtgcaggacgtcgaaggcagaggttccggagacctgcactcccgatcgcaggtgcacgccggcaagcgggatggagtaatctacgagcgacggcgcagcacagagtaggaggcaaaccctagattgattttgcgtgtgttgcgtgaagacggcgg

SEQ ID NO: 77053 - DNA, 601 bp, Oryza sativa
agtgctgttgagattataggcataaaatgatttaatctatttcataaataaatcatgacattacagatgaaaactagcatgaacgcatcattagatctacacatgtaaactacacagtataacatgaacagatcaaatatgcgcaacatattgaatacgtaccgaggtagcggaaagaccggctgctcggtcgaaacttttcgcaggcgtctacgaaggcacgcagcacgcgagcgaagaggaagacgagccgtcgcggacaaacagggagcagtcgcgcaaagcgcttcccaaaaatcttattgccgccttctcccggtgcaggacgtcgaaggcagaggttccggagacctgcactcccgatcgcaggtgcacgccggcaagcgggatggagtaatctacgagcgacggcgcagcacagagtaggaggcaaaccctagattgattttgcgtgtgttgcgtgaagacggcgggtcggtttatatagagaagggtcacttgatcagggcgcccgcacgatctccactgcgcgtaaccgaatcggataagttgcgcgtaacttatccggactccacgccgtttgcacgcaccagatttttcg

SEQ ID NO: 77054 - DNA, 2233 bp, Oryza sativa
atccccttaatccaggggcccgtgccaccagcgacaggtacaaacaactactccatctatctcaaaataaacttaattattagacttttatgtctagcgtttaactattcatctttttaaaaaaaccataaaaaaattttaaaagataagacatgcataaataaagtattattcatattttatcatctaacaataataaaaatactaataaaataattttatataagacgaataaaatatattatttgtctctacttctcctaataactttttatagacggaggtagtactcaccgccgagacgacacagtccaaagcacaacaaaagatcgcctcttctgaaagaaaagaggagagcctactcgttccgtccacacgtcgcacgcccacacgccgcataaactactcgtaaatgctcttttttttttcttttttctttgtctctacttctcctaatagtatgaaaactttttatagacggaggtagtactcactgccgagacgacacagtccaaagcacaacaaaagatcgcctcttctgaaagaaaagaggagagcctactcgttccgtccacacgtcgcacgcccacacgccgcataaactactcgtaaatgctcttttttttttcttttttctttgtctctacttctcctaatagtatgaaaactttttatagacggaggtagtactcaccgccgagacgacacagtccaaagcacaacaaaagatcgcctcttctgaaagaaaagaggagagcctactcgttccgtccacacgtcgcacgcccacacgccgcataaactactcgtaaatgctctttttttttcttttttcttttccgtctagaaacaggtccttcgctttctcaactgcaggtgagtctaaaaattctaaaatttggagtagctctcaacagtgaagtgggatattttaccgtcttaactgctactgaaacaagtactactccgtcaataaataggaggaatttttgctatgcatttttccttatttttaatgacggcattttattcttagagcaacaacaatatatataatgtatatagaaaaaatagcccatataaataggacccacatatataagcttaactattgtaacctttacaatatgcatagataacaaataatattaggaggaaagagggagtagagacaaataacatattttattctctatgggcaaaccatatgcttatggatagcttttgttatttctttgctatagactacttccacaatgttgttgggtggctgaatgaaatattgtattgcttatagactacttttgcacaacactgtggatgcccttattaccatatcacctagttatattagtgagatggcaaaagagtttttcatattggtttataatcctctttcattccttattgcagataaatacaacactatcaaaacgggttagttatctccttaaaataaaggtttgagtgccattacgaagtattttgattgattttaatagttgggagaggctacatgtttggttttacaggaaggggctgatttctaccgcattaggaaaatataactgtagaacaagcatttactagaaagctgctatttagatattgggctaaaacatctaaggctgcgtttggcagcaacaccaaagagagaaaattgttttgtttttcgcacgcacgtttcctaaactattcaacattgtgttttttaaaaagttgatttaataaatcatattaatttgtttttttaagtttggaataattagtaaacaaataatcatagttaatcgttcaccttgttttgcgcatctgttcaatcttctccttttctcttctctcaaaaattaatttttaagtctaaaatatttaatacacaattaatcataaaatatttaatacacaattaatcataaaatatttaataatcataaaatatttaatacacaattaatcatacgctaatagttcaccttattttgcgtatcttttcaatcttctccttttctcttctctcgagcacaaccttagacacaggtttatcctcaaaagctgtttatttatggaacataaggtgtacttccttaggtcaatctaagcggtaatgcgctttgcaatagatggagttttctcttctatcgtggaggttaatataagttatatcataggttcagtttaatgttatggaaaatagcatggtcttcatacgtgattataaaataaagtgtgtgtg

SEQ ID NO: 77055 - DNA, 1591 bp, Oryza sativa
tatctccgtttccggcctaccgtttttattccgtttccgaaaaataatatgaatagggaaatggtttagcgtgtttcctgacccttttttatccctacgtgtgaatgcacgcacggtttcatggcacattggcacagacgttttgcaccccaagaacctgttcaaacgaacacggttccagccttccacacgacatggatgggatggacggttggatttcacaccccgagacgagacgcccacattttcaaatttcaaaattcgaatcgccgtcacaacggccgcaactccctctcaccaccaccttttcatatataaactccccctctgtcccctccccttccaatccattccccttcccccaaatccaccctaccttgccgcgccgccgcgacaatccatagagatcatcgagagaggagtccaccggagccatgaggagcggcggcgacgtcaggtccttcttccggcagcagaaggcccacgccgccggcggcgtcaagcccaccggcggcgtctccaagaaggcggcgctgccccgccaccaccacaagcccgcgtcgcagggtgcttttctcctcccggtttctcccgcccccgaaactgttcgatcgattgcgtctccgctgattcgattgttcggtttttttgcagcgacgccagatcgcgccgtcgacgacgcgaggaggcacgtcgagaaggcggaggaggaggaggggcgggagaggatggctcgggagttcgacatggacatgcggtacgggccctgcctcggcctcacccgcgcccagcgctggcgccgcgccgccgcgctcggcctcgccccgccgcccgccgtcatcgccgtctgctccgacgaccagccgtgcctctgggagggccgcgtctagctctagcaccaacacccgatcgaccgatccgcttccagaaagttctagtagcttgtatgtgttttaagtaggaacagcttctcctctgcttccatctgccacgcctcgtggtgcttgcatcgacagttcatttcaaaccgctgcctgatgagtcagtgatcggtgccatcttgtgttcttattatctgaaatttatgatgttgttcttctcccagtcggtatgatctatgagactatgatgtttatgaaccatggcattttgattggattagtacaaactctaaaatcatggtaaattaatccaaacatttcattcccctatctcgattgttgcgggctgtgtatggtatgcaagatagtatctcagattctgatgccattctcccagttagtatgatctatggcgtcttcattgtatcagttattacattttgattggattagtgccaactctaaaccatgataaaattaacccaaacatttcattccccccaatcttgattgatgtgtataacaaacaagaaatcacacacaattgaatcgttggtactgggaaaaggaagcaacaattgcaactcacgattggattaacagatctttctttgcaatatatcccaatccacaaatcctgttattacattacaagcacgagtacaaaggcaataccgaatcaggacgaacgaacatcggtacacacaaac

SEQ ID NO: 77056 - DNA, 2216 bp, Oryza sativa
tccccatctcgattgttgcgggctgtgtatggtatgcaagatagtatctcagattctgatgccattctcccagttagtatgatctatggcgtcttcattgtatcagttattacattttgattggattagtgccaactctaaaccatgataaaattaacccaaacatttcattccccccaatcttgattgatgtgtataacaaacaagaaatcacacacaattgaatcgttggtactgggaaaaggaagcaacaattgcaactcacgattggattaacagatctttctttgcaatatatcccaatccacaaatcctgttattacattacaagcacgcgtacaaaggcaataccgaatcaggacgaacgaacatcggtacacacaaacatagcattagcaatgtcaaatgtccttttctatgtctgatatctggaacagtaaggtctactatgccagtaatacagtgtttcaagtagtctgattcctcgatcgtccatgtaaagaactcgctatccgttccgtccctgtattcttctcagtatggaataatcgattcgatgagctcctggagtggagccagctccttcttgtcaatcaggccaaattcctgcaccacataccaaaaggccggaaacaaatgaattttgctttccccagatttctatgaaccaagagcaaatatgagataaatgtaaacaatcctggtaatgagtttacaatctacaaacaaaagagacttacagttgtaaacagaatgaagtgcttgaagcacgtgttaagatgggcctcctccttgaggctgacaatcttctgaaaactggagtgatatatgtgggcataaacacgaaacaagcgcttgaaaattgtctttacaacctccttgaagtttggcgggaatggtgtgcctggtaaaggaattaaacccatatcagtgtcatgagttgtgtcaaaattggacaaatatatgagtagtgcctgcactatttctaaggtacacatgaccattccaacatcaaatgtttgtgacaaacaatgattaccaagcttttggggaaatatagattcatcatcaagttggccttcaatccagtccattaggaactccacatattttggcgctgacacttctatcggcttctttatctgtacaccatcagcccatctgtactcatatctgcataaattccatgtttctgttgttactttgttatgacgtgaccaatatatttaagtaattctgtacaaaaaatgaatcaggggcttgttgacatgacaactccactttgtaataggtggatataatacaaagtcactttataataggtggggtataatacaaagtgttcttggaaatttttgttccaaaaaggacccatcatgcttgtccatttagtcaatgttctagcctttaattatatcaggacaggtggaaagaagcaaagcactgtggacaggctaaaatggacagattcgaacatccttacctgaaaattccagaaaatttcctaaaattttgcttcggtgggctggtccaatcgacgcgatgcccacgggctggaaagtggaaactggctgcctcatcttgggctgggccgaattttatcgagaagattagacacgagtatgggctttgggcccagaactctccccaagcgccgcatctgctcccgagttttccgcttccgcaaagcgggaaaacgaagcgggaaaccgggcaaatacctcccatttcttcttttttttttttttgccttcgaaattcctctcatttgggggaaaggcgtcggcggcgagagagcggcggcggcgaagaagaagatggcgtccaacttctccttccctccgttgacgccggagcagatcgcggaggcgctgcacacctacggcctcgcccccaccgccaacctccgcgcggaggacatcgccaacccgcagccggatctcctccccgccgtcatctccaacttcctcgccaccgtcgtcgaccccaccgggtgcgtgcgcgcgcctccccctcccccctctcgccggcgccgcccgctcggtgtttgtaattgttgggtggagattttgcagcgccgacgacctcgacgggcagctaggattcgacgcgctggcgtcgctcgacaacccggagcactacatggagggcatccgggtactccgcctccacaagagggccagcgctttcctcgagtccatccagttccccgggtt

SEQ ID NO: 77057 - DNA, 3081 bp, Oryza sativa
gtttcacctggccctgtagtattaggccaaattctcttctaggtctgagtgtccgactttctgacttcattatataacttgcagttctatattgtgttggttagaaatgtcagaagcgtccaggtcaaatagggatagaaaccagaaggtttgcagctttgccatttggacaagacgatctttgtgtataattggattgaaaaatagtttggaaaacccatttacattgtaacacactatcatttactcttgacatatgttaagctacactgaaatggttctcgctgacatgctgaaattttagatatgcagaaaagacgatttctcactaaacgccttgttattttctttatacagattgccaaaaatgattttgagttggtgaaactagcacaagaaaattccaagttattgccaaaaattgttgagtccccagaaaagcttcaggttcgatctgttcctcttttttctctattgccgctggcaggatggtcagtcttgtttaaatacctgaattacttcaccacaatcatagatggtttgtagtgatcgtgtgcaatggtttttgtcctctatatgtttagtttttagtgctgatctaggttttttttttcacataatctggtattaaagggacatttggatatttaccattctaaaactcttcaaaaagtttgtgagaaattgaaaaacaatgtaaatactattatttttgcatgcacaactgacattcttccaatgccgtagaacttcgtatttactctgtatattatttgttcattaaaaagttgcagttattgccagatgctctgtcttgattctcgaggacacactttcactagtttaatactcctcgcttctattcaactgctatttggaaatatatgcatatatttgaatcaatcagatcaacactttgttcttctaacagcatataaattatctttataagcttgcatcactaattttggattttattctgtattacagagggcccttgaagagaagaaaacagctcgtgctgaattaaagaatgctgagaagatagcaacgcaaagtgtacaagagaaaactgccactttggagatatacagtaaggtagtcttgttccactcttcattacaaaacaccgaaggtagaaggtaacttgtatttgccgattggccgtaacaatatctagcaaatatagggttacttcatctgtttcatattgattcaatttcctgatattccactgtattgtttggatcatctgtttgttgcggttgttggggctgacttgttgcaagagtggcacttggctacttactactgttccttgtgatgcttgacctactgatccattaataactgcagatgctgtctccattttgcagggttatgaaaaattgtcgaagcattctactaaaatccaggctttacaagaacaggtatggacatctgcaatgctagtttttcattatggagttggattaatcttaagatgaaaccctagtaactctcttatttattattgctgttaggttactgcaactaaagcccttgagaaagaagtcaaagcgcgcaaaactaagattagtgatgaaagtgttgaaattatggcccttgacacaaagattattgaatgggatgggaaaggttgtcaaactgtacttaccttttgtagtattgctgaatttgtgtatgctctttccattctgaaatactcttttcctcacgttattgcatgaatacctttttgattagtgcatgaaatggaggagcatgttaaagctaaagaaaaaaaaaaggatcaaatagtagcagacgaaaatcagaagctggctgctttgagttctgaagttgaatggaaactcaagtgtcttgaacctcgtgaaaggaaagtagaggaaacaattgcaaaggtgatgatttcgtcctgaaattttgtgtggttcaaactcaatgtctttgaaaacttctttttccctctgaatcattgatttctggtgttcacatgccacatgccacctaatacaatctaatgttccaaagaggcttcattgtatgcgctagtattggtccaggaacatatgctgaccggcctgactatctccctaatatgctaaagcctgtagattatattatcttatttgttaatactatgatcctatttcaactatacttgacatatttttctgtcattacaggctactaaactatgtgcggaagttgattcaacaaggactgatgctgcagaagaactacagctgatatatgctaaatttcaacaaattggacatgcggtatgtttttattagaggactatttcctataatcattgataaaattgttggttgctaatataatccttcttcagtttacttgctacaaggataattttaagtctttcttggaacaagttgatgaggtgagcaaagaaactttagaaagtttagatcgtcaagctgtggagccattggacacatctgcaacattgtagattgagaaaggttaggtcatccagcaattgacacccactttcttgttgcagttaacagcatttcagctgttattgtagcatttcaagctaagtttggtagacggcagttttgcaataccttgctttcttgctgtgctgtaatcctaatgaaactcatctctccttgttttgaatggcagagaactcttgcagccccgctccctgaaaagaggatagccacttggagaagatagcctagtgtgttttatgccacagctgtaaatttggaattgagatgtttttgttatcactggtgacagttatggaccttatggtctgtttgaacctcgtctgaccaattcggtgactgagaatacttcatcgaattatctgcagtagttatgtaaaaatgccttgaatcactctgatatggaaatgttggtgtcaggttgccaagtaaaaactttggattatctggcctactatctgactacataattcattcctttagtatggtttaacggtatttatcaaaacgctgatgcacggtggtgttaggtcagcaaatctggagcacagatcgtgatatggacggatgtaacaactttcctcttcattac

SEQ ID NO: 77058 - DNA, 1472 bp, Oryza sativa
tatcatcctctctttttatactactatactgcgtatagtatttatatacatatgtagtgtaaactttgtattacactatgtatagtgtgtatatacacatgtataaacatacgtatataagatatatatatatatatatatatatatatatatatatatatatatatatataaactttgtatacatgcgtataaaaaaaaactttgtatacgtgcgtaaaaatatatacatatatataaactttatacacgacgtatacagactttgtatacgagagtatacaaactttgtatatgtatgtaaaaatatatacatgtatataaactttatacatgtacatatacaaacttggtatacgtgcgtatataaagtttgtatatgcgtttacaaactttgtacatgtctttatatacgtacgtaaaaatatatacatgtatgtatacaaactttgtacacgtgcatatacaaacttgctactaaaaaaccgaaaagggagagaaaaaaccgaacaaagacgaaagaaaccaacgtagaaaaacgagaaaaccggacaaaaaaaacagaagaacggcagaaactaacgaataaaacgagaaaaccggaaaaaaaaccaacgaaacgaacggaaaaaagggaaaaccggaaaaaaaccaatgctacctaactcctccgcgcgcaatccgccgtcccctctccgcgcgcgccacatggctagtcgtgcgggaaggaacgcgcgcgactagtcgcgtattagcgctttcgcactcaaaggctgtactagagtgcatctactatataatcgtttaagaaaatagaaaagaaaaacgatagaaggctcgattgcctctaaaaatgtacttcctccatcctaaaatataaaacttttttggtgtatgtgactatgaatctgaacaggaactcgtagttttaagataagttacatccatcttaaattccttatattttcagaacgaatgcagcataaaaaaaataaaaggctttggtcgaacttgtgtatgtcattatgtgcagtcgtacagagaggggtactgaccacaagtgctctgatgccagcaggggcaccggtaggattccatatatctctctcgatcatcggatgatctgaaggctgtgccgccggcggccgtgccggcgaggccagccgcccttgttccagcaagctgcacaggagatcggggccctccgccgccgcggccttctcctcctcctcctccttcttctcctcccccatggcgaattggcgattcgatcgacaatcaatacagctaaactagctatgcgcgttatgttgaggccgtgtgcacgtacgtacgtatatacgtgtaggtttcggatgcggcacgagcaaaagaaatcatgtcaggttcgagttagacaacttcccggggtgtttttctctggttgtcagctagctagctctacctctgctcatcttatatcagatagtgtgt

SEQ ID NO: 77059 - DNA, 683 bp, Oryza sativa
tagggcgaattcgagctcggtacccattccgctgctgttttcttttcttttgtaagtatgtaacgttattattaagatggatttgtatattaaattgtcagtttgtgtacctcggctgattcctggacgaggattttatgcacaaattagttcggaaattactacagaatttccgggcgtgacaatagccagctcctgacgcgtcaagtcaccggtcgggcaaatcgggtttacaatggctgcccctagcgcgccctggcgacgcgctccaacatgccggggctgaggacgacggcgaggtcctcgaaccactaggtgcggctggtgcaccgcacgctgaggcagctgctcttggtgtcgcacgagaaccggaacaccgagctctccggcgaggaagctcgtcagggtggcgtcccctgttttgcttgtgcttttggtttctgatgtaaaatactccatcatgttcttgtttggtgagatgaatcttcaaatctgcaaagttgcagatcggttgtttgagcttagcatgattgattggggtgggtgggggagacgtgtgtatatcgtactgtatattcgagttttgggtgggctcacaaggtcggtagcgccgaaaggtttttttttttatccgaagcgctgattgcgacgttctgaactggagcccgatgctggtgtggcat

SEQ ID NO: 77060 - DNA, 4873 bp, Oryza sativa
  unsure (1)..(4873): unsure at all n locations
tcgaattttaattaattctattattccttttagagaatgattttttttttcaagatgaatttatcaggacatgacatcctcgcaccacgacttctaatggtcgaggtacgactacgactggtcctcgaccaacaacgtagcgatcctcctaccacgacttctaatggttgagatacgactacgactggtcttcgaccagaaacgtagagatcctcacaccaggacttctaatggtcgaggtacgactacgactggtctttgaccagaaacgtagcgatcctcgcaccacgacttctaattgtcgaggtacgactacgactggtcttcgaccagcaacgtagcgatctccacaccacggcttctaatggtccatgtacgactacgactggtcttcgacctactacgttgcggtcctcgcacctcaatttcaaacggttgagagactcctactcctggttctcgaactcgtaggtcgtagcaatctctcgtacctccacttcaagtggtcgagttatgactataactggtcttcgacctgcggtgtagtgattctctcactacttctgtgatttgttgactacaactatacacctggccattgcccaatgtggtggtcgtcttagcatctacgtaaatttctgaaagtcagacattataacagtctagtcagatttcaaggctttgtcgcagtctctatgcccactcgattactcgagaacggttgatggagctcaacaaagaatatggaatgaagcgatggtgtacccgccgagatggaatttcttgacttcaatccaaattctcgattatagcaagatgggggacttagtcgcaaactccataccttctgagtaggcattgggacctagacaaacccaatatagtgcctgtggaggtcgataaggggaatatagcgatatctctgatctcaccgagaatggtcaggtgagcacgacaatagttattccaaagtcttcggttcaggacatgaactcgttcatttgcattgaagtcaggagctactgtcagggttatggatactatatacctaacactaattgactaagctcggcaaggcccaccacataacatgttttatacggaaacaaacctcgtatatagaaggagttatggataaggaaggacaaatagagttctacatggaaacgacaaggactactcggattgtatccatattggtctctctagttctacttggacaagggggcatgtatgggtataaatacaagcccccctaggaggagaggggacaagccaaaagacatacagatcaacatagatcaatagaagccaacacacgccaagataagtcgctggatatcgatatcagagataagtctagacaaacacaatatggtgtctgcggaggccaacaagagggatctagcgctatctctgatttcgccgagtgcggattcgagggaagactaccatgtcgtccactacgagttggttatccatgccgccaagttgatgacagctagataagttatcccaatttaatgtattggtgtgattatgatgaataaaagcaacaccggtttcggccaacaggagtagggctattacctgtcagataaggggctcgaacctatatagaaatccttgtctccatctcttttatcttaatctcgcatataccctgataccaacgatccacatactatgcaaaatactgtagtcgtgatatcaaacgtcgacaacctcggctccggtctcctagcgccacccccagatctgcgactggagcatggggtcgacgcgaccggtgttcgcgaccaccgccgatgcctagctcattgagctcatcgccaatgtctcacgtgggtagagagaggggggacagggagacgtanagagggtaacggngaagggggagctcgagctcgctgacactccaaacgncggggggggcggggggggagaacgacgggggacggggagctcgccggcactaggggggagacgaggaggtagaactcgatcttatcgccagcaccgttctcgtagtggaaggagagaagagagtgaaaaggaagacatattgggtaggagataggtggcatccgacatgtggtaccaattatttgtttttaattttttttgcctgattggatcaccacgtcagcataatttaagaaaaaccacccttgtttgaatggaaggggtaaattaaacatcatttacccggttttagagtttgggtgtgcactttagacaaagcaaagagttcgacagtgtaaaatggacttatcccaattaaaaggaataatataaattattaaaaggtaaaatacatcaagaagaattgaaatctggcttggagtatttttcttgaattctccatgctctaaattggtccctaaatttttatttgaattttcagagcaacaaaaataattttaatacaacaacaaccaatatcagagtttatattaacatgaaaaacataaaataattctctccttctctttgggccataacattttcggcccaaagtcctcctctccccagccgatgagcgaagtctgtatttgtccacccacctcctcctctttctctccctccctcttgggccatctccagctgtcggcccatctctcccctctccccctcggcctgtcctggtctagttgaccggccaccttcccatccccttcccctcacgcgctggcagatggggcccacgtgccaggcgcgtcccctacctcaagtccgccgttcttctccctcccgaccaaaccctaccgtcgccggcacgccgacctccctccccggatgattacactccgaattgaataaaaaatcattctctctcctcctcatcatcaattcccccatatttacccttcttgattcagcctttaatcatcgaattcaatctctggtgaaccactgccattgatggcctcccctcatctccttgcatatatatgttggggcaaatgagtagcccaaccgtatggaaaaataagttttgatcacatggagcaaaattgccgttgtagatttatatataacgggcacatctaccgagatttctaagactggcagcatgggtacaaattattggcaagtctgttatgttaccacaataattaattgggcaaaaaccaaagtataagatgctatagggccttctcattctaccaccctcagtctttcacacatagaagtcacaaaaatattgaaaaaaatattttttaccggttttacatgattataccgaaaatgctcacaccccggcgaccagcggggtggagaaaaatcggacgcaggttttgtcccctgccactgcatgcagacatgcaacgaatcttttattacatgcccccctctcttatttcttcaaaagattttttctcgtaaactatttatctaatttacgatctaattgtaccactaaattcgttacaattaaatctttacaacaagaccacacattagttttttattgatttttttaatgttgcatgtggtctcttctgatgtttcaaccagtagttttacaacgtttcagctagtgtactcatgatgtttcactatgtacgaatcaaatgtcgcagtggatttttatattatgaaacgtattgttgcaacaaatcacccacatattttggaaaccctctattaaatgaatttggtttattttttgttccaccaaaaaggtttcacctagattactcacaatgtttcactatgcatcgatctaatgttgcagtgaactgaaatattccagtgcaacaaaaaagccacatattttagaaaccccctgtcgacgggggatacccgtagaccagatatagagggtattggggtacgctggtacgagcatctacgtaatacgacatcgagcaagcagaaaacaaaaattatactggttcaggccccttaataggtaatagccctaatccagttgatatgggattatatgatggaaaccacagattacaaaggaaatagtggaactcgatgataccgacgagatcgtaatcgagttgattcaactagatcacccggcaattctgctcctgtaagctctggcttcgtaggctgtagtggatgtgttggctctgagattcaatgccttaggtcctcccggggggtcccttttataccgcaggtcaactggtctccaggttggactcggagacatcggacccgacacgatacaatgatgacccagttctatccgagtaggactctttccatctgtagactccatgctggactttcttaacttttgctgagaacgtccgtatatgcgcaaacatactatatcaaaatgtgacgtatatcgaagggtggagggtataccttacctgtaactcggacagtagcccccgacttctacttaaatgatcttgtgagaccgatcgcgacttctgatgttgtcatcgttctcgatgtggaaaccgagagacaaggagtgatcgacaacgtcgggtgaagctcaacggtcatgagtgaatttaaattgaagtccgaaaaactgtcgcgcataatggaccccgaaattttcggcggccatctctctcctttccttggaattcgcaccgtcggaagtacgtctatttaagggagttttggggatcccatttgaagtccgcctgttgaaggaactctccagcttccaagcatccctcgtcttctttgctcccgcaaaaaccctagctagctcatctcgatcctttctccggcgatccccggcggtaagtcaacctccaccagtgcgtcactgaagaaactgcaggaggatggcgcccttcccggtcgcgggaccacagaaagagaagtaggaggtactgaaccccagcctgtcctgggtcgcatggttgcgatcgaagacttt

SEQ ID NO: 77061 - DNA, 635 bp, Oryza sativa
tgtccttacataaatatgttttcctgtctgtccattctaatactgttgggctgtttcgccgtgctactgaactgaactttttgcaatcttcgcaggcaaatcgaaggaggaagcaatgagcgactacatcaccaaggtgaagcagctcctggaggaggctgttgctgcagcctcttaagaagttatgaactctatgctacatggcttctgtcagctgaacaactctatgctaatctggttgctgacaacttaccattctatcaattcgggatgtgaactatgtacctctttgtgtactgttgcataatttatccatctatttatgaagactattagtcctatgaatcatattatcttgtaatctttcatctctctggctgtgtactgcacaatagaaaaataatggttgtcaagccagttacatgccccaatttcaagtaaccataagcagtaataaccatcatatcctggatcatattccaatctcagaagacaacacaatctaaagagaaaaaagatctattgatcagaaggccaaaaacatatctatatgaaaaatgaaaatgcttaattgttcatagttagatagatcaacaacaccgcactgcacacatatatactgtttactcataatg

SEQ ID NO: 77062 - DNA, 1843 bp, Oryza sativa
caatggatctacgaaaagatcgtgtatttacaactacaatggaatagtatacaaagtcaacacaaatcattaaatagaatttatggctacacaaaccgttgaagatagttctagacctagaccaagacgaactcgcgttatgtggtgttagaattaaaaaaatatatgtgagacccatttatccgcagagtgactgagtgactggcgcctacctcgggaggccatgcgccatgctgatgttgtcgacatcaacaccgatgagcgcctccttcctcctcccagtcaccgctcaccgacaacatgtggaggaagagaaatggttaggtttgaccgatgttccgtgtctttctccggtatccgacaataacccctcgttgcacactttgcacaatgccgcgtcacccttctgtcttctaagagcaagtttaatagtatagcccactactgactctaattcatctatagccaatttatataatagttgcttactacactattaatatatggtcctacctatcatacacacaatacgtcttagagtccgtgttgcagctggctacagatctgtagcccgctgctcttctctctcatcttttatctcattaaatatgtttgtagccggctaatagtctgctattgccctttgctctaacaacgctttaccctttgctcaacttccttaccttttatttccatcacacgcgttttatcatctgacatcattgcaatatctctctttcgtgcaacacacagatattttgctagtggtaaattaatttcaaatgctcggttggacaatatgtcatatcagggataaaatttgatcctatagcaaaacattattagctattatccctatatcaaactgaaaattttattatgcacaacaagtaaaagaattcatgttttttagcattcaaaaaaaaaggagagaaaatgtaaaagggctagattgatcacaaataggactctaattattatcggcctccctctctagccttcatttcttcgtggatctcttttagcgtacaatgacccatgacaggtatcccaagaaggatgaccaaacagaaaacgatggcaaataccccctcgatactgttgcaccgtggaactaacgggacaacaaagaaagcaagcaacacgagagcaacagtgttcgcgaaccactgcaatatatatgaagaagagttaaaataagaactaatggttagttgaatatataacgaatgtaaacaatagtagctgataagacaacgagacaaaatatacagatatgaactttcaatggtatagctttaatgctctaaattattataagtataggtttgtccttgatcaaaccatttatagaaacagaaaaaaaaaatataacaatatctacaacaccaaattgatttcactaaacccataattaaatatatttttatagtatatttatttttttgaaaaatattgataattctttttataaacttggtcaaagtcaatgatgattttacttgaaacaaactgatggagtacgatttaaagccacataacttatagatggccatctggaccgtccggcacggcacgacccaagcccggccatgcctgggctgaggctagtcgggccggcatggcccgaccgacacaccgggccatgccgtgccagcccacgggcggcatacacggcccaatactactcgggccggcccgaaggcacaatggctcatcatgtttcctcatagaaaaagtctatttttggtccctcaactctgtgggttgtgtttaaatggctggaaagtaagtctattttatatacctcttgtcttgggccttgccttatacaattatttaa

SEQ ID NO: 77063 - DNA, 5894 bp, Oryza sativa
tatcctgtgtcatttggttggtggcatgatggtttcattccctgcctgacctgaaaaacctgataggttcattagcctagctcaggccaccaaaaacgagcgcctggctcagtctagttacacaaaacaaaacgcgctaatcaagcttgtcctgtcacggacccacgactgtgcatgcaaaaggtgttggaatattttattgttgaatcttggttggtgcaaacgaaccgaaaatacaacatttgcttatatgcgatagattaggatatgagataccgttttatttaaataatatctaccttaaccatgtaattatgaaccatctaatctcaatttagtttcctcaggcttaggctactaaccaaacaacatttgctcaggctagcctcatcaggcaagttttgacaggatagctaatgcctcttaggcatgtagttttcttaggcacatcactcaggtagccaaccaaacaggcccaaatccacaggccaaacaggccaaattgctaacgtgagactatgcctcccggtcacggtcaacaccagtgtagcagcactgcaaattaagaatgccaaattaattattgcaaggactatatactgttaataacgcaagaacaggtaaccgatcgagcagtttatcgtacctttacccaaaagaatagatgtccaaatgaaactagaacaccaataagaccgaacactccttcccatgtcaaccccaatgacggcagcgctagagctggaactgaagctgaatgggtcggatcagcatgtacagccagtagatatatgccataaatcaccagcgctgagaatgtcatgtagagaatatgacccacatgccgactcaagctcttgcaaatcctctcaccgaacatgccacagggaaggcatacattacccagaccccaaacagatgcaaatgcggcgagcatccagccgtcataaccagccggcagaaaaggtcgggcaagaaacagaactgccaaagaggtgctgaggatgtagacgtagccgatttgccttttgttccaaatctcgtcgtccgcctgtgtatacacattaatatttatatagagagagagagttgtggattgttataataacggagcgttgcttaaggcacaaaactggaatgtatttttttcacaagacaaaaattactaaatttcttgaaatgaaaataacacacaaaaaaaaaggtgtagcagtactagagggggggtgaatggtagagaacaccaaaaacacaaaaactgagcctgagaacactgtgtttaaatctgctggcatcatgtcttctttgaatgcatcttcttcgaagtcaaatgttgtgaatgcaaaaccttctgttgatgcaaaatcattgatttcaaaaccatctacttcacaaacttgtcgtgagaagtacccttgttctttttgcggaaaagatggacatttggttggtttttattttcgacttgcccgcaaacagaaaaaggaaagagaaattgcttttgcgaaacgacggtggcaaaaatcgggtttttgttcgaggagcacggttagaccgcagttgaacgggcggtcagaccggcctcgggacagtttttcgcatacttcaaatcggacttttgtgaaaccaaaaggtaagttttcagctaagtctgattctgattttgtcagtgcatatgtacctactggttctattggtcgtgtgactcagtgttggattccaaaatttcttatttctaaccccaacacagaggcctcgacatcttctcgttcgtaggtattttggcggcatactccccatgtgcattcaacgttgagatggcgattgctttttatggtaacatcaatttatttttggattgacatatttttggttctactctctcgattattagctttttatatgctagtgtttgaggtagtaatttttgttaatacaagtggatatatgtcgattcatgagaaccttggtgatatcattggcaattggatgtcttttttaaaatctttgatttcttcttgatttttctttggggagaattggaggttaatttgagggggagtttgtgctttttcatgcattcatgtttattttatgcatttgctctaattttgaaaataaataaaaataagaaaaataagagctttgttttatacctctagtatattcttgtgcatgctagcaaaataattgaggtctatttgttgctatgttagcttgtatgcattttagtctttatatgaagcttagatattgcttttaagtgagatgatgcatgacactaattcttttacttgaattaagaaaatatgcaatattaatgctagcatatggtttgatttttaaatgcttatatatagctttattgaattgttattcctcaaatagctttgtaattgctcattgtgaaaagagaataaaaaatacgaaaaaataaataccgaatccttggaagcagtcttgacgataaggacgtattcgatgtgagcaaaaataatgggtgccgaatccttggaaacagtcttgacgacaaggacgtacccggaataattgagagaaaaaaatatgagcaaaaaagtctcaaggaaagaaaaagttaaaaattctcttggttgttttgtactaaagctaatttgataaacagtaataaatgcaataggtatatatgtatagtgtttatttttcaacctatgtgcttgtgaatatattgcattataaatcatttgaagtcatgagtccttattgatgatttgagcttaattgtaatatctttgattcatgtttatactatgatgcatgcttgttaactagttgatgaatttatctcccttatcttgcaaaacatgatcattaattgcttttggtacatttcaaagctctcgaaaaaaatagaaaatggaaaataaaaatttgttattacaagtggcaagcatgacatcatttcatttgtgctttattgtcattatttctcttttgaattcttgatgaaatcattgtcaaagggggagaaatatacaaaatgcatgcttcttggaaaggggagaattgaactgaaactgtttcgatttacaaaatgcatgcttctcgaaaaggggagaattgaactgatgaactgtttcgatttttaaaaatagtcgattttgtgctttgattgcaaattgatgggagaaattctttcttttaaaaagggggagagtttttctttttctgctttgattgcaaattgatgggagaaattctttcttttaaaaagggggagagtttttctttttcacttttgtgatttttgtttttatttttcaaaaacacaaatttgcattttggagatgttgccaatgtattcatcaagggggagattgtgaaatcattgtcatgattaataattgtgatgaacaattggctatgcaaatgatttaatcaaagaattggtttgaaaagatgtgcgaatgttagtgtgagtgcgtgtgactaatgtgagtcaggttgtgatatctgtgcccagaaacggttgttttgtctgattgtgtgcaggtgacttgaggtcagccttagtcaatggtgaggaccgggactatgctcaagaggagcagaggtctattgcggtcgggataccatgtaagaaggtgactagagctagtattcttggaggtcaacttcggtcaacagtggggatcgggactaaactcagggaggagttgaggtccagacggtcgaggatatcgggtgacgaagttggatacgagatgtcacacggtggatggacaccgtgtgggagagatcttcgcaacaggcttcacgaggtgtgcgtgcaagtgctggtgttcgcgaaggagattggagtgagaaattgagaaaagggtatatggtgctacagtacacgtggtactgtagcatgcgtatggatggtatctatgcatgtatgttgatcatgcatgtgtggctcggtgcgttcttcatgcatgtgtgatggttcggtgggcttcggtggcagctggctggaggccgaaccggtccaggagcagcagcacgttggcccacgtgcgataggcccaagcaggagcaagcgcaggagatcgagtccgatgcggttgattgcggctgtgcgagttttgggaaattgtaaaaggtttggaaattgagggtttgagtcctactgtgaaaaggagttctacacctattttgagtagggggtttttcatgtataaatagagggggagcgtgaggcttcccggtatcgcttttttatcgcttttcagagcgtggagctgatagtttagttagggtttcgagtttagtcgagatttttgtaaggagtgttgttagtgcactttgtaaacacagagagaagcaataaagttgtcatctactttgagagttcttcgatttgtgtttcatcgggttcggcggttcgaccggcggcgtgcaagcggttcgactggcggcgtgcgagcggtccgaccggcggcggcgacaggactacgtcgagatttccatcgatttgagggtaacttttatttccgctaaaagtttttgggttttagttttctctaccattcacccccctctggtaggcttggtttcttgtgttcgatcctacactcttgagggaaaaaaattacatctccatttttattatggtcatctttattgtcaactgctaccttttgaggtcttttggcagttgaaagttgaaacaagaaaacatattactctaataaggtgcaagctagcaggagatctatgcaacaaatagtatctccaaaaccaagctattaaaatcttgcaatactagtaggaaataacatgatttttcagcaggacaactgcaacctaactatgcctttgttacaccatgccattggaaagtatgaaagacagaaagagcagattgttcagcgggactgtacctttgctgtggctgcggtgccattatccgtcaaaggaagggtataagcattgtgaggcgtcgagctctgcggagcagtttcattgggcctcagtgtgatcaatggcaatctgagaccattggagcctgaaactgcatatcctctgtcggaagaagagctgccggagatgtgagaggtaaccgaggcaagtaacaacaatgcattcagatttgggaatagcaactgatcgtcagctgcagcaatagcaaagaaatcatgcagttaggcacaagtaataacagaggcaagtttaaatagtgctgaacaagttggatataggcttgaactggtttcagaccatccattttaaggtgtcgtagaacagagacaagcagtattaacataccattcagctactactggttttccctatctacaatattcagatcatcatctccgaatttccacaacattcagataaaactatcatcaagaaacacaaaataccaaagtactgaacaatttacagtactgaaaactacaaaatccacattattgaacggacaaaagggacctgaaaaacataaacattgcccacaggaaactcagtcaatctagcaagcttggcaatgaaaaaatgccaggcaatctgcaattagtgaactatactagacttactgatgcagttttaacatttcaagaacttgtgcttcaggaaattcagtcactgtcatcacttgtcagaattcagtccctgtcatctacggaatcatcaataatctcaagttatgcagaccattcagaactacataaacaatgttcagagaattcagacacatgcatatcgagctagtctgcttactttcactgttgggcatgacaaggacgatgtgcagggtctcccggctgcgaggcaggtcgatgagcagaggagttagccgcccatggatgccggcgcgaacgcagagtgtaaactcgtcgtagcccagaatgcctgcgagcttctct

SEQ ID NO: 77064 - DNA, 680 bp, Oryza sativa
ttgtgaagacgcgcaaccaatagaccttactctcggatctagcggaaactttcgaaagtctccgctccgcccgcataaagctgaaccccgacaagtgcgtgttcggcgtacctgcgggcaagcttctcgggttcttggtctctgcccgaggcatcgaggccaaccccgagaagatacgagctatagagcggatgcgcccccccagcaagcttagggatatgtaatgcgtcaccggctgtatggccgccctaagtcggttcatatcgaggctgggagagaaggcgctacccctatttaagctcctcaaacgctccgggccgtttacctggacggaggaagctgagcgggccctcactcagttgaaggcgtatctcagctctcccccagtcctggtcgccccggagctagatgaaccgttgctactctacctggcggcagccccgcaggtggtcagtgcggcgttggttgtggagcgcgatgaggacaaccctcattccgcgcatccccaccctgtgccgactcgacccgggagagagcagggaggagaggctcccgagccgaacggcggcccgaggcccccgacgaccggagctggccctccgcctgcttgtcacacggtgtcaggcgcccccgacccccagaatggccccggggccactgcgggaaggccgcacctgccg

SEQ ID NO: 77065 - DNA, 70928 bp, Oryza sativa
  unsure (1)..(70928): unsure at all n locations
aacatgttctacacctgtctttaaatattacaagctagaattgaccgatggaatatatcttagtataataaatagtaggatatatctaatccaattctagatttaccatattttgaaacgaaggaagggagtagcttgagctatgctggagtaaaatcccaacacgaaactctcactacacgacgccactacgggttcaagccgatcttaagtcagaaacaaagtgaccttgttccaagccgcagtagcgagcatttctttatatttagaatctgtttggattgctacctaaaattttggtagggtaacaaaccaaacacctctattaaaatactacgtatgctacaaatttggttttgcccataaatttgtctcttataggtatatttttggcttcaatccaaataaacattttcaactctatcctaccaaaattttagtagtaccgaaacttgcccaagatttggcactaccaaaaatttggtagagcattaatccaaacatgccctcaggatgtgtccatttggattggtttggaaacctctccccttcgcacgcaaaacggaatgacgaaataacacatgattaattaagtattagcaagagtttgaaaaataaattgatatgattttttacaacaactttttctaatgtttttattttttaaaaaagacactgtttgtttagtagttcaggatacgtgcgtgtgggcaattagagaatagaggttgggaaccttgagtgaagaacacatcctagggcaaatgaaatggcgaaaccattataaactctccaggtgacatttactcatggtttatatgtcagtcaaatgaccatgaaaaaaattggaaaaaaataagatagattaatatgcgttagatcactctacaaacataacatacaagttaaatttctcacttttatatgttgcaaaaacaaaacaaatttgactctaaatatactttaactatctgtaatttatttttttcttattgcaacttataaaagttgaattttaactttctaaagtgatatatcacatgttaatacaacttcttattttttacaatatttttgtaactattttaagtgtcatgcaaactgaaaagacgtccccctcgagagtttaaaatccactccataatgaaatgccattcaaaattgtctgatggttcgagcagcaaaataagctataaaaaaaatttaacaaggcaacaaaaaaatttataggtaaataattattactagcagtttaaaagtagtagagataaaaatacaatcaccaaaattaaattataaatttctaaaaggaatcaaaccctaaagatgaatctgaacacacatatggctgtgtttagttcgcgccgaaattggaagtttggttgaaaattagaacgatgtaattgaaagtttgtgtgtgtagaacagattgatgtgatgggaaaagttgaaagtttagaaaaaaactttggaactaaacaaggcctatgtcattcatcgctggttttgatttttgattttttattttttgcacagagagagtataagccagcaaatagacttgaaaaccgaatctctgaagaaatctccgaggagtacgtacggcagttcccacgctagttgcattgggaagacgaggaaagccaagcagtggcgtcggcgaggcacctccggaacgtgtccatgctctccggcggcagagctatgcccacctcgatgccgccggcgccggaccggtcctccgccgccgacaccgcgccggtcttcgccacggacacgatctccaccttcgccggcctcccgaacccgaagtcgacgtcgtacacgcggaacctcgtcgacccggccaccgagaacggcgcgtcgtccctgcacgcctccatgacgcgctccgtccacccttcccagtacgcgggctcgccgcgcaccgcctcgtcaatggcgacggccaccgcggcgcaggccgtgaagacgccgcccgcggcgtcggcgagctcctcatgggtgcggcgaactcgtcatgcctgtccggtacgtcgcggatgagcgtgcggtcgattacgggcagctccgggagcttccggtcgccggcgcaggctgcggcccaggtgtggaggaagtgcgtcgagcccaccccgtcgcaggcggagtggtggacgatgacgccgagagcgaggccgcggcgcttgggcggcagcacggtcacctgcagcgcgagcaccgcgccgccctcgggaagctccgggacgagcggcgcgatcttggcgagctccctcggctcgtccgtggcgagctcgtcgacgccgacgccgtcgtgctcggcgacggtgaacgccacgccgtcgccgagctggtagaggagctcgtaccggttggtctcgctgggcgtggggcggatgcggctggcgagcgggtagaaggcgtggatagcccggggcagcgactcctccatccgggacagcacggcgtcgacaccaccgtcgtcgtcgtcgtcgccggggccgagtcggtagaagaagacgcgctcgacgggctgggcgcggagccacatcgcgtccatgaacatgagaggcagggctcgctcgggcagcgcgggctcgccggcgggcggcgccggcgcgacgcgcgtcgtgcggaggacgcggaggccagcggcgtgagcggccggttgcgacgccattgtctcgccgcagaacaggtgtggtttgtgttgctcgtggttagctgcagagcgatggagctttgcttctactcctataatacttgcatctccgcgagtgacttcacttcactggtccatacccgaattacgcccctaagttattatgtgattacgaattaccccttgaactcaaaaataagatatctttcaccttcaactatcaatacaggatgaaaactcccttaaatagctttgagagcggttttggtcctacgtggtagttcagtcaacaattcttttatcaactaatcgatggggcccacccatcagatctctctcctctctctctcccctctcaaacctctctctcgcacgcacggatgccgacgacgaggatgaggcatgtgccggcagtgctgcaccatcccgacggcgctcacatgccgccccattgttgcctcagccacgccgccaccccgccgccatctgcccgccccgagcagccttcgccacctcccgccaccatcttgcccaccctgagctgcctccgtaccccgcccttgcttgccgccatctactgctgtcctcggcgccccaagcggcctccgctactgcccgccaccccgagctgcctccgcccctctgtcgtcctactaccctcgcccaacacaatccaccgctatcctcgatgcccgagcggcctccgccattgccatcgcgccgccacgaactgcctgcacccccgccgctgtcccactgtcctccccagttactgtcctgccgtacatcatagaaaacatgtaaatacactcaaaatttacgaaatatattgagaaatgtaataacacgttacgaaatataaggattgtatttcagtgaaatataatgaaatttacaaaatgtattgagaaatgtaataatacgttacaaaatgtaaatattgtctttcagtggctttcataagaactccaataccagaaaaagaactcccctctacataattgaggaaaagaacaccacaatctacctgatagcttcaggtcatccaaaccaacttcaaaagatgacccagtgaccctctcaatccacaggtacctgtaaataggtacctgtaaacctatagtaaatgaagttcaagcagcagtacataatcgaagtaaccgtaatttttttaatcatgttgttaatcacagaatatgggccagcggcatccacgagcttgaagtgtaactctacaataatcacaagagcaaagaccaattcatagctaatcctgatacaatttcagaaacatgacaaagttatactcctgaggaacctgaccagcaacttgtgatgcaccatttgtttgcaatcgttcaacactaacaaaaaacaaataaagttacaagacaaattgtatttaaaaatcaaagcaagtaattccaaagatatcaatattttgtttcctggtcatttaagaattcatctcaaaccatgaaaaaaaatagacttcaacaattagagcccatttcaaaagaagcggtttcagttctcacaaatataacaagcaatttgttaatcttaatactggtgggctaaccatataaaggctaacatggaaatgaagcacatcagttgaacttcagattcagtagtggtagaaaattggcatatttaggcattgtattataggagtagttttttgagcaaaaagaaactttcacttcatagagcaatatattactaactccacttcatgtagctagaaagtaacagaggagcttgataaaatagatgtgcaacgctgattagaaataacaggatgatgatgatgcttgatgataactcatccagataaagcaatgctatatgcagtggctttttaatattccactccatgattcacatgacctttttatcaataaaagaaggcaaataacagtaataaggtaatactgggaagggcaagtcaccttactttacatttgatagaacggactcagataattcttaatggcacatctgttacatcttgttatgtatggactaccaaatcagttgcagttgaacaataaagggacatatcttaaaataaataaatctcctttttctgtgggttaaaataaataaatctcaaaaggattttatatgcaactaaagattaaacaaatagatatactgcagccgagtccacatgtcccttgaaacactgtccaggattgctgatcgattacgaaatatgaatttatctgcaaacttttgactgcagtagaaagaggagacaaataaatctcagtcaagaaacaaagctattgtgttgggaatatcaagtaaaattggacatgttagcatatctatatcactattaacatactgacgtgactccaatagtcattaaaaagtgaagtatctcatagtaaatctatacactaaaataatagggtgttctaccctgcaaaaatgaaatatttgtttgcactatatgaagtattcgagaccaaggaacaattcaattttagtttacataggcagagcttcaaatcacaacatacagtgaaaaatagagtaaatatgagataataataaggattcaaacagtaacaggagtgcacctcgatcatgcatttcatcaaacagttggtgtgctgcccatgggcacaccaaggaaccaccgtgatagctgatctggaagacctcactgtaatggaagggtaccatccacagcacacagtagctgcagccgctaaaggcctaggtgcagacgttgaggcttgcctgcgcggcttcagcgatggcggcatggaattctacatatctatcgaacccaacttttaaaacaatctatgcacttgtgtaatcacttgaacaccatgtggatcagtttaatgataacaaaatgaaacacattatataatcttatgattataactaactgttaagtttgtattcttcttggtccctgaaagagaaattttcagctcctgcacttgaatcttgcatcatttacataggtaaaccaaattgacagctgcatttataatttcatttaggatttgtcatgtaaattcaatgtaaaagtgaaacaatacctcagaggtactgtcatcgtgtgcaaggatcaaaagcaaaaatgaccaactgataaattatgaaatttgggatctggggcaatgctttttgtagttgattaagtacccagaatcaatgatttacataaaaattgagcttttcattttatataattttcatagcataatcaaacattttatcaattttgttattttcatatctattggaattgcattctaacatgtatcgatcaagcaaatttggaaatcaacggataagacaatgaatcagtgtgacatagggtcatagtaggttgaatgttgacattatcacaaattcaagattaacatatagcatattgctacagattccattcatttatttttagccaggggaaaattctcataatatgatcagcattcacggaacaattcattgatcctatttgatagcagaaaggagaaggagaaactaaatgcaatctgacaaggggcacataaagaaattgagaaggagagaaggatgtggaaaagcaaacctgggataatgccggcagatggcaacagctttgctgctgtgttgtaaaatcattcatcgatgagaatactggcacaacagaaagaaggcggggggtgtgcatcaacctccgcggtaggagtcatctctcctcgggcgtgtagataacgaagaagttgcacacgatggagaggaggacggcagggatggaggttgtccggtggcgtggagttgggcagtgggcgtccggctccggggcgtcgagggtgaagacaactaaacatggcgcacggcagggatgcgcacgatgaagacaggcgatgagtgcggcggaggaggcagcgaatgggaaagacctcgcctccggttcagtgcgcgacggcggcggaaggggacgacctcgtgggtagcggtgaactgtggcggcggcggtggatggggaagacctcgtctccggcggcagcggatggggacgacgtcggctccggccgcgactggggacggatggggaagacctcgcctccagcggcggcggatggggacgacgtcgactccagccgcggcggatggggaagctccggcggtggctggggaagacctcgcctctggttcagtgcgcggcggcggcggaaggggacgatgacgcgagaagggttcggcggcgtcgcaggattcgggtgacggcgatctcggcggcgtcgaatggggcgatgcgacgcgatggaacgacgacgcccctcacctcccctgctctgctcacgactcgcgagatggggatcggattcgattccgtcctgactggcgtggttctagggtttcgccggtggtggggggaggggaaaggatgggcggaggggcgcgagcagcggccagcgggacagcgacgacggcggtagggcgatgatggcggcggcgcctgatctggaggaatcggtggcaatggcgatttgtggcggcgtatgtggcagatcggctggtggcgaggttagggtttgggcgccgatgtggagcagctgtcagcagggggagggggatgcgggcgctgggggatggggaggaaggaggattaaggcgacgctaggacgacggatatcggcggcggcggcggttgatacggaggggatcgaggcagtggttgagaggaagacgggagagaggggaacgcttgcgcgtctgcgctctgcaggatcagagcgttgcggaagcgatatgagccattggattagacaatctgacaactcatattccgcatgtatgatagggttggagtaacggccacaactacagaattttaaaagtagtaaagaaaatgtcgatgtccttatatgtcctagccttctttctatccttcattcgatctagcgcatgtgtatgcgtctctcctccctcacgcgcgtgtgtatgcgatttttccttgaagatgccacatgtcctcccctcacgcgcgtgtgtatgcgtctctcctccctccccgtttttctcaacggtggttaagatctaaatcattattttgttattcattttaaataaaagttctatgggtagatcatagccgaatctcccagttacgggtgtcttcatgcaagcctacatgaatgcagagacatgggctaatatatttgtgatcgtctatgaacaactttttataagttgagttgtttgatgattagtctttttttttatatcatgacatttcaatcaattatttaaggtgcacatggactatgatttattgtcaaataaaaaaaatagtgtgagccctatacctgcacgttatacattttattacttcctccgcttttaatatattgacaccgtgaactttttttatatatatttgaccattcatctcattcaatcattttatacaaatatgaaaaaaatagttcatgtatatattaatcacatatattttgttttttaaaatgagactaacggtgaaacatatccatccaaaagtcaaaagtgtcatcccaggcccaccctcctctctcgtgctcgggtctagcccggtcatccaaatcctacatgacgtgaccctatcaaacgggcaaggcccaaatacatcaccttggcgtatgtggacaaataccaaattagggttaattatgcctccgtgtgacaagcttgccgttgcatcgaccagaaattacataagcccgacaggcatgcatgcacgaacttaaaaaatagtagctggattttatgatgagagagactaccccatggtataccgtcaaagcaacgggatacatcgtttatgaccctcacgttaaatcagtttccacgtagtcaagtacaaccatgcaagatgtcagttggtcattaaacaatcccgtcgggacgtgatcccgttgcctagattttctcttttatgattgataaacaacataaaaatattttaaaatcaaatcaaatatatgtgattaatactcctaaatattctctttacaagttaaagaaaattctaaaaaaaggcagacgtaatttaatttatatacggttatatatgtattgtcttttatagcgacttaagttttctccctttttttttatggaacttcaagaaccagctgccttaggtaccataatttgtgaacgtgatctgcagtaggtaattttataaatgacataattaaatttatcatgcaatgctaatggataaattcatgaagaaatcatacttttaaaatccaatagatattattctgttagtatactacccttacatcgcgcgggctatcttcctggttcatttttaaaaatctcaccaaagggatcagtatttcatttgaggtactgttcacctcgatttgcagttgggatttgctatctatcagtggacacgtttcttgcttcaaatcacatgattttcgaccttacgttaaaacaaaggaacggataggatttaaaacgcacaacgaacaaaaattgcacccataaaccttaatcatgtgaactaataaatttgactgggccagcccaattaaagtaaacaagctagtacaaatcagttacgtatcaaattacattgtaaatatgatgtaacaaagaaatgagaggctgcatcaattcacatgaaccgattctttgacctcgattacaattgcaagaaatttcataacattgtcatgttctttattcttgtaacctaagatcaatctcttattctcatatatgaatactgcaaaaaaatgatattaagttctaaattatcaaaataaataaaagcctaaaacacaaaaacatccatcgatacagtttccgaactctaatcatttgaaaatgacaactactccctccgtttcacaatgtaagtcattctagcatttcccacattcatattgatgttaatgaatctagacatatatatttagctaaatttattaatataaatatgaatgtggaaaatgctataatgacttacattgtgaaacggagggagtatgaacaatccaaaatcagaagtctaaaccacaaactaaagaaaatgcactatgctacctgaaacactaaactatgcagagtgccattaaaaatgcatcatcaggagttgaataaataaataaacactaaagaacactatttcaaataataaacacttttagaactgatctgcatgttaacaaccgattctctagaccatcttttaggtttcataacattgtaattcagaggaacaatacattgcacaaccatcatagttcccaaaactatggttaagacttaagattcagattaagaaatttaaaattagagctcaaaaagaacatagcaaatacaccccttatcatgtattcataataaatataaatatttagatataactaaatcacacatgtaactaagttgtaagtgcaatataactacggtgtaactaatgctattttttctgtaagtgcatttaatataaatatataaaaaattatgcatcatgaaatgattatttgccattttcataactgtggcaatgaatctgaattttcagccgtaggaaacaaagcaatggacgagattaatgcaatataacacaaaagacaacaaacttgtacatattgatgggtcatccaaacttcaaaattaactgggtaaacaaatatttgtattgaactgaaacaaatcagaaatatgcttgttaacaccaattgtagtctattgaatttataccatcctatagtagtctgaagaatataattcagacaaacaatacattttcacataacatattgcttccaaaaaaactaatatgccattgaatttagaaaatgtaagaaatttcaaaatcagggttcccaatacacgctaaatggatccattagaacacattcacaacaaaaatatagaaaattacattatataaccaaagttttagatagagttgtaactaaaatgtaaatgcagtataattactataactacatttgaattgtggtgtaagtgaatttaaacctaaattcattactacccatacattagaaatatttgatagctatatacttcacaatgatcaaaaaaataggttggaggataatttgactaggaatacatgtgatttttgaacataagcagaattttgttgctacttgaaaacataatctatttgatagttaaatattaacagtaataaaataggttggattatagtttgaccacagaaacatgtgacattatactttacttaaactcacaattaaatcatagtagcgaaaccgtagtctgttcattgggatagaaaagcagatattgagatccttcagtcctttttttttctttttggcagaacacacttaaagatcaaactattccacctgttaccaattatgtactttgtatgtatgtacacattaacaagatatattgatatgtacaagaagtccaaaggacagacaatcaatcacaacaaatttttcaagacctgcattgcaggtgaactattttgtccttcactatgctattatttattgtttcacaaagagaccctctatagttacaaacattattaatagttaaactttagaaaggctgatatatcatattctaggatgttaataaaaaaggaacggatgtagtactttaaataatgggcaaaattggaatgacaattgaaaaaagggaactactacacaattcatttctttcgcaaatgctttagtgctctacacaataaatttcttcttcacaattgtccatgctttactctggctgggatagtggtgcccattcctaaccagttcttacaggaaatagtcccatataaattgttgattgttttattcagacaagtttgtaggtacaacaaggtggcattcaatcatgtttgggtgttagatacttcatacgtattgcggcgtgagtgctaacagaatattagcttgaatacaagccaggaagaacacagcttcaggtagaaaagcattgcagcttcattcgtccttccatttgttgcacaccaatagttgcctttctatatttttgtatacctctcatttgctcatttcatttcctttgccttcttatgttgtgcagatagtcaactaaagagtataaactactgcaatcaccttttttcaggaacataactttcatcaaagttattctctcctaggcctaattcagttaggactgacaatttgccaacccatactgtaaaatggtccataaaaagcatttgttgatatagtattttgagcaagtgttgaaagataaggtaatttccctgacaaactgtttgttgacagattaagaacctgcagatttgtgcagttggctagcactatggatgcaagttagaactatagatccagacattcgtcttgcttgtggttaaaaatatgtcgcatagaatctgagatgaatcatacgtaattgttagtaagactgttcatgaaacaagccatcaagcaagaccattttatgtagcatttttaccatcaaattagcatttttgcactatcactgcagcggatttggatttggtaaagaggcatgaagccttgcgagatacaggtgaggagaagacggggttctaacctactttctagtgatgatggaaatactattaaattttattagtagagaagagacagatatatgaatatgaatatggatatggatacagagtatgaagactttgcgtcaatagattcatattgtaaagcagttttgtatactatatggcagattataaacattatatattgtaaggaaatccatgaaaaaaatgttcagtttggtagatcgcaccatgtcaaaagataacattttacattactcttctcttctattttagtttcgttttcatgcgtgctcacactaacaaaaaaaaaaagagatatttttgggacacgcctcttgttttttttgcaggcagagagtaagaacgtccgtatgtaaaaaatagtgtgaaggtgcctagttttttagataatggaatttatatcccggcctttactcaacagagctacagccaattattacaaagtaccactcatacaaagagtgtgaaggtgcctagtagagacccacttatgaaaatccatttttgtaggtggtcctcttaacatgtctgtttgtgaaaataggattattttcagaggcgggcctgttaaaaggtccccatgtaaaaatcctttcacagccccacttcctctccttttattaactcttctctcctttctgtctcctctaccttttctccctctgtccctcgacttctccttctccacctccgcctcctccctcatcccctctcttcttctcttgacggttgtcgttgcgacgggagtagacaaaggggcggcgttgaaatgggagcagcctgccaacagggtgacgccgcgataggagcaaccgacaggcgatgtcactataggggatcaactgcctccggccccacatcgcgccatgccttggctcctctgatctcgcgtcgcgctgcgcctcgactccttctccaatctcatgtcgtgctacacctcggctttttcttcagcaacaacggcgaactcgcgacagctggatccggtggacggccaaatcctatgacggtgaccccgagacgagcaaatccatcagcgactgcgcacagatcgtcgacaacatcccccaccacggtggcagcgggtcttggccacagcagatccattggagttgaggcgcagccaggggcgacgccacgttcagcttgccaagtgcacaggcaccagggaaaaatttagtttttagttattagcatctaatctccaccttttgtgcactccccagaaaaaaatatgtgcaccaccttcagctgcccagcaggctgcaggcagcccatgaaggcccaatttcttacgtgcagcccaaactgtccaagtgcccaacagctacagcccatgcgtaaatgaagtgtgcattctggtccttcgtgctctagattcgcccccgcgcagcgggcttcgggcagtggtgttggaggtgcggcgtgcttcgggcgacatcaaggagctcagggacaacagatccaccggcaacaacaatagaagcggcggatccgctgcctgcgggctgtcgggctccattcgatggtttgcatgttcttgatatgtatgggctagggtttcaagatttttttttcttttttattcagaaaaaatatttacaagcgggtaccatatcatgagaatctgcttttgcgggcagccctcctagagaagctgtttgcgaaaatggtttttacgcgtggctgtgacgcccgtatgagaaaaccgtgatttttatagctagacaactttggccagacgggtagagcacccgtttgcaaaaacgacttttgaccgtttgcaaaaatcaattctgattgtcacttcttttctattcatttgccgtgtttactcgtcaagctttttctagtgaaaaggcgtctatcatagttactagttcaaggatacagattttttttttggaatgcgcacttgattatggaaaatcttaactaattaaaatattcgtaattttccttttgtcacctctctttttcatccgtgttttcatctgtacatcatatcaaccgatttggttagcaatagcgatggaaaaactgcaaaagaaaaaagaaaaagagaaaccatcagcggtcaccgacgccaccaccgccgccggagggagaagagaggcggcggagggagccgctgctgccggatccgcccgcggtcaccaccaccgctgacggatccacccgcgaacgccaccgccgccatcggagggagaagagaggtggcagagggagccgccgctaccggatccgcccgcggtcgccgccaccgccgccgctcgcggggaggggggagagggcacagccgcagccgctcgttgggaaggggaggggggggagggcgccgccgccgctcgcggggtgcaggcaccttgtcgccgtcgctctgccagaaatcgccgccgccatcgccattttagcctaaggggatcgggagagaaaaaaaactaaaactagggttagggtttggtacaagccgttttgacgaattcggaaccgatctgagccgttcatcaaaatgagcgactcggatcaatcccgcatcgagccggcctccatctttgggctgcagcactattgggccgcgcgcagcccatgaagcactagcagcgtccgattgaattgttggaccacattcggtatggttagtctttttttttaaagcaacaagtccactttgcctctctcaaatatatctcctatctaattcatagggaaaaactaaaaataaaaattacccaacaacatacaattacccaacaagagaaagttagtcttttttttaattgctacaaaaccttagttgatgttaaatctggtaaacaagaaatatattgttttcaacatgttgtttattggcagatttatatcaagaataccatattctaaaaggacccatatcacaaattaaattctaaaaatatttattgtgattttagttaaaattattccgttgcaacgcactattgaataataatttattacgagctactatatatttctctctatcatttgtgactttttctagcgagcaaaagtaccaaagcagtgtgaaaataacttcggttaaaaacaaatatttttagttttaatacaccgtagcgaagcacgggtattttgctagtaattataaagtgtctcctagatacactgtagggttacgatcgaaggacaacgttactagagtgtttataagagcgagctatcaaatgagttgccgcattcaggacagtataaacgtcattaaacaaacagcagagaaacccaccgccatgactcgttcaaggatacatttgtttacgaggatatgctttattccattatcttaaaaaaaaagctctatttcttaaagatttgaacctttgtatttcttttaacaaacgaatgtgtagtctaaatttatttattattacctacggagactcttgtactttttttttcaaacaaagagcaaaaatttgccactctaaccctcacttccaaagtgcgaacggtacactgtgtgatgaggacacaactagctcggatataaccgtgagtaccttatgtattaatcaactaaaggtgcatatgttttatattagatttacttgttatatatttggaaaaacgttgctacacaatgagttttgtgtgttttcgtttgcagagttacttgcttgggcgaaagaaaagagaccgaacgtaaggaatgcgtggatgattgaagaagttgattggtgacaaaaccaagaccttttccaagtcttctttcatctcaccacgtcacttttggtccatagaagacaagagataaagtttcgcatgctttggattcggactcgggcttcctgacagcatcaacttcaaacggacttagccgctgatctagaaggaattttggggcccataagtacttgttggaaagcttatgaagtctactttccgatggttttggtcccatgtcaaaattcttactgagctgccaggaatctgcaaaacaaatcatgtacctcatccagtcctaatctgatttgggttttgggccttataattgtgtcgtgggctttagtcccagggggtgcgcgtcctaggctaaccctaggacgtccctaatcatatttattcagtagccgtcatcggttagagtcgggtttttcttagattattatgttaagaacagtttcgtcgctagatcggtttgtagaatcccaaattcgtgtgcttaatcatttatacgcaatttggttgcaatctatcttgttcttgcttgtgttcttcgattcgcatgcagggattagccttcttggcgaggtcaatcaggtttcggcatggttgataaccagaggagacgtggtgctgcgattgcggaactcagtagcgtgttcgttcagaagccagatcgagttgtgtcgccactccgcccaaatcgactgtttgtcaatacctatcggatgatcaggacctaacatcccctcatcagttggtatcagagcgcggttgcccgttaggtaatttatcttccaataaccagaaaattgccacacaaaaatatttattctttacctaaacaatttgagccgttgtgttgttctattagattttgctttgttgaattctagattgcatcgtcgtgtcgagtgctagtttagttttagatttaatttttagatttgagtattgtatctgttcatcacttaggtctaggtctagggttcatcactcaagtcggtgtgagttgtacgtcagttttggtcgagtttttcatctcgtcggttgttgccgggaccttgaaaagttgaatcgtctcgttgtcgggtttccgtttttgtagtttggagatgtttttgtcaagcggttttggagttgctcggttgctaggggtccggttaccgtgcttgtgtatgtcggtgtgcagtaccatgcgcaggtagaaaagagaaagaggaggttttcttttggttgggaatagcagatcggtttatgttggttgaggataaattatctaaattttcatgtgggaccaataggaaaccaagccgagtcacacagtggccaatccctctcatcctcacgttattttccccacataaaggcggacctctgttacatcttggagaatttttttttatgtcggatttgagatatttttgtaaaaaagaaaatgacatgagcaatccatttttgaggtgatccaattttagttttgtactttgctgagtcccaataattttcatatttacatttgagtccctgttcgaggtcagtggttagttactgttgaaaaaaaaaataataataaaagaaaaggcagaaggtgcaaagaaaaaggaagaaaaagccgcaccaagaaaaaaaaaaggcagaaaggtgctaaaaaaggcagcaccaagaaaaaaaaaagaaaaatcattcatcctttgagtatgttttgagagtgcagagttgtgcattgattcatatctagtccttagtattgtcgggtgcttgcttgagctagagttgggtctaggctaggccagcacattgactagtactttgaactattattgaactttgtattttctgattagcacaattgcgttcctttgctactatatattgtgcctcccaagctctacatatatacttctggtcagcaccactttgatctttgcaatcgccacatcacatccttcgaggtgtcacgaactagccacggttgtaccgtccttagcattgctggtaagacacttgtaatagcttgataaggtgctccatttggctgagttattgagaggcaccactacaccgtgtagcagattactgtttgctgctgtttttgtgtttgcaatgacaggtatgagtggcgctcaaaatcagcgataccaacaaggtaacaataatcgcgtgcccgatgatccttatgttaaggttaagtttaaaataccatctttttttggttattatgatgctgagaaataccttaattgggagatgacagtagagcaaaagtttagtgcccaccttatacctgaccaacatagagttcgacaagccagtagtgagttcaaagattttgctatcatgtggtgggctatgttagctgacgatggagttttacctactacttggaaagaacttaaggtagctatgcgcgatagatttgttccaccatcttatcttagagatttaagcaagaaactgaagcgtttagaacaaggggataaatctgtacaggattactatggtgagctacaaaaggtatttatgcgatgtagcatagtggaaggaaccaaggattccatttgtcgcttttacatgggattgaggcgcgagattcaggacatattagataataaggaatttaacattgtcaaccagttgtttcagtttgctatgcttgcagagaaggaattacaggggcatgatcaacaggtcaagaacaagacgaacacgtacacaccgcgcacgacgccatcttcgagtctgcccaagcctatctctttctgggcgcccccaccagcgtgcaagcaaccagttgcgtctggagtttctacagcgccaaaaccacctcctccacgacctgcagatttaggtacaagttctttgcaggtacccgccaagagtgcctcatccgtcgcttcaacgggacgcattcagtgccaccattgccaaggatttggccatatgcagaaggtttgccctagtcaacgggcatacgttgctacggaagatggctacatcagcacctccaatgttgaagatgatgaggaggaagagaagaaagatggagagcaaaaagacctatccatagtttcatgcatacttgaggaatgtttaattgactaagtgcctataatttctgaagataagaaaaaaaggtaatgataatggtgctacaactactcaaggtatgcataattatgatgtgccaactatgtccactacttgtgctacattagagcaacccatagtggaaacaattgttgaaatacctttgtcacaaaacaatttgcttatgtttcttgcgataaagaagagttgtgcgatgcttcacttatatccatgccacaactagtgaatgaatatattagttctatagtagagccatcatgtgttgagtttaaacatgttattcacattgttagcgagaatgaagagcttaaattgctatcttctttaaatacttggggatatattcaatttgatgatttttgtccactcaactgcttagagaagaaattgtttgctagatttgaattgccatgcccttattatgtgatttttcatgttattggcaattatgatagcaaaggagaatataatgtgcatcgagtagatttagttaactactattaggtatgtggtatccataaccctgacacaaatgttgctacacaatgagttttgtgtgttttcgtttgcagagttacttgcttgggcgaaagaaaagagaccgaatgtaagaaatgcgtggttgattgaagaagttgattggggaccaaaccaagaccttctccaagtcttctttcatctcaccatgttactttttgtccatagaagacaagagataaagttccatactctttggattcagatttgggcctcctcacagcatcaatttcaaatggacttagccgctgatagagaaggaattttggggcccattagtacttgttgtaaagcttatgaagtctactttcagatggttttggtcccttgtcaaaattcttaccgagctgccggaaatctgcaaaacaagccacgtacctcatccagtgcgaatccgatttgagttttgggccttgaattgtgtcatgggcttagccccaaggggtgtgcgccctaggccaaccctaggacgtccctaatcatatttattcagtagccgccatcgtttagagtcggtttttgcttagattattttgttaagaacagtttcgccgctagatcggtttgtagaaccccaaaattcatgtgtttaatcattcatatgtaatttggttacaatctatgttgtttttgcttgtgttcttcgattcgcatgcagggattagccttctcggcgaggtcaaccgggtttcggcacggttgataaccagagaagatgtggtgctgtgattgcggggctcagtagcatgtttgttcagatgccagatcgagttgtgtcacgactccgcccaaattgactatttatcaatacctatcggaagatcggaacctaacatcccttatcactttgttgggttaactattcctcgaaagtcttggggtatttattgtgtggctatctataacgggccgcaaccaaactccgtcaaagattaactctgaatggtgacgagcttcacaatcatctttgtcggaccatggcatttgcccgtcactgatgaccctaatcggtgatggggttttgttgcggcccatcaccaattacttttaactagaaaggaagcccgcgcagatgcgtgggcaatttatttattgtttgtaaaaagaatactaaaataagtcatgtctcactatatttcattataagaacccaacattaacatataatcgtaaaagaaaaaatatttatactgttaaataaaccatagaatttatatactaaatgaaaatggctatcatattcaaacagaaatcactttgtctcaattatatgtaaactcgcctatcactgtccttcgcaaacataatatagactttgatttttttttcttttattatacatctaattcacctatgcatgtttgttggtaatatacgaaggaataatttatattgttgaaattatttgtgctaattgttaacactatttacatgggaacaacataattaaaaaatgatataatatggttccgtatgacatttccgattgtacgtatgtatatatattttttctggtgaatagtaatcgtacgcacttactttttcctttttttaacaaatatttttctctcatatggggtagggtgtgcgtatatgtattcatgggtgggtatgtacatgtttatatgagcgtctatgatcgcctttacattattttttttaaaataaaacctttcaagaaaattggtgggatggcgtaaagcggcaccatagcggtgttgcttcttcgacaacatcgtcaggagtggctgctacatatatgcacaatttgaagaaaaaccatagggctataaagaaagaaacgaaaaactatccaagatgggatggatcgtatgcactcttcggtttttcttcttttcgatatcttttgtgtacatacatacatagggatagattagctgatttctaggagcaagggaatagaatagaccaaatctaatggttgaaaatcatgaactgatcggtttaagtgtaaattgatgactatatgttttgccttttcttatattttctcttatttattagagcgtcacataacatcttaattaggagtgtttgtaggagtgtaagaatgctattactcatactcacaatctatttgtagtcaactattatttgatgtggcttggtggcactctctatttacctatcatttgttcatacttgcccttaggctgagttcggcactgagagttcctaactctcctccctcattttccgcatgcacatttttcaaacagctaaacgatgtattttttttacaaaaatattctataggaaagttgctttaaaaaaatcatattgatccatatttcatgtttttttactaatacttaattaattatactctaatgaactgcttcgttttccgtgccagccaactctaacgaatgaaaatcagccttagtatcgtccttaatttaacctccgtgcttcatgacaaacatgtttattggatgtcagctaattattagacgcactgtgcatagataccatgtaagcaatatgacttggcaattggtagatagtatataaaacctatatacatagggataaattagtggggacatttggttgatatgttaggatattcttgattgacaaattatatattgtatactacatgttaagtgttttagtacataaataacaaatttatggttaagttctaaaatgcttatctgattggctactcacttagttatcgtgactatgtttaccaaattgctaaatagtgcgtatttacaaaatattttctatacaattttttttaaaaatcaaataaattcattttcgagtttataatacttaatacttaataaatattgcgctagtgacctacgtcgatttgtgtgccctggacatgctcaaccaatgagctagatggaacgaaggctaagtagaagataaaaaaaacatcaatatggtgccaaaagaatatatttgttctttaattgtccaataatatatgaatagagaaaacaaaaaatacttgaaaaatacatttatgataaatttagaagtgtcatttgtatatatgtgtattttttttgttgttggagtaatttttattctcgaaaatataagtctaatttaactattatataatctacatttttcaacccatttatgtttttcatggatttttcaatgacatgcgtctaattaaaatacaactagaaataacatattccctctatcctaaaatataattatttttagctatgaatcgggactaatgcttgttcaaaatcatagttaaaagttactatattttgaaatgaatgtagtacatatttacaccttaaagcataatacccaacttatatgtgtattattattcagtgtggttttagtatatttttattgtatcattgttatttggttatcacacaaatggcaaaagacagtggtacatatatatgtttaaagttagaagagtgttttctcatatgtggatttaatggtttcactggtttaatattatggatctactgaattaaatggaaattaatgggttaaattttttgtttataatattttttctaaatttaaaatattagctagacaataggaaggtgagagagaggactcttggaggatggaggaagtttacatacgggcctacgtgcgtgcacggggtgtttggagtctgcttttcatctaatctaaatctaaatgtaagaaagaaaaaaaaagtgcaaccggggagttcataagtacatacatacgtttgtttttcttttttggcaggaatactatgcacaaacttaatcggtagtttttgaaagatattttctggaatacgtacttacgtgtactttttaagtagtatacacatgtacatatatctaacttattgatctaaaataaatggtccaccaatttaagtgaaaatcgacggcatgtacaggtctaatctaacggtataaaataatgggtctaccaatttaaatgaaaatcgacggtgagatttgactgtgccacgtggcagcctatgagcgtttgtaggagtgccacatggtggcttgggagcgtttgtagaaagtttaatggacttttagtatataatagaatagaatagaatagataatagatagatagatagatgggccaccaccaaaccccattttcgataagggtaatcggtgacgggcctggttctgaggacttatatactgcctctcggtgcctatgtgacggggtattttgtagcccaacaaatataagtacctttgtaacgggcctcaagtcttcatcactcacagatggatcgattgggataccctgtcctatggtagtggaagtatattttctagactttgcaccaattaatacatataattatgtttacggagcaagtatttgaacctagcgagtagagtcaggtactcataactgcactagcacaactacactatcacatcaattgtgctttccctaagccattacattttcttattttttttcggccaatattgcagtgtctcgatataaatgtgtataagtatcattatggatatacaacatcctcaaattatagtagcatttacaaactactatgcatatccgaaccgcttgttatcaactagaaagtaatttatgagttatatatatgtgtctttaacgattgaaaagcaaatgttggaaactacgatgatcagaaaaccataaaatcaactcctagtacaaaattatattttaatattagcttataagcataaacataagcgaaaatatgaaatgattgggctttgtattccattaaaaggacgtaaaatagggaaaacccgcaccgatattttgtgataacatggaatgccacacattgaagtgaagataatggtttaaatctctaaccacagcacgaaacgtcccatgtatgcgtaaagaaggtaatagaatttaaacttcagtgagatagtagaataagtatatagtgcttcttttttttctcatgatttcttgacgtttatgggctaggcttcgttcttttcagatgatttacataattattaaagcagatgctccgacctttaaaatatatgtttgcttaaaataattattgcattgtttagacctacttattttcaactatttgttaagtgtattaactaattaaaatatttaatatatttctataatctagatgagtaattaaattgtacaaaataataagctcaataatataaatgatacggaggctaaggtacgttgcagccccatgtgcatttggcaatttggcacttggatatgtatatcaaggttgtgaccatccgttatttttgtttggcggtgttgatcctgaggcgttcgctggccgctattgccgtgggtcagaagaaattggctagtggctacgacggttgacctcaaagttagtgaaattggctgtctggtggttttgggtgccaatggtttttcattctcgggtctctgaggccctgtttagatgggactaaaacttttttattaaatgtttaaatactaattataaatattaaatatagactattaataaaacccatccataattttaaactaattggcgagacgaatctattgagcctaattaatctatgattagcctatgtgatgctgcaataaacattctctaattatggattaattaggcttaaaaaaatttgtctcgcaaattagctttcatttatgtaattagttttataagtagtctatatttaatactctaaattagtgtctaaatatagagactaaagttaagtccctggatcaaaacaccacctcactgggttgggaaattattactactttatgtgtctcttttttaaaaaaatgttcagattcataacagtagattgtgtctgatatagtattagctatgttgttagtttctagaacagaggaagtaaaaacttttatttgtcatccattatgatattgcttgtgattcctactacactccctctactgaggtgtattatttagatatttaatattttcatgtttatctataacctctctaaatcacatactactagaaaaacaatttttaccaacatatttttattttctcaggtggagagaaaaaaatactctcttataaccgtttacaaaaatagagatttagcctcgcctggcaaaatcaatttttatgtttggagtcttaagagatccgcctataaaaacatttattttcataacggacgtccgaatatatgatttttgcaagccgtccgtaaaatatggggatcctattaggtcatggctcctctcctccatcccctcttctccctcagctctctctctccctgcacctactcccactacctcacactccttccccacctccatccctatccccccaccattgcctccagccgataatgacgacaacggcacaatgcttggatccgccaccggccacgacgacggcagcaatggcgaagatgacggctgcgactggctgcgacgatgacaatgacggtgcttggacaatagcaatgggattcgcttcctgctggcctcgggtgcatggatctgccgttggccatcctcgggagcgcggatctgccgtcggctgtcctcgggcgcttggatacgccggtggaaggagtgagtggtggcggctttgaccggcggtggcgtcaggaggtcagggtgggggctctcaggttgcggcagggcttcgaccgacgatgaattttctgctttatgatgatatctaatgaatttgttaaatgaatttgagtattgtgatgagttcgttgaatggatttggagattgtgataaatttgttgaatggatttgaggattgtgatgaatttgtgaatggattaggaggtttttgaatatgctcttataggaatgtttgaattttctgggtttttttgtggtctttaaatttgctctttacgcggccgtttgcccgcctacggaaatacactagtttcgcaggcctttgccctcaggcggttgggctggccgcctgcaaaaagctgatcccactactacaacaccgattgtcccgggcgggcgagccaattttcgcgtgtgggtgggcggtagagattggtgaataagatctcttaatcacccagtagtcccttaaagcccacatgacgatttaatctagctattccattattataatagattatacgagagaaaataaagtccagtggtggtacttacgattgtttaggcttgctaagtaccatgcatgtaaaaaatgttggctaccaaagcataagtatattttggtaatgccaaaatattttggcaacccagctatgtgtggtatcggtgaattttggtagcaatactattcagagtgcagataacttattaggacatttattttgcaggcttcgaaccaaaaatggtccttagagcatctccagcagggaccttaaacccagtccctaaataaattttgagggttaacataaaaaactagatccagtaaagaccctaaacctagcccccaaaataataaggccctcagatccacccccaagcccctagtcctgggggctccgagcatagccccatcgatatttttctggcgccaaacgacaattcactttcacgctctcgtcacattcccgcacggcaccacgatgctggatctcatctgggctccggcaccagcggccatcgattcccctgcacctccggcaagattggcacaaaaaggtgagaatttcccctacctctgtcgcccatcatccgcaaggtcctccggccgccgccctcacgagtccgccgtccacacagtgtcgcacgacctcccgccgtcggtccgcacgttgctgtccacacaccaccccgcactaccatggtcctcctgctgcacggccatcgtccctaccgctgtccgcccgcatgccactatccgctcgccggcaggagaaccggtggctgcccacccccacgctgccccattggcccaacggatggagggccaccgccttcgcactgccggagggccaccgctccaagccagcctacacgccgccctatgctcgccgctctctgccccctacggcttgtttggcaccttgagggaatgggattgggagtttacacgagggaattgatggtgagattaagatgggaatttggtttttattcccaatatcttgtttggcagaggtggtggaaattgacagggagtttagttggagattaggtcattaatgaaaatggatggctgagatttgtttaggcaaagcaaaggagaaattccctctcaattaccacccctacccaggtattgaaaaggagggagttccttcctcaattccccatccccatcccaccaaaattcccttgtctcctgaccaaacaaaacaaataatagccccatccctctaagctcccaatccctcctaaaaactccctccaaccaaacggaccgctagagttttctggattgaactaatctctgtggtaggagtactactagcagagaagtattatacttgaccactttttgtgttagacattgatttgtttttatatattttttttagaactgtaggagtagtagacttcttcggtggtagagaagaatctcaaacactgtgcttgtactagtagcactgcattggatcgtgggactgtacatactactagcactgcactgaactgtcgttgctatggatcactaggtgtttggatccagggacataactttagtctatgtatttagacattaatttagagtattaaatatagactacttataaaactaattatataaatgaaagctaatttgcgagataaatttttcaagcctaattaatccataattagagaatgtttactgtagcatcatataggctaatcatgaattaattaggctcaatagattcgtctcgcgaattagtccaagattacggatgggttttattaatggtctacgtttaatatttataattagtgtccaaacatccgatgtgatagggacttaaaagtagtcccatataaacaaggtcttatgtagcacttctttttataggctttgagtcttaaatatatactccgtactgtgtattattatgaatataattgtctattttgttatttgagatagtggaaattaaattttcttattaatttacaatattgtgatggtagtgattattttatatggatttctacgatgatgatgatctccttgctcaatggtgggagcaggaggaagcgtctgacgacgatgactactatattgcagctgctcttcttactgacatagagcataagagaaccaaaaggaagcatcgtggttcagtcatgggtcaagagataatttacagggacagatttgctggcaatttgcgcatagtggctgattattttgcagatcctcctatatatagtgcaaaattatttagaaggaggttcaggaggatgtcaagggagctctttttgcgcatagtggctagtgtggaggcacatgatgactactttaggcaaagaccaaacgcggtgggtcttcttggtgccactgcattgcaaaaggtgtatggtgcagttcgcatgcttgcatatgatattccagccgatagtcttgatgaagttgtgagaatttcaaaaaacaccatgatagaagctttcaaacactttgtcaaggctgtggtggatgtgtttgctgaccaatacttgagggcaccaacagctgatgacactgcaaggttgatggctatgaacactccaagagggtttccagggatgctaggttgcactgactgtatgcattgaaggtggaagaattgcccaacaggttggaaagggcaatactcagggcatgtggatgggccaaccatgattcttgaagctgttgcatctaaagatttgtggatttggcattccttctttggattaccaagttctcttaatgatatcaatgtcgtacagagatcaccactctttcaaaggcttacttcagggacagctccagagctagagtttatggtgaatggtaagaaatacactatgggttactatcttgctaatggcatatacctttcctgggccacttttgtgaagaccatttccaatccacagggtaacaagagaatccattacacaaaagttcaagaaggagtgaggaaggatgttgaaagagcatttggtgttttacaagcccgctttgcaatggtgaggggtcctgctaaattttgggataccgagaccctatggtacataattaatgacagcttgtgtaataatgcacaacatgttcattgacagtgagcgagatgaagatgtagacttcgattatgatcaggggatagtgaggtgttgaggaaagaggagtaccaacgacgcaataaatttggttagagaagtttctacagatacataaagaaattgaagaccgacaggcacatgagcaacttcgagatgatcttctggaacatttgtgggcgcttcatggtgctcgatagtttgtttcgttgcattttctgtcaactatcggttgtgttcaatactttcttgtaggacatgtcattttcatgttaaaaattttgaattcaaatttgaatcatggtgtttaaaattgtaattttcaatatggttgaatttcatgtgctagaattatttgtgtttaaattattgtgatgttaaagtagacacaaacatacaatttatactaaaataaaagagaaaaagaaataggggctaaaatatgagagctactgctagagttaatgatatttttagtgtcctaaagaattagtggcagcccccatttgatctttagggctctaaagtaggggctgctgctggagatgtcattttgctacaagcacgctgatcagatcacacctgcgatgacgtcggcgaggtacgtcctgaacctccccatgtgctccggcggcagagcaatgcccacctcgatgccgccggagccgccacggccctccgccaccgacatcgcgccggtcttcgccacggacgcgatctccaccttcgctggcgtcccgaacccgaagtcgacgtcgtacacgcggaacctcggcgacccagccaccgagaacggcgcgccgtcccttctggcctcgacgatgcgctctgggtacctctcccagtatccggtctcgccgtgcaccgcctcgtcgatggcggcggccaccgcggagcacgccgtgaagacgccgtcggtcacggtggcggtggccgccgccttcctgggcatcgaggcgtagcacgggccgacgcagttgccgaagtacctgcttgggacgcggccctccatccgccgccggtggtcggtgacgaagaggaagtaggcgcggccgccgccgtcgtcgtggccgccgtcgttgttgtggccatgtgtagctcggaggtggcacagccacatgacgccgtacgtcgcgacgatggacgtgcaccgaggcggcgggacgacgccgcggcgtgccgcctcgccggcgacggcgtccttgatgctctgcagctgcgctgacgacagcgcgtacgtggcgacgagcctgtccatggcgtcgggcgaatcgaaccctttctgagccctgggcgcggcgaacaagtcgtggatgtccttgcggtcaacaatgaagctgtggtccatgactggtggctccggcgggacatttccggcggcggcgcaggcggaagccgcccaggtgtggaggaagtgcgtcgagctcgcgccgtcgcaggcggcgtggtgcacggtgacgccgagggcgagaacgcgcggcgccgccggccgcaggcccaacaacacggtggcctgcacggcgagcaccgcgccgccccgcgggagcgccggcactagcggcgcaatcgtggcaacttccctgggatcgtccgtggcaagctcgtcgacgccggcgccgtcgtgctcggcgacggtgaaggcgaccgcgtcgccgggctggtagaacagctcgtaccggtcggtcttcccgggcgcgaggcggatgcggccggcgagcgggtagaaggcgcggagcgcgcgggacaaggagtcggcgaggtggaacagggcgccgtggacggcggcgccgggggcaaggcggtagaggaagagtcgctcgacgggctcgacgggcttgagcggcagagcacgttcggagagcgcgtcggcgtcatcgccggtcgacgacggcgtgacgtgctcggttcggaggacgcggaggcggccgccgtgatcgtgaggtggcgctgccattgccgcctcgtagcttgtagctaattaagcaatgtgcgagagaggccgatcagaggacgaatgctctcgtcggatgatcagaggcgcgtcgccacagcgtgacagcgggcacgctgctcggctcttcgactagtagtacttatagagttaacgccgatcattatgccgaaatgttacctacggcaatctaccggatgaacgtccacccggttttccatgtaaactactaaatgattattaaaaatatattaatatgaaatgtatcactcaacaaaattaataaaattaatatgtcagttcaaattcgacttcaagttataacaaaaataacatattaaactctaactagtacttatcgaaactgaagttgaactggtatatttatgaagtgttatatttcatattaatctatcttgttatttttctaaaacatttttctataaccatttaagtggcatgtaataaacggggtagatattcacccggtatccaccctagtggttgaaaagtttccctaccataccaacggcccatggttgtcaatgtttttttttaactcaacttgattttgctgccccatcacttatttaaaaatttttataattgattatgaccataaattacttctgatgattatattatgagtgatgaaaaatggatgctcatattcatgaagcttttacagacatcaataatatagcatatctataacatatttctaagtgtttatagttttctttagaaaaaaaagccaggcaatcaaagtctaaactagattagtgtccacgttaattttattcgagaatggaggaagtatatatcttgtagtaactccgtcccaaaatataagaatctattactagatgaaacattttatagtacgaaaacgtctcattcagttttaggtttttacattttgggacggatggagtaactaattactccctctgtttctaaatatctgataccattgactttatagtacatgtttgaccattcatcttattcaaaaacttttgtgaaatatgtaaaactatacatatacataaaagtttatttaacaataaatcaaatgataggaaaagaattcataattatttaaattattttgaataaaacaaacggccaaatatgtttagaaaagtcaatggcgtcaaatatttaaaaacggagggagtagtctttaatacaatttgaatacgatgtcttttctatacttattgagagcggaaaatgtgataattagcaaattgtaacacatactcatcttctaactttaatgttctaatttaccgacttgaaattggcacttctttctaagattatatatggatgatagattttgtgtagatcattaatttgtgttttttattctaagattatatatggatgatagattttgtgtagatcattaatttgtgttttcaaaaaacttttacatcagttttgtgtagatatttaattttgtaccatactttttcttgacatcatctctactattataaaaattaaagatgtttttgcctgtattttggtacgtcattcgtatttgagtcggtttttaagtttgtttgtttttggaaatacatatccttgtttgagtcgattttaaattcgttttcttttggaaatataaaaagaagtcgtataagaaatatctttaaaaaaactcgcatgctaacatgagaagaaagtcggactcctaattacagttcattattttcttaaaaaaatatccaagcaaattcccaaagtgaatttcatcctagctaaaccgtataaaactagcatcacccgttgcaatgcacgggcatttttctagcaatatacaatatttgattcttcactgtaaacaattgtcgatattatataatttgattcttcacttttattttggtcattttgctatatgactttgtttcaataatttgaatttgaatttcaaattatgacaacttcaaacaacatttataaatactaaatgatttcaactgaaaaattcatcaactacaaagttgtataactcatcaatatctataacttttattttgataatttcttcatccgacaaaatgacagtaacattgttcacaaaaaattacatctctctcttgtagtttataaactatataagagatatgtacattttgtgaacaatgttaaaaataactttctcggatgaagaaatgacccaaataaaagttatagatcttgatgagttataccactttgttattaatgacttttcagttgaaatcatttagtatttgaaaatgttgtttgaggttgtcatattttcaaattcaaattgaaactgttcaaaaaaatgttatatagaaaaataaccaaaataaaagttatagatcttgatgagttatacaactttgttgttgatgaatttttcagttgaaatcatttagtatttgaaaacattgtttgaagttgtcataatttgaaattcaaattcaaattattgaaccaaagtcatatagcaaaatgaccaaaacaaaagttgtagatcttgataagttatacaactttgttatgggtaatttttttcatttgaaatcatttactacccgaaaaactattttaattgtgaggaaggaggcaaaatagacatctcggcgagagaggaacaaaagggctgggccggcggcccaaagagggagaagaagggagagagaggctactggctgagggagggagagagaaacagctgaaaaaggatgagaggaattttaatttgttttttatttattttaataagttaaataaactttgtggtattaaaattagttactgagcaccaaaaattcatgaaaaattttagagaattatttagaccacgtagaatataaaaaatatttccggccatgatttttaacggaaagttttagttttctcattaattcacttgattaaattgttttaacttttaatatatttttttagaaatgcattatataaatttatgacgtttgctttgtgcccgttatgacaaattaatattcgtcgcgatgtcccattgaaatactttatgacgatttctagttggtattaacaacgaacacctttttttgtcactaagccacccatctcatactaatcgtcataaaataaaatgtgctagtgacgaatagctccgactttacaaggaattcgtcacagaagatcatatttctcgtagtgtccaattatcgggccatatcattacagtttggctgattatggatctgtgcttctccgacctaaacaatgctgctgcccacccgatgagacagaactacggctaataaaccgctttcgtggaaccgatgatggtcggttcgaggaaaccgatcagttttagctagttttcgtgcagcgatgacaaaaagctacagttttttttatcggttttaattatgttttgagaaatcggtaaggagcggtttttaatttcaaaacaaaaagctaaaacaatgaacgaaacacgagcacctgccctatatcctccgatgagctaaagctcaaaagcttccagcaatggaagtcgcatctcagccatcacctcccccaacacaaagttgcatagacacttccaccaccttgacaatgagccaaccgtcgtaacacaatgggatcaagctgcttaggacatgtacaatacaccaagagtgcttagaaagatcgatacttagaaaaaaccgtctcaaagttaagaaccacaatctccaataataaaaaagcgtattatggagatgggcgtagaccgaggtgacaacgctagattgcgtagactgaggtggcagcacgagatgtgcttgcgagctcaatagatctcgccaaacatggggtgatggcaacagagatggagctcggcgatgttggcatcggctcaaccaatactgccttagcgttgacgaagcacccatatcctccatagggcacgaggggctcaacgagatattgagctcaatcgagctggagccgacgcaccgatatggtgaataagactctggctcgccacgttggttcactacaaatattgttactacccgatttgtttcatctgtttagtttttatttatttatttgttccattctcatattatcttattttcttataattttatgcattgtttttatttctttgttttaccaatcagggcaatagtatacatggacatcgcatgttttatctgttattcaaacaattaatcataaaataattataataaatgaaaactcgatagagatatcgttgtacaaatatataggttaaaattaattcaatttaacacggttaaaaatgaaaaacgtacccatagttgaggtgtgcaggagttggacatctggctctttcacaggtgaagtaataacgagcatgcaggactctcttcagggcgattgatatgtacagggagatagtaggttcaactggtacgaatagtaggttcaactggtatgaatagtttccgtccgtccagaccattttttatttcggataggttcggtcggaactattcgaaaattctcggatttagaaacgattggattttttttctcagaaacgaaatgaatacagtaagattactatccatcggaatcggaaaatgatcagaattaactatccggaatatccacagacatggatcaaattttagagaaaacacgtatatatacataacttttttatatggagtcggatgaagacaaacttttataaaaaatgtagagctcagtgagatctacaactttcttgttgactattttattatataagatcatttaagggtctaaatattcattataaaataccatatatgtttttacaaaatctcagatctacaattcaaacgacatctgatggagacgtattccatatcaaagttgtagagcttaatggaatttaccactttatagtttataacctttgtatttgaaaatgtttaaagtataaaacaaacactctaagttttgaagatgtgaaataaaataaaaaaagacatctccaatttatacaacaagaacttgttaagttgtttagtgaaatggtaagtaagctatacatgtagtaaaatgtcttgggatgaggggaacagtcatgaaaatcgattttcacatccttttgtaggaccgcctacaaaattgatgatataaatgttggagacgttgttctaaaagaaatatgcgatatctcttctctcaaatatccgttgacgtattcgttccgtttcgtattcgctccgtatctgtattcgataataatcatttcatttccatatccgggttttcgattcagattaaaaaaataaaaacgaatatgataaagctagttttcatccgtttccgatccattttnnnnnnnnnnnnnnnnnnnnngggaaatgtcatctctggtgctctttctatcaaccaccattttcttttatcacgtgccgcgcatagaaagagggtagtatgtgttgacgaaaaaatggaacacaccggtctgggagatctgcttaactccagtgcaggtccaaaggttggtgagatgcggacgtgcctgtcagtttgatcctgcaactgacaagatatgcaaatagtagatcaaacagccgatcggctgactgttgacgaaaaaatcgaacacactggcctgggagatctgcttaactcctgtgcaggtccaaatcttaatgagatgcgggcgtgccagtcaggttgatcctgcaactgacaagatatgcaaatagtagatcaaaatagccgatcgactaacaagccgatggagtagttccagccgatagccgataatagccgatgccgataccagccgatagcgatagggtttaagcaatcggctatatgtccaatgtagataatgatataatggcaatcggctgatgatgatgtaataaaataacaatataatccagtataaaccgatcggcaaataatgatatgataaataagcatcgatccgaaggttaacgcacatatcggctggaggtccgacatcatgaaatccacaagattagattaaacagtgaaacctttgttgtcatcggctaaatccaacttatatgtatttataatccttatgagtcgatgcaacgtccagataactcaccggctgaaaccccgatgaaacctttattggcaatcaagaagcaggctagagattatggttctaagcacgacttagtagatcaaacttaactgatacagcactaagtatgaaaagaaacataatatctagacaatcaagccgttgactgagtttgcagggtgatagatgtctaagctaatctaatctagcaacgcaatttagccgataacggcagaaaccctaaaacgagaagcagacgatagagctaaattgatatgctaagactagattaacagagacatatgataaataggtaggcaaatatatcatccaaaccagagcaatccaagaggtcgaatgtactgatgcggccttgaatgacgccgacgtaaacgatacaattgcctgggccggcgaaacattagacttaccccttagcgggagatcgaacactgatgcagccccgcgtcaggtgccaagtcccgccggacgataaaataaagtagaaaaggtaaaaggtggcgatgcgccgaattgtattgatcgtgaggatagattacataaaccctggctgtatatatttttacctatgggttgatacaagtccttgtcggacaagaaagaaactttcctaaagataaaaggaaaagataaagtccttacaggacactaaacacactttcctaaagataaaaggaaactaacaaactattcctaattaatagataatttgccatgccatattctctttaaactcggtctcttatagataagctttctttagtagatcaatttccttaaccgaatatagcaagaatccgacaactgacgacttgacaactctcatcggctaatctcaggacttcgaagccgatgctgactctaagccgatgactactccgggcttaccaaatttaactgttaacattgacaagccgataaagtagttccagccgacagccgataattgccgatgctgatactagccgatagcgatagggtttaagcaatcggctatatgtccaatgtagataatgatataaaggcaatcggttgatgatgataagtaataatatagcaatataatccagtataaaccaatcggctagcaatatgatatagtagaacaagtattgattcgaaggttaaagcacacatcggctggaggtccgatgtcatgaaatcaacaagattagattaaacagtgaaacctttgttgtcatcggctaaatccaacttatatgtatttataatccttatgagtcgatgcaacgtccagataactcaccggttgaaaccccgataaaacccttattggtaatcaagaagcaggctagagattatggttctaagcactacttagtagatcaaacttaactgatgcagcactaagtatgaaaagaaatataatatctagaaaatcaagccgttgacttagttttcagggtggtagatgtctaagctaatctaatctagcaatacgatttagccgatactggcagaaaccctaaaacgagaagcaaccaatagagctaaattgatatgctaagactagattaacagagacatatgataaataggtagacaaatatatcatccaaaccggagcaatccaagaggtcgaatgtactgatgcagccttgaacgacgccgacgtaaacgatacaatcgactgggccgacggaacgtagcacttaccccttcgccggagatcgaaagccgatgcagccccgcgtcaggttccaggttctgtcggatgataagtaaaaacctcggtaaagagggtggcgatgcaccgagagtagttgtattcatcgatagattgatagattataatgacctcgggtgtacatatttatacccacagggagatactagtccttgtcggacaagaaagaaactaaagataaaaggaaaagataaagtcctcatcggacactaaacacactttcctaaagataaaagaaaactaataaactattcctaattaatagataacttgccatgccgtatccttcttgaactcggactcttctggataaattccctttagttgatccgactccattgaggacacggttgctggcgatttaacgactcccatcggctgattctataactctgaagccgatactgactctaagccgatgatgactttagtcttatcaaatttcgtcgttaacagtatgtactctcctttttcttccgcagggccagcggaaggatgacaccggccgaaggcagaaagaaagagagtacgaagaggggtacatgacaacatgacggccagagcttgacagtacaaaagaagaacaagtccgcaggttggttttggagctcgcatcatcgaatcggtagtacaatattgcagcaaagctttcaggtacgaattaaatggtcatcccacgtgtttttacttgaaattgatgtacaatcaagtaaggtcctgtttagttctaaagtttttttccaaacttccaacttttcatcacatcagacctttcatacacaccaaacttttctatcacatcataccaatttcaaccaaagttccaaacttcagtgtgaactaaacacaatgctaacagaatctgcataactgacattacacagtgcattaatttcagcttcatgtcaatatcaaaagcgattttttgtaggcaccctgtaccgcacatcacaacaggcatagtacgtaatggcacccacttgtaccggttttgctaattggcgcgcgcacgccagatccgtatctggcgcgcgtgcccctccacccgccacgtgtccttttccttttagcgattttttttccgcattgctttttttttgcgcgattttttcctttttctttggcgcgacttttttctcttttttttggcgcgattttttccctattgggctccctcccctcggtgtatttttcatctttttggtatactttttgattttttttaaatttgaaagttttaaaatctgagttgaaagttttcaaatctcgagttgaaagttttcaattctcgagttgaaagttttcaaatttgagttgaaagtttttaaatctcgagttgaaagttttcaaaaattttcttgcaaattgaaaattttcaaagtctgagttgaaagttttcaaaatttgagatcaaagtttaaattttaagtcaaaagttttcaaatgtaactcaaattttttcaatctattagtaaaaaagttatcctaagaaaataaaaaatctattcttaattacagtcattatccttgactaacagagttagttatggtaccgcgtccttccaagaacgtgctccgcgtgcgcgctagttctgctcgcggcgcgtacgcgcgtactaggaacgccccgcttgtataggaacgccccgcttgtacagtacatcagggtaggcgtaagggaccatatgtggaaaccaattttcacatgtaacatatgaaaatgcccccatttacacagtcttaagtgatctccttacgaaatgtttgatttttcaaagcagtcgcttaagatatatagccgcttatgaaaatgatgatatttatgtaatcaagcatattaaactgaccgccttagagaatgtgtttatcgagatggcgctcttaactgtctgtatatgtcctgtcttttcatctacttcgcgaccttcaacaatcatgcctaatcagtgtgtgcttatgcatcatcactgcatttcttggtttcaaagcccaagaaaccaggaagaatctcaagagaaaactaaactaattaaacaagaaactgattaacttgtcatcagacagacagagcgctgctcgctgaaattaaatcaatagtattaagagggggacagtggcagaggccgtatctaccccgggacggcctgcgtcgggaaaggagcacctcctcctcctcatcggcgtcgagcagtcgcccggacagcgaccggaccagaccggaccagggcgccgcggaggcagcaagggaagggaggagagagagggcgcgccgccgtgcgcgccttgccggctggccaccgccgctcactgcagcaggggagggaggagagagaggggatagtggatttaggaagagagagtagagagagattgagaggatagaggggaaagagaggagagtcttataggtggggcccacactactttttttaaaaaaattttgctgactgtactcacgtagaactgaaactaccccgaattaagccggaggttatttgtccgattgtatagttaagggtgtaaaatatccggtattcgagtttagggagttaattcaatcgcccatgatagttcaagggtgtaattcgtaccttttcctagcaaaacacacaacgtttaaccatttgaaaagcgtacgtgcggaacacgatggagaggagttggaaccaaggatttaaatctccggctatagctgccgctattgccggagatagccgctgggagaagcaaccactaagatatgtccaatttggcgctacacattctatggcgctattagctgctcttagctggctatagctgctaaatgggcccttaaatagcggcagctaacttggtgggctgagagcctaaaactaaacaatggggcatatagaaacaattcaaccctaactctatcactctttcacagtcactctgtcgctcaccctctcccctcgaaaaacaggcacagcggctgtgcctggaggcgacggcggcggctgcaacctgcagcagcgacggcgatgaaaacagcagcggctgtgacctgcagctccacatggaggccgcaacggtggcgcccggaggcggcggctgtgcgtatgccagcaccaagcatctgcggcggctgtgatgggtggtagctgcaccaatccctccctccccactcttctctattctccctcaagctgctacggaggcagttgtgccgaagacagtgagggctgctgggcagcacaaatcctctccctattcttcgctagtttttctttttcctaacaagagacgtgcaagatttttttgctatgattctctgatattgaatgtggtattgaactattcaatgtaatatcaagtgtcttggctctttaaactgtacaagaattgcaaaatttatgttagtttttgtaaaaccgctaatgagcttagctgcagcaatagccagctatagctggttgttgacagttcgatcagtttcgaccgtcaatattactaaaataggggagaactagtgatgcttgcaatgcataaatatgttagaataataatattccactagtattaggtatacttaccttttgcagagaatgacaataaagtggaggagaatcaacatcaactcagatgataaatcaatcggatgatgtcgagaaccagacttatgtatgaatgggccaagaactcagaaataacacgacacattgggccaaaattcacaagtctacggaggaggacaacaaaggaggccgccagccgaagatgggttggggccgaacccaccgcagctccgtttgatccagggttctcctggacggctgagattgctccccaatgacggttggagggtattaccgactattccaaccgttacaaccgtcattgggaggctataaaaggagcaatcatcctcacttcactcacacacctcaagcaatagctctctcatttatctcaagtttagtttagtagtatctagctggtggaataggaacatagtagaaatcaggagtccggaagccttcggaagagtttgggtatggctctagtagcttttctcttctcttttgtaagccaagccttgtacttttagtagaatactcttctaaatacatttatggtattgaaatacattccgagtatatgagtacctactttacattatgttcatcttatactgaatatacggctagcttatctgggagatgctttggtgcgggtataatgtttgcctatgcaattactctatgtcatgacgatgatattagagtagtatctggtagtttagacgtggtgtctagattacgggatatcattatttggggttatatattgcgaatgagaggtgggctgctgatagtgacagctcagtacgggtattcctccgcgccggtatataatcctaagttaattccctagggaggatactcctccgtatttagccccggttgtatggtcatgacgggctgtcgtaaggaactcggcagtcaggagtggcttctcgaagtaccaggagggcatcggatagagggtattagttagtatatcggttaactagaatgtatgtatactatgtatattagaaatataggaatagattttcttttcttttctttccacttagcttaggtgatatattatgagaatgagtagttaatgcttgtgtgtcactctacccttggattatcttaacccctgcttagaatatgattatcacaagtaatatataaattattagtcaagttctctctacatgatctttccacgggataaaataaatacgatacccttggaatactctcgggtgaaacactacaatggtatatctgtgggcttgcggatgaactctgtaaccataatatatcagaagtacttttgcgccattgctgggaattatatttctagtaatgtcgttaagaaatacgaacaagcatttctggcgccgttgccggaggagattcataatagagactacttgaactaatattttatatttgcctctgtataatcattttcctttgcaggctaaccttggttgttttcacttttgttgtgaaaacagggtagtgcatgactggtttcaacttgccgaaaaacttcaaagaaaatccagaagctttctttcggagcattaggccgtgagtcgctgctccgcagaaaactctaccgatagataaaccagccgtaccaacgccaccgaccttcaagactatggctaataagactctccgcgagttcgctgctccctctgctgacaatgtggccattgggccgcaggtcaacataggggacgtggatttcgacttgaagtccagcctcatcacgattgcgcaggcaaacccgttctgtggtgagcctaatgaggggtccaatgctgatctgcaacagttcctggagatctgtagcacgtacaacatcaagggcgtcaatcccgacaccgtcaggctgcgactgtttccgttctcccttctcgggagagcgaagcagtggttctatgtgatgaggacatcaacaccaacgatacatccacacttccacaattacaacttcatggtcctattacccacgctcgtgcatgtcaactcaactatcaggaacaatggagaggatcaaacggggagaggattcgcgcgggatggattcggactacagcatagcacaaacttctgacggccgccacgacttcctgcgaactccgatttgggcttgtaagtacttcatggaaagcttgtcaagtctactttcaaatgaatccagcctcatgtccatatcagttctgggcagccacaatcttcattttactaccgagtccttttctgtccacggtgccgcgtcacctctttgggcccaatgggcagtgtattaagttgggtccattagggacacgtcgtagggtgagagaacgaccccagcactcctgtggtcgtcctcttcctcttcttatagctttctccgccgccaagaataatcgggttttgtttagatcaaagtatagcgtcgctactttgccgagttgatcccgtgatcgattagattgccggattgcttgttattgaaccccacttgttacttctattgattcaatccaacatctttgattcgcaaatttagttgcttgttcatcttgttcttgctggttctcgattgcttgcaggaacaaataccctcgtagttgggctgatcgtgcatccgtcgagattcacgaccacctctggagttggggtaacgattgctaaggcgcaacatccccggatagttgtagtcggatcgccaacgtcactccatccaatcgacttatccctctcatcgaaagatcgagacaccctcgagcacatcaggtggtatcagagcccaagttgctcggtgagagatttcgtaattttcttattcctacagtccagaaaaagccaaaaaaaatattagattagttttctatgatcctactagtactgcttagttagggcttgttgagttttcgattgcatcggttgtgttaatttgttggttttagtgtttagtcgattagagtttcgagttctggccaccgcacatcgccatttttttctttcatcaccaccatctcagccatcaccacttctgttgtcgtcgggatctacgaaaacggaaccgcctcgctgccacggttctattttagtagattttagaagtttttatcggttggttttggagttgtcaagttgcatataaggtttgccgagttggccgtgtttctgtttcggctgtgcttgtgtctgttgcgcgaggaagaagagagaaaggggatactagatcggtttttggatggagtcttacaatttgtagattggtttctatttgggcgccatgcagaagagataaaaaggaatcgatttccttctttcattttttttaaccgagtcccacccccttgcgtcggtttccatccccctctcccaagtccgactccccctctcgtatctcggtttgaatctataccgtgagttagctacataccttggtgaattttcgtttggtgtcggtttcaagatctgtttggaaaaacggaactggtgtaaatttagcattccatttttgtatagttttattttttggttcggacttttacacttgagtccctgtattttttatatttacattggagtccctataatcttacattgaggtccttgagttgtttttgctaaagaaaatacaaaagagtgagaaacggcagaaaggtgcaaaaaaaagagaaaaaaaagccgcaccgaaaaaaaagagaaagaaaaaagaagaaagaaagaaaagagatgagaagctgacttgtgtgtgagtacaccccccccccaaaattcagtgttgtcaccaccatcttcctatcatcgctcatgtttggtttgtgtattgtggcgtcctttgtggttaggctcgtgtctctacttcggctagcctaggaccagcattgtaccaaccttgagagattattcaacttgctttgactaacgtggtttctagtttttctttgactcattacacagcccacccatagctccaccggttcgactaacacttgacagggattcagctaccaaggcatcaatacaccttctccagaggttcgtccaagtccgacggttgccatcacctcctgtttggcatgatgagaattggtaagagcttgtggaacaggttgagagtgagtgacttgatagatagaaccacatccaactagttttgtaggattttttcttcttcttcttcctttttcatttgctgctccatagtatttgttttgtctgtttattttgtttctaaccatgtcaggtgttgagcattccaacccccactcaccccgcacaaaaggaattatttagcattttgacaggttagtgagggaccgcacacaagggctcgaggaggatgtttgtatcaccaatgaaaagcttggtcatgttgaacgcacgcaaattgattccaacaccaagcttaccaccttggaagcttctgttgcgacggtgaacaccagtcttgatggtattgtgtggcgtcttgatgagatggcccgagcatcccaccatggtagtgagatggatgaccatgactacgttggtgattctgaggatgatgcggaccagcgacgacatcgcttcaatcgccgtggtgtggctcatcgtcggccacgccgtgaggtacgaaataatgatgattcatttggtaagattaaattcactattcctgcttttgatggtaagtatgaccctgatgcctatctttcatgggagttagtagtagatcaaaagtttgcttgccatgatgttcctgaggataagagggttagggctgccaccagtgaatttactgattttgcttctgtttggtggtgtgaataccgtcgtactcatataaatgctttgccacctacttgggatgatttgaaacaaattatgcgtgctagatttgtaccttcatattatgcacgtgacatgttaaataagctgcagcaattgaaacatggtggtactagtgtggaagaatattaccaagcgctgcaaatgggtatgttacgttgtaggttagtagaggacgaggaggctgccatggctcgatttttggggggcttagatcgggaaatttatgatattctcagttacaaagagtataataatatgactcggttatttcactatgcctgtaaagctgaatgggaagtgcagggatgacgtgcacaaacaagggctaacattcctgcaggtagaactccatggacggctcggagtggcgctgcccccaccgatcgttcatcagtttcgacatcgacatctgcaccctccaacagcaacagcaacaaagcgtggccaacaccttctacggcccgctctcgtgcttcagaggttgcagaaaagcccaccaagagtgcctcctctgttgcttccacgggtagaacaagagatgttcagtgccaccgatgcaagggctttaggcacatgcaacgtgactgccctagcaagcatgttttggtagtcaaggctgatggtgagtactcgtctgctagtgatttcgatgaagatacacttacattgcttgtagctaacaacatagctagcgaggatgagaaacacatcggggctgatgtagcggaccaatatgagagccttattgtgcaacgtgtcttgagtgcacaaatgggcaaagcggagcagaaccagcggcataacctttttcagacgaagtgtgtcgtccacaagcgttcctggtgcacaatcatcgatggggccaccgggactaaaaatctgggggtatatatattcccggtgctccctcgtcttctccaccaacacttagacgtttttccatcgagatcgatctcggcttctccttcgccaccactgcctagggcaaccccgcgccgacgccgccgtcgtctctcgccgtcgcttggcggtcctcgccgcctccgccacagacgccgccgccacatctcttgggtgagagccgccgctgcctctctctctctctcgatctcgatctctctctccaaacctccgccgcctagctcgttgccgacgccactactacgccgcggtcaaacgccaccgccgacgaccgactttgacgccgccgcccccgcctcgagctcgccacgccgccgcgccacgccgccgggctgctacgccatgccgccgcgacgccacgccgccgccgggcccccacgctaccgccgcggcacgccgccgccgggccggcccacggcaccccgacgccgccgccgcgccgccacgccactgccgcgcgcgcccaacattgccgaacgtgattgaaacgtgaccgaacgcgaacgaatgtgaacgatacgtggacgactgtgaacgaacgcttaacgaacgtgaacgaatgcaaacgaacgtgaacgaaacgttaacgaacgcgaacgagcgtgaacgaaatgcttacgaacgtgaacgaaacgcttatgaacgaacgtgaataaaacgcttacgaacgtgaatgaaacgcttacgaacgcgaatgagcgtgaacgaaacgcttacgaaacgcgaacgaacgtgaacgaaacgcttacgaacgtgaatgcacttgtactaaaagtgtgagaacgaacgcgtttagactaatacattttcctggtaatacatatatgattatatatatgtaacttggcccgtttagactaatacattttcctggtaatgttgcagagaagacgttgtcatcgtccgtcaagccgaagtggtagctagccatcgaaggaattcgcgcaggcaagtgatgcaaagaagtgattgttagagatttaatataagattgttagacttagcatatatgattattacaattttaatataagatttgtagcgatttaatataagtttgttagacttagcatatttgattattacatttttaatataagattagtagcgatttaatataagattgttagagatttaatataagattgttagacttagcatatatatatgattattacaattttaatataagattagtagcgatttaatatgagattagtagagatttaatataagattagtagcgatttaatataagattgttatacttagcatatatatatatatgattattacaattttaatataagattattagagatttaatataagattgttagactaagcatatatatatgattattacaattttaatataagattattagagatttaatataagattagtagagttttaatattacggttagcaaatatgacctatagatctaacaaatattttttgtatgcacacatggctgatcgcgatgaggaacagatactatacgatacaaacgcagagggaagcagccagtactggaacgaagaagaggggaacgaggatccaaaccagtacttgaacgaggaggggaacgtggagagcgatgcggaggggaacgaggagggaaacgatgaggaggagtctactggaagtcatccctctgctggacagaagagggcacacggacaacgaggtgccgcaaagaagatagagggtcggcacatcgtaactgaggtggacgaagacggccgacctagtgccctagcagaagcagccaagaattttgtacaccacagcagttgggttgtgagggacaacgtgcctgtcagcacggtgtactggcgcagaacaagggcacgcagggataatgacagctttgtcccggactcagaaaaagagatgctgtggaccacaatgctcgagacgttcacgctacccgcaggtacgaagaacatagtgaaacagtggactctgaagaaaatagcagaacagttccagagcttcaagggagatctctacaagaaatacatcttgaagggactaacaccgaacttcgacgtattccaaaagctaagggatcattgggacgagttcgttgcttacaagacagggcaacaagggcaagcgatgatggccagaaacaaagaaaatgccgccaagaagaagtaccatcaccacttggggtcaggcggatatagcgtcgcaatgccgaagtgggaggagatggaggcaagtttgattgagaggggtatcgaaccggccaccgctaaatggccggatcgatcgaagttctggtactatgctcacggtggaacgcttaagccagttgatggctcccttgtcttcagtgatcagatacgcgacgctgccagtcgactaacggacgcggtggaagcctcttctcagggcacattccgacccgacagagagaaggaagagctgtcactcgccctacagattcccgagcatccaggacgaacacgagggaaaggcgtgattccgtggaagattggatttaaggaggacatccacacgtataggagtcggatgaggagcaagagagataccgaggcgaagattgcagatcttgagtacagggtatcgagctacgagctcagcatgcaagagaagatggcaaggaaggtggatgaacgtatggccgcacatcggtcccaggatcccagtcgtacattcctcctgcaatggtcagcccatcaggcaatcgtagcagctgcgcctcaacggggtaggtaggatcacagagcatggacgccatgcaaacccaggacgaaaccacctgccccgttgatgagatcacgcagcggacaccatgtgagctgcatattcccttcaagaacttatcaatcaaggtatgctcatagtttgatgatttttgacttgtacattccacaagttgctgcttaggttgattactaatagataacctctcatcacatgaaggtggcgtcgggaatggccatcccaacggacccttccgggacttaccactgcaggccgattccagcaggatactcgagggtcgaagttgagctggtagaagccgcgtacaaggacctcgagttggactacccaggaggagacggtgagacgcatctacgagacacaagacacgccattatactatggtgcaagcggtacatcatcctccctgggcgacaagcggcatctcatgcaccatctcctctggctccgccatctcctcctgcaccatctcctccggttcctccgccacgtcctcctgcaccatctcctccggctcctctgcctcctccgcctcctccacctccaccgtgtctgcctgcaccacccaagacaaggtctcgccaagctccaccgcctgcccgcacaagggcaacgaagaaggcgaaagttgatgccaccaaaaacaaggagccaccgtacgattgtagtcaagaggagcttgatgcttatgtggcaggagaagtgaagaggcaacttgagcctcggagtcctgaaaagaagatacctattgacccgagcgtgaagaactacttcaagggaatgtccgcaacaaacaaggaggccttatagatatcggactatgactgaacacttcagagagcctatcacaagaagtctaaaccagtccctcagcttggagaacaaccaaaccaagaggtcgagccgttggtgaccggcgaagattttggcataacggaattcatttcagacaccggtctaactgtggatcagctgattcgaggcgcaccaatcctgaaggcggaagtggcatacaagtttgaactcggtaaaccgcttgtcaagcctgagcagctgcagtccctaccgacatagatgtacaaattccatgaatggtacatggaaatgagcgccaagggtagagagatgttcggagcgaggatcagaaaccccgacttcttgcaaggagaagatattctctggatccatttcaaggatctcttcgatctgtaccatctggacgccctcgacgtctctcttctgagcgcatggattttgtgagtatctttgagttcgatttgtttcgttcaataattagctcctggcatatatataagcaataataatttcctttcatcgttgtagaatggagattcaaagggcccgacggcggagggtctacgatactgggttcatcgaccctcggaaaatcaacaccaaaatgatcgacaagtaagagaaagacacagaggacaatctcgtccatctcctaacatagcagcatttcaagacgtacatactactgccgtacaacacagagtgagtttttattgtcgttcgaacaaatttcgttcccatacatatagcatgtacattttcatatatatctcatctcatgcatattccagattccactgggtcctgtcattcttcgacttggacgcatgcaaagtcactgtgtacaactcaatgaataaagaggagaagatttttgacaaggtcttccaactgatagacaggtaatataatgccatctattccaaagtcgcggggaatctattgctattatgttgatctcgggtaataattaattaatcatagcttgcaactgcatatgtagggcttgggatcggttccgtcagttggtccgcgggacttagaaagaaaaacttggaaggaggtttcattttccagtgagtacatgcatgatccaaaattatattgaattgaatctctaattacagttaatataaagagtatattaaatctctcatcgtttctcatgtagtgtgcaaagcaggaccagggaactaacttatgcggctactacgtatgcgagtatgcgagtatgcccactgcctatcaaaccaaatatgcacaacacgagagctcgatgtacgtatacataaaccattcaaaatttcattgcgtatcgatttgttaagttgtttattaatttcatatattgatacgtcattattttttcgaatgatagcatattcacatgagggataatctcccacacaaggtttttatcatggctgttcaagaacaactgatgggattcatcaacgaagaagtccttaattccgatggtgaattctactacgacggatcgacaattcataacgtcggtccttcctcttctgacataacgccggcgtcgaagtggtagctatagctactgagcaaatgaattgtactatatatgcatgtatatatatatttatatatgtacacatttactttagtgttaatatatattttggtaacatatatgcacataaaatgttaagtgctttaaattatacatatgtgtgtaatatatgatttatacatatacacatatgcatatatatacatatatatatatatataatcaaccatgcagcaaacagggccatgcaaataaaaaaagtggtgcaccgatctttagtcccggttggtaacacaaccgggactaaagatggttcggccgaccacgtggctgaccgatctttagtcccagttggtaacacgaaccgggactaaagatcgatctttagtcccagttatttcacccgggactaaagatagctatctttagtcccggattcgtagtcccggtttgacaaccgggactacaaacggtttctccaccagtgccatcgtgagccactctgacggtctaaggccatctacaatgggtacccctaggtcgtgtccctagcaccctccatcaatttttccgtctgcgtcgttccctcgctagtccgcgcacaccctagctaggggtcgcgcctctcgcagctttttagccagggacgaagacgagcaacgcattgcagcgaccggttcctatggccaccgtgtctccagcgatagattccccttccacccctctcctctctctctttctctctctcgcccgttcccctctcttgggccctccgccgccacagcaaccgcccgagcagtggcgaggagcgggaggaggcgacggcaagagcggcggcgaggagcgggagtaggcggcggaggtcgagctcggcgtcgtcgacgggctaaggagcaacggaggaggcggaggatggcggaggtcaagctcggcgccgtcgacgggcttgaggtgcccgtgctcgcggccgagcagcacgaggacgacgtcgtggtggtggtcgtcacgctcggggatggcggcgacgagatccggccaccgcgcgccttgcccggcctcctccaccggtgccgtgctcgccaccgccgtccgccacctcgcactcgcagtccgccgcctcacgctcgccgtccgtcgcctcgagctcgcctcgcgctcgccgtccaccgcctcaatgcggcgcggccggcggcgctccatccaccggggggccagatccggccacggcagcgccggatctgccgcctccggggtcgccgccaccaccatcacgggagagagagagggagagagcggcgggagagagagtggcgacggcactctcacgtgcgtgcgatggagaaagagagagagagaaggggaagagaggggtagaataggaaagagaggaataggagagaaagaggcttttttgggttggggctacccagagtcctagacgtggcctgcattgtaaaggtgagtacgcctagagtacctcagttagtgagggtactctaggagtgtctcagattgtggatgccctaaccagtaaaatactccttgtttcttctttcttcctgccttggtgagtgccttcggccgtagagcaaagagcgagctctgttctttcttttttttccctcatatctctctccctacgtcatttttttcttaactactactcactcttctcttttcttctgcagttctactgctgctagcgagctctccttgaactcactggttggagggaagctatttccgatcgagctcgtcggttgtcgggggtgagatatgtgttctggtgaggaaaaggaggccagcttctttattttgtgcttggggtgagcgcggtcgccttctttgagcgtggagcatgtgaggatcatgtagcggtgccgtccaaaggctaagtatgcaggtgtttgcccccattcagtgttgtcagctccgacagtgtccatctccggcaagcaaacaggagccgataaactgatcgacttttgaatgtgttctcatgtctctacatgtgttctccatgccggtcagggtttcatgccctgccgctgctgcgcgaaccccgctttaccgttgtctttgctgccgtcagtgtcgccttttgttgttgaaattataagcacataatgatttaatttattccataaataaatcatgacattgcagatgtaaactagattgaacgcatcattagatctacacatgtaaactaagcagtaaaacatgaacagatcaaatatgcgcaacatgttgaacacgtaccgaggtggcggaaagacaggttgcacggcaggaactactcgcggttgcgagcgtcgacgaaggcgcgaagcacacgagcggagaggaaggcgagccgtcgcggacgaacagggagcagtcgcgcgaagcgcttccaaaaaacctcattgccgccttctcccggtgcaggacgtcgaaggcagaggttccgaaaacctgctctcccgatcgccggtgcacgccggcgagcgggatggagtagtctatgagcgacggcgcagtatagagtaggaggcaaaccctagattgattttgcgtgtgttgcgtgaaggcggcggctcggtttatatagagataggtcgcttgatcagggcgcccgcacgatctccactccgcgtaaccgaaccggataagtcgcgcgtaacttatccggactccacgccgttttcacgcaccggattttttggaatgtttccaaaacaaaacaaatctgaatttcccgcagcaaaacaaaactgcaaaagcttatccggactccactccattttcacgcaccggatttttcggaatgtttccaaaacaaaacaaatccgaatttcccgcagcaaaacaaaactgcaaaaggaggttgcatttgcgcaagggtgaggagacaattttgtggaccatttgacgcgtacgtcgtgcacgcgcgtcgcctgtcctgccaggccaggcgaggcgaggcgaggcgaggcgaggcgagcgagcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgatttttcaaagaattaatcttcgaatgggccttagcccatatattaattccaacaatcccccaccaaatctcaaaatcccactaagatttgcctttttccaatgtacagttaatataccagcggttcgatggagaccgattaaggttgaacatccacctagaactccaagctacacttactcacaacttgaacaatggaatacgtcttgaattgcaagtcttgtgcaagaaagtttcactcagagtcttatctggtactagaccgtctgtagactacccctcgggtggagcgtataagtcatactcctaggtctttagtaagctttctagaagattcacccaaaatctccatagactgcgaccaacagtcaagcttacaaatgtgagttctttcaagaatgctctacaggacagcatcttcgctaattaaagccaacagaactcattaaggcatagccaacctgccttgcagctcacgagagtacatgcatcttcatttagagagggtatagatcggtactctcctctagtttactaatggtttgttcttcccaggttctaattcataggatctccgatcacatagactgggataccaccatagtataactcacatgtgtctcaaacccatctccttcgatgcattatctatcacatttcgtgatagtcccttcgtgaagggatctgcaggtttctagctgtttggatgtaatccaacgttataactccagagtttcttaatttcctgacagacttcaatcatcttttcacatgtctagacgatttcatattatccttaaaactattcacttttacaattaccgtttgattgtcacagttcataaggatagccggcaccggtttttcaacaataggcagatccattaatagatcatgcagccattctgcctcaacagtagcagtatccagtgccgtcagttctgcttccatggttgacatcgtcaaaatggtctgtttgcaagacctccacgaaacagcaccaccacccagtgtgaagacatatccactagtggctttgatctcatccacatcagagatccagtcagaatcattataaccctccagtaccgcaggatacccagtatagtgaagccccaattccatagtacctttcagatagcgcattactcgctcaagcgcacgccagtgatcatctcctggattagaggtaaaccggctcaacttgctcacaacaaaggagataacatgcctagttgcactagccaggtacatcagcgagccaatgatttgggagtattccagttgattcctagcaatttttttgttcttacgaagcaacaagctaggatcataaggtgttggagaaggcttactatcaatatagccaaagcgattcaagatcttctccacataatgggactgcaagagtgtaatcccattctcacctctaattagcttaatgtttaagataacatcagctactcccaaatccttcatatcaaaattttgagacaagaatggtttaacctcatttatcacctcaaggtttgtcccaaatatcagtatgtcgtcaacatacaagcatagaataactccctcacccccaccatggcaatagtacacacatttatctgcctcattgactgcaaagcctgcagatgtcaatgttttgtcaaatttctcatgccattgcttaggagcttgtttcaaaccatacaaagacttcaacaatttgcacactttgccttcttgaccttcaactacaaacccatcaggttgatccatatagatctcctcatccagctctccattaagaaaagctgtcttaacgtccatttgatgaacaagaagaccatgtgaggttgctagggaaagtagcacacgaattgtggtcaatctagcaacaggtgagtaagtgtcaaagaaatcttcgcctcctttctgagtatagcccttagcaacaagccgagccttgtagttttcaatagtaccgtcaggcctaagcttcttcttgaacacccacttgcaccctacaggtttacacccatagggtcgctctgccacctcccaagtcccgttagcaataatggaatccatttcactacggacagcctccttccagtagtctccatcaggagatgcatatgcttctgaaattgacttaggagtgtcatccatgaggtacacagtgaaatcatcaccaaaggacttagccgtcctttgtctcttactccttcgaggagcttcactgacatcctcctcagagacatgttcatgtgtatgttcagtttgttctggtggtgtgattgtactgggaattatttcagagggttggctcgaaccactatgtgtatcgttcattgggaaaaagctctcaaagaaggtagcatcacgagactccataattgtaccaacatgcatgtcaggtgccccagatttaactattaaaaatctataggcaatgctgtgatgagcatatcccagaaagacacagtccatagtcttaggtctaagtttgcgcttcttcgttattcgtacattgactttcgccaagcacccccatctacgcaaataagaaagtgatggttttctcccaatccatatctcatatggtgttttgtccttatttctgttaggaactctgtttaacacatgattcgaggtcaacaatgcctccccccaccatgccttaggtagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaacacgtttgagaaaaactctccaccacgatcagacctaagcctttttatctttctgtcaagttgattttcaacttctgccttataaattataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaagcttgcaaggttgcttcgattgcacacaactatggcacttagaacctttgacaatggaaaacttaggaattaaacacatgctggaaagctgagacatcaagccaaaattaatatgacataaacgtgagtgccaaacattagcctcatcatccacactgccacaaatatggttcacagacttattgcagaaatcagaaagggaaaagcggaacaggcctccgcactcataacctttaccaataaaatatccatgtttagacatgactactttattagactcaaaaaccaacttaaatccgtctctagtcagacggaagccactaacaagattcctgtcgatagaagggacatgctgcacgttcttcagctgcatgatccttcccgaagtaaacttcagatctaccgtgccaacaccatgaacagaagcatgtgacccattccccattaggacggtggaacccggtgcgacctgataaggagaaaacaatgagatgtcagcacaaacatgtacattggccccagtatcaacccaccaattagtagactgattaactgaaaaaacagtaggtaaattaccatacccgcttccatctccagtgttgccaatggtcacattagcagacttagaagtctaccctgcaggtgccttcatccccttgcgctgtggacacttcctagccagatgaccaggttgcccacacacaaagcaagtcctctcatcctggttaggattattgttgttcttcttctgcttcttgaagttggtggtctgttgagctttgtatttccccttgctcttgttctgagccttgtgcacaacattggcactggactgcccaccatggcccttagacgtggcatctttttctcgagctttctcctcaacatcaagagacgctatcaacccctcaacggagtattcctgtctcttgtgtttgagtgcagtaccgaaacctctccaagatggaggtagtttcgcaataatgcacccggccacaaatttgtcggctaagacacacttcaggagttcgagttccttagccatggtttgtatctcacgagcctgttcgactacagaacggttgtcagccatcttgtagtcatgaaactgctctatgatatacagatcattgctagcatcagtagcaccgaatttagtattcagtgcatcccacaactccttagcgttggtcatatgcatatacacctcgaccagacgatcgccaagcacgctaagaatgcatcccacaaagagagtagtgggctcatcgaattctttctgctgatcagcattaagaacgcccataggcttgccagtacttacccagaagcatttcatagctgtcagccacagagtgaccctgatctgccatctcttgaagtgcacaacggtgaatttatctggcctcagtgcatcggcaaaaccagccatagtaaaatcaaagcgcctataataaggtttttggattgttgaaattataagcacataatgatttaatttattccataaataaatcatgacattgtagatgtaaactagattgaacgcatcattagatctaaacatgtaaactaagtagtaaaacatgaacagatcaaatatgcgcaacatgtcgaacacgtaccgaggtggcggaaagacgggttgcacggcaggaactactcgcggttgcgagcgtcgacgaaggcgcgaagcacgcgagcggagaggaaggcgagccttcgcggacgaacagggagtagtcgcgtgaagcgcttccaaaaaaccttattgccgccttctcccggtgcaggacgtcgaaggcagaggttccggagacctgctctcccgattgccggtgcacgccggcgagcgggatggagtagtctacgagggacggcgcagtacagagtaggaggcaaaccttagattgattttgcgtgtgttgcgtgaaggcggcggctcggtttatatagagataggtcgcttgatcagggcgcccgcacgatctccactccgcgtaaccgaaccggataattcgcgcgtaacttatccggactccacgccgttttcacacaccggatttttcggaatgtttccaaaacaaaacaaaacaaaactgcaaaaggaggctgcatctgcgcaagggtgaggagccaattttgcggaccattcgacgcgtacgtcgtgcacgcgcgccgcctgccctacccttccctaccaggccaggcaagcgtgtgtgtttcccctcttctctccaccactcatgcttcaagtggctaggagggcatcctcccttttaatgaggttcccctctcctagaatacgcaaggtggtactaaactccacatgcatgctatcccatgaggtgggcttttgtgattttccaaagaattaatcttcgaatgggccttagcccatatattaattccaacaattgtttccgccacccttatccccctccgtctatctatcgggagtaccggagtggttagcaaaggaaacagtggaagaggaggtatttgggggaggaggatactgcagaggccgaggcgacgatgtgtgatgtcgcatgatgaggagtcaagagggggctgttatgtaattttcaactataccattttttatgtaaaattgttaaaaaaaagtgcatatattaattcgttgttaaacttggtgatacataagaaaccctgccaaaattttagtaatattgctaacttataaaaattttgacataatcaaaatttgataaggtttatttagctacaatttgaatagtcccgaagatcgccacccttatggccgctttatcttatttctcattcctttatttcttagtagcattttatatcctttgaactcccgttgactgtttccagagtgttccattgtcttattttaaccgcatgatcggacggcgtgagcttcttccttacctccatccaacggttaattttttttaatgacgtggctcattcttgagataaatctgtcattaactattcacagataccagtcactgctcccactgtcctgcctccctgaatctgacgctcgctgcctcgctctacagcgctttcgcgcgcacgcgtcacgtgatcaccggccacgatataagcttgagactgtcccggtggggtcgctccttaccggcgaaatgagaaggtgaaacaaaaagaaacacagtaaaaaaaattagtactacctctgttccatagtaagtgtagccatgatattccgcgtcaactttgatcgagctaactttgatcatccgttttatttgaaatttttttataattagcatttttgttgtcatgaaatgataaaatatgaatagtactttacctcgtgacttatgtttttaattttttttaaaaaattttcaaataagacgaacggtcaaagttggacgcggaaaaccatggctgcacttattttgggacggagtaagtactccctccgtcccataataataagggattttgagtttttgtttgtaacgtttgaccactcgtcttattcaaatttttttgaaattattatttattttatttgtgacttactttattatctacagtactttaagcataacttttttttatatttgaaaaaaaaattaaataagaagagtggttaaacgttgtaatcaaaagctcaaaatttaagtgggactgatggagtagtatatgtaccagtacttgtctgatccaacaagcaaaaactctctgtgtactttgttcgatcgctttcctatgcaaaatgtcggtagcggagatagcgcccggctagcacgggcgcccgggctccaccctccaccacatttaacagctgcacacttaattaatgtcatacttaatctgttggttcgccggtcaaatcaggtgggcaaactagcgaagtaatccctccatcccatacctccatcctataatataggagatttttggtggacgtaacacatgctaatacaataaatttagacagacggttttaactaaatttattgtactaagatgcgtcacatccatcaaaaatctcctgtattataagacagagagagtatggtttaacatcatcacattgtgcagtctgcagcttatggaccaaagagaggcagtacacagccatattattgttccatcgcaataatttgtagcactggtccatcacaagttagcaactactcctcgctatttttcattttatattaggagtattaaatttgcccgcatctatattaaatcataactgctatgtgtaggtgtatggattaatgtcccgagttcgaaaatgccgacgatggcaatcaactaatgtctccgtccaaaataaatttatttttcacctatttcatgcatacaaatataaaataaaaaatagaatatcatactttatcaaatcgcaatgtaactactttttaatttatctactcctaatataattattctctacttttataaactccgatgcaataattactcaaaaataaacttactgtaagataaatgaaatgatctaaaaccaaacttattatgaagcatttttcacttatctcacacatatcaatacaaaataaaaaataacacagccatattttattaaatcctaatacaattatttctctttttatctattactaatatatttatcttatctcacatatatcaatacaaaataatgattactaaaattaagtttatgttggatacaagaagttattatgtaacagagggaggagtaactattaaggcttgtactctcttcatcccattttaaacgcagtcatgagttttttttccaactctaattatacgtattatttaaaattattttatggttagtattttttattgttattttataataaaacataaatagtactttgtgtcttatttatgtgttttaaatttttttaaataaaacgaacaacaaaaattagacatgaaaactcatgtgtgcgcttaaactgggactatactacctaagctcggtatcgtaaaaagctgcttagctcggctatatatatattggtgcgctgaaagcctaggttggttccggttcgcaagttaactcattacgagctttggcttattcatattacctttacgacttttagctagagttctgacattatacatttgccgatttatcatttgctagtcttaaacattattccttccatcctaaaatataaacattaaaaatcaaattcataactaaaatttactgtattttaaaatggatgtagtacactacaagacttagaacctagcctgtaggagcgaaacaagtaattaaaaacttacgagcagggttcactgtaccgtcggtaaccgcgcggttaccgtggggtacggtaatgtaaataccacggtaacctccttaaattcaaataaatttaaaaaataatttaaatttttgatgaattttgtacagtttttcacagttaccgtggtttaccgtgcggtaaccgtgcttacggccggggcgcggtaaccccagcctcagcggtttgggaaaccctgcttacgagtaaatacaaatacaatagcttacaaacaatcggagacttacgagtagtattgagtaagaagcataagcataaatagagatattggtcttgcatactaccaagcttaacacgccccactcccgtctcaaaatattacaagcaagctaaaactggacgagatacattctagtataataaatctagacagatttatttagattgtaacacataattaattaactattagctaaaaatgtttaaaaaatgaattgatatgatctttttctaaagattattttcccaaaaacatattgtttaatagttaaggatacgtgcatgcgaggaatgagagagtgcaggttgagaatcttgagttaagaagacagccaagggcaaatgaaatggtgaaactattctaaactctcgaggcgacatcccttcgttgtttacatgtcactcaaatgataagaaaaaaattgataagatagattaataacgatgtgttagatcactccacaaacatgcaaattaaattttaacttctacactttgtaaaaaagacatgtgtgactacgaataaacattaattagctgtagtttatttttctcattgcaacttataaaagttggattttaacttacatgtttctaaagtgatatagtatatgttaatacatcttctcaatttttacaatatttttataactattctacgtgtcatgcaaacaataaaaagacatcacctcgagagtttaaaatccactctcaaatgaaatgccattcaaaattgtctgatcggttgagcaacaaaataagctataaaaaaattaacaaagcaaaaaaagtaatttataggtaaataattattactagaattttaaaagtagtaggcataaaaatacaatcaccaaaattaaattataaagttctaaaaagaatcaaacccaagggatgaatattaacatacatgtgtggattcatcccaggttttgatttcttttttcacagagagagtataagccagcaaaaagacatgaaaaccgaatctctctaaagaaatctactcgacgtacgtgttgcagttcccacgctagttgcattgggaagacgaggaaaaccaagccatggcgtcggcgaggcacctccggaacgtgtccatgcgctccggcagcagagctatgcccacctcgatgccgccggcgccagaacgatcctccgccgccgacaccgcgccggtcttcgccacggacacgatctccaccttcgccggcctcccgaacccgaagtcgacgtcgtacacgcggaacctcgtcgacccggccaccgagaacggcgcgtcgtccctgcacgcctccacgatgcgctccttccacccctcccagtacgcgggctcgccgcgcaccgcctcgtcgatggcggcggccaccgccgcgcaggccgtgaagacgccgcccgccacggcggcgccggcgagctcctcctcgggcgccgagacgaagcccgggccgacgcagttgccgaggtacttgtcggggacgcggggcaccagccgcgaccggtggtcgacggagaagatgaagtgggcggcggcggcggcacggccgctgccgccgttgtcgctttcccgtctggagcggcggtagcagtgccacatgaggccgtacatcgccacgagggacgtgcaccgaggcggcggaacgccgcgacgtgcggcctcggcggcgacggcgtccttgacgccctggaggtgctctctggacagggtgaaggtggcgaggaacttgccggcgtcgggcgccttgaacagatctttggcttcgttcgtgggtgcggcgaactcgtcgtgcatctccggtacgtcgcggatgagcgtgcggtcgatgacgggcggctccgggagcttccggtcgccggcgcaggcggcggcccaggtgtggaggaagtgcgtcgagcccaccccgtcgcaggcggagtggtggacgatgacgccgagagcgaggccgcggcgcttgggcggcagcacggtcacctgcagcgcgagctccgcgccgccctcgggaagctccgggacgagcggcgcgatcttggcgagctccctcggctcgtccgtggcgagctcgtcgacgccgacgccgacgccgtcgtgctcggcgacggtgaacgccacgccgtcgccgggctggtagaggagctcgtaccggttggtctcgccgggcgtggggcggacgcggccggcgagcgggtagaaggcgtggatcgcccgtggcagcgactcctccatccgggacagcacggcgtcgacatcgtcgtcggggccgaggcggtagaagaagacgcgctcgacgggctgggcgcggagccacatcacgtccatgaagatgagaggcagggctcgcttgggcagcgcgggctggccggcgggcggcgccggcgcgacgcgcgtcgtgcggaggacgcggaggccagcggcgtgagcggccggtggcggcgccatggtctcgccgcagaacaggtgtggtttgtgttgctcgtggcttagctgcagagcgatggagctttgcttctactcctataatacaatacaatacttatatctctctcacttcacttgtccatatagtaattaatttctaaggttaattagatacatatatcattacaaatttaacggttttaaaatattttattactattcatctaattgaaacaaatatgccactaaatatctccctcacttcactagtccgtagccattaatttctaaggggtactttctttcttaaataaaacgttttgagttttaaatagatcatgtaagcttgatatatatatatatatatatatatatatatatatatatatataatttaaattatacgtatattagtgactctaaacgactgacggtggtggagaaactaaactatcatattattagaatggaggatgagagtaggttattctacctaatcatgtgggactaattgccaatttcccattggcatttgccgagatgaacagtgatgtcacggctgacgacgggtactacgaaatgcttgcaattttgaggctatgagccaacagtttttgggtgctagtttaagctgggatggagggtctgtttggcacaactccagctctaactccacctcttctgaagttggagttcagccaaacagtttcagctccacctaaaatgtgagcggagctgggtgaagctctctcacaaaatgaactagaaaggtggaggtgggtttagacagctccacaactgcactccagacctaacttttggagcaaaatttttaggagttggagctctaccaaacaggtccagagtgtatggtttggcgtcagattcgttggtgccataaaacatggaagtggattcagaggatctcgttagtgccttcacaatgtgctgagctgtcatttagcccgatctctccacgtcagaggttcaatacgaatctttaccatgttcatgagcgggcccaccaaattgaagcccgtgtgaccctttttgtcatccgttcttggcacggggagagaaggctgcaaacgcgttgggagggtgtggcttcattccgcttttcctacatgcactgttgaccttgtggctttcctaggttttggtggcgccttaggccaagcctatgcgtgacccccttaccctcccatctatagatgcaatcatgctcttagggatggcaatgatgatattagatttgctttgaggttcgtgcaagccctcaaccctaactccctctctttctttgtttcctcgtaatgccgctagttctctactctacccaatttccccgcctcctatgttgctacaacgccacccccaagccttctctcacacaatctaaatagaaccctatctgacattgatttatttttaaaccatactagaataattttgtttaagattttaccggaatcaataaaaccattactgacatgtgctattgttaataattagtacatccgtctcaaaatgaatctatcactactacaaaactcctaatatgtactagttttccaccttcaaaaaatagagaaaatataaaaccgatatctttgatcaactatatgtaccggttttaaataaaactagcacatataatattagtgcaactggcatctacacttgtattatctgtgccagctctaaataaaaaatcaacacatgaaaaaacgatctgagctaagagccgagctgaacccatccttatctactcaagtgacttgtacttatcctcgactctctctcgtgcttctctccctcttcctctccttctccagcatctcaccctctccttctccagcgtgcttctccagccattgtctactaccttcaacgacactggcgatgcagcggcagaggcggccgccctctgtccatggagagcagaggtggccagtcccgagctcgggacaaccagatccacgcgcggtagcctcttccttcctctcccctgcgtggcgcggtggcggccgcctcttcctctacctagtgcagtggcggtgaccccttcttgttctctgcacgtcacgacaacagttgcgatgattgtctcttcctctccctgccccagcacgatagacactggatccggccaacacgatggtgactgcaggttattcatggtggagagtaggaatctaattggattgccaatatttcagaatgaatttttgtgatttatgatgtttgatttgtgcggggatgttgttgttggatggatccatggtgatttgtcctatgtgatttggggatgttgtaggatggattgatggtggtatgtggatttctgatgtgtgatttgggtaatggggaggggctcgatgcatcggctcgttttgagccgatacatcgagctgtcttttcatttgtggagtttcaaaggtgtcagttcgtaaactgccacagttgattcctccatatcaatgcctcttgggctgcgtaggttgagaaatccaaacatctatgtgggcttcccaaccgacacctaacacatttatgtgtatttctcccttgccccatcatttcaactaattacaagcattctccatttaatttcttcacctacttactttttttcaattaatcaaaatttttataatcattttcacatatcctcttactataaagttagagcccactaaatccta

SEQ ID NO: 77066 - DNA, 2465 bp, Oryza sativa
gtattgtacatgtatagatgtaaatagattgattattaaagtgataaagctgaaaaaaacatctgatgagatttttttaatcccctgctttaggcattactctgctacgctcccttatttctttattagtaatctgcattgggacctggtctggaagcctcctggttggactccactccaaatgatccaacggtccatctctgtttcaactcccatctcctaaaggtccctgatatttcagatgacgaggcatatcgctgtttgagaggcttgctgctttcacctattaagatatttatgtgtcggattctatttccattgctagtatttattaagataagctgatatatacttttagtctacaaagagattaccctcatataagagttgagacgacagatgctctagcaatttttctgttacctttctcttctttatccttcctcatgcatcaaacttcaatttaataaacactaagagtcgatgttaattaagctgttgttaacatatttttaattatagagttattagaaaaaaaacaagattacttagagactctatacttacatagttgagctacgataaagactctaaccactaactataaaatatttttattactattttttccttatttttcaccgtcatctaaccatatttccattttatagagggtaagagtcgttgttgacagtagtaagggcattttgtctttccttttctcttttataagtgagcaaatatttctaactagaaaagctaagagcccctatatatgacgtacatgccctttaagcttaacattgatgtttctctcatctcccctctctcttccatgtcgccaaacttgacttctttagttaacaaccataaaatctattaattgatttgtagatgcccttacctccattcctagcacttgtcgtaattatgggcaataccagagcattatgttttaaatttaggagagaacattccgaaaataataaccataatatcctatgaaattctcgaataaaattgcatctaaaattagacatttggcaaaaattaatgtatttggtgttgtatgtattatttattgtgttgcttcattaggtcaatatagtgaaacaaaacaagcatgtccgccgcaagtttctcgtcatttggatcattttgcatgacatccaaacggataccaattacttaagcaaaaagtaacaatataggttgtgttatcatatatcactttataaaaatttataacaaaattagacacacaacataaaaaataaagcttgcgcgattttgttctttacggttaaattaacagtttaatcccatgtcgacttactttattttataaaaaacgaaggctattttctatcatattcttactcatgcaagtcatccaaggccatctccacacccaaggtcatctttgctggtgttctgaattttaatgaaattaattgagacattgaaaacaagataaggttttcttaaaaaaaaatcaaaccaacaccttgaaaatgcaccagtcaagcacaagtggcagccaatagctagcatgtggtctggcaacgagcaacttgccaacgatgcaaaagctcagtgacgactcatggcttagcacatcctggcgaagcattatatggcagcaggagaacaaccagcgatgtacatagtgtagatggatggccaaagggtgctcaccagcaaccatcgcacatgaaaaaacgctataggaccgaaattatcttcaatattagaagctctaactgctcgatcggaaggatgaagaaatctatcagcggaggcattgtatttggttgtgacagcattgtttatattgggaggaaaagtgcttgatggatatttttttattatgaacaaggggatcagtccttcctagatcttgcacttgttggaattaatgaatgggccttagcccactcgaagattaattctttggaaaatcacaaaagtccacctcatgggatggcatgcatgtggagtttagtatcccccttgcttattctaggagagggggacctccttaaaagggagaatgccctcctagccacttgaagcatgtgtagtagagagaagagggggaacacgcgcgcgcttgctcgcctcgcctcgcctgcgatcggggccacctcgatacgtgttcaatatgttgcacatatttgatctgttcttgttatactgtgtagatctaatgatgtgttcatgctagtcttcatctgtaatgtcatgatttatttatggaatagattaaatcattatatgcctataatctcaacaatccaaaaaccttattataggcactgtgattctactatgactggttttgccgatgcactgaggccggataaatttaccggtgtgcattttaagagatggcagatcagggtcactctgtggctgacagctatgaaatgcttctgcaaatttaccggtgtgcattttaagag

SEQ ID NO: 77067 - DNA, 2288 bp, Oryza sativa
cgtgggctatcaaacccaacataaaacatggtccaaaaccttcaagagattttgaaaaacttgcaaagaaacccggtgtaagtgttgtgacaagtgaaacaactcgtgattaaaattttgacttaggtttttcaactcacacaaagatgaagcattttgagcactagtattttaccaataatatgcatgtggtatccctcttaatagtacgacattcctacgacacaatgtaaggtaaaaggtacaatatactatttgatcattgccgcattgcatcgtgatgtcgcattcatggggtatgcatctcattacaacatgtcgaggacataacaaccttcacatttgcttgaataaaagtgttagtcctctctaatcgcattgtaatcaatcatcaaaatcattaagggcctagatgcactttcaggcccttaccaccacgcgatgaggcgtgggaacgacgacgacgaacgggcgtggcggagtcagacgggaacgacggagacgaacgaatgacattgcgccggtgatctttggacgaaggcgagacacgaccggcgcaacgcttgacgacgcggaggcatggacgaagatgacgacggggccgtagcaaccttgacgaaacgcaggcgacgaacggatacggcttgacggcggaacgaacgccactacaaccgggaacgatgagaggacgacgacgacgacgacgaacatcggcggggttcagccgaaggggaggcgagggcgagggcaaccttgccgcggtgatgccggaggagacggcgacgtcggctggcgcacgggcacggcgttaggggctgccggaggagacatcgacgaggaggaaggatagtgtcacgtcccaaaacgaccctaaaatatatcctttaaattatgcctagaataattaaaatccatgtgtgaaagcctccaaaaattaaaatgtgcaaagtaaaagtcaaataaggcttggaggatttttgtatatttcctaaaagcctaaaatgtgtaaataaattttagtggaattttcagagcacaaataataattaagaagaaataaacaaagttgaaaaagttttaaaaaaaagaaaaaccctaaaagtcccccttcccttccatgggacggtccggcccatctccctctccccccacctctctctctctcctctcccccgcggctcattcggcctccctccccgcgcgcgcgccgctgacgggcgggcccacccgccaccctcgctgacgtgtggggcccatccgtcatccccgtcctcccaccgctcccgccgccccgcccgcgccaagcgccgccgctgccgcctaatccgccgcatcccgccgtccccgcgtgcaacaaagtggggggaaatactccccgtgatcccctctccctttccccccatttttcccactctctctcgcgttcaaatgggcggatttgcccctgcaaatctcgccggcgccattgatggcggccggacctcccgcgccagtttcctgcccctccggccgctctctcccccttccaaccctatttaaaccctccccgcacttccttcgcatgtttctaccctttgtcgcgccttctcatcgctggaatcgagctcacgccgtcactctctctctccaccgtcgccgccgagctccggtccgccgccgtcatcgccccggaccgcctcccacctcggcgccgcctacttcggcttcaccacatcctcgccgacctcgtccacctctccgtttcggtcgccgaccgccggagtgccgccgtccccactgacccgagccacgccgccgcctccctccgcttcggccgcctcctccgtcgccgccgtcgccccggggtgagccgtggaccgtcgcctcctttccccttttcctccgctctctcggccgctgctccgccgcgtctatggccgccgccggcgaccatagtggcgcgggcgtgccgcctctcgccgaccgcgccggcatggccgccctcgggcgcgccgagtggctgccgtgtggggcctggccgtcagccgcccgcgccctcgggtgcggctgacgtgtggggcccacggcaccggccggtgtgagcccgggtgcacccggtccaccgtggaccgtgaggctgccacgtgggccccactcccatggacccggtccgcgcgccccctcccctcggctgacgcgataaaccctttttaaattaaaatttaaatgaagaaattcgcaaatatttattttaagagtatataaacttcaaatggccataacttggccatttgaactcggaattggac

SEQ ID NO: 77068 - DNA, 1135 bp, Oryza sativa
tgttttatctagccatgcctatttacctttgttatgaccttattattgttattgttattattaccttgttcaccctagaataaacaaaaccccaactagtggacactctactcatggtaccactagtatgaatttaggtagatgcttcgccgcttaattaggtaacattaggtggttttacaactctagactttgggaatattcatatcacctagacactatggaatggttggattattgtggaattggattcacacctccccctctattcaaaaccctcaaaatggttttaggctgggctcggggtgcatggttttgatagtagcacctcggtcatataaggaccggtcttcgggcctctgttgcaaagtactaccatacttccacatgtctagtgggtaaggcttagtttgtggctcagtctggttataaacaaaagtacacggatggagatggacaaagtcgggggtcgatggacatctctagggcaaatgaaggctacacgagctgcggcccggtagtcgagatgtgatggcacagggccggtgtcctgctgctaggggctcagtcctgcctacctgtcccggggtgtcacgcccggaatttctatccaaaattccaaacgcttacatgtgtgtgaaccctcgtacaggaatcagccgaggcacacaataacaaattgataatatagtacaattattactctaattaataagcgaataaaatgtcattatagaggtagatagttcctctcaatcaataaagatctaagcagcggaaaataagataaacggcgcagacgactccactccacaggcagcttgaccaggcctacacctaatcctccacaccatcagcttcactgtagaactcttcctctgatgaatgattgcaacgtgagtatatgacatactcagcaagccacgcagcaaatatgcaagcgcacaagataacaaaggatggcatagtagggtttcatttgcataaacaacatttaataaacatttcagaatttaataaaacagttaagtattaattaaacagtattaatccaacgctacacaacataccctgttgcatgggcccaaccattctgaacaaccatcccggctgcacagttctatcttcaaaccag

SEQ ID NO: 77069 - DNA, 1329 bp, Oryza sativa
gtcgcttgggctctcaccatccaacatcacaaaccgctcaaactgccccttgagaatgtccaccttgaactcgctaacactatccgtaacttcatgcaaactccgaagcgtgtcccaaatcactttggcactctcaatgccgtccacacggttgaaatcacttccactcaaggcgctaagaattgcattagcggcttgagcgttcttgtgctcgttcttgtcgtcctccttggtgggttccacgggattctgcaaaacatagcctttttcgactattctccaaatcaaagggttaatagatttcaaatgcatcttcatcttatgtttccaagcggcatagtccgtaccattgaagtacggagctttgccgctataggtgctcacataagatgcagatgtggagggatagtcataaggaaacgtagctcccttatcaccatccttgccattccccgtttgacccgacatgatctctccaagcggttaagcctaattaggagattaggctctgataccaattgaaagggtcaattaggcctaaaggggggtgaataggctaatttaaaactttatgcggaagctaaaactgaaataaggtcggaaagtctgatccacagtcagactatccgaaaatatcagatagtctgatgttggattagactgtctgatccaccaatgaagcacaacaagtagatatatcacacaaacaagagtaaagcacaaacaacgactagatctatagcggcacaattaagcaaagctaaaaggaggatgaagggagatcaccaatgatgaagttcacgaagttgtccccggagttcaaatccttgaggggattctactctccgttgaggagctcactaagagccgagtctttgctaaccctttcctcaagaggttgcactaagcactcttccttccaataaggggtatctctttccttgcggaggcgagatccggccttcacaaacttctcccagccaaccacacgtagatcggtggctcgggagtgacacctagccatctaggagttctcaacctccaagagtaacaaacaccacacaactcttggtcaaaccttagcgctcaagatcgagtgaaacacacactaggccctcaaacaccaaatccacaaccaccaagatccaccacacaaagaacaaggagggatttgagagagggagagagagctcaaagatccaaagcaccttagtaccaagctcaacccaaagtgaatgagaatgaaatgagttgggtaaccctagaaaagggttaggtggggggtatttatagaccccccaaaaatgtggccgtgtgaggggaatcttt

SEQ ID NO: 77070 - DNA, 6122 bp, Oryza sativa
acctgcacactacaacatagaaatttgctgcatctagcttctgagttctgatagctgtccatattcagtcttctagtgtgattatgtcctttcacaacatgtttgtgaaatgtcatggtttttatctatatttttggttttgtgctgaaaagtagtagaagttactacatgctagatgtgttttgactatctatttctttgtcaaacttgtaaaatctcactgctacttccaaatttttaactatctattgccctcatgtcccttttgtaatcaattagtcaattcttatatgaatctgatctaccttgccaacagttctttatattaacttgttactgtgttttgtgttaacgaagatatttcacgatgacgttgctaactatttctttttctataatcttctgaagctcgtcctggcatattcgcccagagggacagggcgaaatgggatgcatggaaagctgttgaaggtccatatacttctctctgtccttacataaatatgttttcctgtctgtccattctaatactgttgggctgtttcgccgtgctactgaactgaactttttgcaatcttcgcaggcaaatcgaaggaggaagcaatgagcgactacatcaccaaggtgaagcagctcctggaggaggctgctgctgcagcctcttaagaagttatgaactctatgctacatggcttctgtcagctgaacaactctatgctaatctggttgctgacaacttaccattctatcaattcgggatgtgaactatgtacctctttgtgtactgttgcataatttatccatctatttatgaagactattagtcctatgaatcatattatcttgtaatctttcatctctctggctgtgtactgcacaatagaaaaataatggttgtcaagccagttacatgccccaatttcaagtaaccataagcagtaataaccatcatatcctggatcatattccaatctcagaagacaacacaatctaaagagaaaaaagatctattgatcagaaggccaaaaacatatctatatgaaaaatgaaaatgcttaattgttcatagttagatagatcaacaacaccgcactgcacacatatatactgtttactcatcatgttcattcattctacacatgcatatgatctcatctggcaatggcaagaagccaagaactcctgaaaaaaaaaggatgaaatcttcagagatgtccatagcctaagacctgaccacctgagaagaggttgaggcagagcagggaagcagccagcagcgtccctggaatccaccacctgacaccctcgtcggcgaacatggcgcacagcaccaggcacagcagcagcagcatgtagaaccccagcccggaccagaatccgccgccgccgcaccactcgccgccggcggtgacgccgtacttggcggcgtccgccgggtagtagtatattccggcgaagtaggcgaccaccagcagcaggaccaagaacgccatgatgttctgcagcagcatcacggatagcacgatcgccaccggcacgaccaccacctcgctccggcggctgaggagcacggcggcgagcagcaggagcccgccggcggcgaccagggtgacggcattgtcggccaccgtccccggcaggttcgccgccttgtcgtaccactccgtcagggtctcgttgtagttgacccagaccagggccaccacgatgaggagtggcaccaccggagacggcccaccaccgccgccgcggcggcccagcccccacgccggcgaggtaccccggtagtagctcatgatcacctcttcttctttgagctctttctgcttcttatgctacttctgttcttgctgcttttaagcacactacttagtactactcagttgtaagtagcattagcagtgaaaaagtccaggtttgataatatttagtttctgaaatgtggattagtgttcatcttgttccaactaattttaactacctgcttgtgtcctgatgtcaattgtcttggaatttagttgaggtagggacctgcttaaagctggtagatgaactgattttagagaaagatggcatagaggatagtgatttgtaggtcttgtcattttcatgtatgtgtcattctttgtttttgtttggtttggctggggttattaactggaacaaaatcttctattgcctccatgtagacttgggaggtacttagcttagcaacagaaaatgatggctgatatcattaagtttaccatgggctgcttcaaccatacaaagtaaactgattaaactcagtagttgtggactcagtacaactgcttttattctaatggttatctaagaagattgtaaaaagcttatgcaatcaattggattcatttcagagtttcagattagaaatttcagttcattagcaaattccttgattagtttcagattaggagccatactgacaaaagaaggcattagtacatggcaagatgaaccaaacaaagccaacatatccggttttttttttctcaaattcactacactgttgagagaagacatgaaattggaagcattttctgaaaagtggacttcctttggcgacaaatgaataatgatccataaataagagagaatagaaaattaatctccattcatataagaagatttgatttttcatttagccattagcctccaactcatgtttttcctttcccccttgatatatatcactcagaatttcttgctagataagagagtgcaccagcaatctgctgagcttcttgttacacagtcaaaaacctgtgaagatattggcagcctattgaaggccatatacaagcaaagcccctactccggcaatgccgattatcaaactgacgatcactgtaataggtggtagcgcaccaccaatcgccctcccggtttctgcatcatatttcgcgaaccgcttctttggtgcgttgcattgtgggcagccatattcatcaggctgaaatggataaaaagcactagttgaattgttggatacacctgattttgcgggctgtgagtgccaaaagactgattctctgtgaaagaattgaagtgaatcttacctgttcttcgaaaggcttgggaaggaagtatatgtatccacaatcaaggcaaatgtgtgttgctctagcctgtgacaattcacaactttgcaggttgaggcttaaaagttggaaagagcagacgattgcaggcagcataagctctgagaagcagacagaactatcttgagcttaccttttgtgattccgtcaatttccggccaaatctcggaggcgccggccttttcggaagtcgcttcacatcaacttgtgcacccctgagatggcgcgaaatgacagcaggagatgaaatgtaaggaacttgaaggatccaaagtacttaccatgaaaagtacatatttctactagtattactgtctgaattttgaatataactgcataatgagtgcatgtacaggatttcaaagttacgaaaaaattgtaatgctggggaggataagtccttacctgctaaccacaaagtagacagagtctggctttgcctggatggctgtcttggtgaaccccagcttatctgcaggccatagttcatctccaaagaagctacttgtgtagagcacctggtcacctgatttcaggcctgctcttgccgcgttccctccagaatccacagcctaaagcaaatgccaaatgaactattactagtcactaattataacactttctgcatctccagctctaaggcaagctgtacatactgaaggcaaacagatatttttagcaggaaaagagtttggagttgcatttttaaccgtcgtagtagttcctagcttcaagtcccccccccccccccctttaggcataagccagtctggctgattgctttgtgtaacaaaaactcttttcctgctaatatattgacgtgcaatccttttgcacgttcaaaaaaaaaaacagatattcttgataagtcctaactcatgtagaagttgattcaacaggttgttatagttttctgagaaattaatccactaatggcaaagaactagttttatgaattaggacttgttgaagatattcctaataagtcctaactcatttttcctgaagaaattcttctaaaaatgtaagaatttcttcaggaaatatagtgatcttgagacagcaattcaatgctgccccttttttttctctgttaatggatcatgaagataaaacaagagcagggaatatacagtgaatagcaatctagtatgttcttgatgagacagcaatcaagtagtgaaaatttccattggttgatcatgcagagaaagaagaacaggtggcatcatgcatggaagtatggaagcaagctgtgttatatactgacggtgatgacgacgccgccgccggtcttttggccgagggtgaggccgagcggcttgtcgacctccacctcgatgtttttcgccgcgccggcggtcctcgcgttcacctgaagcaccctccgccgccgcccgctgccgccgccgacagaggccgcccaccgcctgtccaccagtgacagcccatggaaggccgtcttctgcactcagcacagcatcatcatcatcaacaatatcatcaaacattatcacacaagaaaccagaaaagcaagaagagaaaaaaaacatcaagaatcaatcaatgaaccaagaagagaaaaaaaaacatcaagaatcgatcaatggatagaatcaatcaatgaagcaagaagagattaaaaaaaaacatcaagaatcaatcaatggatatgcatatgtatcacacttacagttgatgatgagaggatggaagggggaggggagtgctgggctctgacaatggagcagtgcttggagggggcaggagcagaggagagtgtggcagccatggcggtggtgagaggatggcagcagtgcaggtggtgtggaggttgagggagaagatggctgccattttggatggagatggtgtggctaaggcaagagtgatgtgtgtggcctcacagtcacaaactcacaaccaaagggagaggcatacctgtggaaactgtgaacctgacaccgacatgtattccattctagaaaaaaaaattactccctccattctaaaatataaatatttttagtatagtgacaagtcaaacattttaaactttaactattaatagcaaaaaaaaaataaaagatcaaccatagaaaattaatgttactagatttatcattaaacaaactatcataatatgcaactctttttatttgaaacattttatttttataaagatattattggtcaaagtagcatatcggagaccgtatcagagtccaatagttgttatattttgtgacggagggagtagatcgagattcatagctaaaattattctctccatatttataatacttattgttattgtttagataagactgttgtcaaactttaaaaacttttattataaataacatctaaaatatttgtcttagaaatatgatgaccatatgtatacatatgatcttaaaaagcacttcaacaaatcatatatttatttatatttttcatatatagtaataaaaaatagtgatcaaagttattttttgaaaactatgtccggttcaaaccaataagtattatcagccttaggtagtaatggcatttttaaaacggagggtgtagccattcaccctgaaactgtggctacaaatggacagcttggaagaacgatggccatgtttgagatttcacaaacaattcaccttttttttttgtttgatgtagaagtctgggaaactttcatgttctaaatgcattctcagtttggttattgatcgaaaatccaaatggacataaaagtgacattctcagtcaaaaccagcaaatttgtggcctgtgaacacaagccaaatatatctcatgtgcaaaaggatgaacatgggtaccagtacaatgcacatttatccgggacgatcacaaaacaagccatagataccatatagaaagcacagacttaaaagaaacagaatgcagctgggaggtaacaaggtggcaaccatatccaacatacggactgcagtatttgtttcacattacagggcatccat

SEQ ID NO: 77071 - DNA, 1950 bp, Oryza sativa
acggcaatgcattcggattcgggaatatcatctgatcattcgctgcagccatagcaaacaaatcacgcagttagaaagagtaatacacaagaattacagctcttgcaagtaaaaacagtgccagtaattcacatgttaaaatgctactcggatgctgaatttcacactgaaaaatctacaacattcagatgaatcctacagcattcagttaaacccaaggtgcacacaattgtctgatgatgcctgaaatgaatattcatcagataagtgcagatatatttcacttgtatagttctgtcgttctaaagtattcttcagacaagtcctaacagacaaaaaaagatgagctgaactagctaaaaaggcccagaaaaacagaagcactgcccacgtcatgccatgcattcctttcagagcaaaattaagaattacataagtaatgttcagaaaatccagcaacatgcatattggatgtcgaatttcacactaaactaccgatatgatcattgtgaaacaagttgaatagacaatgcaggcttgaacttgtttcaatccatccactttagttctgagtcacaacaatagtaataacccagatgcacaccatatttacataccaatcaagcattcagctacagtattcagaccattgtgtgaaaaagtctacaaagctcagataaaccctacaacattcagataagcccaaagtgcatagaattgtctggtggtggccgagattaaaattcggcagatgaatttcacttctgctgttctacagtatattcttcagacaaatcctaactctacaagcaaacacatcatgactacattttcagcaaattccacaacaggcacaaactactgaaaacaggaaaatctacagtgctggactgacgtaacaaaatcagagaaacagagacaaagcaaaattcagaatcacataaacattgttcagaaaattcagcaacattcatactcgaactgggatttttaccttcgctgttggtcctgaggaggacgatgttcagggtctcccggctgcgaggcaggtcgatgagcagaggggtgaactgcccatggcggccggcgctgacgcacatcgtgaagtcgtcgtagcccacaagctccgcgatcttctctctcaggagcctcaccgacctccctctgatctcaaccgtagtccagatttctccctcgctggtgttgtcgaggtcggcttcgtccacgaactggatctcccgcagcggctgggggaagcacgccctgacgaagaacccgggctgcacaaaatcaacaacggtagcagaaggaaattcgatcaatccacaaattgtactgcacggttaattcttgcaagaaatcaagattaatttccgacgaaatcagcatcaagacacaaaacaaaaaaacaggaatcgcaagaagagagcggagaaggatcggagaagctcacctgagtggcgatcgggagccccggcatgtctccactcggggggacgcgcaccacctcccacagcaacgtatcttcgccctcgaagttggcatccatgagcagaggggtgaactgcccatggcggccggcgctgacgcacatcgtgaagtcttcgtagcccacaagcttcgcgatcttctctttcaggagcctcaccgacctccctctggtctcaaccgtagtccagatttctccctcgccgatgttgtcgaggccgccttcgcccacgaactcgatcactcgcagcagcggtgggaagcacgccgcgacgaagccggactgcacaaaatcaacaatggcagcagaaggaattcgatcaattcacagattgtaccacacggttagttcttgcaacaagccaacaaccaaatcaactcccacccaaatcaactccaagagacgcaacaaacacacaagaagagaaagaagaggaggagctcacctgagcggcgatcggg

SEQ ID NO: 77072 - DNA, 697 bp, Oryza sativa
cctctcctcctcgcgacgcccattcactgtgctcgggcccacccgtcattgacttcttttgacctcattgaccaaagggcccacacgtcagagagcggcctgcgtctccctcctctcctcgcgacgctttcaaatgcaccaccgcctcgcctctctcgcagtctcgccttcctcgccacgccacgccacgccacgccacgccccacgccacgccacgccgagaagccgaggagtagcaagccactcgccgccgcgcgcgcatcaccggcgtacgtacgtcgtcccatccgcggcgggcgcgcgggatgcaggttttccagggcgtgcagttcgcgcggctgcggaactggtgggaggagacgtacatcacggccgacgaggacgggaggtcggtctaccactacgccccagccgccaccgcccggcgcacgaggcaatctgggcggtgcagttggtcctcgccggggcgcccccgacgcagtacgtgctcctccgcggcgcctacggccgctaccttggtgccccggacgccgtcgtgcgccgctggccgctctcctgctgctggcccgcccccgtcgtcggccagcgcgacttcgaccagccggaggtcgacgccatcatgtggcgtgccgtcaggcggaccggccacgtcgtctgcttgcacgacaagtccggccgctacctgcgcggcaaactg

SEQ ID NO: 77073 - DNA, 8504 bp, Oryza sativa
ctctataaacctccgataatatcctgcgaggcctaggaaactgcgaatctctgaaacggtctttggttgtttccagttggttacggattctacattactaggatcgacggcaactcctcctgctgagatgacgtgaccaaggaacttcacttcagacaaccaaaattcacacttgctaaacttagcatacagttgatgctctcgtagcttctccaatgcaaggcgaaggtgttcttcatgctcttctttggttcgggagtagataagaatatcatcaataaagactaccacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagctgatcaaacaaatcatcaattctgggtagcgggtacttattcttgatagtcacatcttttagtgcacgatagtccacacacatcctctgggtatgatctttcttttccacaaaaataaccagagctccccatggagattaactcggtctgatgtaccctttctgaagcaaatcgtccacttgcctcttgacttctgccaactcgttggctgccattcgataaggtctcttatggatcggagttgttcctggtaccaaatctattctgaactctatatcccttttaggcggcataccaggtaaatcatctgagaacacatcgggatactcccggactataggaatctcttccaaagttatttggttcagtattgaccttaaagactcagaagacaatgcatgaacagttacaactcgaccatcattgctggtgagagttacttttctgttagcacagtctatcacacccttatgcctggctaaccagtccatccctaggataacatcaaggtctttggactctaacaagataagattggccagaaatggtactccttgaatttctattctgacagaggggctacgttgcaaagagagtgcttgattacttggggtactaaccatcaaaggacatctaagatcttctacttccatcccatgatttcccgcaaaactcatagataagaatgaatgtgtagcaccagaatcgaaaagcactgttgcaggaactgagttaacaagaaacgtacccaaaatcacatctggagcaccttgagcttctgcagcagcaacatgattgacacgggcctttgatgctgatacggtagagttgctctgggcagggacaaccttcacgcatcggggcttcggacacttgtcagcgtaatgtcctgggtctccacagttgaaacacaccacgggcttgctgccttgctccctcttggcaggttgttgctgtgtcgaggctgcaacaggacgtggaacttgattgcggatgttgttgccagcattgttgttgaagaactgacgctgcggacgaacaacagacgaataacctccctgtggcatggactggggtcctaaagtaagatgcggcctctgattattcccctgttgtgtcttgaattgagcaatccggcgtttcttctgctccatgcgattgtacttgtcctcctgacgaatagccttatccactaacttctggaaatcatgataatccccagtcatgagtgggtaagaaagctcatcattaagtccttccaagaacttctcctggtgctcttcatcagtgcgcacatcttccggagcataacgagccagacgattgaactcgtgtagatactccgtaacagagcgggatccctgggtgagcgacctaaattccttcttcttgagagacaccactcccgatggtatatgcatcttccggaaagcagcggtgaactcaagccaagtgataggttcagcagtagtcctattcaggcggaagtgatcccaccattcagaggcagggccatgcaactggtgtgatgcaaatgagaccttctcctgatcagtgcactgaagcaaatccaacttcttctctatggcatgcagccaatcgccagcttcaacaggattagtggtactagagaaagtaggcggcctcacacgaagaaattctgctaacttgttctggggaggtgcatggttatttccctggttctgctggttctggagttgctgcatcatcatgttcataagctgtgcctgttgagccaggacttgggcaagtgtgggattctctccattgttgttgttgttattgttgttgttggggccattcccgttgctgcgagtgaccaccatctggcatggacagggcacaagaagagaaaccgggggaaactacttaggacagagaattaatttgacttttattggtcttaagtgagtttcattattacaaactgaagactctcacaccactaagctcaccaactacctaacactcgaaagcaaacaaacgcatgcacttacatcccatcactgatgtaatcacatgcgagacacacacaaccaaacttaaaacaagcaaactaatacaacgatctaagacaacggcttgacaaggcattctagttcttccgagcatcggagttgattgaaggctcgttcggctcgtcttcatcatcttaagttgctccccactcaatcttggaatgggtgcgcttcgattcttcttcttcatcatcacttacgttgacgaccggaggatccgctagggctggggtaacttctttttccaccacacggacctttggtgccaattgatagcgagggacaaatagagctctcttccttgcggtaagacaaatcctggccttctgcggtggtgcttctcccttcaacgcggctagttccttctccaatcgatccactttgtcctctagcttgcaaatcttacctcgattccgatcttcacgatcttgagctgctaacacagtctctgcacgggtttcatccatagcccacagcatctcaaccaaatgccttgtggtagcatcattctcaattccctcagtctcaaggtagctgccacggtcacttccctggggttgacgagaatggtagcgatactcagtgtcggccaactgatcactgtagcgatcgcggagctcgcctatggcgatccttgctacctcctgacatgcatggatgtagtttcttcctccagcttcgaacatcactgaggggatatcttcactattactgttcaaagtgactttgactcggcacttctcttcatgacgatcatgaggaatctaggcataaaaaggggcagtcccaaatcctgtggcaaaggacatcgtacgcaactcctggacaaatccctcaacaccaaacaagtactcaggcttgtagcgcggcatctaaagacaagtgaaaggagggagttaagacatttatccaattaatagcacaagtttttggattaatttgaataaagttagaaaatcaaagtaaaaggtaagtaaataaagtaaaccaagcttgcaagataagttgaaacagttggaaataaggtcacaaattttgtacttttgaacaacaggttccaacagagataaaagaaagttataaaatcaacatgctaaatttattttcttgcagcaagattaaataaaacaatattgtaaaacttttgctggtaaaatgagccattagtacagtaatagatgtacagtactaataacactggaataaattttgaatgaggaccattaaaagagattatgaagtgcatgtgccattagtttggtttaattaaaagagaaggggaggagaacagttctacttttccaatatttttagagggcttctatgggtaaccatttggcataacctagggtcaaggaggctctgataccaacttgtcacgcccggaatttctatccaaaattccaaacgcttacatgtgtgtgaaccctcgtccaggaatcagccgagacacacaataacaaattgataatagagtacaattattactctaattaataagcgaataaaatgtcattacagaggtagatagttcctctcaatcaataaagatctaagcagcggaaaataagataaacggcgcagacgactccactccacaggcagattgaccagggctacacctaatcctccacaccatcagcttcactgtagaactcttcctctgatgaatgattgcaaggtgagtatatgacatactcagcaagccacgcagcaaatatgcaagtgcacaggataacaaaggatggcatagtagggtttcattttcataaacagcatttaataaacatttcagaatttaataaaacagttaagtattaattaaacagtattaatccaacgctacacaacataccctgttgcataggcccaaccattctgaacaaccatcccggctgcacagttctatcttcaaaccaggaatataccattccaaaccaggagctaatcaaattattaccaattatagcatctgttattatgatgagaggtgtgaaactaatcacgaaagacattgttagacccacccataaccgcgggcacggctattcgaatagttttactctgatcagaggtgtaccactgtacccacaagacacagccccacatcatgtcaccatgtgcctcaataccaccacggtacctcggaaaggagctgtgacaatacccctcgcacaacacaatccactacagcgcacctttcctggatcataatcacccccttataaacaaggcatggactccccagcgacccctgtgggcttatctccgccacttctcagtctggtgctctgcaatgaaccacgctatacaaaaggtaaagccgttgcccacgctggcttgtggttggcacggttaatgtttcacaaccgaaactcgtgaaccggtccttaattgccatgagcacgactctcaaaaccatgtgctcacaacccaccattatcaggttttagttggcaagtaattaattaaccaatcacgattgaccatcgtgaactatcattaagccatcattaaataataatgaatcataagttatcccaatagtgtgctaatatttctaagcatggctaagcaatcacacctaatatctagctgaaccaatatataaagcccaactagtcaaattataataacccaaggtatcaaggaataaagtaatcaagaacaaaaagggctataacaaacaataggttaattccacccaatgacattcgaaaataaatgcaatagttgaatagaaacaatagatttaaacgggatcaacatgctcaaagggttgtttgggatctgtgtgacttgccttgctggccttggaactcttcaaattcttctcctgcgaaaacggactctccggaaacgtcggaatctaaatagaaaagagcaaaaaaaaaccaaaacagcacataaacaagcatgaacagtacatgtggatatttttaacatgtagatctcaattttagaaaaatttagagacttgaaccaactaaatccgagctaagatgaattagttatgaatttttaaagattaaatcgaattaaaacacttatatggattttaattgaattatgacgcaataatgaattatttttcaaaaagaaaaaggggtttgttgcgtcagcggctagggtttgcggtggaccgggcgcacggcagcggttcacgggaacgaacggtcgatatcgatcctattcaaaacggacggacgagatcgagcggtccacggtcggaccacgagggacgacgaccatgacgctagcgacgacgttaccaccggcggcggctcgggcgatcgggcgcgcatgctcgacggcgaacgacggcgcgaggacgcgaacggaggacaccaaaacgatgcggacatcgcggcgaactcaccggtgaccaaagcgacgacggaggagcaacggacgacgtcggcaacgaggtctaatcggcggagaagatcgggtcgacgggggcgacggtgctccggcggttgacagcgatggcggaggggcggacgaggacggcgaccgacggcgaccacgatggcgatcttcccgaacgacgacgacgactggagcgacggtgacacacggctggagcggcggcgacaacggcggcgctaggtcacacggcgctagggcgctaccgacggcgagaggcgaaagcaagggtggcgacgggtagaggagacaccggggatccttttataggggcaaggaggcggcggcgaaggcccacggcgaccggcgacgcgaaggaaacctcggtgtcggtgacatgggaccgggagtatcatgacttagagacttgaggcagacacgatcacccacgtggcctaaccccctcgggggggttgggcccgagggtgatacggccgcccttctctttgtctccccgaggggtcggaccgctcccgtctcggccccgagggccgaggcgccctgaccccttgtgggttttgcgccgcgtatatggggtaggtgagcatagcggggctcacctaaccatatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggccagatatataccaggcttcatcctaaccattacaagcaagacattgtatgaagaggggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggtaaccatacaagtctccgtctgtttatgaaaagataggataagtccccacaaaaaagagagagatggtgcatgtggtatccccttgaggtataaaaggaggaccttgcccacttagaagggggatttttcggatccagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttccacacacagactaggagcttaaaatctcacccagggcccccggccgaaccggcaaagggggacctgcacggtctcccggtgaggagccccacgctccgtcatctggcgcgccaggtagggggctctgcgggtgtttttctaagctctcgcattctttcgtgtgcgccaagcttttcctgttcagcccaatggccgaacaagcaaaggcgcacaacctctctccgagtgttagcggtgacaacggggagccgaacccacgccgtcgagctcgtactccatcgccccctccacgccaaagtcctaggcgggaggaggcgctcgagagggtcgaaggatccgcgacttcaacatccacgggtgatggggaagggcggcgagatggggagcgtcgcctcctcgtctacggcgacggcagcacgcctcagggcgcgctccaagctgcgggcgcgctcctacgtcacccgcccattgtccctgacccggagtctccagcccaacgttggctggacgacgtggccaacttggtcatgacggtacggcagcgcctaggtgctggtgggcggtcctccgccaccaagacctctggcgctgctaccaccggctccatatcgtcaaggcggagggcgcggcgagcggcggctgttgctcgccatttggccgccactccttcgtcagcgcctccgacctaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcagctgtagagcctttgtggcgagccttcggaacatccgttggcccccaaggttccagcccaccatcgccgaaaaatatgacgggagcgtcaaccccgccgagtttctccaggtctacacgaccgggatcgaggccgccgggggtgacgacagggtcatggcgaatttctttcccatggccctgaaggaacaggcacggggttggctaatgaacttgccacccgcgtccgtccactcttgggaggatttgtgccaacagttcaccatgaactttcaaggcacatatccgcgcccaggtgaagaagcggacttacatgcagtccagcaaagggatgatgagtcacttcgctcatacattcagcggttctgtc

SEQ ID NO: 77074 - DNA, 17303 bp, Oryza sativa
tgcatgatgatgattttaaagattgttgctgcattgtaaggatggaaagacatggaacaaattcttcttgaatgatgggtttgtttttagagctaacaagctatgcattccagctagctccgttcgcttgttgttgttgtaggaagcacatggaggtggtttgatggggcattttggtgccaagaagatggtggacatccttgctggtcatttcttttggccaaagatgagacgagatgtagatagattcgtttctcgctgcgctacatgtaaaaagtctaagtcacgtttaaacccacattgtttgtatatgcctctccctgttcctactgttccttgggaagatatttcaatggattttgtgttaggattgcctaggaccaagagggggcgtcatatcatttttgtggttgtgggtagattttctaaaatggcacatttcataccatgtcataaaactgatgatgcttctcatatcgctgatttgttctttctagaagttgttcgcttgcatggtgtgtcaaatacaattgtttctgatcgtgacactaaatttcttagccatttttggagaactttgtgggctaaattggggactaagcttttgttttctactatttgtcatccccaaactgatggacaaactgaagtggtgaatagaaccttgtctactatggttagggctgttttgaagaaaaatatcaagatgtgggaagaatgcttgcctcatattgaatttgcttataatcgttccttgcattctactacaaagatgtgcccatttcagattgtgtatggtttgttgcctcgtgctcccattgatttgatgcctttgccatcttctgaaaaaatgaattttgatgctaagcttttgttttctactacttgtcatccccaaactgatggacaaactgaactggtgaatagaaccttgtctactatggttagggctgtttcgaagaaaaatatcaagatgtgggaagaatgcttgcctcatattgaatttgcttataatcgttccttgcattctactacaaagatgtgcccatttcagattgtgtatggtttgttgcctcgtgctcccattgatttgatgcctttgccatcttctgaaaaaatgaattttgatgctaagcaacatgctgagttgatgttaaaactgcatgagacaactaaagaaaacatcgagcgcatgaatgctaagtataagtttgctggtgacaaaggtagaagggaattgaattttgaacctggagatttggtttggttgcatttgcgaaaagaacggtttcctgacttgagaaaatcaaaattgacgcctagagctgatggtcgatttaaagtgttagccaaaattaatgagaatgcatataagcttgatttgcttgcagattatggggttagtctcacaattaacgttgcagatttgaagccatatttgggcgcagaagatgaacttgagtcgaggacgattcaaatgcaagaaagggaggatgatgaggacatcaacaccaacggtacatccacgcttccacaagtacaacttcatggtcctattacccgcgatcatgcacgtcaactcaactatcaggaacaatggagattatcaaatggggagaggaatcgcacgggatggattcggactgcagcacagcacaaacttctgacggccgccacgacctcatgcgaactccgatttgggcgtgcaagtacttcatggaaagcttgtcaagtctactttcaaatggatccagcctcatttccatatcagttctggggcggccgcaatcttcattttactaccgagtccttttctgtccacggtgttgcatcacctctttgggcccaatgggcggtgtatcaagttgggtccattagggacgcgtcctagggtgagagaacgaccccagcactcctgtggtcgtcctcttcctcttcttatagctttctccaccgccaagaataatcgggttttgtttagatcaaagtatagcgtcactactttgccgagttgatcccgtgatcgattagatcgctagattgcttgttattgaaccccacttgttacttctattgattcaatccaacatctttgatttgcaaatttatttgcttgttcatcttgttcttgctggttctcgattgcttgcaggaacaaataccctcgtgcttgggctgatcgtgcatccgtcgagattcacgactgcctctagagttcgtgtaacgattgttaaggcgcagcatccctggatagttgtagtcggatcgccaatgtcactccgtccaatcgacttatccctctcatcgaaagatcgggacatcctcgagcacatcactatgcaaaccgtgctgctgtcaatacctaggacaaatgctctacgacattcctctcaaaattcttcccgatgggcaaaaaccaatgcccttcgtggaaggattttaagtttccagcagacaagggatgagtctattccggaagcatgggaacgactgcaggagtacgtagccgcctgtcctcatcatgggatggatgactagctgataatgcagaacttttataatagactcaccccgatgtcccacgatcacctggacgcggaagctggaggagctttcttctctaaaacggttcaaggagctgttgatctaatagagaagatggtctccaatatgggttggagcgaggaacgacaccagacccgtcagcgaggcatgcacaccgtcaaggagacggagttacttgctgccaagctggacctcctcatgaagcgattggacgaccacgagaaatggccacaaggtaccatcaaggccttggactctcacgtcacatgtgaggtctgtggcggcacgggtcattctgggaatgactgcccggaaacccgtgaggaggcgatatacatgggcaacaacaacaacgggtatcgtccacaaggaggtcatgggtggaaccaaccacgcccatattatcaaggaggtaacaacaacggtaatttttctaaccagccctccttgagggatctcatttttgcacaagctaaaaccaccgatgcactaagcagaaaacttgcggccaatgacaaggtcctagaaaacataaatgtcaagttagatggctttgcttctgcttttcaaaatcagctgagctttaataaaatgatagaaacccagctagctcagttggcatccttagtccctgcaaatgaaactgggaggatcccggggcaaccctactcctccattgaaaatgtcaaggcggtcatgacgaggggaggtaagtccactcgtgatccgccatatcctaaccatgcaggaactaatgggatatcaaaagaagtgccatctaatgattcggctgacaaggaagttccgctagaaaagacagtgccgcaagagtactgcgacacacggttgctgttgttccctcaacgaagtaggaaaccgtcagtggacgagcaattcgctcgttttgttgaagtaatccagaagatccacatcaacgtgccgttgttggacgccatgcaagtgccaacatacgcccattatctcaataatatactcaacaacaagagaccgctcccaacaatggaggtggtcaagccgacggaacaatgcagcaacgtaatactccacaagctcccgggaaagtatgatccacagtcagactatccgaaaatatcagatagtctaatgttggatcagactgtctgatccactaaagagtcaccacaagtagatctatcacacaaacaagagtatagcgcaaacagtgactagatctatagcggcacaattaagcaaagctaaagagaggatatagagagatcaccaacgatgaagttcgcggagttgttccaggagttcaaatccttgaggggattctactctccgttgaggagttcactaagagccaggtctttgctaaccctttcctaaagaggttgtactaagcactcctccttccactaaggggtatctctttccttgtggaggcaagatccggccttcgcaaacttctccctgccaaccacacgtagatcggtggctcgggagtgacacctagccgtctaggagtcctcgacctcgaagagtaacaaacaccacacaactcttggtcaaaccctagtgctcaagatcgagtgaaacacacactaggtcctcaaacaccaaatccacaaccaacaagatccaccacacaaagaacgaggaggtatttgaaagagggagaaagagctcaaagatccaaagcaccttagcaccaaactcaacccaaagtgaatgagaatgaatgagttgggtaaccctagaaaaggtgggggtatttataaatcccccaaaaagtggccgttaggagagactcttttcatcccacctcggactttccgaggtgacatcggatagtctaatgttttttttgacccccaagcaagcccgagacagaggacaaaattctggagaatttcggacaatccgatcaatcggagagtccgatgtcatatcagatattccgttatttttgaagcaagaatttcatcatcttacagagactcaagttccattgaatttcggagtctctaggtcattggatagtccaattctttttagccaacacttagaccaaagacagagatcaaagttctatgaaatttcggatagtctgagcatcggatagtctgatcaaaatcggatagtccaacaggataaattcaagaacacttcaagtaaaggattttgagcactagtgttctaccaattatatgcatgtggtatccctcttaatagtacggcatcctaatactctcaagaacacaagatatacatggtttagaaagacgattaccacaaaagatgccacaatgcttttaaactcaagttccactccttttttatccttgcattcatctcaacaaaaagcattagttttcttctaattgtgttgtcatcaacaccaaaataaatgaggggtactagatgcactttcaatctctccctttttgattattgatgacaacacaattagaaataataaaagattaggattttggtggagctcccctaaagatatgcttgaaatgaataggagagctccccctcaatctatgcaatagattagaaatgacaatataacctcatgcatatgcaaatgacaagatatatcacacatttaagcatggataagatataattccacgtaacatcattcaagcctatagagttcaacaagacataaacatgcataataaagaatttaaacatgacacaaaagcccaaggttcgactagccatcacgaaaggggatagttttttttttttgataggtggttctccccctttggcatcaaggcaccaaaaaggaaaaacagagtggatcactcatcctcatcaaaatcctcgtcctcctcacttgactcctcaaaagcaaaaaaacggaaaactctctctccgcgcgcgacacatgtagccttctcgccattttgctgctgtctcgtcagggtgtcgttttcttctcaacttgtgactagctttagtaatgctgacggtgacaaactaaaaccaggtaattgtccgactcacatataattaaaattgagcaacggctgcaatacatatgaacatgttcttttttattggtctatgattatatatctctagttgtatatcttaacttcttaaaaaatcggtaattttgcattcgtcacctaaatttttcatccgttttcatccgtcggcgcttgcacgcggagtcaccttcagttatccaaaagagaacggacgggaaatttcaattcgaatcacatactggattcatggagcattaagccaccggtgggagcagcgcgggtccgtccggcccttcgctaggaagcggcatcaccgccgtcgtcgcctgttgccgtcaccgcaccataccccgccatcaaggccgacagggagaaggagagggggagggacgtccattgctgccctcgctgcaccgtacccccgccgtcgccgcaccgcgtcgtactcttgtcgtcatcgcgctgtgctggcaacacgggaggagaagagatggggagctgcgccgccgttagggagaggacaggagaggcgaagaggcgccgccggtgggaggaggcggaggggaagcagcggagagggagcagcagaggggaagaggcggcgcaacagggagaggcagccgacggtgggggaagtgggagagggaaaatgaattagggttaggttttttttgtaccggtggttttgattgatttggaaccaatctaagccatccatcaaaaacaaacggctcagatcgatcccacgtcaggccagcatcagctgggccatgcacgcttgatggaccgcgcgcgggctagcgggtctaacacaacgcttaggctagaattttgcttggggcccacacgacagtgagaggaggagttgggatgactaattagacttgtacgttgggctggacgcttgcttgcggaccgaggtggaggggaggagaagagaggaaagcatgccgctcggttgcgggctgaagaagaaaatgggcggaaaatgacccgaagagaaatgtggacttttatttagatttatttaaataaagatgatgtttgtattatcaaaattagcaattaagttctagaaattccaagaaattttcaaagactattattaatcatggttaattttctcacgcttactttgcttgtaaattaatttaattatactactacgtacttaaaaaatacccaaatattccggaaaattggtatttcaattaattacacaatgtacattatctttctcaacttttcctcaattttttctttttttttaccattgcaatacacggacacttttctagtaagttatacagctgaatcgtacgtataacagtactcctaaaatctccaaatactagtagtgatcatgggttcatagctaagctaccctttcacctccatactctcagtctcagaatattcttaatttttattcatcctaattatatcaacacaaaattaaaaaaaactaaaataccccttatttgttaaatccaaatacaattattctttactttatctagtttcaatatatttattttctgtttttataaactttgatgtaatgataattcaaaagttaattcttttttaggacaaaggataaacgatgattttattctaagacggagaagcattcaacaactcccccttgaactcgtgtggactagtatgtttttcaccgtatcatgattaagtgatcaaggacggctcggtcatgactcatcgaaagagagaaaacaaggagtgaaaggtatgtgtgaatactaatgttctttaggagatttccttcttccagaattaatacctcagttcaaaaacaaatttattttttccctattttatcaaattttattacaactatttgtttattttatcttctcacaatataattatttatattcttataaactccgatgtaatgattatttaataatgagcttattttgaaataaataaaataaaaataaacttattacgatacggaggaagtactgatgttcttttcaccgaacggtgagatttcactattcacatatcatgacgggaaaagggaccgcattaattatcgacaattctaggtgatctgacgtcatcagtcatccagaggtattcccgcacgaaaaaacaagttagagtaaatttaataaaactatatggcctctttaaatcgcagtgttgaaaaaacagaggaataggaaaaacacatgattctgacaggaattaaagtgtaaaacagagtattgcaaaacatagaaaaaacacaggaatggtcgtttgattagagcgcaggaaaaacgtaggaatcggatgagagagatagagtaaaggaaattttccaagaggttggagctcttgctaaattttctccaaaatccacatgcaatgtgtcattccataggaatttcataggatttggaaagcttcaatcctttgaatcaaagggccaaatagaaaaatttcctataggatttgaatcctataaaattgctacataaatcctttgattcaaaggggccctaagtaatttggtcagattataaaaaaatatacatatttaataagatatatcacaaaactatagatttgaagataaataaaaggaaccgtttataaagacaaataaatggagctaaaaacaaatttattacggaatattttttttcatttaactcacacatatcaatacaaaataaaaataataacattgccattctttatcaaatccatacgtaacactaatgttaccttttagaaacatgatagtccaaggacaccagccatatttttattttttcacataataatcatcatgcactttaacaataatcattatgtgtaaaaaagaggtcttctcattctaaacctgcacaataattagaaataagaattaatatgtgcatcaccaattcaaatcaagattgaaaaaataatactattcactaatacatgcgtctaaaataaacaggaagttataggttcttcagaaaaatgatcatcgtatagtctccaatgaccagccaatcatacccaattaatcacctcatgtccaaatacagacaggggcagagctagagcgagatgaggggagtgccacttgtttaatttactctgctttatatcaagtttaaactaatacaagtgtctaaatatgtattgaggggtgcatatatagtgaaaataagttaggtatagctccaaaaaaaatttttgaccgggttcctgggcacccccctcaatacactagctccgcccctgaatacagacccaccttgcattggttctttcatgttctgatcgtacactatttgaaccgtctcaaaaataaattcattgttgtcatccaacaaagactcatcatccagtagcatttggagggagttgcatcgacgactcatctctttgtcttttaacacgacgaggacatgtaaggagaggtgggacagcaacaatgggagatagaggggagggggaaaggagagctgacaggggatggtgggggagaatggcgtcggggaggcagatcagcatcgatcagggagtgcgtgggagaaaaatcgtcgtcagggcatggagcgagggagatcgatgcagcattggggcaaggaggagtgcctggaggatagcgtgatcctcttcagtatggtaatagaggaaaactagatagaagggttcacttttactttttggaattcaaagagatgaattttttcactttctattttcaatttaggaaacaaaaacaaaattttgggtgggttattcacattatgttggtgatgctcttaggaagaatgtgtagtacttgctgcctcagctggcataattttattatgtcccattaattcaaataagagtgacaccgttgcttaaattgatacgtttatacctgattttgtaatctaatatgatgggatttggtgagatgaagatgacaataatgtattatagcttttgtcctgaaatttatatacgtacccccccccttccaagatgtgtccatttttcacgtttaaaactttgtcacaagatattatatctatttataaagtattatatccaccaataaccacctttcattttaattttcatccaatcttgtcttaaccaccttatcttcaaccattctcattgaatgagaaattaattaatccatataatattttttgtccaccccctctaaaacaaagagaggtcagaagagaatgggcagtagttaatccatataaactgtgcacagcacactagacagtaactgcagatggatactatcgatctcttaaccagtacaaacacagatgatgttaatctcaacctatctgacaggggatagggtagattgtcatgctccactgatgttaacattgacctttacagttatagatactcctgtaaatatatactgtatatatatttggagacaaatcttcggccgagtttagttctaaatttttttaaaaaatttctaactttttcattacatcaaaactttcctatatacaaattttcaaattttctatcgcatcgttttagttttaaccaaacttctaattttaacctgaactaaacacacccttcctatcttttcatatgtgaacgcctgtatttgcccgcatccagagtccccctttgctgctgtctcgtcagggtgccgttttctggagtactcatctgtgactagctttttttcatctgtaaacgcctgtatttgccctcatccagtcaagtcccatttcgctgctgtctcgtcagggtgccgcatccagttaagtcccattttgctgtcatcttcgactagctttagtaatgctgacggtgacaaactaataccagagaatcgtgcaactcacaaattgatctaactgttacaatacatataaacatattatctatggttatacgaacaattcagttgttcccccctatagccaaatcaaacggggtctcatcttaacaactcatcggaaataagcgtacttaatttcatacctctctttaatcacaaattaccttgtactggctccttccatcaccttgacaaaacttattagataccctcttcatctcagaatataattatttcaagtgtttaattttttttcaaactgtaactcattctccaattactcgccatatttgattcgatcgtaactgtcttatttaatttttttcacctaattcttcatcttaaccaattacaatcatcccacgttataattttacccttcattctataaacttcatagagaaaactttcttaaattctttacaggtgctcttctcttcttttctttatatgtgcttacacataatttgtagcatgctattatactcgttctgatgaggtggaccgacctgttgatgaggaggagtggaggacagagcccagtgatgacacaagagttagccattttaattatttattttccttccggtggggagccaaccgattaccgatccaaatcaggtccccggtcatgatcatctacaactactagagcaggtgtttgcgtcttgattaatatcgctattattatatcagtttcgtccttatagcttatcatatactccctctatccaagaatataaaaagttttaagattggacacggttattagaaaatagatagaagtagtggagggttgtaattagatgagcagtggaagaatgtgggaaaagttaacggtggagggttgtgattagttgggaagagaatattggtggagaagttgttatattttgagataaatcataagtgataaaagttgttatattttgggacggagagagtatcaatatatataataagggcatcctcaatatttatggtgtagtgtaattttaaggtgggccctatgaatagtgagtcattgttatagccatatccacaatgctatggttagaatttagccacaagatggcccacatagaatggaaaaataattgtttcatctcttgttcataaagtgaatgagagagaaaaaatattttctttttgcttgtggtagaacttaagcataaggtgcactctaagctaatgctattttccacaatgtatatagctcactttacaagtgcaatcattatcttaaggttatctttttcatacataataccattataataaaagatgtgaacccgaggactctttaccctcgcttctcatgcctccgctttcgcattcattacacactagcctattaaatcaggcattcgcgtgactatgacctgttttttatttggatatatacttgtttgtttaaggacagatgacgttttgtgtttatctgaccataattgttgtctagaattttctcttttatcctttcttaatttttttttgaatggccttctggtaccaaggtccattcggcctcatttgccagcatagaccctttggaggatccaatataaaatatttatgagcaaaaatagtttctttaaacatgaaaatagaaaaaaaaaggatatagcccttataatttaatcctattttgtacttatctatatttgctcttagcgctatttatttccaaatattttaatttagcgtatagaatagtagtactatattagcttctaattaatttattattaaggatcgaataactgattcgtatgtgtttggagatcatttgaattggaattgtcttatacattcgtgtaagaagtgctctcattttgaatggttgcacgtggagaagcattaaaaggtacggagtagtagtaattgttggtttcagaaggggaaaaaaaaagaaagagcacctttgtcggttaggagtatgatctaactcaactgaaaacttccatgccatttgtcacaaatttgctaggcttaattagatcaacagagaggttgttttaaatacttttatttacaggagatataggataaagaatattcatatgtgctgaaatgcaaaagtggcatgggcatcaccttttttccacactggtggagaaaccatctttcgtcggtcggcctaattccacaatagtctcggttgcaacaaaaaccgatctttagtcccggttaaaaagggtaacgggcatatatatatatatatatatatcttcttcctcctccagcccgagcaagctttaaaatttcttcaaaaaagaggggaggtcatgccaaaatttctagtaaatttattttggtgattatatacaaatcggaggtgcctaaaaggttagcaacttcatcctccaatgttttttttgtcatattacatttggagctatgtttagcacacttttttgtctccaaaattttgttgtaagttgatgagagagaaaatttctgtggggaataaaaaatatatagaaatttagtttatttgctaaagaaggttttataaaatagttgagaaggaaaatatagcaaaagttaatcttgaataatagaaaacaaactaaaatgaaaattaaaaggagtacaacacattaatattattttaaaactttagaaatagtaaataagaattatttggtgtaatatttcataatttttgtatgaataatgatatgtcattattgtgtgactgttgaaagagtttgtaattattttataattattgtatgagtgtcattattgtacgaataattatttgtgtacgattttttttcatgtcatgtagatggatcggaaatggatgtacgctgaccggcggtccaaagagtttattgatggcgtgcattattttttgaaagtggccgaagctaacaggcaaaagggtttaatttgttgtctatgcaataagtgtaagaatcagaaaaagtattctgcatccaggactattcatttccacttgtttgagtcggggttcatgccaagctataattgttggacatcccacggagagcaaggtgttgaaatggaagaagatgaagtggaagacgacaatatttcggactttgctcagtacgctggatttgaaataaatcaaacgggcgaggaggaaagggatgctgatggtaacgacgttgcggatgatcttggtcagatgttgcaggacgtcaaggaggactgcgaaagtgaaaagggggcctataaattggacaagatgttagaggaccacagaacgtcattgtacccaggttgcgagcaggggcacaaaaagttggatatcactctggagttcttgcaatggaggacaaaaaatggtgttagcgagaaggcatttggcgatttattgaaactcgtcaagaacattcttccggagagaaacaaattgcccgagacaacgtacgaggctaagaagatagtctgccctctaggactggaagttcagaagattcacgcatgtccgaatgattgtatcctatatcgcggtgaggagtacgagaacctagaagcatgccctgtttgcaaagcactacgatacaagattagacgagatgatccaggagaagttgacgggcagctaacgaagaagagaattcctgctaaggtgatgtggtatttccctataatactacggctaaggcgtttgttcaggaacaaggggaatgctagaatgatgagatggcacgctgaagagcgttaacaggacgggatgctgagacaccccgccgatggttcgcagtggcgaaatatcgacagaaaatttaaagactttggaaaggacgcacgaaacatacggtttggtttaagtacggatggcatgaatccttttggagagatgagcagcggccatagcacttggcccgttacgatgtgtatctacaacctccccccttggctatgcatgaagaggaagtacataatgatgccgattattattcaaggccccaagcaacctggtaacgacatcgatgtgtacctaagaccactggtcaaagatcttaaactgttgtggaagaaggaaggtgtccccgtgtgggacgaggacaaacaagaggagtttaacctacgagcgctgctgttcgtaaccatcaacgattggcctgcacttagcaacctatccgggcagtccaacaagaggtacaaggcttgcactcgctgtatggatgaaacagaaagtacgtatcttaagcactataggaagattgtgtacatgggtcatcgtcgattccttgcagcaaaccacccggtacggaagaaaggcaagcactttgaacataaggcggaccaccgtacgaagcctaaacatcgcagcgggaaaacagtgtttgctatggttaaagatcttaaagtagtgtttggaaaggggcctggtaaccagcctatagagagcgaagatggtcacgcggcgatgtgcaaaaagaactctatattttgggagttaccctattgggaattcttggacgtccgccacgtaatcgacgtgatgcacctcactaagtacctttgcgtaaaccttcttggcttcctaggtgtatatggaaagtcgaaagatacactggaagcacgtaaggatctgaagcatatggaacaacgcggtgaccttcacccggaaccaaaggagaaaggaagccattacttgagtccagccagctacactcttagcaaggcagagaaggaaagtatgtttgaatgcttggagagcatcaaggtaccgtctggatactccatgaatataaagcgaataataagcacgaaggagaagaagttcacaaatctaaagtctcatgactgtcacgtgttaatgacacagctgctaccagttgtaataggggtatcctcccagacaatgtccgggcaacaataacaaagctatgtgctttcatgaacgcaatttcgcagaaggtcatcgatccgaatagattagaagccctgcagaatgatgtggtgcaatgtcttgtcagctttgagttgatatttccaccttcatttttcaatataatgacgcatctgctttgtcaccttgtcaaagagatcggtattctcagtcctgtgtacctacacaacatgtttcctttcgagaggtacatgggcgttctgaagaagtatgttcgtaaccgtgctcgtccagaggcaagcatcgccaaggggtatggaacagaggaagtcattgaattctgcgtaaaatttatcgaagacctttgcccaatcggggtacctgaatcacgccatgaagggagactacggggaaagggaactctcggaaggaaagcaataatgacggtagacaacaatttattccgtaaagcccatttcacggttctgcaacaatctgcattggtggctccctacatcgaggagcacttggctctagttcgcgccagaaacattggtaagtccgatgcatggattacacggtatcacattgatactttctccgcgtggctgcgacaacatctcatgagtaacgagacgattaaccaacaactggccttcttggcgaggggaccatctggctcgatcgcgacattccagggatatgaaatcaatgggtacacattctacacgagggcccaagacatgaagagcacgaaccagaacagtgatgttcgtatcgatgccataggtcacgatggtacaactggcacgtattacggtgccatcgaggacatatgggaacttgactatggacctctcaaggtccctctgttccggtgccaatgggttaggttgactggtggaggcgtaacgattgatgacagtgggatgacaacggttgaccttaacaaggttggatacttggacgaaccttttatccttgccaatgatgtaacgcaagttttttacgtcaaggacatgtctagcaaaggaaaaaagggcaaagggcctgacgagccgaagcgccaagtggttctcccagcaaaaagaaaaatcgtcggagtagaggacaagactgatgaggattacgatcagtttgatgggcaaccccctttcacggtgacgattgaccctagcatcctcctatcaaatgaagacaccccttactcacgtagcgatcacaaggaaggaacaatagtgaggagaaagtacgtgcggtcaaccgtcaccgccgatgtattgccgtaattgttgtgtacacgatgtaaactattttggatgtattgaatatccatacaaataaattgttgtatggaatatgctaattatgtatgattattagaatttttatcaaattgaaatcgtccatatgctagttatatatgattattagaatttttaaaagttttaaatcatgcacgtggtatttacatatgttaattagaattttcaacaatttattatcatgatatgctaattatatattattattagattttttattaattttaaatcatgcatgtggtatttacatatgttaattagaattttcaacaatttaatatcatgatatgctaattatatatgattattagaatttttattaattttaaatcatgcatgtgctatttacacatgttaattagaatttttaacaatttaatatcatgcatatgctaattatatatgattattagaatttttaacaattttaaatcattcatgtgcttattatatattatccacttattctactacatacaacaataatttttcgaaggttttgtcattaattgttcgactttaaataattttaaataattgtaatgcattatttactattttagaaatacatatgtaatgaagttcaagacacagctgctattatctttagtcccggttcttaaccctaaccgggtttaaaaagaatttggaaatagcgggaaaagatctttagtcccggttggtgagaacatccgggagtaaagatatctttactcccggttcgtacgaacaac

SEQ ID NO: 77075 - DNA, 11583 bp, Oryza sativa
tccaaattccatagtccacatcgccaatttcgtccatgtttgtgaagccttcttgggaattaagccccacttcgctctgtttcgccggatcttctttctcaagccccaaccgaacaagagtaagccatgtgtagtcgggggggctggatttcagctgagggggactctgagccagaagtacttctctatgcctttcaaaacctcaaacaaagggtggcatgcaaactggttttatattcagaatcctgagcctgctcttcccgagtactcttgtcttcctccggtgtacctagatacctggaactctcttccgattggggatgaagcagcccaagccttggagttgatggatcgcatgctaaaactcaaagaacaaggcttacaaggagagcagattactcggcacttcatcaaatgccgattggcaccaattaaagaaagatctcgtacggcattcgagtttgacggcaagcatgatcctaaccgcgaagaaccagattctttggattttaaaatcatgaaggagagaatgtataaaatcttctcaaacgctattgtcgtcagctactcacatcagctgccagttgtgccatataacgcattcaatccgcctccgcaggtatgtatctgaaatcttcaacctatgaccaaaacattatcttgtcttcatgttgagttaactaaccgtggaggcatctcattcaggaatatgtattgatgaaatctgatcctccaatcactcagcgccggtctcctcgccagcacaccgttcagggaggtggagggccaacaatcagatcagatccgcaacctcaaacctccaatccaactggacagacaggttctcgcaagagaaaactggtacttgacaacgatgaaggcgacgacgacaacaaatctggggacaagggctcgcctaataaactcccaaagcgtaccatgcccaggaaaaaactggctaaccgcccaacgccaaagattagaacatcttctaggtataaaacctcttggtaccatttcacttcggcacgcttctctcatgaaaataatactgaatattgaaagaacactttgcaggaaaccatctgacatagacccaactggaaaagatcctgatccggctgtgacagagccaaatttatccaaggatcctgagccgactggcgcccatgcttcgggtgataaggccgatccgagtgaccagccgccgactggaaaccagtcggcagcagctgaaactgcaacaacccaagagcccccgactggaaaccagtcggatgtaggtctcgatcaagaaatccccgaagttgaagcgcagacgacaacttctcaaggaccagaggctggtaacgactcgatgattgggtctccaaataaagaacaaggatcacctcacgctcagctaggaacatcctcaggtaacccgtcttctcaagtgatgctgatttaaataacctcggtttattcgtctaacgtattggaaatacatcaggaccaccaggcgatgatgaagaagagattcctcgcataaaagcggctgatgactctcgtcctccgatcttgctcaaatggtgggatgaaaactcacaagctgccggcatcgtcataaatcgtcaaaaagaggatgaggaagtgtgccagctgaagaaggcacttggagaagccactcgcatcgtgaatgtaaatattccgggtgactgccttttgacgactttgttttctcttcagcaaaactaaaccatgaaccatcatgcagagaatccatcttcgtaatgaggccaagaccgcaactttagaaaagctggttcctcatttgggaactcttgaagcagttagggaccagctacacgaggccaaggagctcgccaaaaagacagagaaggaattaagggaccgaattgcccagctccaggattcaaactacgagctgagtggttcatcaaaaggtaatctctagatctgtcccattaatttatgctgtcataactgtatcctcaactattcggatttcaaacagcgcatgccgccaggatggctcaaatggagaaacaaattgaagccctggaaagagacaaggtagaactggctgcgcaaagggactcggccttgaaggaggttgaaggtactgccagctgacaatctgaacttccctctttttaatgcagcagattcttattataaatatgttttgcagaccgcaaaatcaaatctcaagctcaattcgacgtcctggttggtaagatcaagaggcttgaaggagcaagagatgaagtcgctaatgtcgctgccccactcgtccaagctatgttcctcaataacagtggtccgagtgcactcgacgcaaccgaaattttcgacaagctgagagttgctccggatgtatatttcaagaacatcaagaaagctggaagtatgggagctagcatggcattggcgatgaccaaatccttgtacccgaggattgaaattgacgccattgatggctttgcagacgggacaagcgaagaggctgctcttgatcttatcagcaatgctcaaaacgcggctgacaagattgcaagtgacgttgtagatcaattccgcaatactgaccttcagccgagtagtaacaactctgatgatgaaaagactgattctgagtgagtatgaatgtagcaaatggaggctcaacttgtacaatactggtgtatttatgctgtgcttgataattctagccaagtctttgatttcttaaaagcttttatcaagctttgttgagcctaaaacccaaagaagctattaaaaactttcagtcctcgcaaactaagtagaaaaatcgaacaaggcaatgataaaccaagtaagcaaattgaattgataaaaaatcacactacgttattatgatgatagcccccgactgacaacttcaaggagaaaacttgatgttgacagtcaagatagggaagtacaatgataagcctaagcgtagaaacgacgaagatgttcaatgttccaagagttgtcgacgagagtaccgtcttcgcgcttgagtcgataggaacctggccgggtgacttcagagatgataaatggcccctcccatagaggagataacttgtgccgatcccgtgtagtttgaattttcctcaaaaccaggtcgccgactaaaacggcacgggatcgaacattgcgattatgataacgccgcaacccttgtaagtatcgagccgaccgaatcaaagctgcttcgcggacttcttccagtcggtgcaagtcatccactcggtcctcttcatagcgttcttcgcggaaattacgaaagcgcaaagactcgaattcgacttcactcggcaacattgcttctgccccatagacaaggaaaaaaggcgactggcctgtggcccgactgggtgtagtacgcaaagaccaaagcactgatggtagctgtttcacccatttgccggcatagggttttagccggtcaaaaactcgcgctttaatcccttgaagtatcatgccgttggctcgctccacctgtccattgctcatgggatgtgctactgaggcataacaaatcttaattccaaagtcttcacaaaagtctttaaaaactccgccagtgaattgtctgccattatcagtgatgatccgattgggcactccaaatctatgcacaatattgatgaagaagtctcgagcgttatctgctgtaattgtgacaaccggtttagcttcaatccacttggagaatttgtcaatggccacaaagaggtgcgtgtaaccgccgactgcctttttaaacgggccgaccatgtcgagcccccaaaccgcaaacggccaagacagcgggatagtctgcaactcttgagctggtagatgaatttgtctggcgaaaaattggcaaccttcacatgtgcgcacaattttgtcggcgtcggacactgcagtaggccagaaaaaaccctgccggtaagctttgccgacaatggtgcgtgcagcagcatggattccgcatatcccagaatgtatgtctttcagcaattgtctcccttcctctaaagatacgcagcgttgcagaactcctgaagggcttttcttgtataactcagcttcatgcataacataaagtttgctccgccttgaaatccgctcggcttcatctttgtcttggggaagttcttgagaagtcaaaaatcgtatgaggggctctcgccagtcggcttcaaccatagctacgtcatgagtgcccgcaacttgagtagtatctttgtgaggtactgtcggcgtataaaggtgttcgacgaaaacatcagagggtgccgcctcgcgcttggatccaaagttggcaagtctgtcggcggcttcattattgtgtcgaagaacgtgactgagctcgagtccatcgaacttgtcttccaatttgcgtacctcttgtcgatacgccatcatgttgtcgtcaaggcaggaccactctttcataacttggttgacgaccagctgtgaatcgcctcgaactattagacgctttatccctagggaaattgcaatccgcagtccatgaaggagcgcctcatattcggcgacgttgtgggacgccgaaaaatgtatccaaagcacatagcttaatctttctccagttggggaaattagaactactcctgctccagtgcccgaaagtctttttgacccgtcaaagtgcatggtccagtgctccatcttctccgcgggggtatcctcctggcactcggtccattcggcgacaaaatcagctaacgcttgggacttgattgaaattcggggcttgaatgatatgtccaaagacatcaactccaaggcccacttagcaatccgtccgtttgcttcgcggttgtgcagtatatcaccgagtggaaatgatgtgaccaccgtcaccgagtgaccttgaaagtagtgagatagcttcctggtagtaattagaataccatataacagcttctgaacctgggggtacctcgttttggagtcggctaggacctcgctgacaaagtaaatcggtcgctggactttctggacatggccttcttcctcgcgctcaacgaccaagactgtgctcacaacctgggaggtggctgatacatacagcaacaacggctcctgcggatgtggtgaagctaagactggtggctcggtgaggagtttcttgaaatcttcgaaggccttctgtgcttcgggtccccactggaaatcatctgttttcttcagtagcttaaagaagggcatcccccgctcgccaagtcttgaaacgaatcggctgagcgccgccatgcatccagtcagcttctgaacatctttctggttacttggcggtttcatgttgaggatagcagtaactttctccgggttggcttggatgcccctatgagacaccataaaaccaagcagcttccctgacggtactccgaaggtgcacttttcagggtttaatttcatcctgaaagcgcggatgctcgcaaaggtttcttctagatccgagaccaaatcatccttttgcttggtcttgacgactacatcatccacataggcttcaacgttacggccgatctgcgttgagaagcatctctggatcatacgttgataagttgctcctgcgttttttagtccgaacggcatggtgacgtagcaatatgctccaaagggcgtgatgaatgaagtcttcaagcagtcagattccttcagtcggatctgatgataccccgagtagcaatccaaaaaactgagaagctcacagccggcggtcgagtcgactacctggtcaatgcgaggtaacccaaaaggatctttagggcaacatttgttgaggtcagtataatcaacacacatgcgccattgccccgttttcttccgaactagaactgggtttgccagccagtcgggatgaaggacttctttaatgaagcctgccgctaacagcttagttaattcctccttgatcgcgtctttcctgtcttgtgcgaatcggcggagtcgttgtttgataggcttggcatcttctttgacatgtaaggagtgctcaatcacctctctaggaataccgggcatatcagatggtttccatgcaaagatatctttattgttctgaagaaaggtgatgagcgcgctttcctatttacaatctaactcggcgcctattacagcagttttagtagaatcagaaggatctaggggaatctttttagtcttggcttcgctttctccactttttgagatcttggtagcgggcacttctccttcgctcgccgtggctgcagccagtcggatatcctctcgagcagacgccatctcgcgggtttgggccatgtcgcaactctccttgtcgcatgtgacggcttgcttgatgtcgctccgtagggataggactcctcggggaccaggcatcttcatcatcatgtaagtgtagtgcgggacggccataaacttggctaacaccgggcgtccgagtatggcatggtatgctgtctcgaaatcggcgacttcaaagctgatattctctgtgcggaagttttcccgagtgccaaaagtgaccgggagggtgatctggccgagtggagttgcggataatcctggaattactccgtgaaaaggcacattgcttggttttagctcggagcgaggaatctgcatatcatccaaggtcttggcgaagaggatattgagtgcactgccgccgtcgatgagggttctgcgaagtttgacattacggaccactgggtctagtaccaggggataccgccccgggtggaccactcggtcaggatgatccgagcggtcaaacttgattgcaatctctgaccatcgaaggtattggggcgtgtcgggctgaacagcattgatctcccgttcggtcaacttttgcttccttttagactcgtaagccaaggggccgccgaagatatggttgagctccttgcggtggtcttgaaatcctgccggggggtcgccgtcgtccttcttccttgacgtgctttgttcttcgtcagagctcttccgtgtaatcttggtgtattgctccgcgaattgcttgtagacgaaacaatctttggccacgtggttggagttaggatggtgcgggcattgggagttcatgatcttgtcgaacgtgttgacgcgcgaacgttgtcgagaagagtgactggcggttgcaacaagttccgcaggcttacgcttgcggtcctaatgattgttacttccacctcctcccgaagccggcgtatccttttttggcttccaactgggacccgactgctttgatgcggtgacggcgtcttcagctttggcgtactcgttggctttttcaaacataagcttgactgtcctgggaggcttacgcccgaacttgccgaccaattcttcgtggcgaatccctttggtgaatgcagcgatgatgacgtcgtcggtgatgtcagaaatcttgttacgttgttcagaaaatcgccggatataatctcgaagggattctccggacttctggacaacgttgtagaggtcgtattgcgtgccgggacgctcgaaggtgccttggaagttggcgatgaagtggtcgcgtaattcagcccaagatccaattgtaccacggggcaatccatggagccaagatcgggcggaatccactaaagccactggtaaatagttcgccatggccttgctgtctcctcctgctgcgcggattgcgagaccgtagacggtaagccacgattctgggttagtggtaccgtcgtacttctctattccagtcggcttgaagccggctggccaatccactcgacgcaggttgtcggtgaaggctgctactccgtcaaggtcgtcgtcgtggcggtccggcgaatgatgatgacctcgagctgctcggcgctgtatgattgtgtcgcgaagatcgacggggcggcgacgaggtggtgagcgaggccgttccactcggcgctccctatgatagtcgggaggtgagtgaacggaccgctcgtcgtgacccctgctcctgcgattagatcctgcgccggtgatgctgaggctcggatgacggtagtcatgagatcggaagtgagggactcggctgccagtcggcgtgtggacgctttcggagttaactgggaccgaagccgcaatcatggtcttcgtctggttcaagatattgatgacgtgatcagattgattaagctcgttttccttgaggagggtgtcgaggagggtgatcgcggcaaccgcattctgttgaggggtgcgaaaaaccgcgtgtcccttcaacatcttgttggccgatgagatcacgcgctcggcgccctgcttccaaagctcgctgccgtcgatcctcagcctccttcgcggtccgctcacgctcctgttgctcacgccgtaaccgttcttgctcttgtgcttgacgctcctcctccagtcggcgacgctcagtctcgcgacgtgcttcggtctcccgggcttggcgttgctcctccgtctcgttatcggccatgaagacgccgaagtagagaggggtgtagttgtcatctaggctttcgtcgaagtcgtcgagatccgggtcgttgtagcgagagcaaaactcgtcgtactccacgatgtcggtggggcgcgagtcgacggtgggagagctgtagtagccatccagctgatccgtcgaaaccgtgccgagtggttggaggatgacgccgacttccctgaagctaggcgaaatcggtgttgaagctgacttccgcctaggcctacgggatggagacgctgtcgtgatggagatggccgccaaatcgtcggggagcttcatcatgatcggtgggtaagccccatcatcttgatctggtgacgttggagaagatgcgatctcacccgagtggtttgatgccaactcgattgagatggtcttgaagtaactttcagccgtgtttgggagtccaaacgggactgaaatccggttctctcccgactggtctgacaccgagtcaaggagagagatcttgccgaagttgttggtgacgaagtcgaggctgccgaaccgaaacgtctgcccgggtgggaagacgaggtcgtcgatgccggagatggaacccattgcactgatcggcgaaaagcttgacgctacccctacctggcgcgccaactgtcgaaactagatttcggcaataataaaagggggtggctatcaagctggaaaagtgtatgggtttggagacaaaggatttatacaggttcaggccttcttattgaagaagtaataccctactcctgtccggggatgaatccgccgagtgtcttattgattgtatgatttggagaaaatcaacatatgcccctagaggtacctggaccccccttatatatgggaaggagtccgtgttacaaaagataatctatatccctaacggaatacgcagatacagataaaatacagtcgtaaccgactaagtgtcaaggtatttccttgatgtacaagttgagaaacaaacccaggatacaaataagatattctatctatattcggtatcctatattcagtccaaatatcatcgccgtgtagatatgggatatccataatctccacagagctcattctcacaagtttttcctcttcgtaaaaaatcatcttcgctatgtcatatgcagctgaacattaatcttgaaagtgcatatgtcttgttgaaaatttgagcattgtggttgtataaaaagtttcaagtaatagttctttgttgtttctaaaacttattgtattcttgaactcttttggatgtgttccttgcttgaactcttatggtttatgaaatgccaatgatatatgattccaccgaaactcaaaagtcatttttgcacttctcaaaaccaagcctccatgggtagactccaaattccaatctttgccaccaaatacaagttgatccttgctaccaaagccaactaccatttcttgattccaaatttacacttgcatacacaagtagtgtccatataaaatggtagtatcctttgatcatcttgcactcggtatttgccaatcttagtcattccattgccgagagtactcacttgaccaaaaatctctcaagtatctttgaccaaactcctctcatagagaaaataattgatgagtatatttcgagagaaagttcaagtgctcataatcactccctcctagaaataaaatccattctaattcttcttgtctaagtaacaagactccgagtgtaagggggagcatttcttaaatggaccgtttctcaaatttttgctttgagctttcatcttttttttttggtcttgtgaatgtttgttcttgttttgcttgagcaaaattgtttctcttcggttccatgcaaatctttttgtgattaatgccaaaaggggggaatatttgaggatcctacatttgatatgatcgttgatatacaaagggaaaatattctaggatcccacattcatttggtgcatgtcgtgaaaagaagcataccatcatctatcatagcatccaatatgcaccatatgcacaagcatcacatgcatggatataaatcaattgtcaatttctcatatcatgttgatttatatcattgatttcacccttcatatccaaatgtgatcatttttaatggatttgtcatcaatcatcaaaaagggggagattgaaagttcaagtgccattaatttggttttggtgattaatgacaaatccaattatatcagactaatgtttttataagcatttctttgcctagtctcatgtggatatgaaagtggagtgtgtgagaggtgattcccggacttcatatgagttgagatagaaacattcattgatggtggaactaaatcacaaagatgaaatgcatggagatcaagctatatgtatcactctttctctccatgtacatattgatatgttcatatataataattccacgtcattgacatatgcatgtgagactaatattttgtttgaaccatatcttatttagtctctttacattgagaacatggagatggtgaaggtatgtttttattttaatacctatatttgataaatgccttctattcttgtataggataagctctcaatgtttcatatcttactatgcatactcttgtcacacaaacagtttgtatgcatatatttaaggggaggaaatcatatactttagttatgcatgtaattgatccaagttattcattttcatttaattgagatctttacatttgagcatatgtttgagtatatgacacttgtggtgttgattaatactcatcatttattcatatccttttatacatgcgatcggttggtcaacgtgtggaggttgacaaccggatcattgggactaataattttattgagttgaataaaagaaataggtcccaaggattacaaaggtgttgatgttcaagtgatatcattacacgtaacgataccaagaatgacaaagtaaagatattgaagaggtgggatacgaagtggctactatggcaagacagtgaagggcaagcgatgctcggtcgcgatggactatgcggtggtgaagggcaagcaaggggcttggcgccaaagaaccaaatccggtggtgaagggcgagtgacgg

SEQ ID NO: 77076 - DNA, 69956 bp, Oryza sativa
  unsure (1)..(69956): unsure at all n locations
gctccaataaagaccacaagaaaggccgatagctccccaccacttgtcaaatgccagaagcgtgaacgcggcaaggggaaggtcggggagttggcgccggagccaaaaaggggcaaggctgcgacgttgatgccggtgagcaaagcggggaaggtcgtgagggcgctagcccaatttgagctaggcatgccattggtggaggacaatgtgttagccgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatacagaagttggacactggtcttctaaaatgctactccttgtaagtgcataccttctatacttgtgatatgattggactatatctcctaattaaattagttctaatacgtaaatgttttaaggttgtgttggatcgagagtcgtcgccttggtaatcaggttgggttccttgatccatccatggtgaacgaggttaatttacgacagagcttcactgaggtggttgactatgtcaaccggtgtttatgggcccatcaagacaaggagtacatcatgtgcgcacacaaccaagagtaagaggacaatacccttcgtgtatattatttttgaagttaaggttcttagtactaacgctacataaccactgtgcaggcgacattggattctcctagtcatcgtacctaagtggagtagggttacctaccttaactccaataagtccaaagattatgatttcactgaaatcaccaaggccttaaatatggcttggggcccatatgtggaaaagggtggtaggcacaaggagggcaaggacgaactttaccatgacaccaagttcgcatgcgcacaacagatcggagaccaatgtggtttccacgtgtgccacaacatgtcaacacttctaagagaggtgaaagatttcgaccctaaggttgttgctaatggcgaataagctcatttcaataccaacattgctattcaaaacgtgctaacatcttgtttattaaacagaaaggtagagctggcctcaagatctcacccatcaacacccccgctatcagaggcgaagtgtgcgccttcattctggcagaaataatgaacaagaaaggacgttttcacgtcaaatagacttatgaacttggctagataatttattgtgatgtaaaaaagatgttttcataatttcttgtgatgtaaaaaaatatgtttttatagagtgcaatgtaatttacttttatatgtgcaatatttatggtagtttactaaagtgtcatcaaatttgatcaactactatttacgttgtactattcatctgttttctcctttttttccttattgacaggttgtggaggtcgaggacattatggctttaatccatttggtaagtatatatgcggttatatgagcaacgaccaaaattgtggctttcaaggggtgtgaatttgctgtgcaaaattgtggcatttgaactgcatatgtgaatgatgtcaatttttgatatggatctgtgttgttggggatctgtgatgtttgagatggatctgtaatgttatattgggggggtgactggaatatatctgtgatgtatctgtgtttcagagggcatggctagcaaatcctgaggctagccaatatttagcatttattttttttctggaattaactcatcagtgactggtcggaacaaaaatccgtcaaaggtaacaacacctgtgacggactagaaaaataaaggcccgtcagaggtgacctacctgtgacgggcctttacttttggggccatcacaggtagatcgcctgtgacagcttctaactacggagaccatcacctcacggcctttatttaaagggccgtcagagatgagtcacctgtgacgggtcccaactcgccctaggcaagcggagacaaacacctctgacggccttccagtaacttgcccgtcagaggtgggtgtcacctgtgacggccagccacctatcaaaggtgactggactcaccagtgaccactgatcactgaccatccgcgaagccgtcaaagatgagggtttgggcccgtcacaggagaccttggccagtgtagtggcccggcgtcccgcggtggatgaacgccatagacagcacgaagtaggcgaccccgtcgacgatggccacgctcctgcgccccgtgaagacgttctggggtgggctcggtaccttcctccatcgcgcgaagctgccgctgttgatgccattgccgccgagggtgagcaccgagcaaacctgcagtacgcggtccatgcggatgcacaacagcttgtactgatctcctcccgtcgacacggtccgcccgagcgcgaaggagcagttggtggggtggttcacccagtcggggacgaagagacggcggcggacgaaccggtcgctgctgccgacgaggagagccacgccgcggtgcgccgtggtggtggtggtggacactatagatggccataaggcccggggcccgaaggcccggcccacgacatggctttttggcccggcccgaccgctgggctgtgcctgggcctccccaccggcacactgggcacggtcgggccagcccggcacgatgggccagcaggccaggcccgacatacaaagtatagggactaaaaatggatatataaatgtcactgtcgaaagaatagggatcttaaatagacttattttagctatttatataccacagcacaaagaagagggaggtagaatagacttttttagctatatatatgtcacacctcccggcggacaccttcctgacgacctcaccggaggacacgtccacgatgcagacgtccaccagctccctcccgtaggcgcagaggcggccgtcggcgttgaagcggccgcggacggtgacggcgaggacacggcctctccatcggaggtggcgacgagaggatagtcgttgtctccgttttcgccaccttcaaatcgcggattttccatcggcggaggcggcaccatcgttgacggctttctcgatttaattatttttgtcagaaacggagcttgccttatttgaagaaggcttaaggagtaatccgagtacttgaccggcatgatttcgaaaatgcttggcgccgggcatcgatgcatcgggcgctgctggcgccggagcccaccatggagcctgctacgccgcccatgtctctcccacgcgtgccctcatactgcctcgtgttccgaccacatattccgttgcaacaaatcacccacatattttggaaatcctctattaagggaatacgtttcatattttttttcactaatgtttcacctagtgtactcacaatatttcactatgtataaatctaatgttgcagtgaattgaaacattcttttgcaacaaatcactcacatactatggaaactctaagggaattcgtttcactttttgttccacaaaaaatgcttcacctaatatacttataatgtttcattttgtatggatcaaatgttgcagtgacttgaaacattctttcgctatctgctgaaacattgtttttatataaggtaaaacaacgctcgatttaaactattgaaacatttttgatctacctagtgaaacaattctgatatacttggtggaacaacgtgtaacatttaaaaataatttaataataagctattttttcatcagaatatatccatgcgtggtcttgttttaaagatttaattgcaacgaatttaatggtgcaatcggatcatgatttgaataaataaattaagagaaaaaatagtttaaaatatttttgaacgcatgaatgcttgatgacatcatgttgacgtgggcgtccgattcctagtcgcctccagatgatttatatgcttgtatctcactggctcagttgagtagaaaaaccatccatatgcaattgatccgtgagaatcaggtcacataggttgatttttttagatggatggagtatttggttgaaaagcgacaaatcagtagactaggggcctgtttagatcccctggcaaaattttttaccatgtcacatcgaatgtttgggcacatgcatggaatattaaaaaaaataactaattacacatattacatgtaaattgcgagacgaatcttttaagcctaattacttcatgatttgacaatgtggtgctacagtgaacatttgctaatgacggattaattaggcctaataaacagtttgcaggcagaatctgtaatttgttttattattagtctgcgtttaatactttaaatgtgtatccgtatatccgatgtgacacacctaaatttttcacccctggatctaaacacaacctagctagatagaaccaacccattcattgtaccgtacgcacgcccaacagggctaaccttccagaacatccagtgtggaacttgtcagaaatggatttcacaacactctggagataagagaatggtgttgcacccatgtataggagggacgtcactgcacacagtgcgtgctctcgtaagagactaaaggcctgttcggttgcttgtctacggtggctgcggctgcaccatatgtgtgcggcactgttgctgctggctgcgtcgcagccacaacacaagcagccgaacagaccctaaaggtacgactcaatcatttttatgattagtacccggccaattaagcgtgctttttgaaagtatgcaactattactacctcagaaaagaaaataggtgtcggttgggaacctataaagatgccggattttcaaccggcacctagaaagcatggaaggaaaaatatgtgccggttccgatgtcggtttgaaccgacacctttgaggtttcaaaataacaataaaaaaaagctggctcgaggcatcggctcaattcaagaaaatgtatcgagcaactccccttcacccgatttcacccatcatttaattcatcaaattaatcggcatccaagaactcaaaaacatcccagagcatcaccagaatcaacactaatacaaacacaaaaaagatggacgacggcctctggagaggatagagctgcagacgagcagtacgtcgagcaccgccgttaccacctcccctcgccaaggatggaactgcagaagaatagcacgccgcccgccgctgtcgccttccttcctaccaccgcccaccaccgcacgtcgctgcagccgccttccctcctgctagatctggcagaggggaggacgccacccgccgctgctgcctcccctcccatcgccgcccatcgctgatgtcgcctccctcccgccaccacacatcgctgctgctgcctcccctcccaccggatctggaggaggggacggcgctacccatcgctgccgcctctcctcccgccgccgcacgccgctgcgactgagagagccgagagagagagggaccgagagagatagttgagacagagagagaggagagggtgccgcacgtctcctttgtggagtggataaggacataataaaagagagatgagaaggaggagagagccactgcttcggctcggctcgattttaggcgtgccatttttttttaaaaaaacaatacttggagagatatatatgatgacttttctttgttttattttaatatatgtgtgaagtacatatggttaattaattaatttatacagtgttgttcgttctatgtggttatttatagtaaacggtagcacgtatatatagatgtctccgctcgcacgcacatgaaacctgagcttgagtcgctcggcactactatagagcgtgtggtgtcttggatagagggagcgtgggaatgagaaagacacacgaagagtagagtggaccataacatgaaacggaaggaaaagattatgcattccaaagtaaaaacagggttggatggatataatttactcagtaaattatataattaacggtaacgattcatctaactttctctatatgcagatgtgctcggcgtggtgcacccacctatctatgtcctccattaacaacttcttagttaattttctagatcagtataagaagagttgccactttagaaatgagatcgtctatagataaatttgtatggatgactctatggctcgggcgcccgattgggttggagaaaaattgggtgctgataacgtcagcgcccgatttacgtgtaaaactactttaaattgatttttctcttaaattacttatccaaatcatgatccgattgcaccattaaattcgttgcaattaaatcttcaaaacaagaccacacatggatatattccgacaaaaaaaattttaatttattattgaattatttttaaatgttgcacgatgttccaccaggtatatcggaattgtttcactaagtagatcgaaaatgtttcactcgtttaaatcgggtgttgtttcaccttatataaaaacaatgtttcagcaaatagcgaaagaacgtttcagttcactgcaacatttgatccatacatagtgaaacattatacgtatactaggtgaaacatttttcggtagaacaaaaaataaaccgaattcccttaataggggatttccaaaatatgtgggtttttttgttgcaatggagtatttcagttcactgcaacattagatctatacatagtgaaacattgtgagtacactaggtgaaacattttttgtgaacaaaaaataaaccaaatttccttaacagagggttttcaaaatatgtgggtgatttgttgcaacgacgcgttccataatatcaaaatccactgcaatatttgatccatatatagtgaaacatcactagtacactatctgaaacatcgtaaaactattggttgaaacattaagaaaaccatatgcaacattctaaaaaaaaaatcaataaaaaagccaaaatatttttttgtcgaaatataattatgtgtggtcttattgtaaagatttaattgtaacaaatttagtggtgcaatcagattgtagattagataaatagtttacgagaaaaaatctttccaagaaatgaaagatgttagtatttgctttgattaacgtcaacgtcacagtctgatgcatggatagccgtccgatccgtgcggctcgatagcacggcgcgcgcggcgaccgatttttcagcgtacgatcgggcgcggtgctgagcattttcgaatttgtatgcagctatgagatgggctccaacaattccaacaagctgtatgacagagctaagtcaagatattaatggtgtactcctcgattcatcaaaggtgtctttgtaatgtgatagttatataactattgttttggtaggctattatattaattacaaaagataattgtactattattcttaaatagatatcggaaagtataatatttttatttaaaaatcggtaccttttgtactaggtatttcgagatacaccaaaattttttatactattttaagaagaaggtggtggtggtggcagtgaatatgatatccccatactctcattgtaaattttacaaattaccacttgaacttctttctattaaaaaaataaaaaacataaatgtataaccacataaagttacgccatgtattctacattacatttctaataatattatcataccaaattcacatagcaacggcgcgaggtctaactacagaatcaatcctccaagctaaattccgaacaatgggctgcataatgatgagttgatcatcactaaaaggtaactaaaattaagcttacttccccggcggcgcagctccaaggctatcatcaagacttgggatgaaccaaaacggaggaggccagttcatgcatcgcccgagcggcttcacctcctcgctctcctcatcctccaacttgtccttgatcctcttcatcgactcgtcgtctaaccgcgtcatcctcgtgatcctcctgcttttttgcctcctgatgttgatcctcctcacgccgaagtcctccgccatggcggcgccggcgtagccggcggcgtcctcggtgaagtacacggcgccaccggcgagcacggcgtcggcgtccctcttgccgacgcacaccgcgccggtgtagctgacgaacgtcgccaggttatggtagatggcggcgccgtccatggtggccggccactccatgccgccgtcgctggcccatgtcaggtgccagacgtggaacgtcgccgtggtgcgctgcgtccggcctccgccgccgccgtcgctgccgacctgcttgtgcttgtacacccgcttgaggaggtagagcgtgccgcgcggcgctccgacgaggtagcagcactcgccggcgcggtcgcggtggtcgtgttcgtattcccgggacatggtgatggcgttgacgttgttgtccgccttgacgacgtagtggtagggcgagtcgatgaccagcaccgactcgagaatctccggcgacctgcggacgttgcagtcgaacttccagcgcgcgaccttgccggagaggtgcaccgtgtagagcttgccgtccccgtgcctcgccatgtcgacgattccgtccagcttgttgttgacgagacgccacgagcgctggcccgtgcgtgccatggcgaactccctctccctcctgtagaggacggcgacggtggcgccgccgtcgctgatgtcgacgacgacggccttgagcaggacgaggtcgcagaggccgtcgaacgagaacgccacgcccggcccgccgcggtggtgttcgtccacgtacaggaagctaccgacgcacccgtcgtagccgtgggcggcgtcgaggtagggcagcctccagagcggcgggagcggcgcggtggcggcggtgagcgggttaacgaggcgcgcgtacccgaagtcgttcgccacgacgagccacccggacgagcacccgaggcagatctcgcggcggccgaggcgcacgtggcggccggggagctgcacagccgcgacgtcacccgcttgacggcggccgaggtaggagccatcggccttggcggcgaggagcagccacgggacgcgctccaccgcggcggcgaggcggcgcgcctcgccgcgcagcgcgcgctcccaggacgggcagacgttgcggcagttgaggaagtcgacctgcgaggtgaggcggccggtgatgtgggtgatgatgtcggcggggagctcgggctcggatgagtcgccgccgtcgtccaccggccgcttccgctttcccatctcgatcgccatggagacgagacgagaatgatggggttttgccgttggaactcgcaagtttctcggactcttgttgggatcagtatatgtcggttagccttcgaactctgagcaaataaacagattttcttctaaaaacgtgaggaatttggaaacgattttttgtcgcggaaaaatctagaaatccggtgccacacgagtacgcgcaaggcggttaaaaggcaatcgctgcgggctggggccgcgtgtccccggtgggccttgtccacatgaacgaaaaaggcaaacgctatgatagatgtgactgtctcatccaaacttatccatatcattcacttataaatgaagagatatgtcatctctagcatatctctaatatctctaagagcaggtacaataatgggcggtagatgatccacgtaggatttattgatgagctgaaggagagagaagaaggggacgactaattagtcgcccggctgcacgctccgcctgaggcgctgtgggcccactaagagagatgggcgcacccgcgcaaggcgccgttgcccgcatcaccgacgtcgtgctctaccgctatggccgacgtcacgcaccaccggattgccgctgtccccgtcctcgtccgctatggctaccatcgccatcgtgaccgctaccgctgccagcgtctgccatgaccgtcactgccgccctcatccgccatggttgtcgccgccgcactcgtccgcttgcatccgtcgtgaccgttgccgccgcccttgtccgccgtgaccgtcgtcgccgccctcgtccgcaatggttgttgccgttgccgccatcctcgtccgccgtgaccgcattcatcgtcgattgcatctgtcgtgacagttgtcgccatcgactggatctgtcgccgccactgccctcacccgccatggcttccgacgcctcgctgtcgccatcaactgcgttcgccgccgccgcatagtccattgtggcccctggaccgccgacctcatcctctgcacttgtctcctgcgtccgcctcggctacaaccttgtccaccgcggccacccgtgttcggcttggccacggcctcttccgtcgccgttgcccttggtccaccgcgatcgtcgtcgtcacgttcttttgctacatctcatccatcacgttcgtcgcgtccgtctaccgatgcaccctcatccgctgcgtccgccaccgtcgtcgccctcttccgcctcagttggcgtccttgtccgccccagccaccgcgggtgccaccgtcatccattgccgtgtgcatcgccgtagttcgaaggagcaaaggtgagaggaacagatgggaaagatggtgggctagacaaaggtaataaaatatatgtgttacaattaatctattatacacattggctatattgtttgctatatatgacatggctatctattgtagccgacagtgggctttattactgaacttgctctaatactctcacacatttcttaaagttcgtgtggaggttgcctctttatttttagggtggctcatcatctctctccttatcacttctctcctcaatccaatgttgcactcttaggggcagcatatagagtattacagtacttgcctaagacaatatgtgtgataactcacaagctcgaggctagacttttgctggctaatccttactattataataagaaaatagtatttgacaaaaaaacatgtgtatttcaaaattttacactagagttatctagtatatatatatagctatcgagtttacattagaattagaaaatatgatacctcctgatatcaggatgataaatttattattctatatggtttcacaaaaatatatttgagacacgtgtcttcgattaaataacagacgtggcttgaaaacaacatcgatgtcttccccgttagcgacatagttacaaggtaagtcaatatttactttattataataacactgattttttaaatatatttttatgtgaaatcagatgaagagacactttactttaaaattatatagctcaataagatctacaatttaattggcagtcttttcgtttgagattgtttacgtgcttaaatatatgttacaagctctaatatttattttgaaaattgaatttttgatttatctattattatatactaaaagtccatgaagcttcctacaaacattctcaagtcgccacgtggcgctctaataaaatagagaaaatcctagatattctaagaaaaaagcaaaacatctatcccttaattttcacttaaattggtgggtccaatattatagaccgttagataaaattgatcttaaaacaaactaaataccatgggtcccacctatcctcctcccatgtattggcaggtggagtatatacgtacgtatgtacgcttcctttcctcctttttttttccttttttcttcttttttcaatttatatatttaatggatatattttttaaataatcattattttacaaacaaagaatctaccatcatataatttaaacgggtatactctttactttgtacaattattttcaaataatgcattactttaaaataaattttacacaattatatcgtattttacacaattatatcgtatagttatcaaataagcaatatctatattaactaatttatatgtgcacttaagctgatggccccattatataaatcatcggatctactttttattacattggtctattattctcaagtaatgcactgtttcaaaataaggtctacaccattatattatctatccattatattaacaatttaaaatctatattaactaatttacacttacactagaacaggtggacatattattataatcattggatctattgattgctaataaataaagcgttcgaaattctctttttgcccgctgcacaatgcacgtctgcaccttggcctttcacacgcgtgacaaagcgtagtgtctgagacatctaagttgatcataactgctgtagcgctaccgctttgccacatatcaaatcatatatggagatgattaattttgttaataacatggaaagaaaattaaaggtgtgatgcagcgagagaataattaagcaccatgggttgtgtttttctcaacactaattagctatgtttaagttaaaaccgagagttgattatatagtaattataatgtatttgtgttatgtcgtatttggattttttactatttgtttgtacaagtgaaaggaatcattatgttataaatgtgagcacaatattgacgaatattaatataactcttactacgataagggtgataaagggagtttaaggccctctcttttttttcccgattccatattttggtttttgtttacacgcatttcaagtttctaaatggtgtcttctttaaacaacattctaactttttagaagtcaattcattcaattataccctcaaatagctatcacataaattatataattcatcaatttcagctattctaaaccttaagtactacatatttttttttcatgtgagtcatggtgataagtaaattggtgatcaacggatcatcgaagtcataagatgaatatgtaagagttactctgaacaattataaataggtgtcaaaattagttgctattaattagacatctaatggcttgctagccacaatattaatttctctctacatgtatataaacatggatgaagttggaacaaatattaccatatgtcccacacatatatattgcacaattaatattctaattagtcatttaaaattccttaaaatgctcgcaagctgccacgtggtgctgtaataaattagggcaaatattagaaattctaagaaaaaaaatcaaagtatctattacttgattttcagttaaatcgtaggtccaatattataaaccgttagattaaaatgatcttagaacaaactaaatagtacgaggtcccacctcggcataggtacgcacctacgtgcatggtacgtatgcctcccctccctttttttcatttttctctttcttctttttttcccatgcatatgcttccctccctttattaccatatcatgcgtcttcatgagacgatttaatcaaaagaattttgagtatcttgcactcggatttttcatttgcggccatactatacgtatgtatatagatggactgtatgataattaactagcaatagtttcttatttactcgagaaaaaaaacattattcaaaagttgtaagtatttaatccatctcctactcaaaagtttgtgaatggttttctaagatatcttaagaaaaatagataccttaaattattataaaataacattatccaaactttagtttgccctaaatctattagaaaaaatttctgaacaaacaataatcttaccttttaataatataagtgcccacgcatacgcgcagaccaccttcctagttgttttaaatgatcttggatggacacatgctctacaccgaagctatataattcaatgggatgtgcaactttgtaggtgacaacgttttctttggaaaacaattacatgtccgaatatgtttataagttctcattaaaaacagattttcaaattttccaaatgacacagacgagatctacagctttgtagttgatattttttcattttaaacgatttaaagtgtgaaatacgaattgcaagttttagagagaagttaagtaaaaaggaatatcatcatttttctctaaagaagctatcataccatgtttggatatgtgcatagtacttaaacactcgtgagtgttctcaatggttatattaccttgatttaataatcatgttagttgaataaaaattccttttatctttaagaaaacatcaaactgtttcacatgacctcgtggactcttaggtcttgtttgattaatgggctttagggaaatgatttcccacccaccaaaaggcatctttgaatgctaactattcattctctctcctccatttaatcctaacacttcttttatttcttaattccaatcccactccttattttccattatctaacatacccttaaaatttacaaacacttcaatcttgaaccggagccaatactacattgtaatatataaacattcttcgaattacatgtttattcaaataatataccactggcactatttaccattttatatatttttttgtgttaaaaaatacatatgttcctttgtacaaataatttttttgaccaagcctttgtacaaataattcatcagttgcttattttatttcaggatattcattgggccaaattgacagctgttatttatagcatactttgtgtgctgtagcaccaattctgaagaatccaagtcattttaggtctgcagaatttagttatataattctcttactactttgaaaatgtcatttgcttacatcgttcatacttctactcaaatttctctatgctttgtttttgtgaaactcttatcagatacagttactccttttcaacagcattgacatcaaagtccatgctcagaatcgtaacaagcttgaaatgtctgaatatacgatcaggttaggatgttatcaaaattccagcatgttcagacaagagacagctgaaacaacaaaacagtaggatattagcaactgcaaatctgcaatataactacataagtaagtcgacttcagtgcacatagttttgtagtagaaccatcaagttcatataacagcgaaaacaggactaaaaccatcagaaaagaacataacttgaataaagtttggacagaacacttcagttgagtgatcccactgaaatcttatacatcaaagatttccaagagttcatcaacagaagtttgccagttacaattcggctacaaatttacagcagatattgagataacatgaagagacaggagtactaattatctgaagacttgatatgctacaacgagcagttcacagcgaacaaatgtacttaactagattgtcaatggcgagagtcgcagcgacgcattgattcgcctggattttcaggcgacgcgctgtctccctcatcgcggcgccttcttccccaaccatcagcttcctcaccgccacggcgacgcggtcccggtcgaacacctcgccgagctccagcccgacgccccactggtgcgtcacgtacctcgcgttcaccgtctggtcggcgaagcacggccgcgcgagcatgggcaccccctcacagacgctctccagcgtcgagttccacccgcagtgcgtccagaacccgccgatggccgggtgcgccaggacgtccctctgcggcgcccatggcacgatcttgcccctgctcacgtcgaccccgtagggtagcgctggcatacagccgcggacggagccgggccggttgacccagaggaacggcacgccgctggcggcgagaccccacgccatttcgtcgaacatgtcgtggtcgatgcaggcgacgctccccaggctcacgtacagcacggagcgcggcgggtgcgcgtccagccacgcgaggcaggcgcggtccggaccgtacaggcgcacgaaatggcggtactgctccgccgccgtcctcgccgtggtgagcttgtgcagcggcccgacggcgaaggttggcttggacagctcggcctcgatcttgcccagttccgacgcctcgatggcgtcgaacgtgttgacgacgaccccagacgccgaatcccgcatcgcgtcggcgacgcgggcgatgaagccgcacagcgcctccgtctcgcagccgtcgacgcggatcaggtctcgcacccggagcggctccagctccggcaccgcctcatccagccgctcgcctgcagggataatccacaaagattcagcgagaacgaagtggcactcatctgagttctcccccaagattcaagctcgaattcatccgttcttgccttggattgggatgaatccggcgtcgcgcagccgcgggaaggcgagcatgctgcggaacgtggcggcgctgtccgtccggagcgcgagcgcggggacgccgagccgggccgccgcgcccagcgccgcgtaccactgcccgtccaccacggcgcacgccacgccggggagcagcgacgccagggcgtcccggaacggggcctcgcaggcggcgttgagcgcgaggagctgcgcgacgatgtcggcgccaggggaggtggcctcctcggggagcgccgcctcgtggatggggaggaaggcgaggtccggcccgtggcggtggcgcgccgggtcgggcgcgttggagcgcgtgtggaggacggtgacggcgagcccccgcgcgcggaggagatcggcgagctggagcatggggctcaggtggccctggaacggcagcgggaacagcgcgacgcggcggccggcgtggggttgccgttcgggttcccgttcttgcgtggccatcgctgccgtcctcggcgaggtcctggggcttgcgacttgcgaggtacaagcagcgagcgctagagagtactgacacggatttctttttcaggtcggtggagaattgtttcaacaaatgcggctatatgatattatgatgcgatggcatttgctaaggtagtacttccattcttatcacttgctcccttcgtttcaaaataaactaaaattaagtgaccagtatacatatgatgtgaccacttaccaagatgaaaccttctaattagaaaagtaattgagatgttttgttgtgcattaaatctcaatgctagtatagaactagagaaaggattgtgtttaactctctcttccatgatccaactataaaatttctgggtgtgttcgattcaaagaatggaagtactccatttgtcccttaaaaaaacttaaatattaggaataaagacacgatttgagtatttttagatagaatgagtagatttttagtggcatacgaaacgagataagacattagcacataattaattgagtattaattattacaagcttgcaaaatggacttattttttaaaaaaactttcatgtgcaaactttttaggcctttcacagtgctccacctagagcgttacttcatgcgtccacataagctgcgtgatggcgtggaagaaagagagtgtgggccttcgtcccttcactgaggtcttcgtttctcaacaaggatgcgactaaaacaattgtactctcaacaagggtgtttgtttcaaccgcatgtgtttgtttatgtactctcaacaagggtgtgggtcctcgtcccttcactgaggtcttcgtttctcaacaagggtgtgttcgattcaaagaatggaagtactccactgctttactcatgttttcttctcaaccaatcgtaatgttccttgatgattttcattttattttttaaatactcgtgttaaaccccgataatacttatattttgagaaagaggaagtagtcactttggttttattgtttgacacatttaacttataaatgtacatttatcattctttaatttatgtagtagttgttaaaaaatataagttatggttaaaatatcttttatgtaaaataaatggtaattacctaatattttaacaagacgaatgatgaaatatatatatatatatatattcaaaagttaatggcataaaacactgcaaaacaagaggaataactataacacgagaggtgttttcatgtttattaaaataagatgtcacggatacatcagcagtaatacagagaatcatggttagtcacacataaggacttgctatcttctcatcctatgaaatatcttttttttaaaaaaaatagcgtttcagattttacaaaaggctattgctgcaccgtgttcttcctctagctttgtttgaataaaccctttaattaatagagtagatacgtttgtcagttatactttgataggtactcctatattaaaactccgagttctgatgtacatagtacattgtcttttactaggcccttgtttacttctcagctttttttcttcaaactttcaatttttcatcacattaaaacttttctacacatataaacttttattttttttcttcaaacttttaattttagtcaaacttttaattttattgtggaattaaacacaccctagatttcttgtgatggtctgtggtgggtgcgggccgtggcgccactgacatgtggcatgataaattgtttattggtgagttaggcaaacatgtagtaggcctgttcggctgaaaaaaaaaaagcagcagccggctgctcgtgctcacctgcctgccgaacaggctcgtagaagaaagaaaatacatttcagcccatttaatcacaggattgaagaaatatagaaatatgaaaaagtcaggaatagtataggaaatcatatggaaaacagaggatatgttagaggattgaaaaacatagaaaaattataggaatgatcatttgattggtacaaagaaaaaacacagcaatgttgagtattaagttaatagcaatcaaaatttgaatggttttactagggtaaaccttatctttcaatagtgttttgcctacgcataggaaaataaaaatgagctcaaggtggatgttagtttttctatggaattcccttaaaatcatgtcataggaaattttctcatgctttttctatgttcaattcctacaaatcaaagggatgaacagtaccaaatcctataagattcttgttcctatgtttttcctctactttttcatatgaatcaaaagaggccttcatagttttattattctcaatgaggttgatcgtttgtgctgctttgtagttagctgcgggtgcggctgtgctgtgtgtacagtgcaagcagtaacaattatattaggtttggtgttgttgatgcggctgctcagccgcagcaatgtctcccgatcagccctaataaatagaattccaacactctcatagtggagatttgcttatcaattatatatattagtatataatgtagatttcatccaatgccatttattagcatacattagagattcgaagagtatattaaaaggaaaaatctaaagagataacatatggtccaccaacttatcaatagcttgctgagtagaacctccattcttcaagcatatcaatattttcttcttaagttcatctgccctctgcttaacctcagccccctcctcaccttccatcaacctcctaatggcctcctcaattttccatctctctagcttaccctccacccgaaaacctatctgccacgtctcctgcacgtacctcgcagtaaccagttgatctccaaagataggccttgacaacatcgggaccccttcgtaaatactctctaacgtcgagttccaaccattgtgcgtccaaaacccacccaccgcatggtgagctagcacctccgtctgcggtgcccaatcgaccactttgcacctaccctccaccgcttccacaaacccttccggtagctccggtttccccgagacaccgataacgagaccaggacgaaccacccataggaaaggccttccactgtttgccaaaccccaggctacctcgttgaactcatcctggctcaccatgaccacactcccaaaactcacatatagcacggatccgggctccttcgtgtccagccactcgatgcagctccggtcctggtccagcaggctgctcctgtcgccattgctggtgagcttgtggagagggccaatggcgaagaccggatggggcgccgagctcgtcacgaactgagcgcagttcaggggtttcaagagcttcgaatgtgttcaccactgtgccggaggagttcgttgtggtttcggtagagagagccaggattttgttggccatttcctcgttgaagtacttgcttgggtcgaacaggtctgatacacgcagtggtggcatctcctccactggcctgttcagctcagactctgaaacgaaacagaacaaaatttgttcaaatggaactaattaaggcatccgggtaactggtttggaatgggtatatagtcatctgaattaattaattgattgattaattactagtgcaattgtgtggttagatacgttgacatggttgtatttgaaatttaaaaacagagcttttttaacagatgaaacagagttgcattacatatgcaaaacaaactattgaccatctgttaatgaatttgaaaatccatttgaaatgtgtactggtcaaatgaaattattaaaccatctaattaatagctggagcaattaatttgtatttagaaacaagagtatccttaaagctaaaacagttgtatacaaaataaataattgaccacctgtaataaacttgaaatttcatttgaaagaattttagccgtatttttagaataaaatgattttcagctcacctttcgctggcaagtatcccttctcgcggagcatggcgtacgacctgaacaggcggaacgccgccgcgctgccggtggcagcacgatcgtcggaaggccgagctccgccgcggccttctgcgcccggggagcgcggcgtcgatgaccaggcacgccggccgctccggcccggacatcagcgacgcgagcgcgtcgcgggcgcacccggacgcctcgatggcggcgttgagcgccatgatcttggcgatgccgtcccggggcgccgcggcgagcgcgcgcgcgatggcgtcggccgacggcacggcgacgaacgcgagctccgggtgcgccgcctcgtcgggcgcgttgtaggccgtgtggagcacggtggcggcgagcccgcgcgcgtggagcgccccggcgagctgcagcatcgggctcaggtggccctggaacggcagcgggaacagcaccacgtggccgcgtggggctcgcccgtctcctctatctctggctccggccatcgtcgccgtcgtctcgccggcggttggctggccaggaagctttccttctattgtggaattggacagcccgttgctgttgcaggtttcggactagttgggggatcgatatatatatatatatatatatatatatatatatatatatatatatccagatttggtcaacaagtgaagaagcaaaaaacagtataattattagggattagtattcattaattaatttgcgtagtggccaacaaaagattttctagtgctgatgcctggatggttgaccgttgattcttcatgcttctaggaaagttcagtcagggtctgttttagtctgcgaaaagaaaatttttttgtatcacatcggatatttgaccagatgtcggaaggggtttttggacatgaatgaaaaaactaattttataactcgcctggaaactgcgagacaaatcttttgagcctaattaatccatcattagcatatgtgagttactgtagcacttatggctaatcatggactaattaggctcaaaagattcgtctcgcgaatttccccttaactatgtaattagtctttttaatctatattttaatgttctatgcatatgtccaaagattcgatgtgtgatgtttttggaaaaaaatttgggatctaaaccaggcctaacaatagtgatatgtagggttgtgagcagtagatgttgcctcttgtttctctttgtgattggtaaagtagcaatcaccatcctccaactaacctaggatatcacacttgaaggttgatgttgacctatcttaacctactactttctctgttcctcaaatttcaaaccgtagcttcttcaagataaagtttaagggcccattcgttttgaaggagaaataaaggaaaaacgtacaaggcccattcgttttgtagtatttgagcaaaggaaaagcataggaaaatttcctttggttatgattcctaagaaattccatatggaaattagcatccagttagagctcatttttctattcctacgcataggatgaaggcaaatcacttagggcctctttgatttggaggaaaatcataggaattttcgaggatttcaatcctattggaaaaaaaatcctatgaatacctttgaaacaagggattgaatcctatcctatccttcaaaaatcctatggaatggacaatcctatagagattttggagaaaattttgctagagcgtcaacctcttggaaaatttcctttgagtctctctctatcttattcttgtgtttttcctgcgatccaatcaaacggtcattcttgtattttccatgtgttttgtaatcgtctgttttgcactttaattcctgtcagaatcttttgtttttcttattccaacatctttttcattcctacgattcaaagggcccctcattgttctgtgtatttagccttaagttgtacagattaaagtattccaaccttgatcatgttaacttaatactaagcattcctgtatttttcctaccaatcatccaaaggatcaatgctatatttttcctatcatttgttttgcacacgcgttcctatacgattcctatgttttttttatattcctatgatttggaaatcttgtaaaccgaataagccctaagaaaaaagacaaaagaccaaaatggccctaattaataggaaagttgtattgatggataggttggtgaggggtattaaatggataattttttttgatttgccaatggatggtaagtaagaaggtagaagttggtttaattcgggacaaaattcaaacatagaaattgatttaatttgggacggaggaaatagtacaattcaccttcttgtggaatgaactatgtaacactactagccctaattatttggacaaaagagattctttgtccaaagaacacaaaaaaaaatccaaggattacaagagtttgctttgttctcataaatatcaatgtgaaatacttacaccaattaacttagccacttatgattcacaaagataagatataactaactagcctatcaatagcaatttgagaggacccaccgtcttccaagcagcgtgccactttgttcttaagctcatttgctctttccctcatctcagctccctcatttttccccattaatttcataatcgctttctcaattttgcaccactctaactttccctcgagctcaaaccctacaccccacaccgcttccacgtaccttgtatttatcatctgatctgcgaattgaggcctacatatcataagaactccctcacatatactctccaatatcgagttccatccaccgtgtgtccaaaaccagcccactgcacagtgtgccagcacctcctgctgtggggcccacttaatcaccttacccctaccttccaccgcactctcaaacccatccggcaagcatgctctctccacccccctcacaaggtttggacgaaccacccatagaaaaggatggccgctcttctccaacccaaatgcgacctccatgaactcgtcggagtccatggatgccaagctcccaaagctcacgtacaacacggaccctgtcgcctgcgtgtccagctactcgatgcagctctggtcttggcgtaggttgaaggtgttgctcccagtgttcatggaggagagcctgtggagtgggccagtggcgagcacggtggctacgctgtcgtcaccaagctcgccgtggaccctctcgagctccatgggttccagctcttcgaatgtgctgatcaccacgccattggagttcctcaccgtttcggcgatccgagcaagcacttcgaaaaccagttcatcacggtgctgaaaaggtcccttactcgcagtggtggtagctccttcactggttcgtataattgtgattctggttcataatacatttaccaaccaaaatataattaatggcggatataaaacttagcaaactttaacattttttacatgatctctatggatacaacacaaggattcaaagccaaataaaacctactccctctatttctaaagtttatttagcaaagattaagattaaggggaaagattctccttcagttatctctttagtcccgatgcttagattgcgtgcattcaaatatgtatccttaaaaatacttacattgtatatcgaatttgaatcccgtaaattcttatattagattcgttccaaaatctttatagtttgagacgggggtgtatgaaaatatgcgattgtttagtcctaacctttgggaggcagatagccttttgaagaagcatgtcgtaggcgaggtagcagcgaaggcaggcggcgctgccggtgcggagcacgagcgtggggatccccagcccggcggcggccttctgcacggcgaggagatgggagtctatgacgaggcacgcgacgctgggctgcccctcgccggcggcgaccaccgaggcgagcacctcgcggatgttggacggcgacgcggcgccgctctcgtcctccgtggcctccatggcggcgttcatggcgaggatgatctcggcgacgcgaccgcgcgcggcgacgtcgggcgggatgccgtcggcgacctcgacgaacgcgagctccgggtggcgcgacgggtcgagcgcgttgaagcgggtgtggagcacggtgacgcacaggccgccgcggccgtggagcgcgccggccagctgcagcatcgggttggtgtggccctggaacggcagcgggaacaccagcacccggcgccgccgctcgccgccgtggcgcgctcctcctccgacgacgctggcgctggccatcgcggtcagtaggatgtcgctcgctctgcgtgtaatcagctcgcgctaaaggcccagctgtcgccgttatttttctcggttttccaggtgggtcccacgtgaaaaggtgacgtgactgcagtactgcagaactggtaggggcgaaacaaacaaatcgcgttcggtgacaaggtgtaaagcaccgcatttggtattgttgacgttgcgctattttgcattttcttctggatgccagttgccacggagcagcagctatatagccagctaggcgtcaccagtcggagggtttttttttatactgctgtgataaatctttattttatatatacttaaaagattcatagtgtttttatcgtcccaactgatataggagaagagttgggttgtcggacgccgtttgcaccttccagcgctagtgaggctagggggtcacatggagccacggtggcatgggatgaattgaggcgtcgagtggcaaagtgggcatgaaaaatgaggagaggataaggtggggtcattgtcatgcacaaatcttaatgtgttctaggccgtttaaaaagtatgaaagtggttttctataaatatatgatatagaccgtcccttataatattgttgtaatgcttctcttgttctagtttgttttcacacatagaatcaaaattaagaatgagggaacatgaaaagagataaaagagataaagtttattaactcgtactatatggccgagcttaattaaacgcgaaaagaatataatatgtaagaaaacaaagggatatttggctcgtactcaacaatcaaacctaaggatgagagggagatattgtgacaagaaagataactccaagatttacagtactacttagtggtgcataaggatgaaggaaagataatatttctcacattgataggactttgtcccatctcttcttctcctatgcattggctattggcacttcagtcaaataaatgttgtgtggtgcatcaagagagagccacatacatggtgaaaattgtaaaggctatatgcaggggcggaatcaggcatagggcagctagggcttgggccccatgcctagctccataatccctattataatcttgaaaaatactatgtaatttatgaaaatatttaagttcccattagatcagtcctagacgtggaaactttctagctccgccactggccacatgacgtgaatatcatgcatagggcctacgagagatctgtgcgttgatggcaaagacgatgatgaaatgcttattgattcttgatgcctcacaacggaacagaaacagtgacaaactaaatgtggttgttcttagaggagtgaaattttacccctaggccagtgcgaagaaggacattgggagaatgaggacatctatatcacttgctttgatacatataaataagaaaattaaaggaaaccttcaacttcttcacaattcgtcgatggtagtattcacacgataagtacataattaaactcaagtgttagagagatattatataattcactaacctgttgatggcaatttgagaagatccactactttccaagcattggtccattttcttcttaagctcttttgctcgttccctgatctcagctccctccttttctaccatcaacctcttaatcgctttcttgatttcacccctttctagcttgccaacaagctcaaagcctacagcccacaccgcttctaagtaccttgtattcaacatttggtctgcaaattgaggtttacatatcattgggactccctcactaacactctctagcgtcgagttccacccattgtgcgtccaaaaccctcccactgcgtggtgtgctagcacctcttgctgtggggcccacttaatcaccttacccctaccctccaccgcacgctcgaacccatccggcaaacttggtttatccaaacccttcacaaggtctggtcgaaccacccatagaaaaggctggccactgctctccaatccccatgccacctccaagaactcgttggagtccaatgacgctaagctcccaaagctcacgtacaacacggatcccgtcgcctgcgtgtccagccactcgatgcagctccggtccgggcacaggtgcaggctgcccccggcgttcatgggggagagcttgtggagcgggccgacggcgagcacgatggcgacgccgtcgccgtcaagctcgcgccggatcctctcgagctcggccggctccagctcgtcgaacgtgttgatcaccacaccgttagagtttctcgccgtttcggcgatccaaccaagaactttacggaccagttcttggttggcgttgctcgtgtagtacaggtcccttactcgcagtggcggtagctcctccactggttcatagagttgcgactctgaaacaaatgacaataatattgtttctcttaattagacagtggatttaaataaaagccggcctctatatctcaagggatgtacaaagccacaatataaaacccggcctccactccacaatgatgtagttagaacttagagcatgaatgcaaaacgaaaggattgtttggattcaaaatgaaatggaaaactgtgatgtgaaaagatgatgatttggtagtgacctttgggaggcaaatagcccttttggaggagcgcggggtaggcgaggtagcagccgaggcaggcggcgctgccggtgcggagcacgagcgtggggaggccgagctcgcggcggtcttctgcgcggccatgaggttaccgtcgatgatgaggcacgacgcgcggggcttccgcccctcgtcgtcggcggcgaccaccgacgcgagcacgtcgcggaaggacggcgacgactcaccgccgtccatggcgacgttcagggctacgatgatgtcgacgatgttaccattcgcggcgacgtcgggcgggatgccgtcgggcacctcggcgaacgcgagctccgggtagcgcgacgggtcgatcgcgttgaagcgggtgtggagcacggtgacggacagctcgccgccgccgccgccacggcggccgtggagcgcgccggcgagctgcagcatcgggttgatgtggccctggaacggaagcgggaacaccagcacccggcgccgcctgatgcttccatcgccgccgccgcggcgcgtcgctccgtcgacgctggccatcgtgttgctcgccgtgtctcagctcgggcgcgcgaggcaaagcagacgggacggtgtgtgtaccggtttatcagctgcgggtggggtgggccccacgtgtcggtgacgtgacgtcctgacgactgacgtgcaggtgggtagtcaggtacgtagcggacgaagacgtcgacgctgctaggactaggaatagtaggaccaggcgtacgtgccgggctcgtgccggccggcgtttcgcgtcactggtgacgtcacaggcagggggcgggggacggataaaaaatccttgtcatgttacgaacaatgatagattatagcttgaaaatcgggtcttgttcctctatttcttgattcgtttcttagggcgaatttggattgctgccgtcctaattttaccaaagtgctaaaacttatataagtttaggagataactacacagtagtggtagctggttgngtctaaaccanctaccactccatctatgagagactctatacacctatacttcaaataaaattttctcttaaactactcatccgatttacgatccgattacaccgttgtgttcgtaataattaaatctttataacaagatctcacatgattatattttgatgaaaaatcataaattacttttatgatatgtctaaattacttttagatttcactaagttacttcttagacatataaaagtaaattcagcaaagccaaaaggtaatttacatatattatagaagtatcttagaacaaaagaaagtaactttaatgcatgcatttttcattggacatgactacacagctagtcgtagctggtttatactccatctagtgtctcctttcaagttgaaaaatacaatagtatgtatcttatgtgtgtcagggttacgggtcaggcataccctctacccttcgatatacgttacatatcgacatggcatacccacgcgcacgcggatgttttctacatatcctaaggaaacctttcacgaaatctacagatgggaagagtccttctcggacagaactgggtcgtcggcgtatcgtattgggtctgatatctccgagttctacttggagacctccagatctgtgatataaaagggaccccccgggggagggcatagatcatcgaatcatacaaccaacatagcctaagaagcaggaatctgcgaggagccaagtcattgagagctagttcttgacagaaaacacgaggcctgggagatctgcttaactccagtgcaggtccaaaactcaccttcggatgtatgagcgtgccagttgatttgatcttgtaattaacaagaaatagaacaaagaaaccgcaatcaatcctataaatgatagccgatcggctaggtgccgatgacatattatttatttcaagccgatgtcatgcgtacatcgatcgacaaatatcaataaacaaatcaggactaaatctactcgatcggctgtagatattaatgatatataatccttatatcgatatatacttaaatcaagtgattgggatagatcggtcaccttgccgagacaatataaatcacttagatcgaaatatatattaatagtgggattatatacttttatagcatagccgatcaaatggatctggcatgtatcggctaataccccgataccactctgtattaagatgttaaagcaagtagaatataccaaacataagtctaatatacttagatgcgataagatcttaacataaagggcagatttaacatatagattaagcatatggaataaaagtagttaaatcagataagatcggctgaaactctgatactaccctaaccggcaaccagaaagcaggctagagatggtagttctaagcacgacttagtagatcaaacttaactgatgcagcactaagtatgaaaagaaacacaatatctagacaatcaagccgctggaagtttcgtagagtggtagatatatcacataatctaagttaacgtcattgtctaacctaatcggctgccttccattaacagatgttagtcgattatgggttagataaatatattatcgaagattatgtgagatatatgataactcgacgaatcatatagacaagattagagtatcataaagatggaagcactaatcctaagaacataagtcgtcatgacaagttttacctcttgttgaagatcgaagccgatgcagctcaacccgagagcacgaacttgtcgaaataaaagtaaagcaaaaagggtggcgatgcgccgagattgtattggatgtgttctcctttttttacatagggctcgggtctatttatacccgagaattacaagatacgcccataacggacacgactattatctctaacaaactctaagataccataagtctttacggcagacttttgcccaaacatatctctaagaaaatcacatagaatatcctaattaataaatacaattgccttcctaggactctatccatgcgtggcaatcatcttgaagcacatcaacttgaacccgatgacatacaccgagtcatattgtcggaatcggctgtatcggctagccccgtccgactcgaactctgccgacctgaccttagccgatttggactgcagccgattcttactctgtttccgcaacgatcttcatcttggattccacttcgatctgatcttcatctccgatgcctatagtgatagaatttaccaaatttggtcgttaacacatgccccccatgtccggaatattggataatgtttcggatttgccatataccgactctgagagaaactcgcacttgctgtttttccgactgttatcgctctgctttaaatactaaccgttgccccaaaaaatctttacgccgtgatttccgtcttcaccgcttaaacagatcccgtcctctctctctccggcgacctcctcgacgcacagggcgatttccaggcgattccactcccggccagatctccacccgcgacgatgtcgacctccaccaatccgaccgccgcatcatcaaccgaatatgctgaggtaagccccatcggctagatccccttttccgttcatcagactagttttcgctcaccttatcttgttttcttcttctctattcttgtaacatctttccaatcttgttgcagttcccagtctgttgcatgaccaacaatactttctcggtccaatcggcaatctagaccccactgagtttatcatagccgaaaccaatagaaccccttttaggtcggccaatccaaccacaagccattggaaaaacaacttcaaatcctgaccttctttggagaaaagctggcctatatggtataagcggatatcggctagcaaacaagcccattgggatgagatctgaatcagccaagccctagccctcacaatagcaaattcggccaaagatgaacccctgatggctgctgcaacttatttctggtccaacactctcaatgcttttcttttcaaccaagggccaatgaccccaacgctgctggatattatcatgctcactggcctagatgtaacctcatcagctaaccccatgaacctgaacaccaagaatacttttgagttcagaactaagagcattgggggttggtcaggatatatcacagcatatatgggcaaagggccagtcactcctagagaacatgtagcttttttgctgatgtggttggaaaaattccttttctgcggatcaagctgcggtcctacaaccaactggcaattcttagccgaggccctagtaatgaagaaacaatttcccttaggcaaaatccttctcggctatctataccagatattaaacaacgcatcggccaagataattgtcggctcagtggttggaacaggtggaccatggtggctcttgcaatcctggctgaacctggtagtcatgaaagttgtcaatcggccatctgtgacagaagctgaatttccaaggttggagccgattgtggaagatgatggagaaaaacgcaccaatcacagatgtatgtcatatggagaatatgcatctacaccagccaacgcaggagcaaagttatcagctgaacttctgaaggactggttcttcagcttttatgacgggttccaaaaagatgcccgaatttggttcttctacgccgactcaatggatttcgaactgccagccgatttcaggtttgaagacattaatcatgaaaagtttcagcaatctagagaaatcttcactactgccatcagcccatgtatcctcccaattggcatccatcaagggagaaatattcagctctcttacgagttttatcatccaatgtcatcggccagacagctcggaatgggaaaactgctaatcggcctgtacttcaccgacaagatccagtgtagaggcaatatctcttcaaccttgatgatggatcggctactgaacatccctggacccccattaggcagcattgaaaacataaagttagcaagactcaggagtagggcatttgatagatggtggggcgagtggaagctacatctgttccatcaatcggcttccatgtacatgacagacttattccctgatgctatccctcaggttaatcttcatttcttcaatcttgcttgaatagtcattcagccgatttgaaccttgactaacttttcttctgttttgcagacaacagaatcttctcctcctcgccagagtaatagcggtaaggtcattaagtatgctccaggtctaatttcaaatggaggtgggccatctctttctaccatcggcttcaatgcccccaagacttcagcacttcttcaacggctcatcagagaaccagccgatgccgacaagaagcggagaaccagatcatcggctacagatacttcagccctggctccaaagaagaaggctaagacaaagaaagctaagccagctgacgatctacccgccctagatccatccatcgaacaagctctggatgaagaagaaatcggggaagacattgaccaagctgcagccgaaataaacgatactgaaagaacaacatcggcttcacctaagcaggctcctccattcccttctgctccagctcaattagcaagggtaagcaactttctctgcccacttttgcaatcatttactttatagccgattcctcacaattttaataaatatagagaaagaaaattgctgtgaggaagaaatcggttactctagcccctaaaccagctccaccagtaagatacttctatcatctcattaactgacttgggctgattatatctaacatttatccctttggcagccttctcctccttcttcccctcttgtgcaggtagaatcaggcggccgcactccatcggctgcaggcagtcatcatgttgaagaggaggaacaattagctgcacctactattccagtaagttttatcaacataaatttgagatcggccaatcatatcttgatccttaatcatccatgatattatctcttgcaggtcttagccgatctgttctcctttgacatcaaagattacctcgatgaaacagaagaagacaccaccagtaaagcaacagttctcccgtctgatgatgtgaagaaaacactcgaagacatctcccatcggctaggagcatcactagataacctggtgaccaactgtggctcgatccgggcaagatttgcagatatccaagcctttcttccggacgaattagccgatgctcttactctagctgtctacctcgagcagcatcaattcaaactggagaaagccaggcagaggttagccgatcgccgggagcgcaatgacatcgaggctacaatccaaaccaatcggcagcttgttcatgaagaaaaaaccaagcttgatcagttatttgaaggcccgatcaaatctaatattgatcggcttgaagctcgcaagattgaactcttggcacaacttcaagaatgcaatgctgaactggatctagagcacaagaagttagccgatctcccgtaagctgtcgaagaacagaaggcaaggctaaaatcagctatcaagaaagttgctgagatgactaaatccttgaaagtcattcctggaaccgatgctcaagacgcccaagctatcgaagaaatagatcaaattaggcaaagggctatatcagctatccagcgatacttgtctcagtgatttccatgtaatagtctagaaaactgttgtaattggctaagacaccctaattactttgctgtttatacaatccctgtaccatccttgtgccggcgtgttcaaaaatttgcaattttctttgcaattctctatgtatgtgcccccctaattttacaacgttgaaaacattgacaaaattatagaaacgactaagggcgatataacaatatcggccatgtgcacatcggcaaaccacaaccgattacaatagtaaaaagcaactaagggcgatataacaatatcggccatctcaaggcgatgcaaacacatcggctatgatgtatcggcaacactacccgatcatgcattaacacaaacactgggataatatttcttcaagtatttgtcatttagagctcggccataaacttttccatcgagtccttgcaacatgtatgctcccttagacactaccttatgaatttggaacggtccttcccaattcggcgaccacttgccaaatttgctatcctgagtcccaatcggtagaatcaacttccatacaagttcaccttccgaaaagtccttgggtactaccttcttattataatgccgggcaactcgctccttatccctagtaacctttgcaagggctcgtagccgtgattgaaccagatcctccctgtcatcggccataaggttataatactcatcggctgttaaagtatcttgcaactctgttctcctcgagccgatttgaacttccatggtaaaacagcctcatgtccataaacaagtttataaggaggaacctatatcgatccatgacaagccatccgataagcccacaatgcttcagccagccgagtatgccactgccgaggataatcagaaatcttcctcttaatcaacttgaccaaactcttattagatgcctcggcctgcccattagcttgtgcataatatggtgaagaagtcaacaatttaattcccatgctatcggcaaattgaacaaactcatcagatacgaaaattgaaccttgatcaatcgtaatagtttgaggaataccaaatcgatagattatatgctcttgaacaaactgtatagcatccccagaatcaactttctttaaaggaatcgcctctacccacttggtaaaataatcggttgccaccaatataaacttatgtcctttactcgagggaggattaatcataccgatcatatcaattccccaacctctaaaaggccacggtttaataataggattcatagccgatgccggcgccctttggattgctccaaatttctgacaatcttgacaacctttataatatctgaaacaatcctccagcattgtcggccaaaaatatccagcacgtcggagcaaccacttcattttatgagccgactgatgtgtaccacatatcccttcatgaacttcgccgattgcaacttttgcctgatcggcactcaaacatttaagcaacactccatcaatcgtccgataatagaggtcatcatccaataaagtatatttctgtaatttccgcgaagccgattgagatggattctgtaaatactgaaacacatcatatctccaatcatcggctgtaattgtggcaatctctatctcgatatcttttgtcattggcttatatcccgatgctccttgagccaaatcattagcctctatattctgttctcgagatatgtgcctcagagtcaccagccgaaattcacttatcaacgttcggcacttttcgtaataaaccatcaatgtatcatccttgcattcatactctcctgccaattgactaatcaccagcaacgaatcacccatgatttcaatagcatcggctgcaactttctgaagcaactgtaacccttttaaaaccgcctcatactcagcctgattattagtcacatggtgtttaatagcataggcaaattcaaaactttccccccaaggcgcaattataaccaagccgataccataaccatgacttcatacagatccatcaaagaataatacccaaggcataacgtcaaccaagccgattgaaccatcacgatgacccacgataaaatcggctacagcctgtcccttaatcgcctttggtgattcgtgccgaagatcaaactccgttaaagaaaatatccacttgccaactctcccttttaaaatcggagccgataacatgtacttaatcacatcggctttacacaccatagtgcattcattggacaacaagtaatgcctcaacttagtgcaagagaaatataaacacaaacacaatttctccacaggagaataccttgtttctgcatccaagagccgacggcttaaataaaacacaacccgctcttttccttcaagctcctgaatcaagaccgagctgattgacttatcaccggccgacaaatataaccggaaaggaatccctttttgtggaggaatcaatactggaggagaacttaaatattctttaatattatccaaagctttctgttgttctgcccccaagtgaattgctgatcggctctcaatcttaacaatggtgtaaaaggttccagttttccagacaaattagaaataaaccttcgaacaaaattaattttgccgatcatcccctgcaactctgtcttgtttcccggaggcttaatctttttgatcgcaaggatactcctctgaggtatttcaatccccctctcatgaacaagaaatcccaagaactggccagccgatacaccaaaagcacattttgtcagattcatcttcagaccatacttcctagttctctcgaaaacttttctcaagtcggctatgtggtcctttatttctctggatttaacaaccacatcatcaatatagacctcaaccaaccatccgatcagatcatgatatatataattcatagccctctggtacgtagctccagcactctttaagccgaaagtcattacaacccattcgaacaagccgattgcaccaggacatctgaaagccgtcttatggatatcttcttcggccataaagatttgattataccccgcgttcccatccataaaacttagtatcttatgtccagaagcagcatcaaccaactgatcggccactggcatcagatattcatccttcggggtagctttattcaaatccctgaaatcaatgcagaccctcaccttaccatttttcttgataacaggaactatactagaaacccattcagcatatcggcaaggataaataaaaccagcatcatacaaacgtttgattttagctttgacaggttcaagcatatcagccttgcatctcctcggaggctgttggtgtggtctaatcccaggttttaaagataatcgatgctcgacgatcgatcggctgagtcctggcatctcataatattcccaagcaaagcaatctctaaactctttcaaaagctccatcagcttggttctaaattctgaagacaaattcttactaatgaatgtcggccttggtcgatcacccggacctatatccacttcttctaaatcatcggccgacataaaaccctgaccttgcttgtcatcgagatcatctaccgtgtccttggcgtagacgcttgaaccctccacgacgccctcaaaatattagcttgggttcttcatcttcaatcggctgtatatcagaatcggacacttttagaaaatctccaacccaaatcttcccggataaacaatcaaggccatccatctcccaaagagctagatcggcactggcaacattaactgacctgtcggctggcacaatctcaaccttgtcgccttgccattgaatcaagcattggtgcatggtcgaaggaatacaacaattggcatgaatccaatcccttccgagcaacaagctgtaagaacctttcccatcgatgacaaaaaatatggtaggtatagttttactgccgactgtcaattctacattcaaaacgccctttgtttccgatgggttgccaccaaagtctttaagcaccatgttcgtcttgatgagatcctcagtagttctacctaactttctgaacgtagtataaggtatcaaatttaccgcagccccaccatcaaccatcatcttagacatcggctttccattgacatagccatttatatacaatggtttaagatgccgattttctgtcccctcaggcttttcaaagattgctcgttttggtgatagaaccaacttagccgatccctcttttaattcgtcaacatcggcctggccaatcccaaatttggctggcaaagtaaagaccatgttaattggtgccgtcacaacacttttcccatttgccaacctctttgcttcgtcggctgcaatatcatcggctccaagaacttgattcttaacacgccactccttccttggctttgcttttctcagccgatgaccaatttcttgctcgacctcctggaagtgctccctgctcctcaacctttgaacccttcttttctgattctttgtaaaaataccagaaggacaccactgggtctttgtgttcttgtcttcctccaagtaatcgtcttgatttactgggcccaacctttgatgagcgggaattctcgcctgcttcagccgattgcctttattgtacgatcggcctgaactctctgtaatatcactgcacccaggacagtcttcaatagatgtagcctcataccttcgttccagcagaaccgaaagaactcacaactccaatgaggattgaaaccatcattatcttctccataacgcctctcttgttgtttgtcgtatttcctcttatacttatttataattttagccgaattcacgtaaaaacctcttgctcgtcccacatcggctgtccgaccaacggtatgcaccatgttaacagggaaaggattaccatcgaccttcatcggctttttggaatcatcaaacttaatcttccctccttcaatggccacttgaatctgctgtctaaaaaccttgcaatcattagtagaatgagatccagaattatgccatttgcaatacctccttttgccagttcctcagccgatggaatcacatgaccagcggggagttgaatttgcttctcccggagcagcagatcaaaaatcttgtcagctttggtaatatcaaaatcatatttctcctctttcccagaattctttacccactgacaaggtacaacctttttactccttacccattcggctgcagctatttcggagtcatcgtcatcatcatccgatccatacatgtaagggcagacgtgattaaccctcttagagcttctcctggcctctgcaaacctctgttcatgcaatgttaccttctgcacgagatgcgataagctatcaaaatcttcagatgagaatttctccttaatcggaggaatcatgccttgaaaagccaaatcggctaactgggcgtcagtcaaacttaagctaaagcacttgttcctcatctccctgaacctctaaatatactcatgaacaggttcatcatgcctttgcttaattgccgtcaagtcggataacttcatctcatgaactccattatagaaatagctatgaaactgcttctccaaatcggcccaactattgattgatccatacggcaaagaagaaaaccatgtaaaagccgatccagacaaggacaaccggaataatctgactctaagagcgtctacagccgatgcttcgccgcattgagctaaaaatcggctaatgtgttcataagttgacacaccatcttgtcccgaaaatttggagaagtctagaactttaaatcggttgggaagagggactttctcaaaccactcagggtaaggttgccgatacaattttccagtatctctcggcttaagcccaaattgttctctcattacatcggcaattacatcggcccatggtcgttgttgagctgctccttgcgactgttgctgtattggttcaaactgattatattgagaagcaaactgaggttgggttagccctccttgctgatactgaacttgaggggaaggatgctgatactgacaatttatattgccccttggtaattctggtaatttggctgaatactttgcaccaagtgctctggcacactctgaggcatcgtcgtaccatctggctgtatatggtgaaccaaatgttctggaataacctgattcacggcgtgtccagtcgattgcccagccgattgattcatcaaggcttgctgtggaatcggttgtatagtttgttgtttcggaggtgttggctgaacggactgcacaacctgctgccttgatgaagtctgttgaatcggctgcacaacttgttgccttggtggcgtctgctgaatcgaattgatagtagattggaggggtaaaaacatagcagccacctgatcctgtgttggccgatttaccgtctgcccgctatgctgtggctgttccctcatcaatagccaaggattaatcagctggcttggtgtcaacgctgatgaagtaggcaaagaagtcaatagcggtgccatcggctgaaccgatggtgcactcggaagaactgcttgagcaggtggctgagcatcagtgatcaaaggtcgatatttcggaaaaacacctccctgcaagtagaccgggcctgcagcttgatgctcagctattgatccatcggctatcgtcttcatcatgttagacaatgtgttgactaatactccagattgattgatcaaagcatggtgtacggcgtagtccactcgatcttggaaattgttgaagaaatcttgtgctgtctcactattctgattaagatttccttcttgtggctcgtgagcaccatcacattgaactgcatgtacctcctgagagccgtcaccctgattctcttgagccgagtcatctaaaactctttttccttcttcctccttagaggtactggtctcaggctcatcgggaaccacctttaccttgtacttttgaataaatgttcccttgcgagtctgtgtgaatgacctaaagaactattctcgtgcttgttgcatcattgcttcaaaatccttcttctggtcaggtgtgagcttttccggatcaacagccacaatattctcttcattaactttgctcaaacctagtctttggattttctctttaacagtacctgngctagccgaggatggcgacggtggcagcttctcggccatgaggaagattgatttctgacttctaacctgtcccaccaggcgtgccaaaagcgtgttgacagaaaacacgaggcctgngagatctgcttaactttccccaggttgcaaggtttcccaaaaaaaccctttttcgcttcagatgtatgagcgtgccagttgatttgatcttgtaattaacaagaaatagaacaaagaaaccgcaatcaatcctataaatgatagccgatcggctaggtgccgatgacatattatttatttcaagccgatgtcatgcgtacatcgatcggcaaatatcaataaacaaatcaggactaaatctactcgatcggctgtagatattaatgatatataatccttatatcgatatatacttaaatcaagtgattgggatagatcggtcaccttgtcgagacagtataaatcacttagatcgaaatatatattaatagtgggattatatacatttatagcatagccgatcaaatggatctggcatgtatcggctaatactccgataccactctgtattaagatgttaaagcaagtagaatataccaaacataagtctaatatacttagatgcgataagatcttaacataaagggcagatttaacatatagattaagcatatggaataaaagtagttaaattagataagatcggctgaaactccgatactaccctaaccggcaaccagaaagcaggctagagattgtagttctaagcacgacttagtagatcaaacttaactaatgcagcactaagtatgaaaagaaacacaacatctagacaatcaagccgctggaagtttcgtagagtggtagatatatcacataatctaagttaacatcattgtctaacctaatcggctgccttccattaacagatgctagtcgattataggttagataaagatattatcgaagattatgtgagatatatgataactcgacgaatcatatagacaagattagagtatcataaagatggaagcactaatcctgagaacataagtcgtcatgacaagttttacctcttgttgaagatcgaagtcgatgcagctcaacccgagaggacgaacttgtcgaaataaaagtaaagcaaaaagggtggcgatgcgccgagattgtattggatgtgttctcctttttttacatagggctcgggtctatttatacccgagaattacaagatacgcccataacggacacgactattatctctaacaaactctaagataccataagtctttacggcagacttttgcccaaacatatctctaaggaaatcacatagaatatcctaattaataaatacaattgccttcccaggactctatccatgcgtgccaatcatcttgaagcacatcaacttgaacccgatgacatacaccgagtcatattgtcggaatcggctgtatcggctagccccgtccgactcgaactctgccgacctgaccttagccgatttggactgcagccgattcttactctatttccgcaacgatcttcatcttggataccacttcgatctgatcttcatctccgatgccaatagtgatagaatttaccaaatttggtcgttaacactagtcaaatcaactcgactacgatctcgtcggatccgacaagttccatcgtcctctttgtaacttgtgttttccaccatataatcccatatcaactggattagggctattacctatcaagaggcctgaaccagtataattcttgtcttttgattatttgatgtcgtacttcgtagatccttgtaccaacgtaccccaataccctctatatccggtctacgggtatcacccgtcgacagtggcgcgccaggtagggggacttggtactcatggttctactactatgtcatccaacttcgtcgacaacaacgtcaacactagcctcagccaagcgctccctgcttcaacaatgctggtatggtctcaagtcggcgaaatcgtcttcccggtttacaccacaacgccgatgtcaaccggtcctccaatgatcggaaacgagaatgcagtggctacaaatcaaggcgactccatgtcgaaaaatccacccgtcgaaacggagaacggatcatcgatgacatccaagctcgggaaggattctgatacggccaaaccttgtccttccgacatgaaccacgagccggcaaagatgacttccgaagccacaaggtcttggtgtcctatccacaaaaccaagaaacacaccctgcaagattgctgggttttcctcaacgtccgtgctgaaatccatgcctgcaaagaacgtggaattcagcgtacttctccaactcgggatgtctattgtcctattcacaagacaaagaatcacgacctgttgagttgcaaagtcttcctcggcgccatgaaaactccgtctcctaagtcatacgtccctgtcagggataacggcaaggaacaaggagcgactccagcctcagatcgattcgttgggataatcgatatcgatcctcacgaaccatcggtcttacatcttctcaaagactatgggtcatcgacaacgagcgtgccgcgagaggtattggctatcgatgacgttggcacgtcagcgcaagccaacatagaagcggcgaatcatactactccagcccaacacatcaaggctgttcaagctatactgagggaaactccttacgatcctgttctgaatgatgacctcgagcgttggacagaacgactacgggaatcagtgaccaacctcagcaacgcgtttgaagaagccactaccgcagcgcaccaagatcagccgccaactagcgacgccaatggtgaagatccggaacggagggaatcacctcaacgagccactcctccacctcacggcgctggcgatctctgagatcaaatcaacggccgccgagaagcacgacgcacacgagacaatgtaaatcgctctcggcgtcatgtctcttcacggcgtcatgataatggaaatcgaggagaccgctcaaacgaggaccgggatcacgacaaccaccacgatcgcattgatcgcgaacgacggaggccagacaatactggtcatggccgccgccgtaacgacgacgataatggagatcggcgccgagacaacagcgagagacaacgacaggattcccgagatccaggccgtcatcctcgtaatcgtacgccggaaccaagcgacccatcgtcatcatcatcatctgcgtcctcctgactgtcagacagacatccatgaaggacacacgaccgccgacaacccaccgcccccaacgctgggtgcagggctttcggtcgttccctacgtgatgttcgatggcctgagagatttcgacccggagcaattgaaaagtatgatgggagcaccgacccagaagaattccttcaagtctactccacagtactctatgctgccggagcagacgacaacgcgctagtgaactagagattcctccaagtatgtcgacgtttgatgtcgtcattctggtatttgcatagtatggggatcatcggtgctaggatatatgcgaaactgaggtaaaagagatggagacagggatttttatacaggttcgggcccctgagtggtcaggtaataaccctatatcctgttggccggagccggagttgcttttattcaccataattgtcgcgaccgagaaaaatacattttcccgaatgctagtgtattaatccccgtcccaggaaaagccggggtacaccacacaaacacgatataaaagacacatctttattatatcgataatatttacattatgacaaaggcacttaaggcctgacaatcaaaaataaacagcagcggactagcgggcctacggctccatcttcacaggcgctcaactggggtataagccaggactccacctaagacttcttctccaaatcttctcttactgaagggggggggggaaagattgagcaagaatgagtacaaccacagtactcagcaagccacaccgacagatgcatgattaatgcaagggggtacaaggggtaataatataggggttaagttttgcagtaaacagcttttaaaagtcacttagttgcccaaagccattttataaagacgatcctagagctacacagtgttattaatcaaggccgtgaaccctcacgaacctgccttaacctaaggcctaagatgattcagaccgaactggcaacccgaccctgagtcccagctcgtcccaagccaactcaggccaaccattccacattttagttgttaagcaggttttaagaattaaaacactaacttgggtacattgctaggcttgcccataaccgagggcgcggctattcgaataggttatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacctccgggacaggcaggcaggattgagcccctagcagcaggacaccagccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgacaaacaaaacccaaccacgcacctcgagcccagcctaaaaccattttgggggttttgaatagagggggaggtgtgtccaattccaacataagccaaccattccatagtgtccaaatgatatgagaattcccaaagtctaaagttataaaaccacctaatgttgcctaattaatcagcgaagcatctacctaaattcataccagtggaaccatgaatagagtacccactagttggggttttattttcctagggtgaacaaggtaataataacaatagcaataataataaggtcataacaaaggtaaataggcatggctaaataaaacaatgataacgcgggaatttaaataaagcgataatacgttaatttaaatcaaaataattttataaactgggattcaatatgctcaaggatgatgtgacttgccttgctcagagacaacggccttccgaaccttcggcgacgaccacgaaccacgcttcgggaacctccggaacgacagaagctacgcgaagcacacaagcaaagctacaagcctataaagaagcaataacaatacataaaaagaaaacacatggttctttaggttataaaaaacattaggagacttgaacggatcgattcggagctcgtatgaccaagacatggtcatccgaagtttaatgctgttatatggagatttgcggattattataattaggttttgcaactataaaacatgtgtaagcgtcagcctggaaaagacaggaaggctgcgctgttgacatgcggaccccacatgtcaacctaaaggaccacagtagacagagtacacagagacggtccacgggtcgacggaaccggaccccgtgtgtcaaacgaggcaagtggccgacaaacggactccactagacaccacgagggctgcacatgtggaaaccacgcggctaccgagcgcgcacacaaacacggtcaccacatgcacacacgaacgactaccgacaccggtacacgggtaccggtgtcgacaaccgcacaacaggcacgggcgacaccgaaaggatgaggacggggcagtgagggagagggatccttaccaccacgcgacaaggcgtgggaacggagacggctcggggacgacggaagcaaacggcgagggaacaacttcggcggcgatccttgaacgaaggcgagacacggccggcacgaggcttgatgacgcagagccgaggacgaagatgacgacggggctgcagtggctcgcatgacgaactacgggcggcgaacgcgatcggcttgacggagggacgaaggccacgacgaccgggaacgacgggaggacgacgacgacgacgaccggggccgtcgaggaggcgacgtgggcagcctacagcggctgcacgaagacgaggatggcgtggaacacgccgctacgatgccgacgacggaggcggcgccacgagacgacgagtcggcgaggatgagcggtgaagacgacgacggacaccggcggtgtttgggtggaggggaggcgaggccgagggcgaccttgccgctgcgatgccggaggtggtggtgacgcagcgagccgacaagccggggaggacgaaggggcggccgaagggacgtcggcgacgacgaggatggagaggccggcgcgggcgacggcggtctccggacgaaaccgagggcaggccggggtggaggtcgacgcggtgatgccgagggaggagacggcgtggccggcctgcacctgagcggcgcggcaggggcggctggaggcggtgggtggcgacagtgccaccggttgccggcggggacgtgcctccgggggtctcacgcgaaacggagggcaggccgggggagaggaggctgctgtgatgtcggggaaggcgacggcacggccagcccgcgctcgggcgaggagggagaggcggctggaggcggccggcgcaggggaaagagaaaggtgacggcggggaggggtgatacgaccacggggaggctcgggatgaggctaaaacgatagaacggaggatggggattccattttataggcgcggggagggagccggccacgggaggagcggggaacggcggcggaaagccggccggcggccatggaaggtggccggggttggcgcgggcgttcccgacgattgggggcacgaaccaagggggaaattatgaggaattgaagaggaatcaatggggattaaaaccccccaattaattttggaaaccccggtttgaatcacgtggattttggggaggaagcgagctagggttcacgggagagagaaaggaggccgggcgggaggaggacgacaacccgggggtgggacccacgtggccaggcacgcgtcagcgcacgcacgtgcgcggcacgggcgggaatggcgccgctcggcttgggcaggggcgcggcttgggccgagcgaccggcccaggaggagaggagggggaggcggcctgggggagagagggaggaggagggagtgggccgaggggaaggagaggaggcccaagagaaggagggagaggaggagagggagaggaagagagggaggaagagaggactttggccgcgggccgagagagagagggaggctttgggccagacttggcccaaagggaggagggggattatttttaggttttctttttaataaactttgttaattgttgttgttgtttaataaatatttccggtgctctgaaaattcaagtaaaatttgagggctccttttagagcaaggagaatttaacaaaaattctccggaccacattcgaatttttcttgtacgtattttagtgtttgccaatttcttttcgaattttaattaattctatttttcctttttgaaaatgacttttattttgggatgaatttatcaggacgtgacaataatcacaccagtacaatatgtgggcagcctatctaactgttgtcgacatgttggtccgaaggtctgactcgtagtcgacaacagggtagtcttccttctcggatccgtgcccggcgagatcacagatagcgctttcatatctcctgacggtatccggagacaccgtaggggaatagctatgcctatccctgaagtcgatatccggcggcaagtcttggcgtatgttggcttgtatgttgattgtgttgggtgttgataaggtggtcgtcccgatcgtggtgatcgtgttgatcgtctcatggtgagtgtctgtcccctgtcttcctaggagggcttgtatttatacccatgggtgtccccttgtccaagtagaactaaggaaaccaatatggatacaatccgagtagtccttgtcgtttccatgtagaactctggttgtctttccttatccggaactccctccatatctgaagtcagttttcgtataggacatggtatgtggtgagtcctgccgagatttagtcaactactattaggtatgtggtacccataaccatgacagtagcccccgacttcaatgcaaatgaacgaattcatattctcaatcgcgcgcagacttcgaagtaactgccatcgagctcatgtgaccattctcggtgagtttagagataatgttagacttcctttgtcagcctcgtgcgggcacctaaagggtttgtctgagtcaatctccgatgtcaaccaaggaagtacatagcgtacgactaagtctcccgtcttgccgtaatcgagaatttggattgaagtcaagaaattctatctcggagggtacaccatcttttcattccgtattccttgtcaagatccagcaaccgttctcgagtgatcgagaaggcgtagagtctgcgacgaagcttttagtcgatcttggtgtagaaccatagagacatggagtcttcgtaaatgtcgaatagaattttcctgaaatcaatactcagaaaagaatatcaaatagaaatagccctcgagcgaatgcccaaagggtgacatgttataatatgtatggtaaattgaaaatgaattaaatttaccgaccaatgttttgtgtaagagtgttttctcagttcacaactttggtcagtcgtttgagttgtacactctccctagcccccaacgttatcatcggagaatcgttctcggaggagaaggctcttggacccttgacctgccttggttgaataagcactgatcctagcccccagccgtgaagttggaaaagtcaatttccgattatacggcttggttaatacgcatggcgagaactcttacacgaccagatcttacatggtctttcgtctttgaaggatccgacaaggccttatcggctctgggcgtcccaagccaaagatcccttaggttcctcggaggccttgtcaagacggcgtaaagggacagcaggataggtttcaatgctaggtgtcgtcgtggtaagggatctctaggtaaaacacttggcgatattgtgtacctgctaccaactttgttgaagtagaggtagtgggagaaatcgctacaccgctggtcgaggaccaggcagtagccgtaactcgaccacttaaagtggaagtagttggaggaacactacatcgctggtcaaggaccaggcagtagccgtaactcgaccactgaaagtggaagtagtcggagatattgctgcgtactggtgcgagaaccagtgagcgagcagaattatctctcgaacaccgatggaagctgcggtgtgagagattgctgcgtactggtgcgagaaccagtgagcgagcagaattatctctcaaacaccgatggaagttgcggtgtgagagattgctgcgtactggtgcggtgaaccagtagtccaccgatggaagtgctagagttggtttattgcaagtgtatttcatgtggccagcatgactcacgtacccaacttatagcatatccggatgtctgttcgcaatcatgtcgggtgatcaagccgacgacgttgaagtagaggtagtgggagaaatcgctacaccgctggtcgaggagcaggcagtagtcgtaactcgaccacttaaagtggaaatagtgggagaaacgctacatcgctggtcgaggactaggcagtagccgtaactcgaccactgaaagtggaagtagtcggaggaatgccacatcgctggtcgaggaccaagcagtagccgtaacttgaccactgaaagtagaagtagtcggaggaacgccacatcgctgatcgaggacgaggcagtagctgtaactggaccactgaaagtagaagtagtcggaggaacgccacatcgctggttgaggaccaggcagtagccgtaactcgaccactgaaagtagaagtagtcggaggaatgccacatcgctggtcgaggaccaggcagtagccataactcgaccacttgaagcaaatgtacgagagatcactacgatcaactggttgaggactagtgcgagatattgctgcgtactggtgcgagaaccagtgagcgagcagaattatctctcgaacaccgatggaagctgcggtgtgagagattgcttgaccactgaaagtagaagtagtcggaggaacgccacatcgcttgtcgaggaccaggcagttgccgtaactcgaccactgaaagtagaagtagtcggaggaacgccacatcgctggtcgaggactaggcagtagccgtaactcgaccacttgaagcaaatgtacgagagatcgctacgatcaactggttgaggactagtgtgagagatcgctgcgtactggtgcgagaaccagtgagcgagcagaattatctatcgaacaccgatggaagctgcggtgtgagagattgctgcgtactggtgcgagaaccagtgagcgagcggaattatctctcgaacaccgatggaagttgcggtgtgagagattgctacgtactggtgcgagaaccagtgggcgagcagaattatctctccaacaccgatggaagttgcggtgtgagagattgctgcgtactggtgcggtgaaccagtagtccaccgatggaagtgctagagtttgtttattgcaagtgtatttcatgtggccagcatgactcacgtacccaacttatagcatatccggatgtccgttcgcaatcatgtcgggtgatcaagccgacgacgttgaagtagaggtagtgggacaaatcgctacaccgctggtcgaggaccaggcagtagtcgtaactcgaccacttaaagtggaaatagtaggagaaatgctacatcgctggtcgaggaccaggcagtagccgtaactcgaccactgaaagtggaagtagtcggaggaacgctacatcgctggtgaatgaagtagtcggagaaacgctacatcgctggtcgaggaccaggcagtagccgtaactcgaccactgaaagtgaaagtagtcggaggaacgccacatcgctggtcgaggaccaggcagtagccataacttgaccactgaaagtggaagtagtcggaggaacgccacatcgctggtcgaggaccaggcagtagccgtaactcgaccactgaaagtggaagtagccggagtaacgccacatcgttggtcgaggaccaggcagtagccgtaactcgaccacttgaagcaaatgtacgagagatcactacgatcaactggttgaggactggtgagtaggtgtccctcgatcacttggagtcgtggtacgaggaccgctacgctgtcgtagtcgtaccgagagattgctacgtactggtgcgagaaccagtgagcgagcagaattatctctcgaacaccaatggaagttgcggtgtgtgagattgctgcgtactggtgcgagaaccagtgagcgagcggaattatctctcgaacaccaatggacgctgcggtgtgagagattgctgcgtactggtgcgagaaccagtgagcgagcggaattatctctcgaacaccgatggaagttgcggtgtgagagattgctacgtactggtgcgagaaccagtgggcgagcagaattatctctcgaacaccgatggaagttgcggtgtgagagattgctgcgtactggtgcgagaaccagtagtccaccgatggaagtgctagagtttgtttattgcaagtgtatttcatgtggccagcatgactcacgtacccaacttatagcatatccggatgtccgttcgcaatcatgtcgggtgatcaagccgacgacgttgaagtagaggtagtgggagaaatcgctacaccgctggtcggggagcaggcagtagtcgtaactcgaccacttaaaaaggaaatagtaggagaaatgctacatcgctagtcgaggaccaggcagtagccgtaactcgaccactgaaagtggaatttgtcggagtaacgctaaatcgctggtcgaggaccaggcagtagccgtaactcgaccactgaaagtagaagtagtcggaggaacgccacatcgctggtcgaggaccaggcagtagccgtaactcgaccacttgaagcaaatgtacgagagatcactacgatcaactggttgaggactagtgtgagagattgctgtgtactggtgcgagaaccagtgagtgagcagaattatctctccaacaccgatggaagttgcggtgtgagagattgctgcgtactggtgcgagaaccagtgagcgagcagaattatctctcgaacaccgatggaagctacggtgtgagagattgctgcatactggtgcgagaaccagtgagcgagtagaattatctctcaaacaccgatggaagttgcggtgtgagagattgctgcgtactgatgcggtgaaccaatagtccactgatggaagtgctagagttggtttattgcaagtgtatttcatgtggccagcatgactcatgtactcaacttatagcatatccggatgtctgttcgcaatcatgtcggttgatcaagccgacgacgttcgcgaggaattatccgttaacaaccttttctcgagtagtccagcatggccggtgttatgagataggtcgtcggtctttgttggtaggttgggtgcgatagctccgcatatgtcgagaatgttctcgataatggagtgtactctaccataacctactcgagtgctgttcctgaaaaatattttctagaaggcaagatatatagcagaaaatatcgagtatgtactcaaaaaactgcatggagcttctagtattatcaggagataacgagtagatgtaaatatcaggcattatgtaaatcgtaaagaagcatgatttatacagaagaaaacagagcgagcccccagcgttagaccgtagttggcctatcgtcggaagtactcgcacaacggatattgtataagaaacatgctctaggtaaacataataaattatagatctgataatgctgtataatctggataggtacgataaattgcatagaaaatattgcgtacctttgtagatacatgccggatgtatctacaaaattagtagatcaattaagttaattaacctactaattaccttgatttgcatgcccgatatactatctacagaagatatatatatatatatatatatatatatatatgcgcatgcagtagactttgatgtatcttattggtttggtcgtagagcagtgtaacctgtcacatgcatacacgtgtctaggcatgtgtacgtgacatggttaggcaagcgtgctcggttgaccaactccgggtagaacacgacacgtcagtgacacagcggcacttgttctcggatgaatcatgtgcagcctgcgtcgagcgattttggttgtgggaatcgatgccgtgttggatctgggctgaagtcgcgcgggcggcaataccgatttgccatcctccatggtggccacgtcttgatgaagattgatcgatctcgccagatcgaaaatttgacaatgatggttccgatcttgtcggaagacatgctctgaccgggttagatctccacagccgaagtcgtcgagtagcttgttgtcggagaatccgtcttttgaaccaatctcgtcgaaatcctagagcaccaaaatccccctacctggcgcgccactgtcgacgtttgatgtcgtcattctgctatttgcatagtatggggatcgtcggtgctaggatatatgcgagactgaggtaaaagagatggagacagggatttttatacaggtttgggcccccgagtggtcaggtaataaccctacatcctgttggccggagccggagttgcttttattcactataatcacaccagtacaatatgtgggcagcctatctaactgttgtcgacatgttggtctaaaggtataactcgtagtcgacaacagggtagtcttcctcctcagatctgtgcccggcgagatcagagttagcgctttcgtatctcctgacggtatccggagacaccgtaggggaatattcatgcctatccctgaagtcgatatccggcagcatgtcttggcgtatattggcttgtatgttgatcgtgttaggtgttgatgaggtggtcgtcccgatcgtggtgatcgtgttgatcgtctcttggtgagtgtctgtcccctgtcttcctaggggggcttgtatttatacccataggtgtccccttgtccaagtagaactagggaaaccaatatggatacaatccgagtagtacttgtcgtttccatgtagaactctggttgtctttccttatccggaactccctcaatatctgaagtcagtttccgtataggacatggtatgtggtggatcctgccgagatttagtcaactactattaggtatgtggtatccataaccatgacaaccgacccagaagaattccttcaagtctactccacagtactctatgctgccggagcagacgacaacgcgctagcgaactatttaccaaccgcgttgaagggttctgcacgttcatggctgatgcatcttcctcccttttcaatctcttcgtgggcagacctgtggcaacaattcgtcgccaattttcaaggaacgtacaagcgccacgcgatcgaagacgacctagaactcaggtgagacgacctagaactcaggtgaatcattgagggaatatgttcgacgcttcaacgaatgcagaaacacaatccctgatatcgctaacgcttctgtaatccgtgccttcaaatccggtgtcagagatcgttacactacccaggaattggtgacaagacccatcacaaccactcggaggctattcgagatcgttgagcgatgcgcccatgtggacgatgcgctaagacgcaagaacgacaagccgaagaccgggggagaaaagaaatcagccacagacgcatatgagtcaagcaagaagaaaaatcacaaaaacgggaaaaggaaagctcaagcggaagtcctcgcagcagaatacgcgaacccccccaagtgcccagacccacaaggcagcgacacaaagaaatcttggtgccccatacacaagacggacagacattctctggaagattgccttgttttcaaaaagtcgctcgagaagcacatggcgtttgaaaaaggcaaacgagtacgcgttgtcgagaagaatgaagagacggctcctcacgaatcggattctgcgtatccagactctgacctccacgtctcacacattttcggcggctccacaacgtactcctccaagcgagaatataagaaagtggaacgtgaagtggtagggggctgcacccaagatgaagtggtctgaggagaaaatagagttctcggaagaagaccaccccaagaccgccgttatcccaggacgatatccgatcgtggtcgaacccactattcggaacatcaaggtagcgcgagttctcatcgacggtggcagctcgatcaatcttcttttcgccagcactctggacgcaatgggaattccgcaaaatgagttaacaccaaccgatcaacccttccatggaattactccccaatcatcgtccagacctttgggcaagattacgttacctgtgactttcggccaagccaacaacttccgaacagagcagatcacctttgatatcgctgaattcgatacagcttacaacgccatcatcgggagaactgcacttgcgaagttcatggccgcatctcactacgcgtatcaagtgctcaagatgccgggaccgaagggaacaatcactattcaggggaacgcaaagctggcggtgcagtgcgacaagcggagcctcgacatggtcgagcaaatgaccagcccacccgccacgactgagccacccaagaaagtgagcaatacaaataagacgccgaagccggatggcgccatcaagatcgttccactctctagtgccaaccccgacaagactgtcaagatcggggcgacactaaacgagaaataggaactcgcgctcgtcaccttcctccgcgataatgccgatgtgttcgcttggcagccgtctgacatgccgggggtccccagggaggtgattgagcacaaactaatggtgcgacccgatgccaagccagtaaagcaaagactgcggagatttgcaccagaccggaaacaagccatacgagaagagctcgacaaacttctcaaagctggcttcatcagagaagtacttcatccagagtggctagccaatccagtcatggtgcggaaggccaacggaaaatggagaatgtgtgtcgacttcaccgacctcaacaaggcgtgtcccaaggatcactttcctctccctcgaatagatcaattggtggattcaacagccggttacgagctattgagcttcctcgacgcttactctggctaccaccaaatcagcatggcaaaagaggacgaagagaagattgcattcatcacgccgttcggggtattttgctatgttaagatgccgttcggactgataaccgccgggaatactttccagcgcatggtccagggcgcacttagcaaccagcttggcaacaatgtcgaggcttacgttgacgacatcattgtcaaaacaaagacaagcgactcattgattgatgatctgcgggaaacgttcgacaacctccgacgatatcgcctcatgctcaatcctgagaagtgcacgttcggagtaccgtcgggcaagctactcggattccttgtctctggcagaggaatagaggcaaatcccgagaagattaaagcaatcgagaacatgaagtcgcccacgagactcaaggaggtacaaaagctaggatggcagcactaaacagattcgtcgctaggatgggagaacgagcacaacctttcttcgctctattgaagaaacaagacaaatttatagggacacaggaagccgaagaggcatttattgcactcaagcactacctatcaaacccccctgtactagttgctccctaacctaatgaagaattatttctttatattgccgccacgccgtattccgttagcaccgtcattgttgtcgagagagagaaaatacaacgaccagtctactacgtcagcgaagctctccatgacgcaaagacaagatatccgcagattcaaaagatgctctatgcagtaatcatgacatcaagaaagctacgccactactttcaagtccacagagttacagttgtctcctccttccccctcggtgaagtcgtgagaaacaaagacgttgtcggccgcattgcaaaatgggtagtcgagctaagccagtttgatgtccactttgtgccacgaacagccattaagtcccaggtactcgccgacttcgtagccgattggactatgcccgaccacaagttagacaaccaaatcgacaacgaaacgtggacaatggcgttcgatggtgcactcaacagccaaggagcaggggcaggatttatcttgacatctccctccggagatcaattcaagcacgcaatccacctcaacttcggggcaaccaataatactgcagaatatgaaggactactcgccgggatacgagctgcagccgcacttggggccaagcgactaatcgtcaaaggggactccgagctagtcgcgaaccaggtgcacaaagactataaatgctctaaccttgagttatccaagtatctcacagaagtcaggaaactagaaaagaggtttgatgggatcgaggtccgacacgtctatcgcaaggacaacgtcgagccagacgacctagcacgacgcgcgtccagatgagaaccgctcaagcccggcacctttctcgatatcctgacgaagccatcggtgaaagaagttagcggcgaagttggcccgaacaccaccgacatcagctcggggtacttctcaaatgcgtttcgtccgacgacggcagacacctcctccttgatatacatgaaggcatctgtgggtcacacgccaccggtcagacgttggtcgggaaagcttttcgacaaggattcttctggctaaccgccctcagatgcatgcgacatggtccagcggtgcgaagcctatcaatttcacaacaagcacacaaagctacccgcgcaagcgctccaaactatccctctcacttgaccgttctcatgctgggggctagatgtactcgggcctttcccatgaggacagggcggctacaggttcctattcgtggcaatcgacaaattcacaaaatggatagaagcagtgcccacgggggaaatcagggccgacaacgccatcaaattcatgaaatggataatctgcagatacggactaccgcaccgcatcataaccgacaacggctcccaattcatcagcgccgacttccaagattactgcatcgggttgggagtcaaaatatgtttcgcctcggtctctcaccctcaatgcaacggacaagtcgaaagggcaaacggcatagtactacaagagataaaaacccgcatctacgacaggctcatgtcacaagacaaaaagtgggttgaagaactcccatcaatactatgggccgtacgctccacaccgataacgtccaataaggaaacacccttcttcctcgtgtacggctccgaggccatgctccactgcgagctacaacatcagagtacacgagtacagaagtactccgacgagaaccaggaggaacagtgagacatcgatgtaaatcttctcgaggagcatcgtgagcgagttgtcgtccgagcagccagctaacaacagtccctccgccgttatcacgagaagcgcatccgagcacgcatactttcgatcggcaactatgtcctccgacgagttcaagcccaagcaggttgaaacaaactctcaccaaaatgggaaggaccttacacgatcacacaagtcttgcggccaggcgcatacaaaatcgcagacggcaacggtcgcgaactagcaaattcttggaacattgaccaactacgaaaattctatgtatgagtcaataccactgtacctgtaagtacccttacagtatcaataaagcctatttctaggccccatatcacaatcaaagtgttttcacccgatgatcccttaccctgatgacacctagcgttgaaacctgtccttatgtccctttacgccgtctcgataaggcctccgaggaacctaagggatcttcgactggggacgcccagagccgataaggccttgtcagatcctgtagagacgaaagaccatgtaagatctggtcgtgtaagagttctcgccgtgcgtattaaccaagtcgtgaaatcggaaatcaattttccaacttcacggctgggggttaggataagagcttattcaaccaaggcaggtcaagagtccaagagccttatcctccaagaaaattcctccgacgacaaggctgggggctagggagagtgtacgactcaaacggctgactaaagtcgttaactgagaacacactcttacacacgacatctagagtaagaaacatttgttaaagatagatttctttattcacaaagtacttcttacaatttttacataaatctctcgctgctttacacctttcccttagatattgtcgcagggtacgagtactaccaagaaggctaacgccagtccatagactggaagatattctcggccaacggcgacatcgacctcgctagatggtctatcaccgccggatttctccgagaacgagcaaaaccttcgcggtgaaattcaaggtccaggcgcgggcggtgactcgtaggcaagccaacacgtgtcctccggcgtatcggctcgctcgacgacactcctgtttcaaggcctcgtcgatacgcttgccgatgccatcgagttgggcacaggctccgttcagccacgagatgtacccggccgccgattcctcgggatcaccgcggactactcgaagttccctgcatactctcgccatggaggcacagcaactcttcaagtacgagttaaaccacacctcgcgacctcggagcgtttccacagcctgctctttcttcacggccagcatggttctctcgagttccgccacttcaaacttcgtcttccagtattggatacgacgatcttggcttgcaagggcatcctcgagatctgctaaacgtgacagccatcaagacacgctggatacctctttcggaacatggacgacctaatcaggagggcattaagagatgaaggggctactcacttgaggcagtcatcgtctccgcatcaagggtttgttccacattgtcaggtgagatgtgtggtccaagctcgagtaccggaattatcgccagtgacccgggttgcccacgctactggacatcctcgtcatcagcatctctacaatggacaaaagtttccaagatcaacatacaaaactaaacaaggatggcaattgcacgcacgagggcggtcagagttcaatttttacacattatctaacaaatacaagaagtcctactcctcaaaaagggggagaacagactcccccagatcaccgacttcttccatcacctccttacgcatgtcacttgccaccccctgatccaagatctcgcgcagatcgagttcaggacgcgacaaccttacacacgcgaggacatgacacaccccggtgtagatcccgttcgacgtctcctccgcgatcctggctgcatgcttggaggggatctcccccatcgccgttgccagttccgcgagagaggaggacaatgagaactcatcaggattcaccgggattgtggacttgatgccgcactccctggcgagttggtggagtccagtgtaggtgatccgcaacaagccctggatctcggacaggttgttctcgagttccgacatgcggtcctcgagcccattccgttgtcgctcgttgccagccaccagctccctcatttttgtgaggtcttcacgggctttagccaactcgcgcaccagtcgatcagcacgcacgttctccgtcaccgcctccgacctcgcctccgcaatctcgcggccgatgccgcgagcaccagcttcgaggaggcgcccaatctcgatttggagctcctcccaggtgaggacggcagctggcagaccacgacctcccgcaggatcgctgacggggccgctaggcatcgcctcccggctccgggttgcgggcacgacatctgtcgacgctgtggcaggtgacgcgctggaagctcccccagacttagctcgggcagccttcgcccgcgcttcctacggacaaccttgggttagacactgctcgaatgagaagcacggagattcaagaatctatctacttacttctcgccgatcgtcacaatacgttgtcgtcgtgggggtggaggagacgcgtccgaggcctgaaagacaatcaatacagagtaaggaaaaaccctccttgccgcatgatctaatgacgagataaagttaccgagggggtcgctgccttgcgacgatgtccgagtacagacgagaatttcctcggcttggtcgagacattgccaccgctagtggtggccgcatcagatgcctccttgacaaccttctcctttagagatgtcgccacctgatggtccgcgagtggcccgatgatgtcaatcaaaggaagggcctacgcttaatcaggtcataaggtgatttcgaaaggagaatacgggatgcttatcaaatatacttacgttgatggcttcatcgcgttccgccgcccccttttcacaaagaggcacgggcatgtcgctagccgtcgttggaccgctgatcatcacttgaccgacgcgccgctctatagcttcgctgctcagacctgttaaacgagaactggcttttgataagtcaagaggaacacaagtacaagcacgccaagatgaatacgagaaagataccccgaggagaaacccaggttgcgtcatccggcccgaaatagttataggctggatgggcccgagcctggagcggctggatccgcctaccgacgaagtctgcagcgacttcatatcccgacaagccccgttctcggagatcatcgatgatgtcgataaacgactgaagagagggggtcaaagggggcttggcggtccaggccggaatcttgtccggttgatcctcgggaacaacgaagacagggtttgagtccttcatctcaagatagaaccacttattccgccacttactgcgggaagaaggacactggaaggggatataacgcgatttcatgccatcacgaagttggaacccgacgcaaccagacaccctattggattccatccaacgcagttcatagtagaaacagaagagatcgagaaaaggctcggcctcacagagatgaacaaatatactaagaaaggggatggaattaggattcaaatggagaagagaaagaccatagaaattcaacatcaggagaagaaactcggaagatggaggaagaaaaccgcagaaaacgtaatcttcgatcgcaaccatgcgacccaagaggggctgaggatcagtacctcctacttctctctccatgtcttcacggccgggaagggcaccgtcctcctgaaggttcttcaacgtcgcgccggtggaagacgacttgccgagatccattgctgtgccaagatcgccggaaaacaagcctgggttggcgaactagggtttctggtggcggtggagaaggcaaggagcgctggcaggcggtgtgtgttcaacaaggttggcagacttcaaaatgagctcccaaagttcctttaaataagcgcactaccgacggtgcgaattccaaggaacggagagagatccccgccggaaatcactgggcccgttacgcgcggcagttttatggacttcagttcaaaattcactcgtgaccgttgggcttcaaacggcatgctcgattacgttctatctccgcggtcctcgcaccaggaatgataacgttctcgacacccgaagtcgtaaatggttgcacgagttcattttaagcaaaagtcggggctactgtcagggttacaggtcaggcataccctctacccttcgatatacgttacatatcaacatggcatacccacgggcacgcggatgttttctacttatcctaaggaaacctttcacgaaatctacagatgggaagagtccttctcgtacagaactgggtcgttggcgtatcgtattggatctgatatctccgagttctacttggagacctctagatctgtgatataaaagggacccccctggggagggcatagatcatcgaatcttacaaccaacacagcctacgaagccggaatctacgaggagccaagtcattgagagctagtcgaatcaactcgactacgatcttgtcggatccgacaagttccatcgttctctttataacctgtgttttccaccatataatcccatatcaactggattagggctattacctatcaaggggcctaaaccagtataattcttgtcttttgattgtttgatgtcgtactacgtagatccttgtaccaacgtaccccaataccctctatatccggtctacgggtatcacccgtcgacaatgtgtgttgaagttaacattgaacttacttttgaaatttgttaaacttatgtgtgttgatctgtactgattaaataaagttttctatataaattcatattatatccctacaataaatttacttctaatgtcgtgacaatgttactcccattttgttttaagttacttttataatatatataaattacttttagactttattaaatttactattatatgtctaagaagtaatttagtcaaatctaaaagtaacttatatatataataaaagtaacttacgtatataataaaagtaatttacaaatataaatattttttcatcgtaatataatcatgtaagatcttgttgtgaagatttaattgtaacgaacacaatagcataattggattgtagatcggataagtaatttgagagaaaactttatttgaagagaaaaaaggcatacatgtctatctcagtccttcctgctacatgggtgtgtcaccctgtctgcagtcaagtactagtggagaaagcgataacgtaagctgaaaatgaatagataacgagatcggacggtcggaggtgcgtcgcgcaattagactaaaacgagaacgcgcactgtttagattttacgataagtttaaattttgccactatcaatttttttagggcaagattctatttggtttgctaccaatataaagccaacatatgaattctagtaaagattgttatagattgatgtcaaatctaacgtagacattactaataaattggtttcaatcaaactaagcacaagtactatttaaactaccaacgttgatagggctaagttttggtagcaattaaaaaggtccttaattcttttttttcatcgagagaagctcttgactgctgctgcctccactccacacgtgagcatgctgtgggcgtggtggctcgtgctgctggctgctgtcgactttcgtcccagtcgtcaggatgcaggcgcactctctcggcgtcagctgccgtcgcgccatcgctcgacacgaaactttacactaatacacggcacaagcggaccagcgatgggcgctgtggaccaacggcagtgcgcagggaggggtactcgcgatcgcggccggcgcgagccatggcgcacgaacgctccgccgcagacgtcgtgccagttacttactctatccatttataataagtaacttttttaacgaacatgacataaaaaaatttagtattagaatacatcccacccgttgaaaacttactatatattttagattagagattagttgaaaacttactatattttggattagaggcagtacacatcagggtatgtactctcctaagagatgtatttcttccgtaaaaaaagttaatttcacaaactatagatactttgattaacttatatttaaaaatatatatcataaaattatagatttaaaatattatatcagaaaactacaaatataacattatttttatcataaaattataacttttctaacctcaatagtgttatggatataaactctaaaatgtgtagatacttaaaaacttcatcgctaaatctgtagattcgtgatatgatcctctaaatcattagtttttggcaaaatttgctacaggaaactcaaaaaaaatgtgtaattaaccgcaaggcaccgtaaaaacgtgaattggctataggacaccgtaaaaaagtggtaattagctactagacaccgtaatacaagaagggacgagtgataaatactcaaaggtccaaaaatagacatgtttgataggaatccgagtaaaaatctcataaaatgatccaccaaacttgataaaaaatcatggtaattaatgagtctaatagcctaggctgtgacccttaccataaccaaaataagcatataacatgctaaaagaatgactattaataaaccagtcatctcaaatcaacccaaacagcttttgcagcctaataaagcttacaaaaacggtataacacctttctgtcgggcacctttttatgtgcgtcataataattccaaagaattattgaatcgcgttaaaaaggattttaacagcattgggccacaccattgtgaacacaaattgccaaagcaaaaagtgcctaagtccctaaggatcacaacgagccacgctggaaataagattgggctgaagtactgtgcaggcccaggcttgttagcactcccgataccctaattgtaccgaagtaaaataaaacgtctcttcgtcatccccgccgagactctcgccattttccccatttcctgctacagtgcaaaactgcgccggccaaactagggttcatcaatccgctccaatccattgtcacgatcggaaataacccaacaggcgttccttacgtgcgtgcattattccttgtcccaggaggcaaggtacaccaaaagttgatacaattcagagtttaacaagcggaagcgtaattaattaatttattacatgggcggcgaagacccagcacacaagaagacaaacgaaaaacagcggaagactagggcgacgaccacaggcgcttgacggcaggcacgagctagacaccaaagccttcatcatccaggggctcctcttctgggcttgggaaaaattgagcaagactgagtacaaccaccgtactcaacaagacacacccataagtgcagaataaatgcaagggagtacaaggggggttataatataaagggttagggtttgcagtaaacagcattaaaagacacttagttgctcaaagctattttgtaaacacgattctagagctatataatattattaatcaaggccgtgaacccacacgaacctgccttaacccaaggcctacgatgattcagaccgaactggcaacctgaccctgggtcccagctcgtcccaagccaacccaggccaaccattccacattttagttgttaagcaggttttaagaattaaaacactaacttgggtacattgctcagcatgcccataaccgagggtgcggctattcgaataggttatactctgatcagaggtgtacatctttacccacaagacacatcttcctcacgtgtaaccacgtgtcacataccaccatggtatacggacggaagacatgacatagtttccaacccatcctagccataaacaagagtaccgacccaaccccacctacggccggaacccccgggacaggtaggcaggactgagtccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgtaacagaggcccgaagaccggtccttatatggccgaggtgctactatcaaaaccatgcaccccgagcccagcctaaaaccattttgagggttttgaatagaggggaggtgtgaatccaattccacaataatccaacaattccatagtgtcgaggtgataagagtattcccaaagtctagagttgtaaaaccacctaatgttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataatttaaatcaaaataattttataaacttggattcaatatgttcaaggatgatgtgacttgccttgctcgctttcccaaacgtcggcttcaacctccacgaagagtggatcttccgaagctgcagcgtctacacgaccaacggaaaagaaaagacttttactctaaaaaactccatataacaagcaggaacaaagtacaaaaatgggttattgacttcttaaggaaaaattagagacttgaacagtccaattccgagttcaaatggccaagttatggccatttgaagtttatatgctctttaaatgaatatttgcgaatttcttcatttaaaatttaatttaaaaaggctttattgcgtcagccgaggggagggggcgcgcgggccgggtccacgggagtggggcccacgcggcagcctcacggtccacggtggaccgggtgcacccgggctcacaccggccggcgccgtcggtcccacgcgtcagccgcacccaagggcgcgggcggctgatggcctggccccacgcggcagctacacggcgcgcccgagggcggccatgccggcacggtcagcgggagacggtgcgcccgtgccccgatggtcgccgccggcgaccaccggcgcggcggagcggccgccgagagagggaagggaagggggaaaggaggcgacggtccacggctcaccccggggcgacggcggcgacggaggaggcggccggagcggagggaggcggcggcgcggctcgggtcgacggggtcgacggcattccggcggtcggcgaccgaaacggagaggtggacgaggttggcgaggatgcggcgaacccgaaggaggcggcgccgaggtgggaggcggtccggggcgacgacggcggcggaccggagctcggcggcgacggcggagagagagagcgacgtcgcgagctcgaatccggcgaggaggaagggcggcgagaggcggaaacggacggaggaggggcggggagggtttaaatagggttggaagggggagagagcggtcggaggggaaggaaaccggcgcgggaggtccggccgccatcaatggcgccggcgagatttgcgggggcaaatccgcccgtttgaacgcgagagagagaggaaaaaa

SEQ ID NO: 77077 - DNA, 37485 bp, Oryza sativa
tgagagctagtgagcctcactccatactttgagtactcgagttcatagcaagcaaatcttcgattgggtttgttactcttggagactaaggtctcctagacggctaggcgtcgccggtgagcacccaaggttgtggtgtgccacggaaagtttgtgaaggcttcgatttcgcctccgcaagggaagaaatcaagagtgaaaccgaggagtgcatttgtgcaacctcgtgaagaaagggttgaaatagacccggccttgtggcctctcaactgagacgtaggatccatggatccgaacttcggaaaacaaatcaacgtgtctcttctcttggtttgctcattcttgccatctctcatattgtgcttgagtttgttttggcccgatctacttgcatgcttaattaatatagttggtgaccttatatcttgcttagataccttatttgtcaccttttgattcgtatacattttgtttattcgtgcaacaagttcatagctagtgttttattccgttacccgccgaacttttcggttgagaccggaagttcttatcccataccggaagttccgatttgaaccaaaagttctctaatctctaatatgctatgaagttgtgataattttttaggaacacctattcaccccccctctaggcgacatcaagttcctttcaggaagaaagttgatataggtccaggtgataggccaagaccgacatttattagtaaaaatttatctccggaattcagaaccaagttgatagagctcttaaaagaatacagagattgctttgcttgggaatattacaagatgccaggactcagccaattgattgttgaacatcggctccctatcaagccgggggttagaccatatcagcaaccaccaaggagatgcaaagccgatatgcttgaagctgtcaaggctgaggttaaacgtttatatgatgttggttttattcgtccatgccgatatgcagagtgggtttccaatatagttccagttattaagaaaaatggcaaagtcagggtgtgtattgatttccgagacttaaacaaggctactcccaaggatgagtaccaatgccggttgccgatcaattagtcgatgctgcttcaggtcataagatattgaattttatggatggtaatgctggttacaatcagatttttatggcggaggaggacattcataagacaacttttagatatcctagtgcaatcggcttgtttgagtgggttgtgatgacttttggcttgaaaagtgctggagctacatatcaacgggctatgaactacatataccataatctaatcggctggttggttgaagtttatattgatgatgtggttgttaagtcaaaggaaatagaggaccacatagccgatttgaggaaggtttttgagagaactaggaagtatggcctgaagatgaatccgacaaagtgtggttttggtgtatcggctggttagtttttaggatttcttgttcatgaaaggggaattgagataactcagaggagtgttaatgcgataaaaaagattcaacctccagagaacaatacaaagttgcagtagatgattggcaagataaattttgttagaaggtttatctctaatttgtctggtagattagaaccttttacaccattgttgagactgaaagccgatcaaaaatttacttggggggcagagtagcaggaggctttggataatattaaagaatatcttagttctcctccagttttaatccctccccaaaggggaataccttttagattatatttatcggccggtgagaagtcaattggctcggtcttgattcaggagcttgaggggaaagaaagagttgtgttctatttgagtcgtcggcttttggatgcagagatgaggtattctcctgtggaaaagttgtgcatatgcttatatttttcttgtacaaagttacggcattatctattgtccaatgaatgcactgtgatatgtaaagccgatgtggttaagtatatgctatcagctccgattttgaaaggaagggttggaaagtggatatttgctttgacggaatttgatcttcggtatgagtcaccaaaggcgattaaggggcaagctatagccgattttattgttgatcatcgtgatgactcaatcggctcggtcgaaattgtgccttggactttgttttttgatggatcggtgtgcactcatgggtgtggtatcggcttggttataatttctcctcgaggggcaagtattgagtttgcctatactatcaagccctatgaaactaataattaggctgaatatgaagcggttctcaaggggttgcaattgctcaaggaggttgaagccgatgctgttaaaatcatgggtgattccttgctagtgatcagttaattggcaggagaatatgagtgcaaaaattatacattagtggtttacaatgagaagtgccgagagttgatgaaagaatttcggctggtgactttgaagcatgtatctcgagaacataatgttcaagctaatgatttggcccaaggggtatcgggatataagccgatgatgaaggatgtcaaagtagaagtcgccacaataacagccgatgattggaggtatgatgtgcatcattatttgcaaaatccatctcaacggcttctcggaaattgcactataaggctttgaagtattccttgttggatgatgagctatattatcagacaattgatggggtattgcctaaatgtttgagtgccgatcaagctaaggttgcgataggcgaggtacacgaaggaatttgtggaactcatcaatcgtctcataagatgaagtggttgcttcggcgggcatgatatttttggccgacaatgttggaagattgttttaaatattacaaaggatgtcaagattgtcaaaagtttggagcaattcaaagagcacccgcatcagctatgaatcctatcatcaagccatggtcgttcagaggttggggaattgatatgatcggtatgattaatccaccatcaagcaaaggacacaagtttatattggtggcaaccgattactttaccaagtgggtagaggcgattcctttgaagaaagttgattcgggagatgctatacaatttgtccaggagcatattatttatcgatttggtattcctcaaaccatttcaactgatcaaggctcgatctttgtgtccgatgaatttgttcagtttgccgatagcatgtgtatcaaattgttgaattcttcgccgtattatgcacaagccaatgggcaggccgaggcatctaataagagtttgatcaaattgattaagagaaaaatttccgattatcctcggcagtggcatactagattggccgaagcattgtggtcttatcggatggcttgtcatgattcgatccaagttcctccttataagcttgtttatgggcatgaggctgttttaccatgggaagttagaatcagctcaagaaggacggagttgcaaaatgagttgacagccgatgagtattataatctcatggccgatgaaaggacttggttcaatcaagattgagagcccttgcaaaagttactatggataaggagagaattgctcgacattacaacaaaaaagtggtgcccaaaacttttgctgagggtgaacttgtttggaaattgattttgccgatcggaactcaagataacaagttcggcaagtggtcaccgaattgggaagggccgcttcaaattcataaggttgtatccaaaggggcgtatatgttgcaaggacttgatggagaagtctatggatgagcgctcaatggcaaatacttgaagaagtattacccaagtgtttgggttaatgcatgatcggctggtgttgccgatacatgacagccggtgtgttcacatcgccttgagatggccgatatggttatatcgcccttagttgtttttatgttgtaatcggttgtgttttgctgatgtacaatggtcgatatggttatatcgcccttagttgttttcttattgtaatcggttgtgttttgccgatgtacaatggccgatatggttatatcgcccttagtccagattataattttattaatgtcttcgtcattgcaaaattaggggggcacatatatacacaagttgcaaatttgcaaaaatttttagcaaattgagaagttatattaatcggcacatcagttcaatgacaaaaggagaatcaaggtttcatagccgattacaaaaagaagctataaagtctaagtcctattacatagaaggtcactgagatagatattgctggatagctgatacagcccggtgtctgatttgttctacttcttcgattgcctgggtatcttgtgcatcagttccagggatgacttttaaggacttagtcatatcggcaacatttctaatggccaatttcagcctagacttatgttcttcaacaacacttggaagatcggctagcttttgcttttcaagatccaactcggcattgcattcttcgagttaagctataagatcaatcttgcgggcttcaagccgatctatgttcgactgaatcggcccaacagagagttgatcgagcttggctttctcttcatgcacgagttgccgattggcttggatggtagcttcaatgtctttccactcccgccaatcggctatccgttacttagccttctccagcttgaattgatgttgctcgaggtatacagctggagtaatgatgttcgccagatcatctaggatgaaggcttggatttcagcaaatcgtgcccggattgaaccacaatcagccaccaagctgtctaatgatgaccctagccaaagggatatatcctcaagtgttctcttgatggtttcatccaaaggggctagagccttgcttgtggattcttcttctgcttcttcatcaaaataatccttgatatcaaaagaaaacagatcggctaaggcctgcaacagagaaattcgaagatagtcaaatatcaaacagtttcagccgatctaggttcttatgtcaatgaaggacttattgggatggcaggagtggctggttgttcctcttcttcaacatagtggcttcctgtagccgatggggtacggtcacttgacatctattgcacaggtggtgaaggaggacgaggaggctgcaaaaaaacaaagtgttatgtaaatatcagctgtgattagataagtgagaggatttatatacgacaatcttactggtgtagctggtttaagtgttgttgctgccgatttcttcctcacagcagtcttctttttctgcaaaaacgagatttataagtaatcggctatgaataaaatgattgcaaggggaaattaatataagtgatttacccttgaaaaatgagctggagcagaaggagttggaggagttcacttaggtgaagccgatggagttttttttgtatcacttacttcggctgcagcttgatcaacatcctcttcaatctcttcctcatccaaggcttgcccgatggatggatctaaggcaggcaagtcatcggctggcttaggcttattcttcttgatcttctttttgggagccagagccgatggatctataaccgatgccttggtctttctcttcctgccgacatcggctggttctctcatctgcccttgaagcagacttgaagtcttgggggcatgatagccaatgactggaggggtcaatccaccaccgtttggcaaatggcctggagcatactctatatccctgccactgttgctcttgcggggaggagaagattctgttgtctgcaaggtaaagagaaaagttaatcaagattcaagtcggctaatagttgtttaaataagattgataagagcagaggtatacctgaggaatgacatctgggaacaagtctatcatgcacatggaggctgactgatggaatatgtgttgcttccattctccccaccatctgtcaaagtttttgctccaaaacctggccaactctatgttatcaatgctggccaaaggaggtcctgggatgttgagtagccgatccatcatcagggttgatgaaatgtctcctcggcattggattttatcggcaaagaacaagccgattggtagctgtcccattccaaattgcctagctgagctcatcggatgataaaactcataggagacttgaatatttcttccttgatgtatgctgacagggaggatgcatgggctaatagcagcagcaaagacttctctggacttttgatatctctcatggttgatatcttcaaatctgaagtctgctgggagatccaaattgactgaatcttcatatgggaaccaaacccgagcatctttctggaagccttcataaaagctacagaaccaatccttgagtaattcagccgataactttgctccagcatcggctggtgtggatgcatattccccataggacatacacctgcggtgggtgcgctcttctccatcatcatctgtgatcggctctaatcttggaaattcagcttctgttacggctggccgattgacagctttcatggctaccaagtttagccaagtttgcagcaaccaccatggcccgcctgcgttaacgactgagccgacagcaatcttagccgatgcgttgttcaacatttgatacaaatagccaagaaggattttgcccaaagggaattgcttctttgtatcaagggcttcggctaagaactaccagttggtggtagggccacaacttgatccataaaaaaggaatttctcaagccatatcagcaggagggccacatgttatcgggaagttacaggtcctttgcccatatatgctgctacataaccagaccagcctcttgctcttagttctgaagtcaaactggttcttggtgttcaaactcatggggttagccgatgaggtcacatccaaatcggtgatcatagtaatgtcaagcaaagtgggggtcatcggcccttggttgaataagaaagcgttgatggtgttggaccaaaagtaggtcgcggcagccatcaggggttcatccttagctgaatttgctatagtgagggcgagtgcctggccgattccgatttcatcctagtgaacctgcttgctagccgatatacgcttataccacacagcccagcttttctcaggggcagttttctcaagagaaggccaagacttgaaggtgtttttccagtgacctagattctgattggctaatctaaaagggatcctattggtttcggcggagatgaactcagtgggatcaagattgccgatcggaccaagaaaatagtgacgctcatgtgacaaactcggagtcgcaaccagatcggacaagtgctacagatgtgaataagaatagagaagaagaaaacaagatgaggcaaggaaaaaccaatctattgcgaaaagatgggatctagccgatgagcacttacttctgcgtactcagccgatggcgtggtagacgggctggcggaagtcgacatcgccgcgggcggaaacttggccggggaggagatcgccttgaaatcgccttgcgcaccgagggaatcgccggagagagggaagatgagtttggcttaagcggtgaaaacggaagtaacagtgtgaagtttctcggggacaacggttagtatttaaagcagagtgataacggtcggaaaaacggcaagtgcgatattttctcggagatgaaatatcgcaaatccgaaacaatatcatatattccggacttggggggaatgtgttaacaaccaaatttggtaatccaagtgtcagagatgaagataagatcgaagcagaatccaagatcaagatcgtttcagaaacatagtaagaatcggctaagtccgaatcttctatgatcttaatcagtagagtttgagtcagacaaggttagccgattgagccgattccgacaatacgactcggtatacgttgtcgggttgtgttaatgtgcttcatatggattgccacacacggattgggtcctggaaaggcaattgtatctattaattaggatattttatgtaattcccttatagatatgtttgggcaaaagtctaccgcaaagacttatggtatcttagagtttgttagagataagagtcgtgtccaacacggacatactttgtaatctcgggtataaatagaccccgagccccatgtaatacaacaacacacgttcaatacaatctcggcgcatcgccacccttttactttcgttttgtttcgacgagttcttgctttcgggttgagctgcatcggtttcgatcttcaactagaggtaaaagatgttatggcggcttgcgttctcgggattagtgcttccatctttatgatactctaatcttgtttatgtaattcgtcgagttatcatatattttatataatcttaggcaatattgttatttaaccatcaatcggctaacatctatcgctagaaggcagttgatcaggttaaataccaacgttgacttagattatataggatatccaccactctatgaaagatccagcggcttgattgtctagatattgtccttcttttcatacttatagctgcatcaattgggtttgaccttataagtcatgattagaatcttatctctagcctgctttatggttgccgattagtgtagcatcggggttttagccgatcttacctgatttaatatatatttcgatctaagtgatttatactgtctcggcatggcgaccgttctatcccaatcacttgatttaagtatatatcgacataaggattatatattattaatatctacagccgatcgagtagattcagttctttcttacttgttcatgactgccgatcgatatacatatgacatcggctcaaagataaatgatatgttatcggcaactagccgatcggctatcgtttatggatttaaccgcggtttctttgtctttatttcttgttgattgcaggatcaaatcagctgcacactcacgaacctaaaggcaagcttttggacctgcactggagttaagcagatctcccaagcctcgtgttttcgcatcaacaatcgtatagttccattagctagctagtgttttgcctgcaagtacagtgtgatgaccgtgacgccgctcttctcaacatcactctcaatataacttgtgaaattacgtgcaaacaccgtgaagagctcctcaagtatgccctccccaaaatggctcgcaatcagggactccattgccgcccttaggcttgcagacatgctctctcccgcagtgtgagtggctgaaatgccctctgcttgctctgagtcatccatggcgttcccatctatctctaagagttggatgtcacttatgtcaagtagctcgcactgctgcaccagctgcttcagctcgtcagctgaagggcagtagaatggtatgttgaaagagtccagcttctccttggcaacacgaccctatttatgcaaatgcagattaattaaacacgaattaagataatagttttccacgtatgagtgtttgactatataacattgttggtttttattgcccttcaaactaaaagcaatgtacaggtatttaatttaagcccaatatatactgtttggacaaacataaacatttaattaggtagcttctgaatatatatttgttttctatagcacacatatatatgttcatatttttgcacgtttcctttgcactgtcaaacgttccaaagccgtaacaagcaaaaattcctatttgtatagtaaaaccaactggtataactatccaatgaattgagagccttccaaaatccaaaccgaaggatcagattgattcttgtactatttgtactagcagtagtagaagacacaactatcaacagtaacaaatgttaaatggtcaacattactcgaaacaacaaatatttttatttctcatatatatgtttatacttttaagcatttctcgtgtgtcatgcacaagaatattttaacatgaatcaaactttagaataagtactaaaataagtaagatgctagctattttcactaaatctttgataagtaccacaatacaattcaaactttagaataagtatctataatgtttttttcctaatatgggagtaggtcaaccaggagaataattactttttctatcaaagaatatcattatggtttaaaccataatgtggtatactcttgtcatgtgcattatacctcagcaacaagagtgcgtagcccctgtgacagcaactcgaataaggtggttgtccctcctgcatggaacacatctttgttcttcctcccagcaaccgtcaggaccatccggcctccgggcacaatctccatgcatctcatttggaggaactgtgagaagtccttctcaaactgattttggtagagctttgccaccgatggtggtgtagtcgctcctatgtgaatgttcccctcgttcatgctgccatcaagatgctcaggaacctatccaaacaaccaacgttgccagtgagctcaaagttccaaaggtcaataacttagtgtcctaattttaagcttatgcaatgagacatatataaacaagcctcacctgagagagccacatgatgctcattgaggaatggaagagatggacgctattggaagggaagagtctactgtagaaggaacccggcagacctgcgacaaagtgcgcgggaggttgtaaccctttgcaagcgcaatcatgtattgtcgactgctcgaactgctctagtgattggaagatgtggttgaagtcattgccaggtagatcattgaggaagaactggatctccatggggctctccttgatagtgttgttatggtcctcacatattgtggtgatcgcctcagagacgaagagaagtgtgtttgctccgaaggagcaaccaaggtcagcaatgaccattaattgaggatgaagatctatgcacacttcccgtacagctttctcaactattggtttggcagcaagaacagctcttttctagacagacatggtaagtataaaaattatggtcaaacaaatactccacttgtcatgtgccaacttcggtaggcccctggatttgatacatgactttaattaatttaaagtcctgttagtatttgcacatgaacaagtaatgttagtggttaatttctctatgctctatatatactaccgagtagatgcatgaaatctacagtactgcatgagatagaatttacaattaacaattttctcagggcagcatgtttaatttgtaatgaagcaataatttcaagaatttgaatggaagaaaagtagagagttggtacaaacttgcatccttgaattctcagcataactgaactcatcgtcccctttcatcatgtggaaatcgcgctcgatcttcatggctgcaagatactttggctagaagcttaattccctgtatgtgttcctatctgctgcctagacaacaacagtgttatgtgtggagtatgagagctcacgagagattatttcttccttttatagagaaaccaaatgcatgtccgatttcgaacaagaaaataaaattgtatcgatgatagttattcattccaaatcagggtgcttgattctggggtcataatatacattgtcctcggcgattgcctcttgttatgtacataatagattttgcaacttgtaaagccaatcagttgatagtttggggttatactatggggatgcatttaaggtgggtcttggaaaatctcacgtccagtttggtgttcatgcaaatggatttgttgaaacaagagttagggatcatgtatgtgaaggaaaaaaaaagttcatttgtctccaactgaactatttcaatgcatcacttaacctccaaagttttttttcactcattttacacgaagaactattaaaaacgattcactttgctctctatcgatatttctctttttgttcttctaggacaatgaaatttagtacgattgatagatgcgctataacttacctctctttttttttacaattttttttatcaccgtttatatagatcatgaaaaaaattgataatattttgaaattttgataatgatgttatctacggctctacaaagttttagcttaaaataagactcgtaaaagtgtaacaaatcatagaaatgctattaaggattaaagtgaataattttttatttgtataggggtaaaatgagccaaaagactgtttagggtctaatgaaatagtttgggggagtaaaatagacttttttctacgtgaaatggaagaaacggtgatgggttcctttgacatacattcattcaagaatgtagaggaatttttcctgtggtattccttttttctatgtgcatgctagatttagattctaatctgaatcagtgtgcttaattccggagcattgcccacggttgcaattgctttcaaaccctatacgtgctcaaatcttacacctcaaaccaattaacgcacgttttaaacgttttaggggtccacacaagagtgttctaacgatttccagctacaacacggtacaacaccaactttctttttttttttacatgggcacatcgtgtgtaacaataaaaattaagttcataaggtacgatgaatgtgtccatctagccttttatacttgacaccattgaccagtgtaattttatttttactaaaaaaatattttaaattgcactgttgtaagggatgccagttatatttatcatgcatagcactccgcattattttgataatccgacattgttctaaatatttgtaaatcttttaaaaaataagagcggtcaaagtttgtagatcaacatatctggtgacaaagagcaccaagggagtaattaattactccctccatattttaatgtatgacgccattgacttttcgaccaacgtttgaccattcgtttcattcaaaaattttgtgtaaatataaaaatatttatgtcatgctcaaagaacatttgatgacgaatcaagtcataataaaataaatgataattatataaattttttgaataaaacgaatggtcaaacgttggataaaaagtcaacggtgtcatacattaaaatatggaggtagtattacgtatcatcactgaagaaaccaccactctaaagtctctattgcctaatagactttccacttgtacagagtacagatagagacaccatctatatctttgatcaacgcaacgacttacctgccatgcgtcaaacctagcctccgttttttttttctgtaaggtatgataacgtctccaggagaaaattttgacgcgtcagattattttatttaagtaaagaatgctgtaatttctaagcttgaccttatgctacaccgtttgttggcaaaatcgtcacaagaaggacctcctgtcttttatttgttcttgttgctccatatgttactgctgattttgttctcctgaaattaaaattcatacgcagattgtacctgaacaggttcacataactgacaaagccagttcaaacccaaattggccaagttagtttaaaaagttcaacataaattcaaaattttgagaaatcttgttcgatttttactgattttagctagctagcttgatggtaccgggttgtatacatctctagttgcagatattggatgtttttatttgcttaaagaatcttagaggaaatgtgtctgggcctcagggaaagttagatgatgggctggcatgctgacatggccagtttgcacgcatggcatctcctagctactaacacaaagggctcataaacctgccaagttgttaaaccgctggtcaaactgcataaatttctcaaagacattgcacctttgtgtttcaaattggcaaagagaaagcaaagaagtgttcaacaagagttactaaataataactggattatatccttcaggcaaataacaacagttgaagagctccacgaattagtgaagttggggagtttacttcagggagttgaactaacgccgaaccctgatgatatctcatggaagtggaatgaatcaggaacctactcaagcaaaagtgcatacctgtttcaatttgagggatcattcgcttccatagatttcacctcactttggaaagctccggctgaaccaaaaacaagattcttaatttggttggctcattcttcatcagaaaactcttacggtgcaaaatttacttcgaatacactggccatgcaattggatttgctgtttgtgcacaagcacctttgaagacactaatcacttattcagcgaatgcccttttgtaagacaagtctggagcatggtctgtgcttgggagaatttggtgctaagcaacggccttaccctagacggagtttcaaaatggtggtctgcaattgagtgtgctggctcgaaagatcaaaagaaggcggtaaggggggcaatgtttcctacttggtggaacgtttggcttgagagaaataagagaattttcaacaatatcacaagatcggagagagaagttgcttatattacaaagcaagatttagaccttcttagatcggcttttaggcctccttgagtttcgattttgttttgtttttatcggtgtaagtttctcatagtttctctggactgtaagcacttaattcccccccccccctctaatgaaattccgccaggtctcctgccgtcgttctcctcaaaaagactgcataaatttcaagagttaatttggtccatgctattacaaatatggtatattagaaagatggtattacaatccacgttatcggctgggtgccattgaaaatttcaaaaattggaaccatgccactcctgtcactatttacgtcctcctctctcatgtcgccgttgtcaccgtcatagtccacccctaacgccaccgccgccgacgacgaccaccgccggctgtgaacctgcagcacctcgtgcgccgcctctgtcacggtcgccgccgacgtgccccaccacctccatggcaccgtcggtgtggaagctggtgcttgcctcggccgttgtgtcgttcgtgctcgcactctatgatggcgcagaggacgacgaggtcagggcaaccgccgttgtggaacccttcgtcatctagctcatcctgatagtgaacgtcgtcactaaagtctggcaggagagcaatgccgagaaggcgctcgaggcactgtaggagatccagtccgaggacgcaatcatcaagctcgacgctcggtggtcccatgggcttccggcgcgcgatctcatcggcggcgaccgtggcaaaggtagcacacggtgcggacgcacggcctcttcctctggtatcccgtccgcggctggcggtggtcgtcagcggcggcggtggagtttgggagggctgtgctgcggcagcaagggccgcgtcctcatgctcctgtcccagcagcggcagcagcagcacgcactcccttgacgccagcggcaggcaacaacagcagcagcgccgcacttgattctctccagcaacaacaaaacatctgcaggccgaagcaacagcagcagccactaggcgacgacatcggcgccgtgcttcgcctggtcggcgcgtcgtcgcccctgccgtcgtcgtcgatgtaggaggcacgcgaggtcagctgcggcggtggtggtaggacgaggcggcgcatgggtgccgacagtgacacgatgtgacggtgaggatggcgacgtgagagagcaggacggaaagagtgacgggagtggcatgattccaatttttgaaatttttagtggcacctagccgataacggaaattgtaatagaatttttctaatatgtcatatttgtaatggcatcaatcaaattaacccaagcatgaattctttatgcatgaatgacccaatcatatttctaatatcttcccttcaagcggagttttatgcatgaatgatcctccggcagtgacgtctagatagaatgcagattctttatctagacccgaatgaaaatgttgcaacagcacatgatcgggtatagataaaggttggccagattgcactagattagtgaacctggaccaaactacactgattgattctttgtttatctgctgtaagctcagaatttctacccacagagtagtgatacgggttaccggaaagaatctatctcgcggtttttcccagtcaccgttcacacatctgacggtagatgtgcaccattgtttcactctctcgtgaagagagaacggaaacaatttccaccgaacagtctcttgcttcatgcctccaatcttaaggcacgagcaaagtgctcaaattcccacagatgatagtaagggttttcctggtctaaaccagagaaagatttctccctaaccatactgatgaactcgggacaaatttcatagccaggtgttaaaataggctctaatgaaggaggtggctcgtaaaattcgccccgaggagcagataattggaaaatagattgtggctccattggttgagaaggttttacaggaaggggtgaaggtacaggaaagaaaaataaaaagggtacgaggatgaatgaggttccgagatagacaacaaaggttcctcggcaacggcgctagaaatgcttgttggtatttcttacgatcatagataaatccgcaagcgcacggaatatactgatgtagcacttcacccgggagtattctcaggtatcgatttccacaaggaacgtgtgtgctaactctggttcaggctcatctaaggacacgaagctatggataggcaaaggatagagaggtttcacgggtaagaaacaatgtctacagaaagcttaactttaatcctaatgtggtactttgggcactggctagctcgctactcccagatatcgctctactgcgcacctggatagggaggacttcagtgatattgacggttgtcaccacctctacaccgacctcacacctattgtgggatgcggagcaaacaccagaaatcaactatctagacaccgcgtctaagcagttaataactactctagtgtttataagtcactaaagcaatcactatattttagttgactatagtgaacgatgatcccgtactctgtttaggaactaaccaagaaataaatctcactgagcaaaactaaattactcaaaagatatttcaattataatcagagtaataaacagagcagaatgaaataggaagaggattaccaacaactccggaactcctccgacttcttctactctactctctcgctaatctagtatacaataaagtacaattagagcctcttataatttagcttatgcttcaagtgtttgtgaatgagggagaaaagaggggtatttatagtgtagaggtgacttgagagagtggagatgctatggaatattctccatagtatccaaagagcatatttcttctcctcttgccatgtgacctgttgatgatgggttccaccggtattaatgctcataaccgtcataggatgaggagcacaaccgtcatatcgaagttgggctggattgggccacctgctggtttggctgaaccaggggttcggccgaaccctggctggcccatccagcccagccctttctctggtgttctgacatgtgggtgccactatatgttccactgaagattggccaagataaatgtatcttattgggtttctgggctcaaaactccataggcttggatatggaagttatattgcatttcatctcaactttggtgggttgtattctacatacaaatatacattaacactcgtgaaaatggttagaaataaatcctaccactatgttggatgttttacttttatggtcttatacaggtattgacggtgagaattttgtacttaacagccgtcaacaaacgtgtacgaagaatagaagaaaatggagagaaaaaaagataaagaaagtaattcaacatccatgtggcatgctacatgagcaccacgtaggatcccgcagaggttttcgcaattttggactagaatgacaaacactgacaagttcggaaacctaaaaaatacatttttgagagtttggggacctggatgacatggacgaacaaatctaaggaccggcaatgcaatttactccttcaaaaacaattttttttttgcttttctccatactggatcattactcccagatttattttcattgaggcgtgttctagatacctaaacaagtttttgtaaaaatctgtgatatacttcaacaagttctactgccctttaattatcccttcttcctgttctccatatgttattatgtctttccttttcccaccattagctttgccatgataatacatggtgttattatcccccccccaccctctcaagccaacacccagtaaattgtgcggctgtggtggtggagggcctcttcccaagccctatgcacctcctccacctcgatacacatccccttggaagggggagtggtgtggatgtcacatgcttgaacggaatatgtccgccattggagctttccccaccaccttcaccaccgttgcaaaaccttgtgaatctcccatcccatcccctttccatctccaatgtctccactgtaacaccttctctcgggcaatattcctctacccaaactcgcattgctctagccttcgaagatgctagaaagtgttttgagaagtggcgctagtgattctagggcaagccatgacttgagaagatcaggaaagaaactgggaaaggtagcagtgcaccaagcatgatagctctcaccttaccgggtcggatccccattacaccctagacccaatcgccatggccaggtcccttgtgctttactgtcgcctctagagtttttcctaaccaattgagttatgctcactttgcgtgtattattaaatcataaaaaaattatactcactctgtcccactaaataaggcatgattgaacttatcacggactcgaaaactaatcttttacattaaatttctcttatacaactgtttgtagcaacaaaatcataatcataggaaagtaaattcaaatgtcaatctaatgcaggggcgcatctacagtaataccactggtgtcaggcgacaccgacgacttttggcaagctatgcttaaaccgcctatccatatattataacactatattctaaatatagttagcatgctatgacaccgatagacacgttatgacaccaacgaactaaatttctggatccgccactgatccagtgatattattttcatcaaataaatttgaagttataataaaatagttattggtcaaatatttaaagagttgaatcttaaaatacatttgtgccttattcagtggttcggagggagtaattaatagtcaaaaccaaaaaagcaggagcttcattaattcttgttttaataaatccatatattttgtgctagaagatcaacagattggataaatggacattgttgatttaatgtttttgactaatgtgagaatttattgcatttttaggattaattttggggcttatagattctgcttataggagagactttaattagaaattaatacaaagatggggatccatcttaccaagtgagcaaccaaaaggccaaaagcctcataagcttgctcttattaattgggaagtgcatctctagttgttttttttttatcgaagtgtatctctatttgttattggagatactgatgttatcatttgcttaacataatcttgtaggagaagttgtgagcttcgggagaattagatgcacatattctcctaacaccaaagaacccaccatcttgcatcatatcacaccacattattttcaatttcttgcattaactttcaccgaacttgccaagctggcataccatgagcgcactttactctataaaatcaccttatatttaaactttatatgtttctctgccaggatatattgttgacactctaccgtatagtaccattatctagctagtgttttgcctgcaagtacagtgtgatgatggtgatgccacttttctcaacctcactctcaatataactagtgaaattacgtgcaaacaccgtgaagatctcctcgagtatgtcctccccaaaatggcttgctaccagggactctgtcgccacccttagagttgcagacatgctctgtcccgctgtgtgagcggcggtggtgccctctgcttgctccgagtcatgcatgcggttctcatccatctcgaagagttgaatgtcacttatgtcaagcagctcgcactgctgcaccagctgcgtcagctcatcagctgaagggcagtacactggaatgttgaaagagtccagcttctccttggcaacacgaccctgtgtatgcaaatgcaaattaattaaacaataattaagagaatatattttccatgtatgagtgtttgactatatcaacattgttggattttattgtccttcaaactaaaaaaatgtacatgtaattagtttaagcccagtatatactatttggacaaacaaaaacatttaactaggtagcttcatttgacaaaaaatatatttgttttccacggcacacatgtatatgttcataattttgcacgtttcctttacattgtcaaacgttccaaagccgtgacaagcaaaatgtccaatttttagagtaaaaccaacagggtatataattgtccaatgaattgaaacccttccaaacaggatcagattgttactgctactatttgtattagcagtagtacaatgcacaagtataaagagtaacaaatattaaatggtcaactttacttgaaacaaaaagtatttttctttcccatatatatgttcatacttttaagcatttctcgtgtgtgtgcacaagaatattttaacatgattcacatgctaggtattttaactaaaattttgttaagtaccaaagtacaattcaaactttagaataagtatctatagcactttttttataatatgggagtaggtaaacaaggaaattaattactttttctatcgaggatatcattatggtttaaactataatgtggtatactcatgtcatgtacattatacctcagcaacaagaatacgtagcccttgtgaaagcaaatcaaatatcgtggtcgtccctcctgcattgaacacatctttgctcttcctcccagcaaccgtcagcaccatccggcctccgggcacaatctccatgcatctcatctggaggaaccgtgagaagtctttctcaaactgattttggtagagctttgccacggatggtggtgtagtcgctcctatgtgaatgttcccctcattcatgctgccatcaagctgctcaggaacctttccaaacaaccaacgttttaggtgagcgcaaagccccaaagttcaataacttaggatcctaattaagctagctagtttatgcaatgagacataaataaataagcatcacctgagagagtcacatgacgctcatggaggaatggaagagatggacgctattacaagggaagagtctagtgtagaaggaacctggcaggcctgcgacaaagtgcgggggaggttgtaaccctttgcaagcgcaatattgcgttatcaactgctcgaactgctctagtgattggaagatgtggttaaagtcattgcttggtaggtcattgaggaagaactggacctccatggggctctccttgatggtgttgttatagtcctcatatattgtggtgatcacctcagagatgaagaggagtgtgtttgcaccgaaggagcagccaaggtcagcaatgaccattgattgaggatgaagatctatgcacacttcccgtacagctttctcaactattggtttggcagcaagaacaactcttttctagacatacatgaaaaatataaaaattatggtcaaacaaatactccacttgtcatgtacaacttcgataggcctgtggatttggtacatgactagtaattcaaagtcccgtttagtatttacacatgaacaaataatgttaggggttatttcctctatgctctatattactgagaacatgcaatctacagtagtgctcaagatagaatttacaattaacaattttcacagggcagcatatttataatttatattgaagcaacaattaatttcaagaacttgaatggaagaaaggtaagagagttggtacatacttggatccttgaattcttggcataactgaactcactgtcccctttcatcatgtggaaatctcgctcgatcttcatggctgcaagatgctttggctagaagcttaattccctgtatgtgttgctatctgcctagctagacaacagcagtgttatatgtgtggcgtatgagagctcacaagagattatttattccttttatagggaaaccggatatgcacgtccgatatttcaaacaagaaaataaaaatatatggctgatatttattcattctaaatcaaggtgcttaatattgtatttgatacaatccaattagtacgggattatatcaaatacaaaattctcaggccatgagatattggcactatgtaagcaatactcacaaacttacaggcggtttttctaagtatccaccagtgaaaaccatgaattttaaaggctgtttcttaagaaacagtctgtaaaaaatgtggtgacttttataggtggttctcttaaataaaatacatgtaaaaatgtttttttacactgtccttcaaaattgaagcaatatgttctggatttaaagaaaagtcaaatgattataaattttatattaaaattgtagctcttgatgagatctataaaagttttttttatttgagatcacttttcaggccgaaatagtcattacaggctctcaggacatagggtaattttgcacattgtcagggttatggataccacatacccaatagtaatcgattaatctcggcagggcccagcacataccaagtcttatacggaatcataactcgtatataaaaggagttccggataaggaaggacaaatagagttctatatggaaatgacaaagactacacggattgtatctatattggtctctctagttctacttggacaatgcgacatctataggtataaatacaagcctccctagaaggagaggggacaagccacaaggcacaacatacacacaaggcaatacgccactaaatatcgacatcagagattagcctagacataccctatccggcgcctatggaggccggcaagagggatctagctctatctctgatctcgacgagatcatattcgaggaggaagactaccctgccgtcgactacgagttggttatccatgccgccaagtcgacgaccttatctcaaatattgtactggtgtgattatgatgaataagagcaacaccagtttcggccaacaggagttgggctatcacctgtcagataagaggtccgaacctgtataaaaatacttgtctccatctctattaactcaatctcgcatataccctggtaccaacgatccccataccatccaaataccgtagtcgcggtaccacccgttgacacacgtgatattttaggaatttcaaactctgatattcatagaaaattcattttaagtatgatttagatgaactaaagttctctaaaacctttgaaatattccctttaatatggcatggactatattcccttaatatggcatggtcaacaccaactttctttttttttcttttcttttttttgcatgggcacgtcatatataacaataaaaagttcataagatacgaatgaacatgtccatctagtcttttatacttaacaccaatgaccaatgtaattttacttttgactaacaaatcttttaaattatttgtaatgttgtaaaggatgcaagttatattatcatgcatattactccgtagtatatattttgataatacgacatcgttctaaatatttgtaaagattttttttaaaaaaaagatgagctgtcaaagtttatacatcaacatatctggtgtcaagtaagatacaacggaacggagagaatgattaaatactacttcctccgtttcacaatgtaagattttctagcattgtctatatttatatttatagatgctaataaatctatatatataataatgtctagattcattagcatctatataaatgtgggtaatgctagaaaatcttacattgtgaaacgaagggagtaccaccgaagaaaacaccactctaaactctaaagtcactattgcccaatagactgtccacttgtacatagtacagatagagacgccatctatatcttctattgtaaagtctctattacccaacaaactgtccacttctacagagtacaaataaaaccgccatctatattttgatcaacgcaacaacttacctgccatgcatcgaacccagcctctgattggattgtccacttgtacggagtacagatagagacgccatctatatctcctactctaatgtctctattgcccaatagactgtgcacttgtacagagtattccgtttaaattttgataacgtcccgaggagaggattttgacatgtcagattattccatttaaggccgtgtttagattgaaactttttaattcaaacttccaacttttccgtcacatcaaatatttagacatatgcatggaacattgaatgtggaaaaaaaaccaattgtacagtttgcatgtaaatcgcgagacgaatcttttgagcctaattacgccatgatttaacaatgtggtgctacagtaaacatttgctaatgacggattaattaggcttaatagattcgtctcacagtttgtaggcggaatctataatttcttttgttattagtctacgtttaatacttcaaatgtgtgtccgtatacttaaaataattttggcacatgaactaaacacagcctaagtaaagaatggtgcaatttctaagcttgactttatgctacaccatacagtcaccatgcgtgcttcactatcgatgggtatgttgcttgttactgaaaaaactaattagccgtaaatgcgagcacccttgtcaagtttaggacttgaacctgctgagtggattggttccacacaagcaaacctaaccagttgagctacactcacttcgctatgttaggcattatattgttctcctgaaattaaaattcatatccagatttgtacttgaacaagttcacataactgacgaaaccagttcaaacccaaattggccaagtttgttcaaaaagttcaacataaattcaaaattttgagaaatttcgtttgatttttactgattttagccagcttgatggtatcgggatgtacatctctagttgcagatattgcatgtttttattagaagtactattcagcagccagcgctcggattagaaaaagacgcgcctcacacatcaatcccacattcccacgcaccaccacccctcctccttagtctgattagggtaataattttacccaagccattccatgtttttatacaacaggaatgctaaatagctgtcgcatgatttttgatagctaaatcattcatgtttcaatatattagaaccgttgtttcatacgttgtagcaaaatgtttcacgaggtgatttaattgtgatctacttggtgaaacatttacggtgtttcaactttctaaaagattgaaacattttttatctacttggtgaaacatttacggtgtttcagctttctaaaagattgaaatattttcaatctacttggtgaaacatttttgatctatttggtgaaacattcagaaccgttgttttcatatgttgtagcaaaatgtttcatggggtgatctgattgtgttccagcttttttaaaagattgaaacattttcgatctacttggtgaaacattttttatctacttggtgaaacactgcttgatgaaagactaagaaatcatgcgaatcccatatagacagtccctttatactataccgtaacaatccaacaacccatccattccttccaccacgatactatttttccggattgaccaaacaacgaacaaccaccgtatctcgagcaacgtaacatgcatcggcagcggatgaggggcggatctatagtagaagggtcggtgtcaaacgacaccaacgacttttggcaaaaaaactatagtgaaacttcttatccatatgttataacatcattatttaagcataattagcatactataacactgatagacacgttatgacaccaatgaatcgattttatggatctgccactgagcggatcaacggagtgtgggaggaggcgcaggaggaggtcactactataaaaatgatttttccgtgcggaggtttttgcccgtctgcacccacgggtctggaaaaatcaacatttttttccgtacgggcgccccaaccgcacaggataataatcttcccgtgcggtcgggttaagtggaccacactggataatcgattatcccgtgcagttaaattataccgcccgcacgcaacaaaaaaaaaccaaaaaaaaatcaaaaaaataaaaaaagcctaaccctaaccgtagaaatgcctgccggtgccctccgccgcccgagctcaccactcccggatccgcacgtcatcatcgtcccgcccgccaccgtccgcgcccgctgcgcgtgcacgtcgagccggcggtgccgcctcgtcgtcgttgttgtcgcgcctgccgccgccgcccgagctcgccgctcccagatacgcacgtcatcatcgtcgtgcccaccaccgagccgcgcggggccccgccgctgtctgcgcctgctgcgcatgcacgcggagcgagcggcaccgcctcgtcatcgtcgtcatcgcgcccgccgcagctcgttcgctcgcggagccgccgcggcgcctccgccagcagccgtcggtggcggcggcgcttgatcgatggggaggggaggagaggagaggaaagaggcagagagagaggagagagaggagtgggtaggagggaaaagaggcatagagaagggaggcgagtaaacagggagagagaataaaatggaaaaaggaagagagagagtgtgcgtcaaaattttaaaatgggtaggaggaaaaagagggggagtatttttctgtgcggtcttgcacgcgaaaatcgattttcccatgcggtcctcttaagtcgcctgcatgggatagtgaggattatccactgcggtcgaattaagacgtccgggaaaatgcattttcccgtacgggtgacagcctgatgccgatccccttatttttccatgcggttccagttatggcccgccagaaaacaaaagcgctcggcgtccaggaaaatcttttctctagtgggtggtggtgttgtgctgctggtgggagcaacgtggtcgagggtggatccaggtgacagctgatatgggtcggaggtggaggcctggcggtgaccgtgcaggcagggataagccactgatgctcgctacagggagcgcggcggtgaggtttgtacgtagccactcgatctggtgtaggggatgcttgagccttgaggtcaccagagtctgtgacatggagatggaggtctgtgtggaacccatcagaccgtcggcgcgccgccaccatttgctctgccttccattggccactcacgtctctctctccatggctgagctccggccgtctgctagcctcacaccaggcgccctgcccgggatgagtttaggggaggaggacgcccatccttggcaaggaggatgacgcttggggggagcgagagacaggaacggttcccaagatgccggggagtggcggggacaccagatctggtggtggtgggatcataaccgccaggatgcccagattcgatgccagcgtgggtgaggaggatggatccgtcaggaagccttccaccagtgccacctcctccgcggcatgtcgcttccgccgctgggaaccacgccaatactagaggcggtgaggtgatggggcagggggacggttcctggcggcggcgacctcgatatcggccaccgtccggatcaaccccatccaccgttcatctccggtcacagtcccacctgtcacttgtcctgcgtagcaccgggccgatctagcgcaccaaaaaatgtaggaggcgcacgactggcccgtccttgaaactgcattggcctttgagctgtcagcaaaccggcttctccgtttccaccggcaacgacagcataggctggaaacgaatatggtatgagaatatttcgtccgtatccactacgatttcatctctgcagttaggtaggtagaatcatttggtgtgggacacgtgggttggggttgactgaggcgctcgaaataaccaggagtgcgttgcgcaagtctatataatatataatagaaaaatatatttttttaatcaaataggttagtgccacttgtttaaacaaaatattggatcattttataatattagataatatcatgggtcgatttataaaattaaaaaacagtgatggttgaaagtgagtctaccaccgcaagccttctaaagaagtatatattacattaacttgtactcactcacctagctaatacacaatgagcaatgtttgcttaaaaaaagttactcacgaggatgtatatagttgaaacaactgtagggagagcacaaatgttcacagtcgactaccattaggctgagttcggctcttcatcttctcaacccaccactttcattttccgcgcacacgctttccaaactactaaacagtatgcttttttaaaaaaaaactctatatgaaagttgtttttaaaaaatcatattgatcctttttttaaaaaaaaaagctaattcttaattaatcacgtattaaaagaccactttggttttgcgtgtaggagggatgggttcccatcatgcagtgcagaacacagccttagcttatataacaatttagtgttttggctgcaaggacaatgtgatgactggcacagggctcttctcaacctcactctcaatacagttggtaaaatagcgagcaaacaccgcgaagagcttgtcaagtatggactctccgaaatgactcgcgatcaggggctccttcaccgccctcaggctcgtagagatggtcttgccggcggcctcagcggcagcggcaccatggatgatgacaggtgcagcagcagcatcctctgctgactgatctgagccgccattggggttcccgttaatctcgaagagccggatgtcggtgatgtcaagcagctcattctgccacactagctcctttagctcatcaaccgaagggcagtacaatggcaagttgaaggagtccagcttctccttctcaacacagtcctgacgcggaaaattaaatcaattaaaaggcattctaccagtaaagcctaatatatatttggataaagcaaaattagttataaccagttagctttatttgaaaacaaaaacatgtatttgttttctgtagtacacacatgtttttacacgtacaccgtcttcttttaattttcactgtctgcgaagttgtgccaagcaaaagcaccgatttctagttttctattaacaccttaaatattggtagtcaaactgagacgtgcccccatttaaatacttttttttgcccgaaaaccccatttaaatattggtagataattgcccaataagtcaaaaacatatatataaagattgttcatgctactatttctaatagtagtagaaaagacgacgattattttttatcaacgaaagagatgaaattaattgatggatagttgtgatagcttgagatgagtgactaggtagaatagtagctatatcttgggataaaatttgaacgctagaagtaactatattttgcgatggagaaaataagaaaaaaaaatctttgttttgtcttaaaatagcacctatctttgaaaaattaactggtggactatgggaccacgcttcaagtattaaattgggtgtatgatgtttattaactaaaatttaaacattctttttaagattttgattctagaactgtacagttctagttagataggtacatgtaccatccaaacatataattagttagataggtatgttgtaatgggacagtaaaataatgttgaatttgagttcttctattgctaggtatggctatgagttaaattattacccacaagttgaaaatttttttaaaaagggagccaattcatgtattttaaatcttgaagccccgtatggccatccatttgtctttcccaatgttcatacttttaataatttcttgcctgtagagatgcatattttaacatgctttacatgctaggtaatttcacgaaataatttgataagtgccaaaacgcagctcaatcgatctttagagcatgtatttatagtgcttttttgtttttgaagtgggagctggtaaacctagtgattaatttttctatcaaagaatatctcatgatgtaaacaataatatggtactcatgtcatctaaattatacctctgcaactagagtttgcagcccttgtgaaagcaactcgaatgccatggtcgtccctcctgcactgaatacatctgtgctattcctccctagcatcgtcagcaccatccgacctccaggcacaatctctttgcaccgcatttgtaggaaccgtgagaagtccttcttgaattgattttggtagagctttatcaccaatggcggtgtagtcaaccctatgtgaatgttcgcttcattcatgatgccatcaaggttctcggggacctgtccaaacgaccaatgtggttggtgatctcaaagccccaaagaggaacttaggaatctaaattaagtttatgcaatgagtcatatattaagataatttacctgagagagccacatgaggctcatggaggaatggaagagatggacgctgttacaaggaaagagtctggtgtagaaggagcctggcagacctacgacatagtgtggaggagattgcaaccctctagaagtgcaattttttgttgtcgactgctcaaactgctccagtgattgaaagatattattgaaatcattgccaggtaggtcattgagaaagaattggatctccttcggtctctccccgatagtattgttagggttttcgcctattgtggtgattgcatcggagacaaaaaggagtgtgtttgcaccgaaggagcaacctaggtcagcaatgaccatcgattgaggatgaagatctgtgcacactttgcttatggcttccttgactgttggcttggcagctagaatagcttttctctgcatagatatgaggggaaaaagggaaaaaattgtggtgaaacaattactccatttgccatgtgcccactctggtgtaactaggcccatgacaatccaaagtgtggtgggactgtatatttggctcatgactctatagttaatccaaactagtgtcaataataacatagtacccactaacaattattatattctaaagcacaacatacaaatatgccatatcattaccactagtaattattattgtagagcatcttaaacctgatgcaacatgacaccatcatctacaatttattatattccagaggtcaacatgcatctgcatgaaaaatcataattcacatattatttttataatattttaacatatctctattcattatttctataatatttagcatacaatgattcatgcatgcatttcgcaacagaatgcatggcatcatctagttatatagcaaacagcaatagtgtggaaaatttttatatgctctatattactgattacatgcatgcaatctacgttgtggaagatgataattgcatttgacaatttacgcagaaaatcatgtttagtttgtaatgaaacggcaattaattcctttcaaaaactgaaacggcaattaataagcacacaattataacataatggagaaacaaaaggtagagtcagttggtacaaacctgcatcatagagttcttggcatagctgaactcatcatccccatcattcgtcatgtggaaatcacgctcgatcttcatgtctgcgagatgctagaagctcaatccctatatttgttgccacctgggcccaaacaacaaaacagtgtttgaatggaacttgagagttcacaggagatattgcaatcttttatagacaaaccgaatgctcaattcctgatcgactcctaaaaactggatgaatgatgcttgttcattctaaaccagggtgctcaattctgaggtttgagatacatgaattgtccttgggaattgtctgtttttattttctacataatatactttgtaaagccagtcagttttgatcagttgattgtctggaacatatactatgggatgcatatatggtgtatttcctggaaatctctctctggtcgctgctttgtggtgcagtgcacacacaacttgattgttagaataatgggttaattaagggcttctttggaatgcatgattatagacttatagtaatgttggaatagaaaaacacattattaagatgtatgattttgctagtaccatggttaggcaaaggttgtgttttggagagctcccatacagtttaattcagaacatgatcagaagctagaatctaaaaaatctaagattctaaattgacctttggctagggggaagttaaaaaaaacttcctttagctatgtagaaaaattgttactccctctggactaggattatataagggattattcccttttagcactaattaaggaagagaaaaaagtgtgaactccatcggttgccctaaaaaggcaaagccaaagctaaaatttgaattttcaaacttaattttgaagttgattttatgataggatcggggattagtactaatagtacacgtgattttctctgtgtgtcttttcagatgggaaggggtgggagtgggattgctgatggttgttgtactgatcctctcgggataaccaaaatcctccataattttggacaaacccaaggaccataatttcctataattatggatagagggagtataagatggatctagtttttttcttttaaaatacatattatttaatgttgaatgactgttgtttttattttggctcggctcattaaaaaatatggtcttaaatgtagagaaaaatatggtaaattaaaaaataatttcaaagaaacctcgataaaaaggtggccaagctttacctagccatattattgcggttcaaaggaagccctacattgctctataatgttgtgtgtggagcttggagcttatgataagaattgcttcctccgtttcatattataagacttttaaagttaatatttatgtgtctatattcattaacatatatatgaatgtgggtaatactaaaaagttttataatataaaacaaacggagtagtttcatttccactagtctataaagacaatagagatctctactttatattcatagtgtgcatgctagatcagattctagtataaatcagtgtgctcgattcctggacattccccacagatggctgccataattactttcagccgtacttctggaagaaaattttgttcatttgggaacattgtagaacacattttgttgaatctcttgaatatgaagatgaagataaaaattaaatgtttcacataaaacgatgtagtaacaatgtctgattattacaaacttaaaaaatggattaatccgatattttagagcaactttcatatagaaagtttccacacgaaacacaccgttaagcagtttgaaaaacatgccacgagtatccaaaatttcatccaactctaataagagaaacgaacgcaccaaagtaagtccaaattaaatttgatgtcaatttttgaaccgtcactcatataggactccatctatatcttgtgttccatgctaggtggttcaagtctgagacaatgttctgatcaggagtataatttgacacgtcagtttatttaatttaattaagtaagtaaagaatgtttccaactttccaagtctgacgaaactgtcaccaatgtccctatgaggcggacctcctggtctatttcttctacatagttcatccattccataaaaaattaatatgaaatgtaatatgacacatctagtaatataaatatgaaaaaatatatccaatttcatagtattaagatgtgtcacatcatatactagatttatctttttatggaatgaaagaagtacgtgtgttgtcgttgattatttctttcttctaacattcaaatccaaatggcacccgatcaggtacatagaaccgatcaaaaccgcttggtatttgtgattttctattgactctttatggctcacaccaagaaaccgcccggtaaatatgaggaaattggacgtgtccattgaggtggagcatgaaaaaaaattgggtacgtgttttaccagacccctttttgacggaaccaacctagttttattttcaaaagaaaaattaaaattcaattttgtagtaaaacttcttgtcgttttaaggttttacctattttcagcagcttttaagaactaatcgagaaaaagaaaggacgaacgggttgggaacggtattctgttgtcaaacaattctgaaaaccacgagagataaaaacggcctctcgtatcgcccctcccccacgggcgtcgcctccccggggctcgtctccccttcctcctctacatcgccgctgcccgagcgcggccacaagaatggtggtggcggggcttcgtcctcgcgctggggaatggaaggggggcctgctcgggcggcggaaccgcctagatccatgtcgcccgggcggatctggtgatggggcagctggcggcggggctgagcggtgcggcagcggtgtctagtggcagtggcaacggcattcgaggcgttggcggcggcggaggaaaccgccagatccacgtctggatttggcaggatagcggccggcagcggcgtttagtggcggggatggcgacggcggtgaggacggcgaggggatgtagccagcggcggtgtctggcggcgggggtggcgagggatggcatcgatgaggcgaacctggccgcgccggcggtggatccagtgcctcgaggagttttggacccccggcggtcgcggcagtggtggcgaggagttcacgcgacggcggcgcgggctaccacggtaggccgtctgtgtcgtcggagctcgtcgaggataagcaggtgtgggagggtggcgagatggcaatggggattgaagggcagcggcggctgcggtggtggcaaccgtcaccgtggtccggggaggcatggcggtcttggacggctagccgggggcgtggcagacgaccgcacctagccggcatagcagcgtttggaggaggggtcggaggccggcttggcgcagagaggcgcagtcgatggcagtggatgccggcaggcgcgagaggcacggccggtagcgaggaggccagcttggcgcgagaggcgcagccaatggcgggaggccagactggcgtgagaagcgtgtccggtggtggaggaggccggcgcggcgcgatgaggcgcggtcggcagtaaaggaggtgaccacggtgtgaggaggagctgccggtgggtgtggcgcggtcttcggcgcacgaaggctagctagcggggggtgccagtgtagtggtcccacatgtcggcagaggttgagcggtggtggagcatcggtgcatcagccgtggactcgcaggtgatgagcggcgggtgaaaacccagcccgtccttggccaaaccgacaacgatggttcattccccctcctgagagcgttgtcgtgacgtctcatccctcaagggtggttgcagggggaaagcccagtcttggctcttttgagtccctgacggacggcggcggcggttttccgtcgcttctctccttagagacgtcgtttaggtatactcttgccaaaactacccaaacgattagtgcaagcacgctctaggatagagttgggctttgtgttggttgtaagggcgtttattgggcgttcttgtttgtgttcctttgttgacctacggcggtcggccacgcttagcggtggccggttcgatgctagccttctcctggatctgtgtgtcggtgttgtcggtgtgtgggtggtggtatattttttccattttcccagttacgatcttctaaagttgtaatctttttttttctactctatcaatagaacttcgcatcgtctcgtgtgagtccttaaaaaaaaaacaattctggaaacctgcgcccgagcagaaattcgtgatttttttaacccaacacaaagagcaatgctaccacaaagcagtgctcggattgatgtgatatagagcatgtccgcttctggatttttatcctattgagctggtatcgaaccaaatactactaatttctaaagactgagatgagaagtaggtactccggccgtttcatattatgtgttgtttgattttttagtgaaactttgttaaggttgattaagtttatagaaaaaaataacaaaatctgaaatatcaaattagtttcattaaatttaatactgaatatattttgataatatgcttattttgtattaaaaatactactatatttttctataaacctagtcaaactttaaaaaaacatatttccagttccatgaaattcagttacggagccaaatcaaaatgtaaactcttcataagctcttcataatttccaatatcatttgactttaagctcttcataagggacagatagtttcggctcagatttttttttttttgagatgacgaagggcgtgatgggctcttaccatctgacgacagcccatgggcctcagcacagcctcaaaatgaataagtccattttgcctccctcatctcttgcccttgtgtgaataacatccccaaaccgtaaaaccgggtataacgcctccttcatctcttaaaactagagcaaatgacctccctaagcggtttagcaggcggtttcgtccgacttggcgccattgacccggttgacaagctgactcagtgtgagcgacccacatgttagtgtattgtatgtacgaactaggccgagctgagtcagctggacggtaaaattattggcgcgcggctcgcatctctctctctatccccatttcacccctttgaccaaaaccctagaccggcaggcgacggccaaggcgacgcgaggtgcggcggcggcggcggcggctggtgtggagcacggcgacggctggtgcggagcacggcggagcatggttgcggctgcggagcgcggcgcggcacggctggccggtcgagaagcgcggcaagagggttcacctgggttgaatgtgtggccgtggttcgtcctctttcccttgtctgaatgcttccatttgatttgttttgattttataatgccggtagatttgtttgtggtctcggggtgggtgtgtttgaataattttttaggttggctagcaggagctgtagctcaagtggattttttttttgtgcttgaatcatgtaaagtgtgttggaatctggattggc

SEQ ID NO: 77078 - DNA, 810 bp, Oryza sativa
aatttccttgtccattggattactgaagaaacggcaacatatatgatcgaccaaacacccgtctgacatgtataacagtgaaagtccagccacaatctcttgcatgcatttggagcatgccactgtttcagcacaaccgaatgattcagaacatacactagctggggcatatttgctactagtaagactatgctatcgaaattaaattatagtgtttgcaacaactctgcccaaggaagtggccaggaagaacacaacttgaaattaagctagcgattacaaatcgataaatccaagcagaattaaagaaaaaaggatgaaggagaagaacgctgtaattaacggtaatgcatgacttaagcagtccaaaacgatttgaggatactactcacatgtgtgcgtgacttgacgatgtaggagtagtattgtccaacagcacgagctattcaaaactcaaaagaggagtcaagcaagccgcaaagccaacagcctgcaagtacctgacattgacctgttgatgaaaagtctcagcttacacccaaccattttcacatttgccaacaacataaacaacgcaaagaaatgagcttgctaaaccttcctttggtgggttctgtacaagaaaaatgatggattaatgttacataatttgatttcgaaatattgctgaaactgaaagcgtccatttcattctttttctgcgcttactctgattcatgccaggtcaagatttaattaggttaattgcatgtatgaaatgtactagttagtactggccgttatatataaacacggtcaaaattaacctaa

SEQ ID NO: 77079 - DNA, 1038 bp, Oryza sativa
aagagttttaaaaaataattccatttcaaaagttgtatataataaacttcctccgcccctaccataggatggggcatataaatcaccatatggtaagacaatctatgtgcaatgaacccgtaggagggaccaactatggcaattttgtagccggccttctccggcgataaatcaccctcagggagggcgagaaggggcgcctgcaaaattaccatggtgcgcccctccagccttgtgccacgtcgcatagcacgtcctacataggatgggaggagtataatttcgcaaaactttaaaacgacgacttatttttaaatctttcaaaaataaattaaaaaattctggaaatgatatattgtgggctactagactcttggggttcaaaaacttacctaatgtaggaataagtttattttgcttccctcatcttttgcacttagttgaatcgcatccctcaaccgtaaaaccggatataatgcctccctgaacttcaaaaaccggtgcaaattgactccttcgttgcttttgaaagcattttctgatgacgtggcacattgacttggtttaagtatgttgacgtggcagcgtcataaaaaattaaaaatagaagttggtctgacatgtaggtgacaaaagtaaaagggacattgcttatttgaccctattttgaagtttaagtactaatttgaccttgttttttcaagtttgtttatttgaccccgtttttcaaaattgaagctaccgtttgaccctattttcaaacaccgttagggtttcatttagatcaaattaaaaaaaatgaatttacaagcctaaatgactaaaatgcctttattcactcattccttatcctctccatgctctctcaccacttccttcattagagcacaaatggctggagagacggcggctgcgttggctccacggcggcggcatgacggggaggaccgcccgcggcagcggcggctgcagaagggcgatgacggctggaggaccgtcggcggcggctgcgttggctaagggcggggggcagcttgg

SEQ ID NO: 77080 - DNA, 614 bp, Oryza sativa
tggtagttgttttatccaagtgctcctcgacagcaacagtctcaaccttgtcaatcgaacagtcagtaatggaaatcttggatttaaaggacaaagtttgttgattctctccaagaacaagaacagcaggttcaccataactcaaaagtgctccaagcagaagtgcagttaacaggaagactggagatgaagacagcaagaagttgaatagagaagggcaaagcctgtgtagaaacagcaacaaaacgccagcagctagtactatagggtaatcacaagcaaattgatatccaattctgacagatgaatacattagtctcttgatatgcaacacaatgtcatttgcaccaaaagccatatatatcttcttgaattttaccctcagataaaacgttggcctggaaataggaaagagagaagcaattcatcactataacattatggtgaatattcaaacaagtaaagatttatacttgaacaatagcgggcgtacagctcttagcctccatggcagctgtaattgttgtactagtttgaacctcttcccaatcttaataaacttcagccgcgtatcttacgccagcccggcgaaaaaaaaaaagatttatacttga

SEQ ID NO: 77081 - DNA, 35419 bp, Oryza sativa
atagtgattatctgcctggtgatgattgctctttagatgatgatgatgaggaaggtgcagctatagaaagacattacaaagatctcaagaagaagctgaggacaagcaaagtggctagcttggatgatgtgacttttggggggcacaagacaaatgcaaatatggctactggtactaatgaaggagatggcaatgacactgagtatattgacagtgatgatgaagagtcagtggaagagggttctgatggggagttaagagtgagaggaagtaataatgcaaggttcaagaagaagcctggatatccaacatttgagttgggaatgaaatttagttgcaagagtcagtttaagaaagcaattacagcatatgctttggctgagagaaaggtgataaactttgtgaaggatgatcctaagagggtgagggcaaaatgtgactggcatagctgtccttgggtatgtctgttgtccaataacagtagaagtgatggttggcagattgtcacctttgagaatttccatgcatgccctcctagaagagataacaagttggtgactgccactaggattgctgacaagtatggcaaatttataattgcaaacccctcatggccattagctcacatgaaggctacaatacaggaagagatgtttgctaatgtttctgtaagcaagttgaagagagccaagtcaattgtgatgaagaaagctatggatgcaactaagggacagtaccagaagttgtacaactatcagaaggagttgctgaggtcaaatcctggaagcacagtggtagttaacagagaggttgatatggatccaccagtgttcaaaaggatctacatctgcctagatgcatgtaagagaggattcatatctggttgcaggaaagtgataggactggatggttgcttcttcaagggagcaacaaatggaaagctcctttgtgcaattggaagggatgctaataatcaaatgtatctagtggcatgggcagtgattcacaaggagaacaatgaagagtgggattggtttctagacttgctgtgtggtgacttgaaagtgggtgatggcagtggctgggttttcatatcagaccaacaaaaggtattcccaagaagcattttttcaatcttgtaggactgaaagtgcatgatttgcaatagggctaatgttctcactgttttcttatagggtattattaatgcagttgagaaatgggctccagaagctgaacataggaattgtgcaaggcacatctatgctgattggaaaaggcatttcaatgagaagatattgcagaagaaattctggagatgtgccaaggctccatgcatcttgctgttcaacctggcaagggcaaagctagcacaactgacaccacctggagctcaagcaatcatgaacactcacccccagcactggagcagggcatggttcaggttaggctccaattgtgactccgtagacaataacttgtgtgagtcattcaacaagtggatcttggaagctaggttttttcctatcattactatgcttgaaacaattagaaggaaagttatggttaggatccatgatcagattactacctcagctagatggaacactgctatctgccctggtattcttaaaaaattgaatgcatatatcactaagtcagccttttcccatgccatatgcaatggtgcatctagctatgaagttaagcaccatgataataggttcacagtgcaactagacaaaatggcatgttcctatagatattggcagttgtcaggactcccatgccctcatgcaatctcatgtatcttcttcaagacaaactcactagatggatacattagtgactgctactcagtgactgaattcaagaaaacttatagccattgcctggaaccatttgagggcatgaacaactggccatatgatgacagacaacctctcaatgcacctggatatatcaaaatgccaggcaggccaaggactgagaggagaagggaacccactgaagctccaaaggcaaccagaatgtcaaagatgggcacaaaaatcagatgtaggcaatgcaaatagtttggccataacaagtctacttgttacaaacatagttcagggggccctagcacagctgcttctcaccctacaggcagcccagcagggaccaatgcagtcagcccagcagggggtttagtactgtcaaactatacacagggtaggaaaagaaagtcaatctcgagtaccagcactagttctgcaatacactcagtgagaccagctccttctaagagaaaggtatgcacatatttcataatccattcattgctgctccaattaatagaaacaaacttggtgctaactctttcttgtacatgcaggcacaaatgcaggaggcacaacagatggtgaaagtgacagccacagcataagttcccacaaatgaaggtggtacaacaactgtagacctgcatgcaattgtaccatactcataggcttcatccagtgcttcagtgaggttgaatagtggcaaagcagttgtcaacgtttcagctcaagaaccagtcaagatgaagccaaagaaagccacacctgggccactactccttcttccaccatgggagtctgcaaagctttgaagttctgccatctccatttaactaatattagaactatgttaatgtgttgtaatgactcctgtgtctgagagctatgatgtttgatgtttttgtaatggaccaattcctggccatttgctgccatctgtgaaccatttcaaatgtgtgtgatgtctgatatggaccatttgttgtgtgtaggcctatattgccacacactaatgcagtctgaacttatgtcacaaattgagctatctgaatgcaatatcatgtgaactatcttcatttgtgctggtcatatgtgttgtgtgtgctgttacaaataatgtgttataaattgagtgctcaaatgacccaattatatttcatgggttctatcttgtctgctcaaattacacaattctaattcatttaatttcagatgtatcaagcacaaccatacaaacattttaacaggaatttttccttcattaacacagagtgcattacaacacaccacaacttgcagatatttctttcaacctgacaaagttcattacaaaacaccacaacacccatcttgctgcaaatacttcaccctacatttctccttaccaacaccagtgcaaacatgacaaatacacaacccataacaacaactaacagataacatctctccttctctagcctactatttctatccttcagcacagcaattctttcagcatagtcacatgacagctttcttgctgcctccaactctctttgagcagcatcaacctctattatcttctcctcaaccttcatcctctcttcttggatagccaaacaagtctttccttctccctcctcgctgaccaaactgcatctcgcaaatcattcaacacttctctaataaaggtggtcgtcggcccatcataccaagcataaaaaccacatccaccttcctgcaatccctagcaataaatttcaatccccaataaaaaatccaccgtccaaccaaagaacaaaacatacctgggcattgcgacatttgaagtaccggcggctggggttgtccggactccacgagatccaccatgcagccttcacgcgacagtcgcacatcacggccgactggtaatcaaaaggaccaaccctatatgggatgggactcctcgatgaatgctgagaataggacgatgacccgtcgctctgggaactagccatcaccgcaccacctctattcgcgaatccactcctaccttcaccgtctcggcggattgcgcccttgccgtcgccacggattgtgccctagtcgtctccgccctcgctatcgccagccgcgctccgcaccagccgtcgctgtgctccgccgcgctccacaccagccgctgccgccgccgccgcacctcacgtcgccttggccatcgcctgtcggtcaagggttttggtcaaaggggggaaatggggatagagagagagatgcgagccgcacgccaataattttaccttccaggctgactcagctcggcctagtccgtacatacaacacactgacatgtgggtcccacatgctgagtcagctcgtcaaccgggtcaatgacgccacgtcggacgaaaccgcctgccaaaccgctcaaggaggtcatttgctctggttttaagagatgaaggaggcgttatacccggttttacggttgggggatgttattcacacaagggcaagagatgagggaggcaaaatggacttattccgcctccaaaaccctagcccgttcccacggcccttaaacccttctcccatcttctccacctctcttgctctctcgccctcttcaccaagaaagaaaacaggcgcacgcctcgcctcgcctcgccgccggcggccaccgtctccgccgcctcctgcccccaacccaggaacccccggcgagagagctcgatggaccaggcggggtcgatggaggagcgggtcatcaccgagcggatccggcggaagctggaggaggtgaacgccgccgcgcagaagcacctcgccggcgtccaggaccacgtcaacttcaccatgcaggtcagggctcctctgaatctctctagtgttagtacatttttttttcgcctcgcggtagtatatttattgtgttttggggatacacgggaccggaaatccggaaatttggtggtattgattggttgcaaatcttgactgacttggtgcggcgtttcttggattagtctcgtgggagctgggaagtaagggcttggatgttcttgttccgatgtttgatttggcgacgatgaagcaaagtgttacggtagtgcgtgctatttatatgggatttgtagatagttcagggatagggcagtctctgctattttgataccaaatgtttgtagactctcaagttgatataaggatatcagatttggtgagccttgcataaataatttgttccaatgtagtttcagtgattcggttgggcatcaatcaatcaggtggatgcaacttagtatattttggaagtttggaaagcccaatatcggagaatgattaccaactactgaaacctgctggttatatatttttgtgtgacttttgcccggatctagcttctggagtatcttaaaaattctcctgtcactccattgtatgctatcaggtgtgggtagacagtcttggagtttgtttatgaaagttcttgaatcttctgttctgtactgtcatttgctttttgtatgttatcaggcatgagtagacagtattggagttgtttatgaaatttctttagtgttctgttctggagtctgtaaatgtaaggatatgctgtacgcttgttcaatttgtttcactgcctctcattgtggaagaccaagaataaagtatgtcattatgagagaagaatttatctaaattgagagccctgtgctaattatttattttatatctggttttcttattgatcttcagataaagaataaatgctgtaataaaatatgctacatatctttgtaagaggagaatttatctccataaaaatgagaggggtaatctgcacagagagccaatgttaatttttttttttggtttctggttttcttattgatcatcagcaagcgtacttcaagtgtgcgtatgaatgctttgatcgccgaagaagtcaagaagggatcaacaattgtgttgagaactgcagcgtgcctgtccttactgccaacaatgttgttgagactgagatggctaaattccaggtacttccagtttcattcacctattgcttttcatttttcttatgattattgccttccattacttgccatcatagagcaacatagaacccaactttgtgtctgttcatttatgtagagtttcaatatattttttgctgtacagtctatatcactctacatgtgaaagaagctatggttcacttgctgcaagttttacctagaaatatgcgtggacaaaatttttttcctctttggtttctttgtgaacttagactgatcattgatgctgaactatgcctaccacatgtgtgtttgttattgatgatatcatactgagcaacttgtacataatggtaccactgtacaaagcgcaccgtgttacagtagattatcaaaattttgttgtccagtacaaacaagcatttgtgcatatctatttgcatatgatgtatgttcctgatttatcttctgattatgtattttgttcagcaagcaactagcgtggctgtgtgctgatcttagggaaaatgatagaaggaatgacttaacaagtagtgacatatcatctaaccaaaaaatgggaatatctctcccacgcgataggtataggcatcagttgctatggacatttgttataaggtagccaaggtgtcacttatggaaacatatttttccctccatctggcagtgtaagtgtgtaacattgataaaactaaataatgcttaaatggtaaaattttgcaggactctgatcttggtgtgtaactgtttaaggatatgcatatctaactgcttgagctattttatcggaatacatatgcgaaaaatattatgttagaacagaaggaaaagtcaatggcatttcgaataaaaacatctgtttgtacaaatagtgatcagtattcagtattcacctttagctgtatgttttatcatgcaaaagcatgtctaacccctattacctttatctgtatgtgatctaagttgtgatcttttcccctgtcctcaggagcggctgaatcgatctttgatggtgtgccaagataaatttgaagcagcaaagctccagaagatgaaaacacatgcgactgaggagctagaagcatgcgtaaacagatctattgatgacagtatcagggtcctgccccatctggttgatcagatcaagtccaccctctccatgaattagagagatcagaagaagttcagaactaaacagtagaatcttcctcgtaaactatttcagcttttacaaaaagcattttcactaattttggcaccaagatcgttggccaaattactgccctttgttaacatgagtatgacatatgagcggcatatcgtattttgtgtgccttgagcattttgttcggaaccacactttgttgcagagctgatttatcgaaagatggtgcaataatagaagatgatatcctcatgttgctcatccttattcatttgcatcttgcagtttgtttcagttcatgttaccagcatttgatcttcattcatgaaccctatgatgatggcagaagatgatattcccatgaaattactggcgtttccacttgttctccctcccttgtcaagtatataccacattttttattgcttgttctcaagaatatacaattaggcctactttcgaatggaggaatcaatttgttctctatattatcaggcctcttttggaacggtggaattttaaaggatttttcgaggaactgaactagaatcctgtaaaatttatacatttcaaagagccagtctctctctcaaaaaaaaaaaaagacaaatgtaatgtgctatgtgcttgatttggtgaaaggaaatcccgaaaaccgggggatgaatttaaaaaaaagggtgaatagctaatttagtccctcaagtttcaccgaaggctcactttggttcttcaggtttcattttgttaacataaaaatcctctaagaccctgtttatatgggactaaaacttttaagtccctatcacattggatgtttgggtactaattataaatattaaacgtagactattaataaaaccaatccataatcttggactaatttgcgagacgaatatattgaacctaattaatcatgattagcctatgtgatgctacagtaaacattctctaattatggattaattaggctttaaaaatttgtctcgtatattagctttcatttatataattagttttgtaagtagtctatatctaatattctaaattagtgtctaaatacatagactaaagttaagtccttagatccaaacaccaactaagtatttgttttggcctaaaattatcattgggcccacttaatatgccatatggctatttttagtcatcaattctattagaaaatgtcccttttgcccttaacttgtatacaactatacactagaaaaaagaaaccaaaataaataaacaacattgtatatttacttcccattatttcaacatgtgcacatgaaaattgagcctaatggctatcgtatacacttgtaagcacataatttttttttgttttatctataaaaagaattcattacatgcattttttctctatatatgtgaatgagggggcataagtgtcatttatcaaaagagttgttagttatgtgggttaaaggataagtttgaattaaaatggtgaatagctaatatgacctgaagtttcgcttcgggctcaatttagtccttaaggtttcaaatcgtccatacaagtcctctaaattaattatttgggttaatgtagtccttagacccacacaaagtaccatgtgagcatgccaagtcatcctcgcatgcagcggtatgaatgaaatgaccattgtacccttatataccatatagaaaagaaagaaaaaaaagaagattaatgtttcacacgtgcatgatcattttagaattgtcagttacgattgctgcaataagcaaaaaaagattactaggaggacgtgctgcacacttaaaattcaaaatattttccttgcacaagaaaaatcttactcatctaaaagttttgatgaagttgctgtttcaaaacataaaagacccctcaaattcgtaccatcacaaatcccgcagaactgacgagcgctaatggcccctcctcccctggcggcagcgccaccgccaccgcccgccgccgccctcgtccaccactacacccgcctcctcttcgccgccgcctccgcctccgccgccgcctccctccgcgccctcctccccatccacgcccgcgccgtcgtgctcggcatctccgccaacccggccttcgccaccagcctcatcaccgccgtggcccccgcctgcctcgcctacgcacgcagggtgttcgacgccgcgcccagccgggatgcctacatgtggaacaccctcctccgcgcccatgcccactcccgcgcccacgccagggacgccctcgcgctctacgcgcggatgcgcgccgcgggcgtggcgcccgaccactacacgtacccaatcgtgctcccggcgtgcgcggcggcgcgggcgccgcggctcgggcgggcggcgcacggggacgccgtgcggttcgcgctggcgcgggatgggttcgtgagcagcgccctgatctcgatgtactcccaggagggggaggtgcgcgacgcggagcgcgtgttcgcggagagggatgatgcccggacggtcgtctcgtggacggccatggttgctgggtacgcgcagaactgcttcttcggcgaggcagtcacgttgttcagtgacatggttgctgcgggcgtgcttccaaatgagatcaccctgatcagtttcctgccctgcttacgggggcaagaatggctgcctgttggggagatggttcatggattcgtcgtcaaactgggattcgatgcaaacgttcccatggtgaatgcgctaattacgatgtatggaaggtgcggaagtgctcccgtggcaagagttctgttcaatgggatgagtagccgcactctggtttcttggaatactatggttgcgatgtatgagcaacacggtgatggggttcaggcaatcaagtttttccgcaggatgcttaccgagaaggtggggtttgactgtgtgactttggtgagcgtgttgtctgcttgtgcgcgctcgggagcccttggtaccgggaagtgggtgcatgagctagccaggagtcatgggcttgacactgatgcaaggattggcaatgttcttgtagacatgtatgcaaagtgtggtgagattgcttatgcaaaggaggtttttcattcacatggtttgcgtggtcacagtgttgtgtcctggagtgccatgatcaatgcatatgccaaccatggggaggcagaagaggctctcaagctcttctccctgatgaggaatgaaggggtgaggcctaattcattcacatttacagcggttttaatggcgtgttgccactcaggccttgtcgatgaaggactgaagcatttcaacagcatagccacagactaccaaatgtcaccaacacttgagcactatgcttgcatggttgacatgctaggacgtgctggtagacttgttgaagcatatggaatcattaggggaatgccgattcggcctgacaagtgtgtgtggggtgccttccttggtggttgtaggcttcatggaatggtggagctagctgaatatgttgcaaaggagcttttcgactcaggatctaatgatgtaacattttatgttctgatggcaaacatgtactttgaagctggaatgctggaagatgctgagaggataagaggagtcatgaaagagatggagctaaagaagacagctgggcatagcttagtttgtactgatagagaaagaatagctgtcgtaaggtagcagactagtaaaattgtactactgatgctaattagcttatctgttgctagcttcgtatgtagattaattctttgatagttgagatattcaagagtaccagcactttcttttggtgagtggcttgtactacggtctttattgtgaaggcaacataacttctactgtcttcagaccaatagcaacttttcatggcaatgttgtccaatcctgggtgtctatttggtgcaatatccatgatttgttttggtgcctcagcttgaaggtaccacaccaaatgcctagatttattaaaggcacgtatttccctaatatcaaggaatggaacctctttttgcacaattattttgaccacaagcttcatactctattttgcaggtatgttctcttctgtaagcacactaattgaggacaatgttcaacccaaagtgcctaccaagtcattcatcaagaaacaactgaccaaatagtaagcctttattttctcaatgatattcatgagaacactatcaacccaggaaggaaaactaagaacattatctccagaattcatttcttgtggagaactaggttcaaatgaactcatattctttacttgtgcctactctagttctaaaaagggagctattttccgagactagtcttgtgctgaaatcccacgcttaactatttccaagatgggaggtctatagctcattcattttgctcttctgtttgcaaccactaagaaaggtactcttatttcccgtgaatgatgaatattatttgataatacatgctctgatagcctacatgtatatgctcataatcctacaatattgttttaaaaatataaactgggaaataaaaatgaaggaaattcgtttcagttggatagcatttagaatgggagccttatcattgtaggtaacaactaatgaggtagagtcacctggggttttgtaagccaagcgtggaagtgaagctgcgatgtgggctgcaagagagctcagccattcactggatggagacaagagcgtggcatgatggcaggtctatccgctcagcatgtcaatgataacttgaactgaatatgaatatgtttggtgagatagcagtttgcttatgcagttgatacatcagaaaaaccagaatactaaacttccttttgtatttttgttatatgcaattagcaattcaatttagtgtactctgagcggcaaattatcctgaacagaaatagcactgcatgtcataatcaatagttttattggtctaccttgtttcgtttgccaaatggtatgttcaaaatatcatgaatttctattcctctaagattacaattttgttatctattatctattgaatttgtttatcttgcttcagtatcatttgtcattttcttcttttggatgttcacaaactgatgatctgtgaaaagagtggaaaacgagaactttgtgttagatacaattgttgaatggctggtcaagacaaattatgagtgccctctatttggccccttgaagacattgatatgatgagactgaagatatgtgttggactatttgttgctcgatgagcaggacacagttccattggaaattaggatgtgttctcccagaaacctctaccagaaaggcatgcactattctgtttcatgtgcttgttgttcatcttgtgtgccttaccttaccatggttaacaatttgttatccatcaagtgtagttctggaataataaagaaacttcaatttgccatgaaaatcttggcctgatttattgttcgacaatattagtggaggctgggacaagcaaatcagctgtgtgtattattactgagactacgagttctgcatgctggtatattcacttccatatccatttcttgttttctttggctggttgcagcaaaattggttgatagttaaggtcttatggatatcataagagaacaaactttgatgcctatgtttgaatgttgtatagatattggctagtgggtaattatttgccagattcacccttcattcgttgtcagtaacagtgcctggaccttgattgtccatagttgacaatttgttccagcatagttgacaatttgtgcctggaccttcattcgggatgtacgggcctgtttattcagctatcatagtgttgacaagctttgctgctctactgcccctacctattcgcagggttcaatctttcgtttgtgttagatatggcaatatttctgaaattttgaacaaaatttagtcaaatttgaaaaaatattgccgaatttcatgaaagtttttaaaaaattcggccaaaataatatcgtataaggggcgggggttccataggattgaaattccgaaattttgaaccctacctaatcttagtgttatattatattcctcatggtttgttggcttataagccagacccaaaattttaattttcaggcttaattttagattattttagacttatttatttatttttttaccttaacttttaaactgctaaagggaaagatacacgaggccaagccggctatcaacatccttaggtcatatccggtttcacctaaactggaacctattaagctttcaaaagtatagtttctttaaaacatttttttatcatccttacgacttagtatttatttgtcctcgtttcattcagttatgtctatttcatcaaatcaaacataccaaaatcgaaaatggccaacaactgcatgcgggacgaccgaacgtttcccttttttaatatctaagattggctcattcaaatattcagagtttataggatcctgatatagccaggaatacaatgaaataactaaagaaacaagtagatcaaagcaagaaatggcagcatggcacgcggcattcaacgcaccagccaaccggaaacaaccgttacagtgaccggcatcccaaaccccaaatgtatgaactaattacgtaatcaaccggcctaattaagcaggcaaccggcgcaccggcaacgcataagcacgcaaatcaggctgaggagcagagaacagtaaacgaagacgtgtaaaacagtcagatagccaaaaaaaaatccaaaatcatgagaaaaacgcgaggttagaggagttattgattgatgatatcgataaacaacgagctcactcgatctagtcaatgtactttccatgtttaaccatttatctcatttaaatattatgtgtaaatgcataaaatataaatcatgcttaaagatatttttagttataaaaataacataaattttttaataaagaaatggttaaacgtgtattaaaaaacaacagcgctattgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtgagcctcacctaaccgcattaattgcggtctggtcgaacgtgtcacgctgcatgaagcacagtgcagcgcgttcctttatccggtctgtgaccggtcacagaccggtcagatcacgggttaggtgcgactggtggtctgacgcacgccttgccccatcccgtcaagatgaaagcctctaggcactcgtctcaagccggagctagcgtgtaatctcttagagatggcacgttagccctggttagatttataccaggcttcatctcaaccattacagcctatatgttgtatgaagaagggtgaacatgcagattgttgaactgacgcgtggaggacaagaatgaccagtctgacactggtcatgtcgtcggcagacagccacgttcccacgacgcgcctgtcttcggcagaagtggaggtaggtgtgtgccgtcccgtcagaaggatgttcggaggacaaccgtgcaaatctccgtccatttatgaagagaagaaaagtccagtttggaaagagaggggtgcatgtggtatccccttgaagtataaaaggaggaccttgcccatagggaaagggggatgatcttttccagattcggaacttagaacaagtaagaggttggctcacactttgtagctccctcatacacagatccaccaaaacacaggagtagggtattacgcttcttagcggcccgaacctgtatacatcgcccgtgtctcgcgtttcttcctagctggcgatcttttcacataccgagagagcttgagacttcaccctaagcccccggccgaaccggcaaaggggggcctacgcggtctcccggtgaggagccacgagctccgtcatctggcgcgccaggtagggggctcagcgtgtgttttctgagctctcgtactcctccgtgtgcgccaagtttttcttgttcagcctaatggccgagcaagcaaaggtgcacgacctctctccgagtgtgagcggcgacgacggggagccaaacccacgtcgtcgagctcgtactcccccacctcctccacaccaaaatcctaagcagggggaggcgctcgagagggtcgaaaaatccgcagcatcgccagtcgcgggtgatgcaggagaacggcgagatggggagcgtcgcctcctcgtctacggcgacggcagcacgcctcagggcgcgcttcaggctgttggcgcgctcctacgtcacccgcccgtcgtccctgacccggagtctccagcccagcgatggctggacgacgtggccaacttggtcatgacggcacagcagcgcctgggtgctggtggacggtccgccaccaccaagacctccggcgccgccactaccggctccgtgtcatcaaggcggagggcgcggcgagcggcggctgttgcacgccattcggctgccactccctcgtcggcacctccgactcgggaggatcagcatggagagccggatgcccgcctcgacatcgagcgccggcgtaatagccggcgtactccccgcgcaacggagggcgcctcttcgtccagagtgtcacctcgacatggacgtaaggaccagccctccgtgcccccggctggtggtgtcggctgtagagcctttgtggcgagtcttcggaatgtccgttggcccccaaggttccggcccaccatcaccgagaagtatgatgggagtgtcaaccccaccgagtttctccaggtctatacgaccgggattgaggccgctgggggtgacgacagggtcatggcgaatttctttcccatggccctgaaaggacaggcgcggggttggctaatgaacctgccacctgcgtcggtccactcttgggaggatttatgccaacagttcactatgaactttcaaggcacttatccgcgcccaggcgaagaagcggacttgcacgcggtacagcgaggggatgatgagtcacttcgctcgtacattcagcggttttgccaagtccgcaataccataccatgcatccctgcacacgcggtgatctacgcgttcagggggggtgtgcggcacaaccgcatgctcgaaaagatcgcttccaaagagccccagactaccgcggagctttttcagctcgcagaccgagtggctcgtaaggaggaagcatggacctggaacccctccggttccggagtggcagcttcggccgcccccggatccgccgctcagacagggcggcgtgacaggaggaggaagaagaggtcggtccattccggcgacgagggtcatgtcctcgccgtcgagggcgctccgcgggccacccgaaaggggaggcctgcgagcgacaaaaagaaagaggctggtactcccgccagggagcgcccagctagcaagtggtgctccgtccacaacacctccctccacgatctcgcggactgtcgcgcagtcaaaaacttggctgagcgaacaaggaagtgggaggaggacaggaggaaggaacgccgtgagggcaagtcgccggcaactccctccggtaaacggcgaagtgaggccaaacagaaggcccccgctgtcgacatcgatgtcggtgatgatgacctaggtttccaagaacctggagccaccattgccactgtcgatgggggagcgtgtgctcacgtctctcgccggagcctcaaggccatgaagcgagagcttctggccgcggcccctactcatgaggcgacgtgccgggcgcggtggtcggaggttgccctcactttcgaccagaccgaccacccaccgtgcgtcgcccggggagggcagattgcgatggtggtttcccccaccatctgcaacgtgaagttggggcgtgtcctcatagatgggggagcggccctcaacatcatttcccccgcggcttttgatgccatcaaggccccggggatggtgctccagccgtcccaaccgattatcggtgtgacgccggggcacacatggccgttgggtcacatcgacctaccggtcacctttggtggatcagccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctgaaagtcgcgctcgcttgcatggagcagcgcgcgggccacctcgctgctgcgtccaagcccgagggtggtgacgagaggcttggcacctccgcccccaccgccccgaggcagcggatggtcacatgcgccgaggtcccggtcaagggggttgccctgggcgacggcccatccaagaccacacggatcggtggtcttctggatggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttccaaaggcgaacggcaagcttcggatgtgcatcgactacaccgaccttaacaaggcatgtcctaaggacccttaccccctgcctcgcatagatcagattgtcgactccaccgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaatagggcgtaatgttgaggcttatgtcgatgacttggttgtaaagacgcgcaaccaagacactttactctcagatctagcggaaacttttgaaaatctccgctccgcccgcataaaactgaaccccgataagtgcgtgtttggtgtacctgcgggcaagcttctcgggttcttggtctctgcccgaggcatcgaggccaaccccgagaagatacgagctatagagcggatgcgcccccccagcaaacttagggatgtgcaatgcgtcaccggttgcattgccgccctaagtcgtttcatatcgaggctgggagagaaggcgctacccttatttaagctcctcaagcgctcggggccgtttacttggacggaggaagctgaacgtgccctcactcagttgaaggcatatctcagctctcccccagttctagtcgccccggggccaaatgagcccctactactctacttagcggcgaccccccaagtagttagtgcagcgttggttgtggagcgcgatgaagacaatcttcatttcgcgcacccccgccctgtgttgacttggcccgggagcgagcagggaggagaagcccccgagtcgaacggtggcctaaggcccctgacgaccggagtcggccctctgcctgcttgtcagacggtgctgggtgcccccgaccctcaggaaggccccgaggccactgcgggaatgccgcacctatcgccctttggcctcgaggctaaccctgtgctgactcgacccgggagaaagcagggagaagaggcccccgagccgaacggaggcctgaggcccctgacgaccggagtaggccctttgcccgcttgtccgacgacgccaggagcccccgacccccaggacggccccgaggccactgtgggaaggccgctcctgtcatcctccgaccccgaggtcatcggcacagaagacgagtgcgccccgagaggccacttggacgaagaacgccccggggatgcggcccctagcgaagaggatcggccccgccgaaaggtgcagcggtctatctactttgttagtgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatctccgaggccagcacggacccctctcggctgcctcacaccgcccactgggtgatgcagttcgacggttctctgtctctccagggcgccggtgcgggggtcacgttgacctctccgaacggagacgtcctcagatacttggtccgtctcgattttcgagcgactaataatatggcagagtacgagggactccttgccggactcagagtggcagctggactggggatccgccgcctcttggtgttaggcgactcccagctggtcgttaaccaggtctgtaaggagtaccggtgctctgacccacagatggacgcttacgtacgccaagtgcggcgtatggagcgccattttgacgggatagagcttcggcatgtacccagacgggataacatggttgctgacgaactctcacggctcgcgtcctcgcgagcccagaccccaccgggcgcctttgaagaaaggcttacccagccgtcggcgcgacccgaccccttaggggagacggatgcgcctgaccggcccccgaggtccgtcggagtccaggcctcgggacccgaagggagcgctccaagctcccttagattgattgcttggatctctgagatccaagcatacctcacagataagactctacctgaggaccgtgaagggagtgaatgcgtccaacgcatttccaaacgctacgtgctggtagaaggtaccctctatcggcgcgcggctaacggaatcctcctgaagtgcattcctcaggaacaaggcgttgagcttcttgctgatatccatgaaggcgagtgcggagcccattccgcctcgcgcaccttggttggcaaggcctttcgtcaagggttctattggccgacagctctcaatgatgcagttgatctggtccggcgatgcagagcgtgtcagtttcacgccaagcaaatccatcagccggcccaggccctgcagatcataccactttcgtggccttttgctgtctgggggctcgatatcctgggaccgtttaagcgggccccgggcgggtttgagtatctgtatgtcgcgatcgacaagttcactaagtggcccgaggcttatccggtcgtcaagatcgataagcactctgcacttaaattcattaagggcatcacggcccgttttggagtgcctaaccgtatcattacggataatggcacccaattcactagtgaactcttcggcgactactgcgaagacatgggcatcaagctctgcttcacctcacctgcccaccccagaagcaatggccaagtggagcgcgccaatgcagaaatcctcaaaggccttaaaaccaagaccttcaatattctcaagaagcatggcgattcgtggatcgaggagttgccagcggtgctctgggcaaaccgaaccacaccaagccgagcaaccggggaaacgcctttcttcctcgtctacggcgcagaagcggttctcccatccgagctcaccctgaggtctcctcgggccaccatgtactgcgaagctgatcaagatcagcttcgcagagatgacctcgactacttggaagagcgaaggaggcgcgcggccctccgagccgcgcgctaccagcagagcctgcggcgctaccatcagcgccacgtccgggcccgatcactctgcgtcgacgacctcgtcttacgccgcgtccaaacgcgtgctggattgagcaagctctcaccaatgtgggagggtccgtatcgagtgatcggtgtcccccggccgggctccatacggctggccacgggcgacggcacggagctgcctaacccgtggaatatcgaacatcttcatcgcttctacccctgaggggggggtcgagtgtcaggttttggctcgggccaaccccgcacccccctcgggtgtgcagggttggccgggggctaccacacatgcactttcttatttctcttatttcagcatttcaataaaagcagtttcaatttcctaaaggttgtgtctgtgccgttttttccttttgaagaatcttgacttgaaataaggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttctcggcctggccagcctcgacatgtggatctccctaggcactagccccgacccgagccattagaggactgggacttgggcacgaggccttaaatcaagctaagacacaaaagaggaccacggcacagataatcctcatctcatacgcatagcaaaataaaattgacacgaattttttcatcatttttgattccagattaagttgatctatacaaaaaagaggcatgaagaccttagaagaaagaaaaagaaaaaattggaaattggcgggggcctgggggctcagtccgatgcgcccgggtcgccggcctcgtcgtcacggtcgtctgcaccgctggcatcgccctcctcgtcggagttgggggcgaacgcgagccgaggggccgacccctcgaaactgtggacgatgtggtcggcggcatcccggacccgcgcgcgcgcgtcgtcctcggtcccgggagggaactcttccagcgccatccatggagagaagttggggtccctggcctggtaactcgccagtacgagttcaaccgctccttgggcgaggtccctcgaggatgacttgatggtcttctcgagctcctcggggagttgttggagagcccaggccatcttcgtgaggtgcggagcgaggccttccaggttggtggagtgcgtccttgtctggcctttccagaggcccgcttgccgaccggcgcgatccaggcgggagaccgcatcccaaagcatgccgggccctatttcgcccgccaagcggagggcctcggcttccccggcggatgagtctagcgcgcactgcatgtcggcgatggtgagttcggcagctgcgaggcgggcggctaagtcgctttcgcccgcagccgccccgctgatatgcgccctcgcgtccagctccttttcccgcgcctcgaggttggcagcccgctgctccagtgcggctctctcggcgcggatggattccaaattgcggcgtgcctgctctgccagcgctgcctcacgaagggaaaggctatccgccaaccgttgcgccgcagcctcggcctcttcgagagctcgctcccgctcagcgagtgcgtcctcgcggaggcggagcgcggactcctcttcggcgcaggcggcctcgtgcaccgccagcgttgcctctcggatagcggcggcggcctcgcggtccgccaagcccctctccacggcgccggcgtgttcctccaatgccatagcacgggcctcaagggcctcctcgcgacgccgggacgccgcttcgatctccgttgcccgccgctctcgggcagcggcggtgtcaaggaccccttgggcggcgtcgagctttttctttagctccgcctcccagctcccgtgttgaaggcggagggtgtcctgcgcctcgatcatcgcggtggtggcaatgagggcgacctcccgctcctcgtccacctctcgggcgatctctgccagcgccgctttgcgggcttcaagctccgagacgtgacggcggtgagccttacggcccacctccaccatgacatccaccgagcgccgcccctcctcgacacgcgcccatgcggcctcgagctccgctcgttccgctcgcagggcctccacttgggcgctgaacccatctagcaccgcggtgtttgcggcggccaaggcctgcagaaggggctcggcgctcagcggggcgacagaagacgaggagaagagccgccttggagagaatgcgacgcggctcggcccgccggaggacgcactgggctcgggaatgtcccccggacccgtttggtcctaggcgtcgcctggggaagtgcgcccaggcgatccgcccgcggcctcgtcgcgagccgccccggaggctgtcgtctgagcgtcgcccgagggagtgggcccaagcgacgcgccagcagctttgtcgtgagctgcctcggaagacgccatcgcctcagcctgacgagcccgggcggcctcctccttagcagcttcttcggcttggcgagcccgggcggcctcctcccgagcggcctcccgggcggcctcttcagcttcccgaaggcgatctgcggcctctcgccggtcagattctcgcctccgttcctctacggcccccggatcttcggcctcggactggccggacttgggatggcgggaggaacgtgacgggacatcgctgaagcaaaagaaaaaaccagaagacaagcaagataggtaagagaaaacttgcttttgggataaaagaaaggcggtcgcaatgagagtgggacgaacctgcgagggggtcggttaaatgaccaccttggaggggaaatcaggtttccccgggatggttccgtctcccccatcttgcggagccgtttcttcttgcgctccccctcgggctgcgatgtcggcgcggccccctccgggtgccgactgctggcacgcaccgccccgccccctcggggaggagatgggggaggtgttcctcccagcttcctcttcccctgggcgtcggcagggcggctgctccccgagcccccgacgcggggcccagaagcacgaccccctcctggggtagattgttccccccggcggctctcgcccgcgccgtcgtggcccttaggagtttcttcctctgaggccccgacccccatcataatggtcagaatggaggcgcggtcgggatcgctgcagagggggaggataccttgaggaatgagagacgtctccacggagctgagattcagcaccctttggaccacgatcttgaagtcctcgggagcccaatcccatctgactccctggtgggtccgcatgtagtcttcggacccggtgtactcccaggcgccccgggcgcgccgttggagcggcgcaatccggcgacggaggtagtcgccgtacaccatggcccctgtgagcccttgggatcgcaggcccgccaggcggtcgaggacggcgtcatagtcatcccccagatctaccggcgcccgccagctggagacctgcgccgggggctgacttggaagtcggaggcgcgcttcgttggcgaggggggtgtagaaccagtcgctcttccagtcgtcccacttcttgcggagggcgcaggggatgtagcggttcaacaccggcccccgcggctggaagtagcagccaccaaccaccgacggcggcgacaccgactgcacggtgaagaaccaccggaacagccgaagagatgggcgcaccccaatgaacatctcgcacaggtgcgtgaagatggccaatgtcatcactgcattaggggtgaggtgcgccatctggagatcgtagaaatccagaacatccataaagaaagaagaaaatggcggaaccagccctgccattgcgaaggggaggaaaaagacggaccgccccgggtagtctggtgccgggcgtccctcgcccagcatcactatctcccggccggtggcagattccggcataaagcggcgcggcagcccggcatgcctctcgctcacgatgcgagaaggcggaagtacgcttccgtcgagcagagcggaaccccgagccatggcgccggaggaagggatgattgagagcgagcgcgtgtggcgaaggtagggcgcagcagagaaagagttagggctcaagcggcgaaggcaagaggaataatggcgaaaggaagggagcaaaacttttcctcggtatttttatacccttgccatagctgggcccggctcctcgtttctcgcgcccactatctcgctccctcgtttctcactatctcgctccctcgtttctcgtgcccacgcttccactaatcccattcgcccgcttgcggcgcatgaggtggatatgcgattgtggcagtcgagataggtcgtatcgtgcgcgcattaattacgctcgccggccgaagcgacgttaccatatctccaggcgaagcaaatcagctcacccagattcgtgcgctgcttaggtgatgtggcagtcttaaagagaccgcccattatgaacagccaagttaccattaccgatgtgcatggtttgagaccgttgggtttctgcgcaaccatgaaaaccggtcccacctgtcaccaggctttaggagtggcgttacgcccgatcgcttcccttgagaagggcgatcgccctggcataacgccggggactactgtcggtgatatgggaccgggagtatcgtgaccagaggcttgaggcagacacaatcgcccacgtggcctggcaccttcggggacgtcgggcccgagggtgaggtgtccgcccttctcctgatttccccgaggggggtcgggtgactcctgccccggccccgagggccgaggcgccccgaccccttgtggagttagcgccacatgaatgggttgggtgaacacggtgagcctcacctaaccgcatttattgcggtctggtcgaacgtgtcacgctgcatgaagcacagtgcagcgcgttcctttatccggtctgtgaccggtcacagaccggtcagatcacgggttaggtggcgactggtggtctgacgcacgccttgccccatcccgtcaagacgaaagcctctaggcactcgtctcaagccggagctagcgtgtaatctcttagagatggcacgttagccctggttagatttataccaggcttcatctcaaccattacagcctatatgttgtatgaagaagggtgaacatgcagattgttgaactgacgcgtggaggacaagaatgaccagtctgacactggtcatgtcgtcggcagacagtcacgttcccacgacgcgcctgtcttcggcagaagtggatgtaggtgtgtgccgtcccgtcagaaggatgttcggaggacaaccgtgcaaatctccgtccatttatgaagagaagaaaagtccagtttggaaagagaggggtgcatgtggtatccccttgaagtataaaaggaggaccttgcccatagggaaagggggatgatcttttccagattcggaacttagaacaagtaagaggttggctcacactttgtagctccctcatacacagatccaccaaaacacaggagtagggtattacgcttcttagcggcccgaacctgtatacatcgcccgtgtctcgcgtttcttcctagctggcgatcttttcacatactgagagagcttgagacttcaccctaagcccccggccgaaccggcaaaggggggcctgcgcggtctcccggtgaggagccacgagctccgtcagctatctattaaaagtaaataaaagaacagtacgaccgtatggtttgtctagttaaccctgcggcttacaacaggtataacagcagactataaaccagctataagcgcatatcgagaagataaaagaagagaaataagaacagtgggttataaatctatagccaaccgtaccacagactctaagacacaatttgtgtatgataggtgggaccatgtattaatagtgtagtatatatttatagataactattatatgaattgtgattatagttgatttgaagctagtagtcggctacttgctcttagagcaagtacaatagcaaggtataagctagctataatacatatcgagaagaaaagggaagagagaaagcgggctacagatttatagccagctataacacggattataagacgttgtgtgtgtatgagaagtgagaccaggtattaatagtgtactatatttttataggtaactattatataaatgggctgttagattatctatagatgatttggagttaacatttagttatactactacctccgtcctaaaatatagctatttctagcatagtgtcttgtcccaaaatgaagctagtttttcacctatctcaatctctcaaccaatcacaactattgttcttcacttaccttttcttttcgaccaatcacatacgttttccaatcattcttatctacttttttaatacccatatcaaacttaaaaatggctatatattttaggacgcaggaagtattaaacttgctcttacatggaattattagcgtggtcgtttcgcgtgaactccacccgcagacgcagacaatctccgccagcgccaaagccggacatgccgacgtggcgagcaatgtggggcccaccatctgactcatcccccctaaacccccccacggcccaccgcctctcctcctcctccttcctcgatctctccctccctccctccgctcccaatcatggctaccgccaccgccgcctcccgcctcgcggtggccggcgctgaacccgctcgcgcccggcgccaccgcccgacgacggtggcagtctgcgggggcgcgaggccgaggtcgcgccccgcggccgtcgttgccgccgccggcgccgccgctccctctccggccaccggcggcgtcgcgccggttccgccaagccccaggggctcgtaagatccgtacctgctcgaaaattatttttgttggtccggtttgatttgggtttctgggcgttaaggactacggaaatgggagctcccctccattttgatggaactctcgtcgtatccgggttgacctgatagtgtatagatagaactgatcctatcttttatttctccccgtctcgtgtcgccgtatcggatcgattatggtgttaggggtgtggaattcggggatttagcattccgttgtgaaatctgaaatggttcgttctgagcagtcatttctgtagcgcctgagcataattgaccagaattacaatcatttttcaaatcaagcattcattattgggtgtttgtgacatgcttgtttgcatttgttgcccacaaagcctgtaaagtgacttacgtcggagtccagaatattagctgctgaatggcaattctcgtaagatgatttagttgcacagaacatttgttatttgtttggtccatgtcaatgaaaattgtataacagtatctttcagttatgcaaccccttttttcttctgaagactagttgtgttaacaaagggaccaactttcaagatgtgtataatatgctttttctgttaaggttgatttagacaactaagaagctttccatatttatgtatgtatatgatgaattgatgaccatgtaggcctttgaaccagagtctagcacaactcctctttaacatttctatgatgatttcttcaacatcaaacggcaacaatagtttctcaagcaaccttttaatatacctctttgcatatgtatacctaaagagatcaccaattgttatacatttctattgaagattgcaatcaacacagttttgtcgtcctttcatgttttttaggacttccttttaagttataaataatagcatctgccatatagaaatgttaaagatgcctgtattagttccattttgatctatatttttttctatgtttatcttgtaggattataaagcgtcatacactatcagtttttgttggagatgaaagtgggatgattaatcgaattgctggagtttttgctagaagaggatacaacattgagtcattggcagttgggctgaacaaggacaaggcattatttacaatagtagtatctggaactgagaaaatactgaaacaggttgtagagcaactaaacaaacttgttaatgttatacaggtcagtattttcctccttatcatatgaattctaagatgtttgctgattaatagtagcaagagtgactgtactaactcgttcattctttccaatatatctgatattcatagcctaatgtgaatgcaactaggttgacgatctgtcgaaggaaccacaagttgaaagagagctaatgcttataaaactaaatgttgagccagataagcgaccggaggtatgactgcacaaccttatgagaaaaccatctggggatttatatttgtgctgtgtttttgattttacaactttcataatgtctggatttttttactctatctgcattttctggatttaccttaaaaaggagcactgaatactgattactgagttggtgcaaaatttaaagaattaagtggataatggacgaaacatttgcacatttacaaattacaaatgtcaactggatttgcaaagctgcaaatctacatgctaaaccttgtttatttatttatttgtttatctgcttttacatgtaggtgatgggtttggttgacatcttcagagcaaaggtggttgacctttctgaccacacactaactattgaggtaatcctatgtttatcttaccttgcagatcacatcgaccataattcttgtggtttttatgaaagaaaaaaaatcttctttttttttttcatgttgaaggtaactggagatcctggaaaaattgttgctgtacagaggaacctaagcaaatttggaatcaaagaaattgccagaactggcaaggttaaacttctccagaaagaggctagaaaaatatgctcttttcatctctctatttttatgtaataaaacttattaatgcaacagatagctttgcggcgtgagaaaatgggagaaagtgctcctttttggcggttctctgcagcttcctatcctgatcttgaagtggcaatgccatcaaaatctcatgtcaacactgcgatgaaaacagctaaccagaattctgaagaatcttcacaagtatgacacatcaattatcctcgttcatgtgaactcagccatgatctctctttaatttcttcagaattgtaataatatattttatacatatattactctatggtgttgttctaactttcccatgcatgctaaactgtcgaacactcataatatcttcaatatttttctttccaatcaagttgtagtttttattttttcaaattgatcttattaatgctctcctgctgctcattccatgaagtttgatactataaaccattttattctttgcaatatattactatcattatgtgttaaggctgagtttagttcggcccaaagtttggaatttggttgaaattggagacgatgtgactgaaaagttgtgtgtgtatgaaaggtttgatgtgatggaaagttggaagtttggaaaaaaactttggaactaaacagggccttattcccgtgcattcattctttttttattttgggaatcatttatgcatccaggactggatgcattatttaatttgttgttcctgactaatgtcagcattgtattgaacaatattaccttaattagaaatatttaaaagtgttatctatcttagcataactacacggtaggctgatatttcagaattgtaaaactgagtatcgctgtttagaaaatgatcatgggtactgtgttgcatgcactaatatgggttgttatcattaccaggatgttcatttggattttgactattttatatgtgattatcttcttactcctagggtgatgtctatccagtggagtcatatgaaaacttcacaacaaatcaaattcttgatgctcattggggtgtcatggctgacggtgatgtaagttcttgtgttctgaattgtttggttgcagctaccctcacctccatctagttctgcacttctacactgaattatgtatttattttgactgacttgtaatactgaatttagtgtataccctcgaactaagctagcataattttgctgcttcagccaacagggctttgttcacattctttgtccattttggtgaatgatttccctggagttctcaatgttgtaacaggtgttttctcccgaagaggctacaatattcaggttcatttccccttgtatattttatgttgtctcacttagacaactgcaggtttctaggttccactgaatgctaaataatttcatcacttgacagagtctggctgttggcccagctgaaaaagaaggcacttctcggatcactactgttgtccctggaactgatgagtctattgccaagctagtacaccaactgtataagctcattgatgtttatgaggtaaatcctattcactttgtggtttgcatggttattgatgctgatgtaaacttagctcaaattttgtttgaattttcaggtccaggatcttactcatttaccatttgctgctagagagttaatgatcataaagattgctgtaaacaccacagcccgcagggctatcctagatattgctgatattttccgggccaaaactgtggatgtatcagatcacaccgtaactcttcaggtaatagtcatgggctatttttacatacacccacctcattggcccttatatcttactgatctttgaaactattataattatcagcttgatgtaagatattgagatagactagagaaaatctctctagtgtagctttcaattagctgatgctaatttcaatatagatccttgaacataagctatcattttttcttgaaatatatatggcgggagcctctcccgcagttttgattcagtaaagaaaatcaatataggtcaaatagagacaatgctattaggaaatgatgtaatttgttgatttggattgatttgaacattatgaatttatgcttttttacaccaatgaacaatatacctgatgactgaatcatctcctttagtatttgcatgaagtagttttgagggcaatgtatccattctggcaccaattgcttttctgtcaaatatttttccttaatagtttgcttgcatgcaacaattgttttaccattcagaaaacttttaagtttacggatgatctcaatttctgaatgtcatgaattttatattttttgcacattagtgaacaacataatctcctttttagtagtttttatgaactagtttcaagagccaactaatcatattggcaccaatttgttgtgttatatatttttccttaataatttgcttggcgaacaacattgttttggcatgcagcttactggagaccttgataaaatggtcgcattacaaaggatgctcgagccctatggcatttgtgaggtttgtattgagcttatcactttgcatcttgcaccatgtttttcaaccaacagtagtgaatccaacgtaaatcatagttcagatggttgcaatatattgctcttgatcctcctctttgcaggttgcacgaactggcagggttgcgttgcgccgtgagtcaggagtcgattccaaatacctccgtgggttttcccttcctctgtagtttgtttgtcagttggcaaagaggtcatccccatcttgtcatttcgattcaattttgttctcttctgttagaatcacaatcttgaagtgatagaatcattcgaaagcaatacaataagaaaatagtggtcacagtttgtgtcagttgtattagaaaagattcaataaaagtatttgagttggctcaaaattgttgtatctgaccattaaagctgtttatttttctagttcttatattgcatagtttctggctttctgcgtatttgggtgaatccgtgtatggaattgttcattagggtgttttcaagggtgaatttcatcgtttcgtataagttttttttttaaaaaaatacatgtattttggttgaatgaataggatgagatgatttggatacaattttttttaatactcctgagatctcgcatcgttccatacactaaaaaaaatgtgcatcacagtgtcccggatggctcgcaacagagcttatgtaatagctcagcatctgctttggtctatcagcaactttacgagatttttgcagtattatttagagtatttactccacgtctctagaactacgttttcttaaaagaaacattgttttgttgtattgtttagaacttattttaatctatctgttaaatttatttattaaaatatttaattcatcgttataatcaaggaggcaatgcgtggcaaataatatgatcgaattattagtggtgttgtgatcgagtcctttcagaatttaaatcacggcgcaaaaaaattacgcacaagcaagtgagcttctagcagaaatttagtaagatcaggagtgtgtatcattggttttcgtctctttaagcgtgtgttcaaaagagtatttacagatacgtgagtatggtgttacgtgtatagtggtgtatatctatcatgtactttatgaaaaatataccatgaataacctgttttgcatggaaaagggaggtgtatatggatgtttgaaacagaaaagagaaggacgatttttttgcctcccacccaaacacccccatagtgtacagagagcagatggacttcaataccagagcaagcaattggccaccatggttcatgggtttcacctaacagaaagtagcaacaagggacaacccacccataccgacataggaggatttactactggcaaaagaccgtctcgtgaaaacgccacaggtgcgcaacgaggagcatagggaggaaagcgaactggaggaagagacgggggaagccacgtcatttgatggaaatggaaggtccaagcagcccattcattcttggaataaggggagggagcctatcttctacaaatactccctccgtttcgaaatatttgacaccgttgactttttagcacatgtttgactgttcgtcttattcaaaaactcttgtgaaatatgtaaaattatatgcctacataaaaatatatttaataatgaatcaaatgataggaaaagaattaataattacttaatttttttaaataagacgaacgatcaaacatgtgctaaaaaatcaacggcgtcaaacatttcgaaacggagggagtaacaaattttatagctgaaacttttagacatcaagtggccagcatggcatcgttgaaacttttcggatagtgaaaaccaagtcctctttttccattaaagaaacaaataaacaactttaaacggttgtgtgttgattttcttttgaacacatacttgaatggctccttgctacctcataagagttcaaaaaaaatgacaagcagtcctctgaggttttctcaggttttgcctatataatctggttcaagtttttctggtctatctacccttaagtggtattaccaaccattccggaggagcagttgatttagcaaattttagtattcatctattagatgtttcatcaaattggttctatcaattttatacaactatcttcaacatgtgtggacctagaatgactatgcatagtgacatcatgcctgtatctaccaatttcgctatggtggttaagttgaaataacatgtttattaaaaaataaagttattttctcgtgatttgtttagattggaagagacattagaaaattcattacaatagttggctttgatcgattgcttggtgttacgctatttactactttgattagctaaattcatttatgacaccaattaatttacagctgatccattcataatatcgtttagaagcaaaggcttactattgtactatccatacaagtaacttggtcaagtcaaaagaagtttgttgactactactaaatgagtgcacgaagaaaggaaggtaaagcagggacaatagtatatggtaagtagctttgcattgttctatatgtagaatacctattagtttttcacaaaatagtactatatgtggatggtacataggtatgatgaaagagggctagctctgtttgaataatagttaccagttaagataagactactaaataatctgctacttcgtttccaacggttacaaacatacaaagaagagataactctttcacaagcgattgtgggcattcctagaatatgagactagtgccttacttggggttcttcttgaaataaaacaaatgcccattcaatcggaattagaagtaatactcatctttcctgagattccaaatcccaacatatgaacggggggtgcaggaa

SEQ ID NO: 77082 - DNA, 10035 bp, Oryza sativa
aaaggtgccagaccacgtgggcgattgtgtctgcctcaagcctctagtcatgatactcccggtcccatatcaccgacagtagctcacgatggttaatcgtgttatgataattaattgataattaaaacttatcaagggtgggttgtgagcacatggttttaaaggttgtgctcatggcaattaaggaccggttcgcgagctactgttgtgagaaattaaccgtgccaaccacaagccagcgtgggcaacggctttaccttttgtatagcatggttcattgcggggcaccagactgtgaagcggcgagaagtccgtgggggtcgctggggagtccatgcctctggttattgagggggtgattatgatccaggaacggtgcgctgtggtggattgtgttgtgcaaggggtactgtcacagttcctttctgaggtactgtggtggtattgaggcgcatggtgacatgtcgtggagctgtgtcttgtgggtacagtggtacacctctggccagagtaaaactattcgaataaccgtgcccgcggtcatgggtgagttgagcaatgtttttcgtgattagtctcacacctctcacaataattattgatgctataactggtaataatttgtttagctcctggtttggagttagatctgtacagccgggtatggttgttcagggtggttgggcctgtgcagcatgggtgtgctgtgcagtgttgattaaaattgatgattaattactctactgttttactactcttaaatgtttgctaaatgctgcttttgtaaatgagcctatattatgacatcctttggtatccttgtgcacttgcatatttactgtgtagcttgcggagtatgtcatatgctcaccttgcaataatcaatcaacctcagttgaagaaaaaggatccagaaggagaagacgtttggcttataccccagttgagctgcctgtgggagtggagctgaagccatcgctagaccgttaattccgctgctattttcttttcttttgtaagtatgtaatgatgttattatgatggatttgtatattaaattgtcagtttgtgtaccttggctgatttctggacgagggttttatgcacaaataagttcggaaattactagtgaatttccgggcgtgacacagacccacatttataacatctcaatagtcaaaactgacatataagtcgtcatcaatggcaggtgtttgcttctacctctatctataactgtcgaaatattgaaccattgtagattgtgtcattacaaacggttctagctgagccattacacataacaggtcatagatgaagttttttttttaagtagtagtgatttaatgtagggaaagtataccaataaggtgtagatttagaggtcattaggccatgtcacataatgtaatttagtacaagtgccaataattttttatacatgtatgaaatgctcagaactatatcggtttaacatataacgatgctaccatatccttaattgtattcgcaaaagtgtatgagtctgttttcttatacatgtaatcggctgttcgtgcaagatcaacaattgtctcagccactatttttggttgttctgttggtagtgtaaggtattcttttactatatccttccatgaatcttcaatcaactcctttatcttcacacatgcatcatgcattgttgttccatgctgaaacatgtaacattgcacagtagaaacatggtgctcccctttttgctcacgctgtacaagggatagtaagacaaagtcaaaccactattaagaaaagatatgatggaattttcctttagtttggccaattataaactacatataaatttgttaatcatgtgtttgtttgtatgaagtttatgtttgtacttcaagttctattctaataaaagaatggaggtgtaaatgatgcaagaataaacatctatgtaaatgcacatgtgtaaaaccatataacgacctttgttgaaactatatcgttggataatcttgccaatgttgtgaaacacttgagaagctccggatatgtcaaaagccaatcaagagtttctttagttatgatatcacccattaccacaaaggaagcacatgctatctcaaaagctccaacagtcgctcttgaaacctccaaatgttcatcgactgtttttgggatataatgttcatcacgccatttaatctcctgtgagtatccttgaactaacctctttaactacaatgaacataatgaaatatgatttcagatattgaatttccataaaattaactgttgagaaatatcattttactaaagaattagctgaataacaatattaaaatacaatagtttgttgtacttatgcaaagcatgtatactttatacgtacaatggtttgttttatatagtttaatttggagcggtattttttgtattaaccattgtacatataaatgatttgcataacaatgtgatttctacatactatataaaacaaaccatataaaagggtgttaattagttttaaggaaattcgaatttaattggattgctcaacgtttgtttacatggatcatactacacatcatgatatacagcctaatcataggatgaaaaaaatattaccttcatcccaaaatataactacctaggagtgtaggggtgagataaaggatcggggcaaaatgtcaaaaatgcccctcattaatacataggggtttatgggattaaggatagtatgggtggtacatagtctcgggagctagtgaggtgatggggccattaggggtagcatggggagtaatggggtaatttaaacaatttaaacataaagactgatatattttgggacggaggtactatcgctacgtagcaatatcaagatttaatttggtctaatataaaattggattatgtaaagtaaacttagagtgaagagggcaaattttattattcttgaactctagtgtagctaacataaattataatatgtcatctttagctggataaagtatataaatcacacatgtttaacaaactaacaagtttaatggcataaatacttgccagctctttgagataaaatacacgataactgttacttgttccaagttcctcttcaatcaagtcaaatgtcttcaataaatacaagtaaaaacacttcatatattctggaagtctcactattgcactttcattacacctgtattttacattagagcatcaggtattttacataaaccaaaatacaaccatatcagaaatttagaactacaagtcaataatatttcccgaaattggtgctacatggcccagattaataatttaacatacataatgattgaataatcattaaaccacattgtaagaatggagttgcattttatacaatttaatttgtaaaatttttattctagttggttcaagtcagtaaatttgtatgtacaaatgcatgcaatatataccatctctgggggggttcggggtaaaagtgaagaaaccccaaagacaatggtaaatttcaggaggaggatgaatatgagataaaaaagcaacattaacattagactaaaactaaagattacttgtatatcgcttctgcaagcatcatactctcctctgttgtaccatgggtgtcaaatatatcatctattatagtgatataggccatcatctttataagtataatccgtgacagagaataattgaattcagggcatactcctgtcatccaaaaatgcatttccacaattctatctcgaatgaaacttagatttgattgaatattaagctccttccaccatctgtaataatgcatataaagataaatctactaattaaaaataataattaagaagtacaacttagctttttcagtacatatcaagtttaaagtgacttacaatgtgatcttttttagctcctcacaataaagaaattgaagtaggttgaaattcaactttgcaaattcaagtatggtctcatttcgtccagagatcttttcatagattgggatatagtttcttgtttctaatattcgaaccctcctaaaaaggggtgtttcaagggcagaagatacttcttcttttaacggagatttcaaatgttccaatttagcttcaaggtgggatttcgtgaaggcaatggctccgtcaagtactttgtccccacgagtccttacatgtgctgcattatataagcctaagagacttcttacttcatcagcagcaaaacttccttccttgtctttgaaacatagaaatatatctgcaaagtttgataaaataaagtattaatttgtcactgtcttttaacaatctattttttattttaccaataaaagacttaccagacgacacgtcatagccattcttccttagaagataaaatcgaagggaaactaggtttagatctttatcgtcaaaatcggaattgtaaatggaatacagtagatcatctagctcggtcttgtagtagctatccaaaccaagccgttgcagtgtgagcacaaggtctagtatctcagatacttcctttgagccctttaccatgcacctaacttcttctttcagcacctcagccctttctttcatgcatgcatgctttaaaatgagtagggtagtgtgtattagtcaattcttccatgcaatcgatcagaaagctacgcctattacttaaaaaaaaaggaaaacaactatgtttatagctatatctatacatatgcctatagttattaggcattgttgtgatgcaaggaatatctcaacatgcctaattactataatatgatgttaaattattgtgagatatcgtactcttatttaatatttaattggagtagcaaaattatctgggatccatcgagcggaacataattataatggctaatattaaataagagtccacacatgcacaacttattattattattattattattgttgttgttgttgttgttgttgttgttgttgttgttgttgttggtccctccaaggaaattcacattataattggagaaataatgaataatatatcaaatgaaattaaaataaaagtaagcacccgttactacttgttaattattaattcctaattttgaaaataaattaacaggagtccaatacagatagaactttgtatttattattttcgaaattctgaaatatttaattaaaaaactatcactgagactccaaggctagtacagctttgcatttgttgattttgaatttggacattatttttgttaatgataaataaagttaagactccaaacttggtagaacattacatgaaaaactaaaactgaaactgttgaacaacatatgagtgcaagtcagggatggcatgccaattattattaatttcaagtttttatattgttaaacaacatgaaaaactaaaactgaaactgtaaatcaggtatagttttcttattaattccatatttatgatttttctgttcatttaaacactaaaataaataatccatgaaaaatacaactgtgtattaatttattaattttgagtttcaagattactaaattaagaagataaaaaactataaaaatattaattggtatgcataatgttgtatattaaaattttgggagtatctattgttcgttaaataccatatacaatgtttgtatatcatagtatatataaatagcacgcgtgaatgcacgggttactgaaattcttcagcgctatatttgcaattaattgttttaaaacaaaatatttgcgattaattgctacctgagatttatttggtggctggtaatcgacgaagaaatcaccccacagggtggggtggaatgtagaagcagccttttgcatcctctcgttgtcttctttctcggagcaaacagctgcaggtttgattaccattctatccatcttgatatattaattagttgtctctccttaagtgttcttcacaatttctcttcttgctgactgaaactgtgctgctctgaacggctacttatagagggtgaggcatcgataggccagcaacaaacgttgtaattaaaatgctggcattgatcgtgtccaagtgaagaatctttccatgcagcagcctgccttatgaccgaattggaagatgtgatagttacagttgaacttacatgaagtaattttgatataaaaatttttgaccatatgtaaatattcttttgagatgacgatgcaggcaagaagaggccaacaacgttctagctttggcattgaacaggccaagtgatgctgatgtatatatatatactctgactgtactggctgctatcgatagcgttccaaacaatgcagtaatttgatatacagtcgatcctgacccttatgtcaattcattctattttttctagaaggaaatgtgcacaagtgatgtagcaccaagagttagagtagtacgtaacagtagtttgactcggcaggctttaaaatatttcagatcattgtattcctattccaaacgaagataattcaggaaagagaacgaatggggagaacaataaaactaccaccgatgaagagattccttgcagcacactatagagctcgcatgctgtcggtcgatcttggtgacaaaagaaagagcttttttaccgtccatccaaatttcttcttaccttttggtacctgcaatcagaaccatccatatagatagatccaacggctgtcaatacttggtactgctaggtacagaaatctcctctgtggtacctccccttcatccgcatgcattgaaagagttgaagggcaaaattgggttttcacatggctaggctggctcatccttcttgcgttggttgtgagtttgattctcgcatgccacttatttttttctgccgtcttgccacattatttttccctactgcctgtgctcccgttatcatcctcgagagcgcgatataaggagttcttcgtgctctctctctccatggtgatgtgattccggacttcaatcttcctctcatccaaaatcaaacaaaaggctaaagcctagaggtgatgatcaggtgatgcaagattttttttttttagggggggggggtggtgggggaagggagggcatcggctccaccgcaaccacagtcagggtcatgggcgtcagcgcatcccccgttggatcgctagccgcctttaacaataaatacaaactgtcgcgcatgaaggcatgtaagtatagtgggcctttgatgggatcacgatttgcacgtgaggacatttggcaggtcacaagtccatttccttctttttcctatcgtacccttacataatcgacgattagattttgtttggtacctcatagtaccagtacctagagacatcatttgctggaccgtaaaagcccacctcatcaatccatcaaccctatgtagtttcacttgctcatcccgtccatcgcatttactcgctagatcaacactcgcctcgtgctagctagatcgtcttctcttctgtggtccaccccatgtgatatatatcccggtctccgcatgctatgaaaatttgatctatatagttgtgctgtatttgggaaatttttgtcctgttcctttttcttatgtaagcctattatttgtttaagcaaagttggtaatggatggatttggtttaaggaacaacaccatgtatgggtgtactattcatctaaagcatgtatgggtgtttggtgacttcattgaaattcaatgtagatagactagtgttcatgatgtcacacaaatgaattagtctttctatatagatcaatatttgcctattaggaaagaggatagcaagttcgtaattaacttttaaattaatgagatgtgtgatctgcacatagctaaccaatatattgtactaatacgcttaaatatgagcaaatttcataaaactacatatactttacacaatctatcacaaaactatatatttaagaacttatttcacaaaactacagattcaatgtcttcgtttatcacaaaactacaagtactttgcacaatatatcataaaacacagatttaagaacttgtttcacaaaacaacaaatttaatatctttatttatcacaaaactacaggtttagtgtcttcattatcacaaaactacatgttttagcattgttaaaacctgtagttttatgataatggagacactaaatttgtagttttgtgataaatgaagacactaaatgtatagttctgtgataaacaaatacactaaatcgatagttttgtaaaacaagttcttaaatctataattttgtgatagattgtacaaagtacatgtagttttgtgataaacggacatactaaatttgtagttttgtgaaataaatttttaaatctgtagttttgtgataaattgtgcaaaataactatagttttgggaaatttactccttaaatattaactagaaaatgacgtgaagatagctataactagcaagtttaatattatagccaactgctagctctaaaaattggcacatcatctatttttatataaatatatattgcatcattaataattggcaaacctctcatacacataatattttaaagcccatgttatagctgtctacaaatctgcaaagctaacttattgtacttgctcacacccaattaaaggcaggcaactcttgtctgaaaaatgcccaaattaatctctgcaagtaccgattgtagccatgcttttttctctatatatgaaaagaaaagattgtaccaaaaccatctatatatgcagtggcattggcaagtccttgtagatactcgatcattatcattgatacagtggtgggttattgtctcgtttaccaggactccaagaaacaagctacagattcccacccagaaaaaactgctgcaaattctctcacgacaaagcaagtttcagatgtctgagtgacgcagaaaatttgccacaagcagggaaattcttcgtgcattcatggcattttcgtagctactccatgcagcctaagtacatgttgtagttagttagctgcctgcgtaccagccgacgaaattaacttggtcgatgttgtagtagtctcagtgcatatgctcggaaaatcgcaaccttgctatatactccctccgtttcacaatgtaacactatgccggcccatgctagctgtgacgggcctaaactatcatctctgacggattcggcccctcgtcaaagattagtggttagtgatgactctcttcacctttgacgggtgaagggccgtcagtggtgaccagcccctatgacgggccacgtatagaacccgtcacaggtaactattatctcaaacggcacattaatttgtgagccgtcagtgatgtctaaaatccagaaaaaaaaagaaaaatagactggaacccgtcataggtgtgaaaaaaccctagcaagaaaattggcgcacgctgcattggtggtgcttgctgtcatcaaactgacagcatcacaaaaacatcaaactgaccacatcacaaaacttcaacctgaccaacagttcattgtcctccatcaccgcatcaccatctcatatagcaatcattcacaaaagaggatggcaagaatttatcatacaacaatatcatatcattcacaaaaggggcacactagccgatagttcgtcgtcctccatgacgaaccagctatgggagacgcatgtggaggcgccgcgctcgcagccgccggggaggcggcggaggatctcgaagaggcactccactgctgctgcaccactaaacaaaaatcaagaaacaagaaaccaccattagagcccacattctcaaaccaaacacctcaaatcaacaacaacaacaacaacaacaagaacaagaagatttaattaaaaaaaaaactcaccgaggtggccggtgggtggggatggaggaggcggtatctgtgcatccccggcctcttggaggtcggatccggcggctagcgcggttggtggcgttggtgagggaggcatcggtggcgttggcggccgggaggtggggggaggcaccggcggaggtggaggcataggtggcggccggctagc

SEQ ID NO: 77083 - DNA, 19877 bp, Oryza sativa
atagttaaagttcatttatatgtgtcccatctatatggatcattttgtcatatacatagttgatgccctagctaaggataaaataatcagttctctcctctaaaatacatatattctattaagcatatatataatcatatcaagatttatatgtaggatatgaccaacaatgaagtttctatacgatttgtaacaaaagttatattgtaatcaaggataaataactatatcattaaatttcagtctatttaataatccccccaactcccctccccctccttgttcccaaaatataaagcgactaagagttttacatggtcaccaaatattgtactttgaccattaatttatttcatgatatatcatcaacaactatgaaagtaacattatatgaaagcatatccaaatactacgaatctaatacaaggatatggtaactacatatttaattgtcatatatataagttttgccacaaattgttttgagataggagacttaccagctctttgaaataaagcactcgataacttttgtttggacctagtgcctcttcaaatgaatcaaatgtctttaaataatataagtagaaatccttcatgtattttggaagtagaactgttgcagattcattgcacctatattttacaatctagtgtcatttaatattttcacaaaaaacaaccaaaagtgtaatcatgtagggagccaaattgcaaatatttattagcgtatagtgatttttgattaaatggttgaagattggcaagtttgtctagtatacacatttattttattggcgttaatatttttttatgtataacagttcttatgtcatttcttggtagatcatatatccaagatataagattaattacgtggctagcttgattgtctgttctaccttcctaaactcctaaggttaaataaaatggaagcattatatattcttggcaaaggttggtgtatggcatgacataggttcaaagtattactcatgatcatggactcatggtgtgttcagtagcagtgtcccaaatataagctagtgttgttgcatacatgtaggatattgccaaatcattactttgtctagataatccatgctaaatttatcttttgatgtttgcattatgatgattgctctggattatattttttttgacctcacattgtctttccactactttatgtccatagtatgtgttctttgatttaaatttttaggatgaattactttaaatgaaatgaatgaattattatcaattctgccatgttttatatctatgtttttatttttttatttaacctcagaataattttgataattgcaatatatgtaagcatggtatttgtggattttatatcattgcctgtatcgaagaatattatgatttaacttatgtatcaacttcatattgcataaaacatgcatggcagcaaatgaccaactgttaatattacaatgaggttttaagtaaccgttacaattaatgcccagataggttaaatgtttgcatttctttttctaagagaaaattgttttccttgatctttggtaattatatataggagaaaatttaatatgcttactctttttctcaattaatgaggcatacatgggattaatatattaatacaacatggtgaatagattacaagtatcagaacatgtacggatatacatgtgcattgcatatatataatttcatagagttatttggctcctttatactatgattttgttataatttactttttatgtgtttagtctattgtgaaattgattccacatacaactagaaatttcacacttagtataaactagctactacaaaataaagatgcaattaatattaccacatattataatgaaggcttacatatatatcgctttggcaagcatcatgctctcctcggttgtagcatatgtatcaaatatatcatctagaatggtgataaatgctgtcatctttgtaagtataattcgtaaaagagaataatggggctccgagcatgctcctgtcatccaaaaatgcatttccactattctatcccgaatgaagcttaagttggattcaacgttaagctctttccaccatctgtattgtacataaatgtaagtactaacttatttatcataatttcacgaaattgtagaatcattatgcactttaaagtaattaacttaccgtgtgatagtttttaactcctcacaataaataagttgaaggagattgacattcaactttgcaaattctaatatggcttcatttcgtgtagtcgcgctttcataaataggaatatagttttgtgtttctattattctaaccctccggaatagtggtgtatcaagagcaagagacacttcatcggctaccggagatttcaaatgtttcaattctgatcttaggcggttagtagtgaaaacaactgcttcatcaagtactttttcaccatgagtcctcatatatgccgcattatataagcttaaaagacttcttgtgtcatcagcaacaaaactcccctctttgtctttaaaatgttgaaatatgtctgcaatgcaaaggttgatcatgttaacttaaaaatacgaacattaattgcatgtccccagctatatatgtataggagaatatgcaacacaatatagttattaggctgcatgcatgagtatacatgaaatacattatactgaaatatacttcatttaaatttctccaatctaatctatatagctagcttgtttaaaatatttcagttaccagttgccagggatgttattagtatataatatattcagttcatagatgcaaactatatattttttaaaaaaactaatagggtatcaaatccttcttgtggttttggaacagggaaagtaaaaaaaaaaggaatgttcctatgtgctaagggtttaattataggccagtagaaaatgcatgtccttgcatctatctgcaaaattattggtttgtttatttgaaaatcctaattaattcttatcatcaataaggccttaaaattaccagatgacacatcatagccgttcttccgtagaaggtaaaatcgaagagaaactaggtgtaaatctttatcgttgtagtcggtgttgtaaacagtgcagagaagctcatctatctcggccttgtagtaactatccaatccaagtcgttgcagcgtgatcacaagatccaatatctctggtacttcatttgagccctttactacctttctaacttcttcttttagcacttcagccctttctttcatgtaagcatgctgcaaattaaggaatacacgtctgtcaacgatgcaacagagaattctccgtgtataaatataaatatcagtaatgttaccgacagatggcacagatacacaattaatctccaatatatacactcatccgctaataatttactatggtaatataattagtaaaaacgcagtgtaaatgtaatactaatgctgaagtgtttcaaaatattattctatcttatttcttatgcccaatataaaaatatccatgaacactggagaaattagtttattattagagtttataacgttcagctatcacatagtgtaaaatgtctcacttattaatttcctatctacacagagccagagaatatatataattaaacaagtataattaccttaggtgcagtaggtggctggtaactgatgaagaaatcgccccagaggctggggtggaagccggtaggagcctttcgctcatcgtcttcattggagaaattagctgcaggtgtcgatgacatcttctgatctcttaacaaaaagctctttcctattaattgttgccaacctaattttattattgttctgcaactatctggtgagtgtctactatttgctgcatctcgcatggtatttatagacagttgcacaggcaggctagctgagcaagcatcagcatgatttcatgttgccaagtcagaatgatgtactcatgcttgcgtgatccacatgtgtattttttttccctgactgcttagagatacatacacacacatatgtcatgactcaagcagatacctacgagtacacaccccttaaataagctcgagagatggtagcaaacagttaggtggtgttaatttggatccagggacttaactttagtctctatatttagacactaatttagagtattaaatatagattacttacaaaactaattacatagatgaaagctaatttgcgaaacaaattttttaagcctaattaatccataattagagaatgtttactgtagcatcacataggctaatcatggattaattaggctcaatagatttgtctcgcgaattagttcaagattatagatgggttttattaatagtctatgtttaatatttataattagtgtccaaacatccgatgtgatagggacttaaaagttttaatcccatctaaacagggtcttaatctattagactaccgttacctagctaaccaacattttattaaaagcatacatttacatgtggtaactacagaaaccaagatttaaatctgatagatgaagtcatgcgctcataagaccacgactccaccaccgcactaaatatgattcatgtatgtgtttaattattctataggcaaatactgaaagtaggaggggtttcttttttaaaaaaaaatatctagaagtatgaatttccttgagaagtaccattgctcttttatcaaataagaaccaagtctggcttagtatgaaactgcttctttagcttagcttttcggcgacaactgaaacaagacgagtcattagcacaaaattagttttgtattaagtatgaaaaactaaaaaaaaattatttgatcttttaagacaatttttataaagaaaagtacgtatttaaaaaatgtatcgtttattagttgaataaacatatatactcacgataaacaaggtatgtctcgatcggttggtaggaggggccatgtgtatacagtgtacaacgtaccccttccacgtacgattgattccattaattcaagtggtcttgtttttaatttctgctgattgatttgataccagtgtcctaactaataaataggctgtcccttattttctttttatttcttcttcaaatacataagtaattacaagggaaaattctcacgtacgtgaaacatgtagtagtagctcacagtcacaaggacaaacataccatgagattgattgatgattggtacgtgtatactattctcccagaaaacattcaaatatggccagctatttatcactggttcagcttgcatcatcggtcacactcaggcatatatagcattaattaacattaatatagcatggccgatgcatgcatggagcatagccacattcttttagtgtgcataaatggactttgaactgccagcttgacacaaatatgagaatgtaatggaactcttttaatctctctagcggatctccactcgtttgttcaaacactatccaaacagtcataaaaaatatctcaaaaaattgacagcatatattcatgtaacaaacatatattgcactctgcaaaatctcaagtctaaactcgtctcatacattcgatttttttatcatgttttaaaaaggcaaatcaagcgtatgaatggtagcggtattatattcacacctaaaattatcatatcctttttttcaaatgaatattaagtttgaagtcgattttttttaagtagtagttgtgtcactctatactgtcatttgtttctaaaaaattgcatcgaatttaagagaaaaggtcccatatgtaaggctcaagtgggccaagacactcacactgcaagagctagagaagcaacgtgtggcttggattatgtcccacctcacctagctgatgcaatttatatgttggtagtcacatgtagcatgtgccctacgatgctatataagggcatgtacaatggagatcataagcacctgtggcctcaggctgtcacataggataaggccaataaaaaccacgatgtctacaatggataccactgctaaatatattttgtgtttcagcccctatctatttatgtgttagtctctatgatatttgttattataaaattaactattttagaccttctaataacaaaaagaaaaatgtacagatacccctaatctctatacggacccactgtcagcctctccaatcctctttctcatttattttctctatcttatcctcttcctctccagcgttcctttggagtctcgtcgcctccgcttcctctcaaagccgtcgctccccctctcgtgtgccaccgcatcattgactcctccacatctcaacgcagcatccacctccggcctctcccccgcgtcttctctgcaagcggcgatgacggagccacatggcggcggggacagatttggctgcgagctcgtcggctctcgccctcccttctctacgagtggcggcggcctcttcccacgagggcagcggatctggcctccggcttcttccctctccccccctctcttctcgcggcggccgagggaccaccagcggcagggaggaggagttctcaacggtgagtactcggcggcggcggggaggagttcacgatagcggatccggacgcgggctcgacgctgccgtactcctccccccacaatggtgcggacgagctcgccgacggcgtggcgagcttggcggtggcgggctcgccggatctgggcgcaggctcgccatatctggcgacgggggccacaacgggggcggttcctctcctcctcccttcttcgcgagcgtcggtggcggggagcaacggtggagaaggatctggcgaccggacgaggcgatgcacggggcttcggctccaccaacgcgtgtcctcgggtcatggcttcgccgttcccgaacccaggcgcagcgcttcgagcggttcttctgcaagcgcggaaacggcccgcggagccacggtccccactgccaccggtgcgcgcgtccgacgtggagccgtgagaccacaagctggagccacgcgttgtacatgtcctaaagcagggttcaatctttcgtcgtcggcattattttaaattatttgaattttcaaaaaaaattgatcaaatttgaacaaaattcagaaaaatgaaaaaaataaaaaattaggccaaaataatgtcatattgagggggtccgatagagccaacatttctggaattttgaacccttataagatagtgatatgaccatcaagtatatgcatacatcccagcatgagaaatataaaacatggccaaagaattcatcaagtgaatggaggatctacaagatattaaaatccaatgagttttggaatccagttcggcctccggagacagcactgacttcaaatggacctagcgccttcatgccaactccgatttgtgtgatcttggacttcgtggaaagcttatctcgccacctttcaaacgcatctggtaccatgtccaaattcatctcgagtcaacgggaatcgccaaaacaagacagtgttgttgctaaaaccgaacttgggccttgagccttgtaatagactaggccccctccacctccacgaattttaacttaaccctagatttattttcctctataaatagctttgtacatcctcaaaaatatttgggttttgtttagttgaattttgccaagtgccattcaccttgtctctagtcctcgttcgattagtcgacgactttagattcagagcccctaatagttggtgtgttgatttgccgggtcgattagatctaccacttcaatcgcaactatttctttgtgcttaatcacctattcgcaatatttagattgcatcttatcttgttcttgcagtgttctctcgtttgtattgcagggatcatcaaccgcgcgtcacggttggtacgatatcgtttgtggtgtagcgattgcacggcgtcctggacttgttctgattggtagccacgtcgcaaacatcgtactcgattatagcgagagttatcccctcaccagaagatcggcccacgagagagagcgtcatcagatagtaacaagagatcttacatatggttgacctctcttttagccattagtggccaattaattaagatgaatattttacacatgtaaatgtgatgtgaggaccaacttggtcctgttggtctagtcagactgatcgctcttttttagttagaaagaaaaatggaattcctgatgacaaaatggttgacctctcttttagccattagtggccaattaattaagatgaatattttaaacatgtcaatgtgatgtgaggaccaacttggtcctgttggtctagtcagactgatcgctcttttttagttagaaagaaaaatggaattcctgatgacaaaatgtggcaatagcatgtcgaaatcctaggagcctattcttttttttgtttcttacaaaacagtgttgtacctatctatattaattcgtctgtgtgtgaacagcaatagcacgttggaaacctgagcttatacgtatttcgtcttcctacttggtacctaaaagtgttgtctctatcatctactacctccgtttcacaatgtaagtcattctagcattttccacatttatatggatgttaatgaatctaaatagatatatatgtctagattcattaacatcaatatgaatgtgggaaatgctagaatgacttacattgtgaaacggagggagtattcatctctacttaaagctaccgcacgccgttgaaaaacgattttcacatgccctttacctcagggggcgttaatgaaaaacgtcacgcgttggtttctctagggaacagaggtcaaggactgtctgcgacagctttccgctttggaagcatctccccctcccaactggtagtgctttctctcttgcttttaattttactctacttccttgtcgatccccacggacggcgccaatgttgaaacaaatcaaacgggaatccaacaagtgtttaaggtagtcctctttctatattcaacatctcccaatagtgagccgatatacatttatataccccatagaagtacaggaaattatgaaggcagccttctcagcctctactctcctgctagggaccaacaggtgggtcccacagtaattaggtaaagttctaggggacagaggatgggactgctcccattatgcccgtttcgacatctcccaatactgagccggtatacatttatataccccatagaggtataggaaattacaaaggcagccttctcagcctctactcttctgctagggaccaacaggtgggtcccatagtaattaggtaaagttccaggggacagaggatgggactgctcccattatacccgtgtccccagggatcctgcgactcccgggtgcgtggctcaagggcaaggcgggagactggggctcctcgaccctttgctctggcaccgccgcttgtgtcaggggtagttgggcaccttgaatgcgccatcaatgccgttggtgtcacgcgccctggatgccatcatgttgttggaggcctagggaatgggactgactttctccccctgaggcttactcctggagcccctcgagggctccgcaaaggggaccttcgctagtctcccccggtggctggcgggctccgaggggcttcccaggagcaagactgtaagactccttaatcagccacgagaatggggacgacgggggatcctcggtcccatgcctccgagggcgaagccacttccccaacagcaggaacataattataatggctaatattaaataagagtccacacagtcataactcctactccgatttagtgattactatagatgaacttattttggaataaacatgaggagctaaaaataaactagttacgggaagaagggagtaataaatgctaaaattatcttgtaaattttaggtataaaggtgcggttataaccaaatccatcgaccaacacggcccatgcggttgcaaacaagcccatgggctagcatggttagctgagatcgtttgctcacaatggaggttgtttgcggaatcatgcttactggagataaattctttagtcaaatgtaaggctagatataagggttttttttttcttttgcgaagaaatataagggtcatatagacttgaattcttattccaaccacagatcaagcgttgctccagtgctgttggacacatggagttcccttggtgataattaaggttcaatatatctatcacttctgatctagaccatgtcaggagtcaatacatgaaaagcttaacaacggtgacataatattttttttgtacccatcaactacgtacatgatgatgatcataacatctgaacatttcatcagaatatttgaacaattttgccatgagatctactccaattaactaaaatatatataaatagttgggggacagaacaagatcatatggacttagtatattgcacataatattgtgacaacaagctaaggaaaacatttcttagtttaaccatggaaactttctaatgaggctgaaagtaatgattatttggtgatcaacagccaccaacacattattgaaagctagtgaatatatattacaatttgaaactctatattggataatataatatttataatgtaaatacatgttttgatttaaatgttatacggctccatatagagcgatgctatcatatccttgattgtatgtgaaatagtgaatgaatcaacttgcttgtacatataatcacccgttcgcgcaaaatcaataaccgttcttgccacgatttttggttgcaggtctgttggtgtaaggtattctttcatcatatccttccatgagtcttctatcaactcctttatcccaacgcatgcttcatgcgctgttgcaccatgttggagcatataactctgaattgtagaagcatggtggtggtcccctgcttgttcacgctgaaagattccatagcatcatgtttcagttatttataattgaagtcgaagattactaaacataaataaatatataagtgtaaagatataatggtagaaaatgacctttgttgaagcaatatcatttgagagccgtacacatgttgtgaaagacttaagaagttctggataagtcaaaaggcaatcaagagtttcctttgctacaaggtcgcccatcccaacaaaagaagcacatgctagttcaaaggcaccaacagtctttcttgaaagttccaggtgttcctctattgtttttggaatgtaatgatcatcacgccattttatctcttgagagaattcttgaactaacctcttgaactatattagaggtgtaaaaagtgtagtgttaattcagccgttatacgggcataattttgaagaaatatcattttaccaaaaaatatgattgagtcattagaatgtcataaataaagtggttaccataatttcctcttaggataaaacaatcagtattgttcgttgagttagatatattctattaaaacatacaatcaaataaatatttatatgtagaatataactaacaatgaagttgttatatagtttataacaaaatttgtatcataatcatggataaataactatatcattatattccaatctatctaatactcgctccatccaaaaatataaggcgcctgattcacatggtcatcaacattgcacttttgaccattaatttgtttcataatatatcatcaacaactatgaaaatatatgaaggcatattcaaatacagatctaacataagaatatggtaactacatattgtcatttattttacaacccattagatatatcgatgtattaaaaataaaacaattctacatctttagccataaatagttttggggtagaatacttaccaactctttgagataacacactcgataacttttgtttggacatagtgcttcttcaaatgaatcaaatgtctttaaataatataagtagaaatccttcatgtattttggaagtagcactgttgcagtttcattgcacctgtatgttacaatatagtgccatttaattttattcacaattcaaattaaccaaaagtgcaatcatgtatggaaccgcaactcaaaatattatattagctatagtggtttttttaataaacgaaagaagactagtaaatttgtctagtatatacatatttattggcattaacaaattttgacatacatcagttcttatgttatttccatggcagataatatatccaagataaaagataatgttcgtagcttgattgtcttctctaccttcctaaactcctaaggtaaaataaaatggcaagcattatattcttgactaagattggtgtatggcacgatgtagcttcaaagtactactcatggtcagtcatatggtagtcactgaagcagtgtcccaaatataaccgttgtttgcactgtccgaaatatatatggcaaaattgtcatttcgtgtccaaacaatctatccaaaatttaatattttgatgtgtgcactatgatgattactctagaatttttttcatctaacattttttctccactgctctcagtctatggtatgtgatgttcgatttaattttttaggataaattactgtaaatgaaatgaatgaattattttcaattttgccctgttttatatctatgtttttactcttgtttgtttatcatcatagaataatcttgataattgcaatatacgtaaacatgatatttgcgtgtcattgcctttatcgaatcgattttagaaatattaaattacctcaaacattggattcggatatgattcaagtaaagcattaacttcatgttgcataaaacatgcatagcagcaaatgccaactattattattgcttttaagcaattattatagtaaatgcccaaatagatttactgtttctggtgcttatttttagagaaaactgttttccttgatctttggtaattatttaggagaaaattcaatccacctactcttttactcaattaatgagacacacatgagattaatattttaagatgttatggtgaatacattactagtatttaaactaaaaatgtgtgcatcgcaatatatagtattcatattcataaaggtccttcgctccattctactatgaattttttaatagttgactcctgatgttcatcctacagtgaaatagattctacatacaactggaaatgtttacacttagtaagaactagctatacaactggaaatgtttacacttagtaagaactagctacaatataaagctacaattcatattagcacatattgtaatgaaggcttacatatatatcgctttggcaagcatcatgctctcctcggttgtagcatatgtgtcaaatatatcatctagtatggtgataaatgctatcatctttgtaagtataattcgtgaaagagaataatggggctccgagcatgctcctatcatccaaaaatgcatttccactattctatcccgaatgaagcttaagtttgattcaacattaagctctttccaccatctgtattatacacaaatgctagaaattacttatttataataatttgagggaattggataatcattatacactttaaagtaattaactcaccctgtgatagattttagctcctcacaataaataagttgaaggagattgaaattcaactttgcaaattctaatatggattcgtttcgtgtagtagcactttcataaataggaatatagtttcgtatttctaatattctaaccctccggaacaggggtgtattaagagcaagagacacttcatcagctgccggagatttcaaatgttccaattcggatctaaggcggttagttgtaaaaacaattgcttcatcaagtactttttcaccatgagtcctcagaaatgccgcattatataagctcaaaagacttcttacatcatcagcaacaaaactcccctctttgtctttaaaatgttgaaacatatctgcaaaggtgatcatgttaacttcttaaaattatggatattaagtgcatgtccccaactatatatgtatatgagaatatgtaacagaacataattaggctacatgcatgagtatatatgaaatacattatactaaaatgtataaatgaaattttatgacaggtacttcaattaaatttctccaatctagactgtttgttgtttttctaatatgatttgtttaaaatatttcagttaaccgcagcactaatttctactagatgctaggggtgttattagtatatatttagtttatagatgcgaactatatatttttcaaactaatctataaggttcgtattgattccttcttcgagatctttgaatagggcagttggataattggaatagagtagaaaaaaaggaaagttcctatatgctatgggcttaattatataggacagttagaaatacatgtccttgcatctatcatcaaatactttgttagttgtttctttggaagaaactaattaattaattcttatcatcaataagaccttaattaccagatgacacatcatagccgttctttcgtagaagataaaatcgaagagaaactaggtgtaaatctttatcgttgtagtcggtgttgtaaacaatgcagagaaggtcgtttatctcagtctcgtagtaactatccaatccaagccgttgcagcgtgatcacaagatccaatatctctggtacttcactcgagccctttactaccttcctaacttcttctttcacaacttgaacccgttctttcatgtaagcatgctgtaaattaaggaagacacatgtttcaaccattcaaaagcataccatgtatacatataataaataatcagttacctatagaaggcacaaatacacaattaatctccaatatgcactcatgcatccactaatagttttcgatggtaattaataatatagttagtacaaaacatggtataaatgtaatactaatgtgaacatatatatttctcaagataaagtctacattattcgttatgtccaacaaaaaaaattccacgaaaactaagggaccgttagttatttagttatagtttatttataaagttgaactaccacatagtgtagaaatgtcacttactaatttcctatcaactgagaatcagatagtatatatatatatactactccttccatattttaatgtatgatgccgttgactttttaatcaacgtttgactattcatcttattcaaaaaatttatgtaattatcatttattttattgtggcttaatttattatcaaatattctttaagtataacataaatatttttatatttgcacaaaaaatttgaataagatgaatggtcaaacgttgtttgaaaagtcaaaggtgtcatacattaaaatacggagagagtatataataagaaagtaattgccttaggcgcagtaggtggctggtaactgaggaagaaattgccccagaggggtggaagcttgtaggagcccttcgctgtggctgctcatcgccttcattggagaaagctgcaggtggcgacgacatctcttagcaaattaaaattctctcttctattgttgccaatgtaacctaattatatttctctgcgactagctggtgagtggctacgtctgctgcctcgcgtggtatttatagacggttttgcacaggctgagcaagcatgcatcagcatgacttcatgttggcacacgtcaaaatgatgtaagcatatgcttgcatgatccacgtgtgtgtcatccttccatgattgcctagagtatgtcatgatgcaagcagataccagcgagagtacagacccctaaaactcggtgagatggtggccaacggataggccaggtgttcggttcataaccacactttatcacaccacacatttaaccgtcacaatttgttagccatgtgtttggttcactctgacaattataccttgccacattttcttttaatcacatgtcccacacatcatatactcaattttcttgctaacttttccacactttattgctagcaatttgtccaccacacttttgtggatgcctcgacttgacctaattaatctttgttaggggtaaagaatggctgacaaccaaacacacccttaatcttttatagtgtgttctcaactacacattttcaacttctagtccctcatttaattcttcgcacgcgtgtttcccaaactgctaaatggtgagggttttttttaaaaaaaaaaacctatacaaaagttgttttgaaaatatcatattaattattttttaaagttttttttagcgaatacttaattagctagttagctctgagccaccccttttttacgtgcacaggagaaaagttcctaaccctctcctccgaacacacatctaatagatgaattccctaaaaaaaacatctaatagatgaaatcatgcatgcgtatgtaaggaagttgggagggtttcttattttccaagtaaatgtctagaagtgcaaattttcttgggaagtaccattaattgttcttttgtcaaataagaacgaccgagcctggcttagtatatatgaaaaactgcttctttggcttagcttatcagcggcaaccgaagcaaaacgagccagttgcttatagctagttgagtcttaattaagtattgaaaactgaaaaaaataaatttatttgactttttaagataactttcatatagaaagtattttaaaataaaataatatcgtagtagataggaaaatatgcttgtcataaacaaggtagtagtcattgcaatttgcgaagcagtttagacagccttaactcgatcagttagtaactaacactaccacgtacgattgattccacgcattagtgggtcgtctgtttaatttctgcttaattgatttgatacaatatgtcctaactaaataggattatttcctcattttctttttatttcttcttcaaatacaagggcacattctcacgtgaaacacgtaaaagctcacagccacaaggggaaacatatgacactgagtggtatttcctccgccccataatatagcaaatttatttttgtctatattaattcataaatgtgtcatatccctcaaaatctcttatattataggtcagaagaaagaaataataggtaaataccactatcctcccagggagaacttgcaaattggccagctatttctcattggttcagcttgcatcattgatcacactcaagcatatatataaagctggccgaagcatgcaagaagcatagccaaattcttttaattagcgtgtactttgaaatgacagctcacactcaaagggaacgttaataccatctcgttttaatctttcagctgaaaagaacaccaccttagggcccctttgaatcgtaggaataaaaaaacagaggaataggaaaaacacaggattctgacaggaatacaattgtaaaacagaggattgcaaaacacaggaaaaacacaggaatggccgtttgattggaccacaggaaaaacgcaggaatcagatgagagagatagactcagaggaaatgttccaagaggttagacctcttgctaactttcctccaaaatgtgcataggattacccattccataggaattttaaaggattggataggattcaatcctttgtctcaaaggccttcatagcatttttttttccataggattgaaatcctccaaaattcctacatttttcctacaaatcaaaggggcccttaatctctccagcaaaactcctctcgtctgttcaaacactgttcaaacagttacgaaaaaaatcccaaaaaattgacaatattcatataccacacttcattaaaagtctaaactcaagacatcgatttttattaaaaaaaagagataaatcaaacgtctgaacggtagtggtactattcacgcctaaaattctctcttttttctgaatgtatatcaagtccgaaattgattttctttcaagtaatagatgtcactctgttgtcaattgtttctagaaatttgcattaaattgaagagaaaatgccccatgtaaggctcaagggtcgacaaattagataggtgtggtccagcacactcatactgtaagagctagagaagcaaataatgtgtggctcgcatcatatcccacctcacctaggggtaatgggcccgtgctctttgtacaacccatcttagctcttaaatatttttagcttaaaaatctattaaatcttatcctaatcttttttgacacaactcttatatatgtttataggctaaaatgttgggcaccttacaacccctaaatacattatgttggtggtacataattaaacagcatgtgtcctatgttgtatatacagccgtaataggatgtgttccatatatatgttcgacctgtctttgagcaaatagtggtcaagattatgcatattttacaaattaaattcaaatgtaatgtgaggcccaacttggtcctgtacgttggtctagtataggactgattgctctttttttttccaaaaggaaaaaagggaactcgtgatgaaataatatgtgtgggtctaagtacatagcacgtcgaaatctataatgttatatttttttgtttcataggttacttacaagtgctgtccctatatatttatacgtctgtgtttgaacagcaatgacatgttcgagacctaagctttatacgcatttttgtctcaagagatgcctaaaagtgttgtccctatcatctattcatctctacttataagttactccctccatcccaaaatgtttgatgccattgaattttttaaaaatatttgaccgttcgtcttatttaaaaaatttaagtaatttattgttaaatatacttttatgtatacatatagttttacatatttcataaaagtttttgaataagacgaacggtcaaacatgtttaaaaaagtcaacggcgttaaacatttagggaaggagggagtataacgataccaccgttctcatgcatatgggccacaatttcgaaggttccccgagttagacctagccaagtactgataagctgcccgctacagtaggtgggatattgatttaatcacctccctctaccataaaaccgggtataacatctcctccatatttaaaaaccggtgcaaatcaattcctttagttgtttggaaggtggtttcagctgacgtggcatattgaccgcaattgactagctaagtcagtgggcgggacccatgtatcatcctaatcttatcttcttcctaacctctcctaccctctctctcaccaggatgcaccgacgacgacacgtcccacggaggcagcaaaccggcggcacccactatcaacgccgcactccgatcccaacctttagttctccgggacaggcaacttctccagttaggactatggctttccggtcggggtcgccatgagaagtggcttgggaggatggaggagcataggagagtggagtagcaggtcatcgtaccactggcctcccgccactgcatagtctcccatgggagaagggagaagtggggttgacaagtgggccccaccaattttttattttttactttggggcaattgcgcatctgaccctgttttgagacctaacttccaatttgaccctcttttttcaactttgctcatttgaccctcctatttaaaattgaagatacaatctaaccatcttctattcagggcatgtaacggtgtcaattggaacaaaaaaaataccccttctgcccttgtttatttgactctattttatcaaaaatattacaaaattttggattcgaaccaccatcctcttcaccacggcggcgtcgtcatcgttgccgacccggcggtggcgcttgcacggatgaagat

SEQ ID NO: 77084 - DNA, 19097 bp, Oryza sativa
tatactctaaatgtttattatatttatactatgtattaaggtgcttaattaaatagagatatttttattgccgtacttcagattttatttgcctaattacctttttaaaattttattagatcatgccatactacttattattatatagttagttatagatgaacatagttcctttcttacaagaaaatataaaaagtgaagtgcacaactagttgtagtatactatattaaatgataaaaatagaatttttgatttattgttttagaaaaatattagctacatctcttcgttggtttgagaagttcaatttaaaagtttttatgttccaataaatatacattaccttattcgctccgttttcgcatttaataataatcgattccatagtcatatctggggtttctgaaaacgaaaacgatgaacatggtttccgttcgtttccgaagctaggtttctcgttcagcgaatttggctgcgcatgttgtagcgaaggagtgttactccaggaaatgcattacgaccattatgacctggttgttagtgcgtcggtgcgtccgattttacttaggtctttttttttattttttttattctttcagagaagggtattttttattctgcctctatattcaattagatatatgtagcatttttaaattaggaacttagcctatcaaataggggacttatagcacttaaataacccaatctgaaataattcgctcctatggagatttgaactcaggaccatagggaatttatagcacttaaataacccaatctgaaataattcgttcctatggagatttaaactcaggaccttggttgctactcaggtcactgcaaccagtagaatacgtgccctttcacatattactacgaggattttatccagcagaatcggattgtgtaatgtggctttaggcctgctctcaaaaaaataaaaaaaaactgggacttgctagttcgcgcatacgcgctgctacagtaactcgcgcgcactaccctatcacgccgcgctcccatcactaaacatgatgattagtgttaattacggtaattagagttaattacgccctacagtaattcgagaaagttgatcggtgcgcgcaacgacggagtggttagggattgttttgttgcggttttcttttttcttttcgggagttttttcgtgagacgcgtaactaatccgtttagttttagataatgatgataattaacgtaagatttgtagctttgtcttatttaaaagattttttaaagtaacagattgaaaataaatcgtgaaatcaaattttgaaaactttcaacccaaatttgaaaactttcaactcgaaatttcaatttgtttaaagtcaaaatttgaaaacttccaacttttcatctcaaatttgaaaaactttcaactcaaatttaaaactttcaatccagatgtgaaaactttcaaccgagatttgaaaactttcaacgcgaaatttaaatttgtttaaagtcaaaatttgaaaactttcaacttttcatctcaaatttaaaaaactttcaactcaaatttaaaactttcaacccaaatttgaaaactttcaactcgaaatttaaatttgtttaaagtcaaaatttgaaaactttcaacttttcatctcaaatttaaaaactttcaactcaaatttaaaactttcaatctagatttgaaaacttttaagtaaagatttgatatctttcatgtcaaaattaaaaactttcaattctacatttgtaaaaaggtgtgtgaaagattgaaaaaaaatatgaaagaaacggcgaaagaaaagaaaaacgcgcgcggcaaaatcagaaaaaaaaatgcaaacagaaaaaagggaaataacctttacgtagaaaaaaaaatataatggtcaccgtaattcagatcgtgatcatgattacgctaattaatttgatcctatctgctgcccatacgaacgtatacgtgtccccaccttccacactgtgaagctgcgttatcatgtggtgggctggtcccaaaccgcgcgccagcgaacatcatgtggtgggctgggcccaaaccgcgcgcgacttcgttcgctggcgcagacgcgcgcaataggaaattcgaaaaaactaacttttttaagtcaacattactgtaatgtacataagacgaaaagacccttgaataaaatacaggaaagtgtaataagtatgatcctcgaataaaatacacgatgtagtaagtacagaaaaatatactagctagactgatgtcacgagcaaataaactgtgtatattgacaagttggtgcatacacgaccagtttaattgtttcaaattctagtcgtaccgacgttgcaccaaaatcccaatgcatattgacgaacccgtaaaccctaaactatagataaataagaaatcatagctagatatatctactttgttccaaaacaacccaaaaagtacttgcgaaacgcctccttgtggctctgccgggtgccaccgctcttgcatggctcatcgtcattgtcgacgctgcatttgcagatcatcatcaggccatccaggtcatccggcccgagctccatcgacatcgtcgccgccgccgcggcctcctcgacgacggcgacgtcgcagtggatggcgaactcgtcgtcggtgctgaaccactgccccgctaggacgtcgtggcggatgaacgtgaagcagcggtactccgccttcccggtgccgtggaacgacgtcgcgtagctcctcacctcgttcgtcggaggcacgcacggctgcagattgaccatacggaaccggacgttggttcggatgccgccagcggcggcggcggtgccggagtcggcggtgtggagcttgaggcacacggtggagtagccgttgcccgaatatttgctcgcgttgaggtggaagaagaagctccaggtgtgaccggcgacctggaacttggacgactcgatgtcgtatttgctgccttggtgagatttcttgatcgcgttgcggaccttgatcttgagaaggttgcaaccggtggcggccaccgacgtagaggtggccgtcgacgcggtgacgacgtccttcgtcggcgacgatgacatggcaagctaactagcagctacctggtggtggtggtggtggtggtcgacggcgagatcaatcggggacgaagaactcgatgcagggttaacattggttaaatagattaggagaggtaattaaccacacgtttgacggacggacgcgcggctataatccgtatatagttttgttccgatcatgcatatagcatagaagaaaagccagggtaaatatgtctcgttctcaaaaagaaattataagtttgtccttattaacttcgaattcgataaagcagctgttactgggatacatacggatcagttaatattatgcaacacaagttaccacagctattaggttagttaattattaaaaaatataggtcagttaattttagtttggttcagatcggatacaaacagttacgtcaacagacaggaaagtatcaggttgttacggtagataggaatagttttcatctacatttaatttcaaaaattactttatcatttactcttatatatattctaactcaattcaattaaatctattatttacagtagtccctatttaattcaacatcgtaagagagtactaaacactgatatataaaaaaaacattttcacagacaaatcaaaatctagtattcacagcaatatctcttctacctaattcaacacggtacaatagtaatactcactattagaaaacatatgttgcaaacgggcaaaatagattttttcaggttgtcatccaccctgcctgtacataaaggcttgtgaaaatgcacggattttacaggcagccattggctccacctgcgaaattgattttcgcagccagcctttccatctttgcaagcggtacagtcgaaaccgctaaaaaaagatcagttgcatgcctcccctcccacacggcgcggccacgtggcacgcgcagagggggggggggacggtggaatggcgtgggagcgtcacgtgcggcgcattttcttggttctttttcggttttttcttttcgtttttttgtttttcccttgattttttttggtttttaacttatacgtatataaattttgtattcatacgtatacaaagtttgtatacgtacgaatacaaagtttgtatacatggtgttttctgtgtttttctttacttttcggtttattaaatatgtttgtatttacgtatataatgtttatatacgacatatacaatatgtcgtatataaatttagtatatgtcatatataaattttgcatatgcacatatgtttttatacatataaaatatatacttttttatagtagtagtatattagtagcagtagtgtagtagtaagtactactagtagtagcctagtaggtgaccgagtaggcggctgggccacgcattatcagtcccccggttcaatcacccgcctgcgaaaatatactccatgaacaaataaaagaaaaatcccccgccacccctcccacccccacctactgttgaccctccttttatgcccgcgccactgccgtcgccgtagcctgctgcccggcaccactctgccatcacctattgtggaaggagagggaagggaggggaaccagatcttggaggtaggagggtcgcaccggtcgccgccaccatcgctcctcttctctgaccggatctaggagcaggaagggagggaggggaggggagcgccgcctacgcgccaccactgtcactccctccaagacgcctccatcgccgcttgcggtggccgtcgctccccctcctccggccggatctaggagctgggagggatctaggagctgggaggaagggaggggagcatcgtctctgtcgcctccacgctgctaccactgctggcatcctctgctgccctggtttgaagtgggagggagggaggggagccgcctgctgagaagggtggtgggtgaggtgagggagagggaaggagagctgggaggggagagaacttgcggaaattactggggcttggtaggtggtgatgtttacgaggtataagcttttcgtaggtggaacatattaaggtcttgcctatgaaaattgattttcacaggcatggccttaagaggtctacctgtgaaaattaaggatatttttgtaggtggagctcttttgaccatgcgatttaaacaggcaggactagatttggtatctttaactatttttacaaatggtgattttatagtttgtctggaaaaataaatcgtaaccttgggaaaaaatgtttttctactggtgagtgatacagaaaacattcgcatagacagtcagtaactctgacgaacgttttgtaaaccgcctgcagctcaaggcaggtaaaagtcggttatttatacagatggattctgtaattggccacgaaaatgcaaaaattagctatttttatactaatggataatatatatttttacttcaatgtgcgacaaaaaatatttcacagcttgtattggaacacaattgtccaaagttgtccccgggcaaatctcgtctgataactcatcctccgtgattcgacaatgttggctcggtgttacctttctcaacgattgtcacgatcttgtaagtcttccactgctgcagaaaccatctttggtcgattggccaaattctacaatagtcccggttctattaaaaaccgggactaaaaacgatttttagtcccgggttataagagcaacgggactatttgatctttagtcccggttagtaacagtcccagttcacattgtgtcagggattgtcaggctccccggatctttattccagttggtgttactaatcgggactaaagatctcgtggatcttttcgcccggtttgtaacaccaaccgggactaaagttagcttcctttatatatgtctttttcctcctccagcccgagccaagcttcaaaattttttcttgaggagggaaggtgctgccaaaatttattgtgaatttattttgatgattatatacaaattggatatgtctaaaaggttagcaacttcatcctccaaagttttttttatcatattacatttagatatttgttttgtatatattactgcctgtaaaactttgatggaagttgatgagggagaaaatttgtgtagggagggaagaatatagaaattttgtttatttacaattttataaaaagtttttataaaagagttgagaaggaaaaaatattaaaaattatttaaagaatagaaaactaactaaattgaaaattaaaataagtacaacacattaaaataagaacaaacaacctcccgttaccttgcccccatcaggccggacatcacgttccccattaattgcgatcgaggaggaagcaagacggtgatggcagcggctccgatcgaggggaggattgtttcacgacgtttatctctccactctttttttttgacaattatacccttgtacttttttttactattatatccttgcacttttttttaagaattacgcagtacaacgcagatatttacaacgcacgcgcactcacccctataaacacacacacacaaatcctttccctatcagcatctttgaaaactgagccggcaaatccttgagatgcactcacccctataaacgcacgtatccaaatcctccaattatgacgactgttcacaggatgacaactgtttataccaaaccttgtatctgtcataatcatcgtcacactatactctgcatgggctctatgacgatagcacgatgacaatagtggatcgtcataaaatatagaactattatatttttagaaacaaaaaaaatattgttatactacattgctaccagaccacaaattgtttgttctaggtggactcttcttgtctacagcatttcttgtctcttattttaggatttaggattgaagtcatctctactctcattttatgaatgaaaaaaaatcaaaattatggcgtttcattttatgatggctaaaatggctataaattggtctaaattattctttgaaattttccatgaatcttcggagcacaataactaattttaataccataaagtttatttaacttattaaaataaatagaaaacaaattaaaattcctctctatgtctttgggccttttatggcccaagtattactctctccctcccacagtctgcagcctctctctcccttctcctccctttctgggccgccggcccagcccttttcctcctactttgccgacaagtccattttacctcactcctctcaattcaaataacttttcacgtagtaaatgatttcaaatgaaaaacttgtcaacaacaaagttgtataacttatcaagatctacaacttttgtttcagtcatttttctatatgactttgtttcaataatttgaatttgaattccaaattatgacaacttcaaacactattttcaaatagtaaatgatttcaaatgaaaaagtcattcacaacaaagttgtataagtcatcaatatctataacttttactttggtcatttttctatgtgactttgtttcaataatttgaatttgaatttcaaattataacaacttcaaacaacgttttcaaatattgaatgatttcaattgaaaatgtcatcaacaacaaagttgtataactcatcaatatctataacttttattttggtcatttttttatctgccaaagtgatagtaacatttttcacgaaatttagatatctctcttacagtttataaaaccatataagagatatgtaaattttgtgaataatgttactatcactctgtcggatgaagaaatgacaaaagtaaaagttatagatattgatgagttatacaactttgttgttgatgactttttcagttgaagtcgttcaataacaaaaagttctatttgaagttatcaaactttgaatttcaaatttcaaattgttcaaatagagtcagatggagaaatgaccaaaataaaaatttgcatctcaatgatctgtacaactttggttttggtgacttttccattcgaaatcatttattaaccccaatttttgttcgaagttgtcaaattttgaaaattcaaaatttgaattgttcaaatgaacttatatgtaaaaaggaccaatacaacagttgtagatctcgatgagttctacaattttgctgtttatgttttttgcatttgaaacataaaaatcagtctaaaattaaatttaaagttctcataagtttaaggtgaaatgtccattttgtccataaaatttcgtaactaccctcacaccagggacagtttggtaaattcgcataggattgcttcttatccatatactctgttctctaaaccctagccaaactccatccatccactcagccgccgccaccatctactcactctcctcctccatccactgcgccacctgcatctccttccctagccacctcttcgcccttccccgcctcactcccccacccagggaaggacggtggcgtgcaaatctgccacctcccatcctcaggagcgacggcggcgcatgaatccagcggcctccgtcctcgggagcggcctggcgtgagcgggagcgccggtagcacgcagatccgcccgcctccgccctccggagcagtggcggagggcttaggaaggcgggagcgagcggctacggtggcggcggctgcggcaacgacggcgatggtggctgcaacgacgacgacgacggcgacagctgcgacggtagctgcgatgacgacgatgatgatgaccagcggcggccggcgacttgcaatcgcgaggcgggcaggtggcgtggggccgcgggggcgcgccggcgcggggcaggggtgcatggcaacgggccagcgacacgtcggcgcctcggcacaggagctgtacgccgtcgcggcggccagcgagtcggcgaccagcactggaccagcaatggttgcgccggaatgccaaccaaaggtccagctccaagcgtcgttcactcatctgtccatgtgcacggctgacggctggtatattcagtgagtatttctaggatctctctctggtttggtttttctctttgcagagtgagattatttgaaaagttgaaacctagaatgagtaaactcagttcagttcaaggcatatttttgtgatttgtatgcagagaattgagatcctgtgtctttacttcatggttcaattagcaatgtgtaaaaatgaagcgctataattaggaatgattaattatattgttgtgaacaagttttttatttgattcaactatactatgacatgtgggcacacccatgacaaaaatctgacccttgttttctgctaaattcgaatgcgctgttaagtttaagtacactgggtttgtttgcttagcttgttcttctgatcgtatagtcactagaacaggtgctttactggtacaggtggacctaattacttttatgataattcatgagtgaattggaggcatcgcacaactcaaattgacttgaggatcataactcaaattgacttgagattcatagcttggacaagtgagcaatccatccaaggaaattaactaactgaaccaaagggtgaaatttgatggcaccgcttcttttgggctttctgttttgcaatgggcttcctgataagttctttcaagaaaaatgcatggttaactaattatagttatgaagatgtttatgcctgcccaaccgatcagagctgttgtttactgctttgatctctactatgtaccaaacttatcacatgcattcttcttgaaaacaaacaccttttttttgttaatgttaggtgtggtagtattaatctgaactcagtttaatccaagtatatagatcatgatatctctaaggaagaaattttttctagcttttttttgttaatattaggtgtggtagcattaatctgaactcagtttaattaatccaagtatatagatcatgatatctccaaggaagaaattttttctagcttggatcctttagtgcagtcagtagaagaagtaggaagggaagctactgctgcatctccacctcagtctgtagttcataaagctgaaaatgtcactggtaaaagggaagcatcacctcctgagaagaaaggtcatggctagcatctctctgactccttctgtaatccaatataatgtctgtcacagaaatatccctttaagaatgtaaataagatgtgagatttttactaaattgcctattaacttgctcaaagagtacatgttccttaaaatcatgttccttaaaaccctactcaactaacatatttgcctagcaaaaccggttactagtcagaagcttctgcaactctaatgcaatgttgtgatcctttcttctgatcctttcttcatctgtgttgcagaatgtgactacaggaatgagggcctcgggactgcaagatcaggtggcgctagtgagcatcggcgggtggagccctaaccagggcgtgccgcagccggccatcatcctcaacccttccttctcgcgccacagacggggcctttgccctgggcggccatattgggcggcggcaatgggattgagcaaccgcactttaagtacagaactggagccaatggaattgagcactactgaacaaggcaagtaacttggattcttgttcttttgtccttatatgtgctatgcttcattcatatcaagtgcaggatctttttattgacacctgtaaatgttttatgttaggcaccctcactggcagtagacaagtggagccaagggggaagaccatgggcactgcaattgacagtgagcccactgcaattgatctctttaaggagttgcattgcagcaaaactaaatgttttagtgaacctgtgaagaaagctatagtaagtactaaactattacttcttctttccttcttttattaagtaccttatgcaatgaacctttatttatataataatgcaaaactgaaaccttgctttgattgataggaggatatgcatgcccgggaagtcctcacttcaccatcagtagaagatgggcagccagctaagacttctattgaagctgtttccaaagtgctgcggaagtcgaacacatttttgcgcaacgtcggaatttagcagctcgctgccaagacaaccaatgtgatgaaagagatacaagttgaactagatgcaaagaagctagagtctgcagtacttcaggaggagcttgaaagattgaaggcacaggtacttgtgtagttggatggtggatggatcattttgtattcatgttttgtgcttttgtatggaacatgttggaaactctattctggaacttgcttttgtatgggctggaaaattaattatgactggaatgtgattataatataattatgcaactggctgtgatttatattctgtgattgctttttaattgggctggcccataatatgggctagaattgtactgttgagctataatgaaaaaaaaaacgtaaaagcaaatttgtagctgggtcaaaaaaaaatatttgggccaattgtaattgaaaataaaaaagcccatgctatatgggccgaatgtgaattgccacgtcatttgccatatcacccgccttgtcatctgcaacatcacatgtcatcgtacacgtggcgttattcagttcaatttgttatgacgaatttgtctcgtcattcatcaatgacaggagaactatcgtcactgcatcaatgacgatgtcctctggtggtcacagaagctggttagtgacccaccttctgtgatgataaccatttcgtcactgtgggcagtcagtgacaggaaacaagctgttatcgtcataatgtaatcgtcacagaagcccaaaattcctgtagtggccgttgcccgaataattgctcgcgttgaggtggaagaagaagctccaggtgtgacctgcggcctggaacttggacgactcgatgtcgtatttgctgccgtggtgagatttcttgatcgcgttgcgtactttgatcttgagaaggttgcaaccggtggcggccgccgacgtagtggtggccgtcgacgcggtgacgacgtccttcgtcggcgatgacgacatggcaagctagctagcagctacctggtggtggcgctggtggtcgacggcgagatcgatcggggacgaagaactcggtgcagggttaacgttggttaaatagattaggagaggtaattaaccacacgtttgacgtacgcgcggctatatgtctctatccgtatagtagtttgattcggatagcatagaagaaaagccgggtaaatataattatctctcgttctaaaaaaaacaattataagtgtgtcattatcaacttcgaattcgataaagcagctattactgggatatatacgtacggatcagttcatatgcaacacaagttactacagctattaggtcagttaattttagtttggtcccgatcggatgcaaaccgttacaaacagttacgtttagagacgggacaatatcaggttgttacggtagataggaatagttttaatctctatctctatctcgtccataatccatgtttgagtcggttataaaaattaaatatgtttccgcggttcgttatccgtgtttgagtcggttttaattttatattttggttttaatctatatatcctctctatctctatctcttatcataaaaattaaaaatgtttttgctggtattttagtacgtcatccgtgtataagtcggtttttaagtttgtttgcttttggaaatacaaattgaagatgtttccgtgatttgtcatccgtatttgagtcgattttaattttatattttggttttaatctatatctcttctctatcgctatctctatcttttctccactattataaaaattgaagatgtttttgtcggtattttggtacgtcatccgtgtatgagtcggtttttaagttcgtttgcttttggaaatacatatccgtatttgagtcggtttttaatattgtgcacttttgataataaagaaggaatcatataaaaaatatgtttaaaaaactcgcatgctaacttcagacgatcgaactctgaactgcaactcatgattttctaaaaaaaatatatatatccaagcgaagtcccacagtaaatttcatcttaactaaaccatataataataataagattaaaatagacttcacccgttacaacgcatgggcatttttactagtatatatttaatttctaaaattaatttatcatttacccttatatagtatatatatatatcctaacccaattcaattaaatctaatatttacagtaatccctatataattcaacatcgcataagagcactaacagtgataccgaaagcatttccacagacaaatcaataaaattgaatcttaatattcactttaatatcccttcttcctatataattcaacatgctacaagagtagtattactcattactagaaaatagattgttgcaaacaggcaaaaaagatttatccagatgatcatccaccctgcctgcacgtgaaggcctacaaaaatacatgatttttacaggcggacatcagctctgcctgcgaaaatcattttcgcagacggtctctccatctttgctggtggtacccaactgtgaaaatatactccatgaaaaaaaaaggcccctgccaccccaccaacccccacccaccgtcaactgcgctcccctccgctccctttctacccggcgctactctaccattacctgctgtggagggagagggaagggaagggaatcgaatctgggaggtacgagggccgctctgctgccgcttgctgtggcgaccgcggctaccctccccccttgggtcggatctgggagggagggagagggaggggagcaccgccaccatcgctccctccgcgctgcctccaccgctgcatgcggtggctgctgccgccgccaccctctcacggccgctccggccgaatctgggagggaaggagggtactatgggaggggagcatcgccatcgtcgctccccttctctaaccaaatctcgcctcaactactaacaccacttgaattaaaagatcagagggttgcaaataggacatagaagctagaacctagatcataaacaatcacaagctaccgcatgcatagattggccaaataaaattaattactcaaataaatatgttaaaaagggtgaggaggcaaacgataaaattaattactcaaataaatatgttaaaaagggtgaggaggcaaacgattttagcgcggattttatatccagtaatcctacttctctgtttgagtagccccaaaaggataggtctgttccatccattttcctcgctatagcaacgccttattgctctgtgggttcaatcttaattccttcccctacggaggtgaaatcgaagcactcacaaacttatggtgagagctgtctgtcttgaattatctaggaggttctattcgacctgggagttatagcattagccccctatatccaggacgacaccatctctatccatagtatcaatttttggtgactctacaaaagtgtcccaatgtaacattaactactttttcgaaaataatgatgcaaacctttacaccatggtactaatattttgaaggaaaataagtgttacctataaagaaatcgataggagcaattccattaataaatgaaagaaatgtaactaaagacatgaaggatggttgagattaaactcaaaagagatccaatgactaatgttttctaggtgatgtctcaaactctcagtagaaattaatctttatacatacttccattttacaccatggtgtatcaaactaagttttacatgacattgccgcatcaagatgcatcatcaaactagtagaaatttccataaattccacaaaacctgaatgaaggtacttcaagaaaaatggtctaaattcttcccaagattttccttccaatcgtgcaacatgaaactagttgttttcatatacccaatgtaaattgaaatctattaacttattaaaggaatagaaaaaggagcctccacgttcgctctcatggccaaaaaattcccacattaatcggagaaaaagaaaagcagagtccatatagaaatacaatttagaaatagttgaaattcagaattaaaaataaggaatattggaagaggagactagtatccatatagaaatacaatttataaataactgacattcggaattaaaaaataaagaatattagaagaagagtatagagtccatatagaaatacaattaagaaataatagaaattcagaattaaaaataaggaatattagaactagagtatagagtccatattaaaaatacaattaagaaataatagaaattcagaattaaaaataaggaatattagagatagagtatagagttcgtataaaaatacaattaagaaataatagaaattcagaattaaaaataaggaatattagaagtagagtatagagtccatataggaatttaaaactaactaaaatttagaaaaaagcataataaaattaaaagtagagtttagagtccgtataaaaatataatttacaaatatttaaaattaggaatttaaacaaaacatgggaagaagagtataaagtcaatattggaatacaatttagaagtaactgaaattcgaaattaaaaattaaagaatattgaaagatgagtttagagtccacatagaaatacaattagaaattgttagaggtataccacgaagtgccttccgccgggcctgccgaaaccgaaaacttgggcgacaggctcggaccagaggcaagcgacgaaggtcaaagaggaatgacccaagggcgaaagactacagctcaggagtacacgtgcttcgccggacaaggaccccgtcaggaggccacacaggcggagtcggtgagacgaaagcctcagcccgaaggcataggtttcgccaaggcaccaaaccccaccgtgaggaagcccagcgggccgttgcgcccccgcagggggattctccagattaatgggccaagccatctagcccaattggggcccatacatgtaaaggacgttgtgtacccctaataatgtccctatcataagggtaaccatataaattcccctgtaaagcctaaaccctaggggagagaacctgtaataggattataaatagcccctctaggccatgtaatgggtggatctgaaaaaatttctaccaagtaatacaattgtcctttttcccaaccactgttgagagaaccacgcctctcggggcgtggcgcagttgtctattcaacaacagaaataatgaaaatttcagaattaaaaataaataatattagaagaagagactagagtacatatagaaatacaatttacagataacgaaaatttggaattaaaaaatattgaaagacgagtctagagtccatataggaatataatttacaaataactaaaagctgatattaaaaataattaataactaacacatatataaaatacaatacgaatattacacatttgtagtttcgtaaagttagtacaaaatttaaaattatgttgtcattttaatatatttgaataatacattaagaaaacatatatgctattatatgagagaaaatataatgattttgtactaaactaagtgcaaggtcacatgacgtaaagtctaatttacttttttccatatcccacgaagctttgtagccaaatgacttgatcgatttgtattgtagccaaatgaaccaattcctattagtatcattcggtttataaatataaaaataaattcttctttcctacacgttatagagagaacataggaaatgtttcattgactcaaaactcgtagaaaattcctaaagattgaagtgttcatacatttttattcctccattttttttctattcctattgtttaaaatttcttcaaaccgaaaaatcccttagtcttagtttgaaccagctgtttggcctggatttttgatggtacgcgaaataacttgttaatgtttgactaacgagggtaaaatgtatattgctaaagttttacaccgttgtgtgtgttgactcacactaacttgctaattaattagcattaattatacacaaccttcattcttccgaaacagctttattgcgcccatggttccaccatgttgcatgtgctagagtatatatgctagttgtaggaatattattacgataggattgatttgattagagtccttccttatctccatctctagtaccttccttatctctctacccatgtaatctctatatatactggcctacgaggttcaatacaaagtatccacgttacacattattcctctctttctatagtattcaacatggtatcagagcgggcgagttagcgctgcagctcaccgcttctgctacccttgcccccgagaccagcaatatcgctcccgggtgtggccacccgttccctttttcttttctttcgtcgttgtgcttgccacgagagagatcgatctcggtctcctccgacatgccacttcttgacgtcattatgagattatcgatctcgatcttcttggacgacatgtcttcgtcgttgcattgtcatcgtcgttcttcatcgagtcttcgtcaagcagcaagcagcacaccatcttccacctttggcaccactaacgaaccacgacctcagattggatataagggacgtgttgctagctgcccccttcatctcccgcctcgtcgtcacgggactgcgccgccactgtcaacgtcaccctcagccgaccaccaccaccttgactcctctgccggccatgctgacccctgcctctcctcagacaccatcgcaccgccggtcaccctttccccggagacctcatcaccgccggttgcctgactgccaccaccgcccaactgcttccgcttcaatgacgacgacgtcacctctacggccggggaccgccgtcgcccgagcgatccgtctacgcagctgctggggggacgaccgcgtcgagggccaaggccggtgtcgttggattccctctgccgcgttgctcccgacgacgcccccaattccaccagtctaggccgccggcaaccgggtcccctaggatggcgcccccgactccaccacgccatttcgatgtgggcctgctccatggcctccatggctggtcgccaccttcctcgccgatctccagacccttcgttggccgcctgacggcctggcgctccccactggcaccactgtcacaccctgaagttctcctcccaagcctaaattgaatttataattcacccaaagaaaatatcggtgtaaaagcaagagtaaaccctaataaatcaatgcaaataataatcggatttggcatatggaatttttcttgagttctacatgtcgaaatatgctaacaagacttttagtggaattttcagagctctagaaataattttaaccaattaaaaatgagcacaagcattatttattccctggaaattcctttttccttttctttttcctttttctccccctttttcccaaatgggccgccggcctatttcctccccctccctgcgctcttgctgggccgaccgaaggccacggcccagccgctcgcccgagctccccctctccccctcggacgctgacaggcggggcccgcctgtcaggcccatccccaacctccagtcgccgccaccgcgccttgcaaccgccgccgcgcccacgctcccgcctcctccgggccgcgtcggccacgtcggccacgcccgcgcgtgcgcccgaatctcccgcgcccactccctctctctctcgcccgcgccggcgctcgagacggccgggattcgattttcgaatcccgcctctctctcctctcccactcccccacgtcggccggcgattcccagcctctctcggccacgtccggacccctcttcccctatttaagcaccaccaccatcccctctctctttttcctcatctcgccgagtcctcccgtgctctctatcgccctagtgccgttgccctcctctccgccgccgccgccgcc

SEQ ID NO: 77085 - DNA, 12543 bp, Oryza sativa
cggcgggaggcggcgggattcgcagcggcggcggcgctagggcgcgggggaggcggcgggaggaaggggatgacgggtgggccccacctgtcagcgagggtggcgggcgggcctgcccgtcagcggcgcgcgcgcggggagaggccgagtgggccgcggggagaggagagagagggggagggagatgggccgaattcggcccattagagagaaggagggattttagggtttttgtttttataaaatcattttaactttgtttatttcttaataattattatttgtgctctgaaaattccactaaaatttatttacacattttaggcttttaggaaatatacaaaaatcctctaagccttatttgacttttaactttgcacattttaattgttggaggctttcacacggattttaattattctaggcataatttagaggatgtattttagagtcgttttgggatgtgacatccatcctaaaaaacttcacgaaatttctccctgcatccaccgctccgattccccatccctttccagccgtatctcgaaccaaatcaaaccatccagttcacattcatggcggaagaaagagagagcttcgagagtcagtgggcgccctccgatgtgacggaagacaatctgaaggagatggtggcgcacggcgttcttccggcgaaagagatcatcaggtggcgaccgccattcggcgaggcattcccgacccccgatacactcgaaatcgtggtatttgctcatttcttctatggcggattttctcttccaacctcaagattcttccggggaattctaaatttctacgggattagcttgcatcatctgaatccaaactccataatgcatatcgccaattttattcatgcctgcgaagcttttctgggcattaggcctcatttcgccttgttctgccgcatcttcttcctcaagccccagccaaacaagaacaaaccatgcgtcgttgggggtgctggtttccaactcaggggaaccctaagccaaaaatacttctctatgcccttcaaaacctcaaacaaaggctggcatgcaaattggttttatgttcaaaaccctgagcctgctctcccgagtactcctgtcttcctcctgtttatcaggatacttggaactcactgccaatgggggatgaagctgcgcaagcagtagaactgatggagcgcatgataaagctgaaggaacaaggtttgcaaggagaacagatcaccaggcactttatcaagtgtcggttagccccaatcaaagagagatcccgcacagcttttgagttcgacggtaagcatgatccaaatcgtgaaaatccagactctcttgactttaaggtcatgaaggaaaggatgtacaagatcttctcaaatgccatcgtcgtcggctattcgcacttgctgccagtcgtgccattcaatgccttcaatcctcctccaccggtacgtattcatacacttcaacctttctcaaaatatgatcttgttttcttgttgaatcagttaacaatgaaggatattacacccaggaatttgctttgatgaagtcggatcccccaatcgctcaacaccgatctccccgccaccaaactgggcaagggagcggtggaccaagaattcggtctgaaactcaaccaagtgctcctgatccagtcggccagccaaattctcgcaagaggaagctggttctaagtgacgacgaaggcgacactgctagaaagcttggagaccgagaggcaaccaagaaactgccgaagcaggctactccaaggaagaaaacatacagtcgtcctgtgcgaaagatcaggaagtctactaggtgcaactcatataacgatcttccttgcattgatgcgcacccattgcggtaataatactgataatcaaatttgcaggaaaccatctgatatagatccgtctgggaaagactctgacccgactaacatggacacaagttcttccaaagaaaccgggccaactgttgaggatcatccaagtgacaatcaaccggcaaccgataatgtagaatccggtgatcaacccccgactggaaaccagtcggccgaagccgaagccggagttaatcaggagcctccgactggaaaccagtcggacgcagggccaagccaagagattccagaagtcgaaacccaagcaaacaacccttgcggacaagacaccagcaatgaccggagatctgaatctcctttaaaggcatccgaatccacttatcctcgtccagaaatcattaagggtaaacactttgtctgaaaccatgttgacccaaataactctgatcaattgtctaacctttgtcagtggatacactagggccaatgatcagtgatgaagaagaaattccccgtatacaagcagccgaagattcgtgccctcccattctgttcaagtggtgggatgacaacttgcaacctcaaggaattgtaataaaccggcaaaaagaagacgaagaggtatgcctactgaaaaaggcactcaaccaagcgacccgcattgtaaatctaagttccttgacgcctggccttagccatcttgtttgccatctggctcgagcgctgattaaactgctctgtagaggattcatcttaggaacgaggtgaaaactggaaccctagagaaactagttcctcatcttggaaccctcgaagccaccaggagtcaactgcacgaggccagagaacttgccaagaagaatgaacacgatctgagggatcggattgctgagctccaggaatccaatttttaactgaatggctcatcaaaaggtacgcgcaaactctgcccaactgatttgtgctgttatctctgtaatcttgactaaccgaagttaatgtagtgcaagctgccaagatatctcaactagaggagcagatccaaactctggaaaatgacaaggcagagctagcaagacagaggaattcggctttaaaggaggttgaaggtaccaataatcaatacctcaaaagccattatcttctatatgctgattcattaatgtgaatctgttgatgcagaccgcaagatcaagtctcaagcacagtttgatgtcttagttgacaagatcaacaagcttgaaggagccagggataaagtcgctaatgccgctactccactcatccaggccatgtttttcaataacgccggttcgagtacacttgatgctgccgaaatcttcgacaagctgagagtcgctccagatacttacttcaagaacatcaaagaagctggaagtatgggagcaagtctggcgttggcgatgaccaaatcgctttatccaagagttgatatggatgccattgatggctttgcaaacgggacgagcgaagaagctgctcttgacctcattaatgatgcgcagaaagccgctgacaaaatcgctgctgacgtggttgagagattccaagatgtcgaccttcggccgactgggtctgataattcagatgatgaaaaaactgatactgattgatgtacccatgattttgatgattaatgataatggaggctcaatttgtacaatactgatgaatttatgctatgcttggtgttccatacttagcttctgatttcttaaaggcctttgtcaagccttattgagcctaaaacccgcaaaagctattaaaaaaccttcagtcctcattgactaagtcgaaagaccaaacagggcaatgataaatcaagtaagcaaattgaattgataaaaatcacactccattattatcatagtagccccccgactgaaaacttcaaggaaaagcttgaagttagcagtcaaagaggaaagatacaaacgaaatgcctaagcataaaatcgacgaagatgttcaatattccaagaattgttgatgagagtactgtcttcacgctttagtcgataagaacctggccgagtgactttagcaattatgaacggtccttcccataagggagataatttatgccgatcctgtgtggtttgaattttcctcagaaccaggtcaccgactaaaaaggctcgcgatcgaacattccgattatgataatggtgcaacccttgcaaatatcgagtcaactgaattaaagctgcttctcgggcttcttctagtcgattgatgtcgtctactcggccctcttcatagccctcctcgttgaagttccgaaatcgtagtgattcaaattccacttcactcggcaacattgcttctacaccataaaccaaaaaaaacggcgactggccggtagcccgactgggagtagtgcgtaaagaccaaagtacggacggcagctgatctacccacttgccagcatagggacgtagtcggtcaaaaacgcgtgctttgatcccttgaagtatcatgacgttagcgcgctcgacttgtccgttactcatggggtgtgccacagaggcgtaacaaattttaatgccaaagtcttcacaaaagtctctaaatgctcagccagtgaattgagtgccattatcagtgatgatccgattaggtaccccaaaccgatgcacaatgttgatgaaaaaatctctagctttatctgctatgatcgtgatgaccggtttagcctcaatccacttggagaatttgtcgatagccacaaagagatgcgtgtaaccgccgactgcccttttaaacgggccgaccatgtcaagcccccagaacgcaaacggctaggacaacgggatggtttgcaactcttgggctggcagatgaatttgtctggcaaaaaattgacaaccttcgcatgtccgcacaatcttgtcagcatcagacacagctgtcggccagaaaaaaccttgccggtaagctttgccgacaatagtccgtgcagcagcatgattaccacaaataccagaatgtatatccttcaacaattgtctcccttcctccaaagatacgcagcgctgcagtattcctgatggactttttttgtacaactcagtcttatgaataatgtaaagtctgctgcgcctggaaatccgctcggcttcatttttgtcttgagggagttcttgtttggtcaaaaattttatgagaggttctctctagtcggtttcaatcatgcttacgccttgagtatccatggcttcaagtgtttcttttctgggcacggttggttcataaagatgttcgacgaacacatctgaaggagctgcttcccgttttgaatcaaaattggccagcctatcggctgcctcattgctatgtcggaggacatgggtgagctcgagtccatcgaatttatcttccaacttgcgtatctcttgtcgataagcagtcatattatcatctagacaagaccactctttcatgacttgattaacaaccaactgagagtctccacggacgattagtcggcgaatgcctacagagattgcaatccttaatccatggagtagcgccatgtattccgccacgttatgggacacagaaaaatgtatccacaatacgtagctcaatctttctccagtcggggaaatcaagacgaccccagctccagtgcctgtaagcctctttaacccatcaaaatgcatagtccaatgtttcatcttttcctctggcatgtcttcttggcactcggtccactcggcaaggaaatcagctaacgcttgtgacttgatcgaagttcgtggcttgaacgatatgtccaaagacatcaactctaaggctcacttcgcaatccgtccatttgcttcgcgattatgaagtatatctccgagtggaaacgatgtgaccaccgtgaccgagtgactttgaaaatagtgagataatttcctgacggtaattaagacaccatataataacttttgaactagaggatatcttgtcttggagtcggctaaaacctcgctaacaaaataaattggacgttggactttttgaatatggccttcctcttcatgctcgacgaccaggaccgtactcaccacctgggaggttgacgacacatataacagtagcagctcttgtggatgtggcgaggccaaaactggtggagtggtgagaagtttcttgaagtcttcaaaggctttttgtgcttcgggtccccactggaaattgtcagtcttcttcagcagcttgaagaagggcatcccccgctcgccgagtcgtgagacgaaccggctgagcgccgccatgcaaccagtcagcttttggacgtctttttgggagcttggcggtttcatgttgaggatggtgttgattttctccgggttggcctgtatgcctctttgagataccataaatccgagcaacttccctgacggtactccgaagatgcacttttccgggtttagtttcatcttgaaagcacgaatgcttgtaaaagtttcttctaaatccgcaatcaggtcatccttctgcttggtcttgacgactacatcatcaacataagcttcaacattgcgaccgatctaagttgaaaaacatctttgaatcatgcgttgataggttgctcctgcgttctttaatccaaagggcatggtgatgtagcagtaggccccaaagggtgtaatgaacgaggtcttcaagcagttagattcttttagtcggatctgatgatatcccgagtaacagtccaagaagctgagtaactcgcagccggccgttgagtcaaccacctagtcaatgcgaggtaacccaaaagggtctttgggacaagatttgttgaggtcggtataatcgacacacatgcgccattgccccgtctttttccaaaccaggactgggttagccagccagtcgagatgaaggacttccttaatgaagcctgctgctaacagcttggttaattcctccttgatcgcatccttcctgtcctgtgcaaaacggcggagtcattgcttgatgggtttggcgtcttgcttaacatgtaaagagtgctcaatcacctctctgggaataccaggcatatcggatggtttccacgcaaagatatctttattattttgaagaaaggtgatgagcgcgctttcctatttacaatctaactcagcgcctattacagcagtcttatcaggatcggagggatctaagggaatctttttttgtcttggaatcaccttcttcggtcttcgtcagcttggttgcaggcacttctccctcgcttgccgtggtcgcagccagtcggatctcttcgcgggcgagagtagtctcgtgggtttgggccatctcgcaactttctttgtcacatgtgacggcctgcttgatgtcgctccgtagtgatatgactcctcgaggaccaggcatcttcatcatcatgtaggtgtagtgtgggacggccatgaatttagctaaagccggtcgtccgagtatagcatgatatgctgtctcgaaatcagcaacttcgaagcaaacattttctgtgcgaaaattctcccgagtgccgaaggtaactggaagagtgatctggccgagtggtgtagctgacaatcctgggataacaccatggaagggtgcattactcggcttcaattttgtgcgaggaatctgcatatcatccagggtcttagcgaaaaggatgttaagtgcactgccaccatcgatgagagtccgtcggagcttgacattgcgaaccactgggtctagtaccagagggtaccgccccgggtggaccactcggtcgggatgatccgagtggtcgaacttaattgctatctctaaccaccgaaggtattggggcgtgttaggctgaaccgcattgatctcccgttctgttagcttctgctttctcttagattcataagccaggggtccgccgaagatgtgattgaattctttgtagtgatcttgaaaaccagtcggggcatcgtcttcatcatctttcttctttgatgtgccttgatctccgtctgacgtcttacgcgcgttcttgacatattgctccgcaaactgtttgtagacgaagcaatctttggccacgtggttggagttgggatgatgcggacattgggagttcattattttgtcgaaggtgttgacgcgggaacgttgtcaggaagacggagaggtggtcgccacaagttcttcgggcttacgcttgcgatccttgtggttgttacttccactccctcctgcggtcggcgtatccttctttggcttccaagtggtgcccgactgcttggacgccgtgatagcatcttcggctttggcatactcattggctttttcaaacatctgcttgaccgtcttgggaggtttgcgtccgaacttgccgactaggtcctcgtggcgaatgcctttagtaaaggcggcaatgatgacgtcgtcggtgatgtcggagatcttgttgcgttgcttcagagaagcgtcgaatgtaatctcgaagagactctccagacttctgaatgatgttgtagagatcgaagtgtgtgccaggccgttcaaaagtgccttggaagttggcgatgaagtggtcgcgtagctctgcccatgatccgatcgtgccgcggggtagcccgtggagccatgaccaggcagaatccgctagggccacaggtagataatttgccatggctttactgtctcctcctgctacgcggattgcgagaccatagacggtgagccaagactcagggttggtggtgctgtcatatttttcgattccagtcggcttaaagccggctggccaatccactcgacgcagatcgcttgtgaaggcagccactccgtccacgttgtcgtcgtagcgatctggtgaatgatggcctcttgctgcgcggcgctggttgatggtgtcgcgaagatcgatggggcgccttcgatgtggggggtgtggtcgttcaactcggcgctccctgtatcgttcgggaggcgaatgaacagaccgttcatcgtgtcccctgctcctgcgactagatccggcgccggcaatgctgaggcttggctggtgatagtcttgagatcgaagatgagggactcggctaccagtcggggtgcgggtgcttgcagagttggctggaaccgaggcagcgatcatggtcttcgtctggttcaagatgttgacaacatgatcggcttggttgagtgcgtcttccttgaggagggtgtcgaggagagtgattgctgcaaccgcgttctgctggagggtgcgaaagaccgctgtcccatcgacgtcttgttgcccaatgagctctctcgctcgccgcccagattccaaggcgcgttgtcgtcgatcttcagcctcctttgcaatccgttcgcgatcttgttgctcacgctgtagtcgttctcgctcctgtcgctgtcgctcttcctccagtcggcgacgttcagcttcttgtcatgcgcgatcttggtccgcttctcgggattggcgctgttcctccgtttcgttgtcagccatgaatacgccgaagaagaggggcgtgtagttatcctcatagctgtcgtcgaagttgtcgaggtcaccgtggtcgtagtggtagccaaagtcgtcgtagtcgaggatctcggttgatcgagaactgacgcctggggagctaaggtagccatccaactcttccgtcgagactgtcccaagaggttggagtataacgccaacctccctggatctagatcggatcggggccaaagccggagctcgcctagatcttcgagtgggagatgtcttgactgtgaagacagcggccaaatcatcaggaagtttcatcaagattgagggataggacccatcgtcttgatctggtcgcggaaaagtagattagatctcgtccgagtggtttgaagccgactcgggagagatgatcttggagtaggcctcggccgagttcggaataccgaacggcacagggacctggtctcttcccgactggtttgaatccgagtcaaggagagagatcttgccgaagtcgttggtgatgaagttgaggctgccgaaccggaacgtctgcccgggagggaaggcgaagtcgtcgatgccagaaacggaacccatcgcacttagtcggcaaaaacttgacgctacccctacctggcgcgccaactgtcgaaacaagatttcgacaataataaaagggggtggctatcaagctaggaaagtggatgggtttggagacgaagaattttatacagattcaggccttcttattcaagaagtaataccctactcctgtccgaggataattccgccgagtgtgttattgattgtataaactagaaaaagaatcgcgccccgagaggcacatggaccctccttatataggggaaggagtccgctttacaaagtaccgtccatatcctaacggaatatgggattatagataaaatacaatcgtaaccgactaggatcccgggtattttcttgacatacaagtttagaacctaacccgagtcctcatatagatattctatctatatttggtaccatatatccgactaaattataactgtcacgtagatatggggtatccataatctacacactcagggtattcctcctcccatttcacttgtagttccacttgcactagcaaatgaataaatcagcaataataaaataaacaaaatctttaagaattagttaaaaacaaggataaatgcgagtagcaatgaatgactcacactgatgtgggtgcaacaattgggccattgatcccctctcctgtttcaatttgacttgctgagagagttccctggcaatgcttggttgtatggtatagctcatgacaataactgtatttttttccttttactagtgccatctttataaaaaaaaacccttatcctagccacttttgatcttcccggtttctttctcaatctaggcttcttgattttatagcctagatcaacgtgtgtccacccatacttagattccattgaaaaattgaaccttcaagcatatgccttttttaacatctcaacaaagaagcacttatccacaaaatcatccatctgtatctctcgcaatgaaagccaaagcataattgcagtggctttctcattggaggctgtggatgccctatttctcactgaaagatgacagctcggttttatgagtgcaatttgcaaaataaccatcaaaatcaattatttgtgcatcaatgcatacaacccccttacgtaggttcagttgaaaccaatatagcatttgttcatctgatttaatcttaccagagtcactattcaaagaacgccacaaagtcatgtactgcttataacatcatatgaagtgctcaactatgaaattaattaattctagcaaaccatagttatgcatgtcaacatattggtttggcaacgttttattagggacataggtctttggccctccatttggaaagctaaaaaatgataggacgctaacaactaatttcgactcactgtgaattggcctacaaatcacagaaaaaaaaacacatttagctaattgttgcctagaaacaatttctcctaatttattgtacgaaccaaactgagagacaactacactcacaataatacaataatagcacaaaggtgttacttgctagcctcttccaagaaaatctcccccatttacattattgcacaaaatacaaatcctccctgcagctcctcgcttgctgccggccgccgcctttgcgctgctgcctagcctgcaccacagcctcttgcacgctcgtcgccgccacctggccgacgcacgctcgcccatgccttccaatgcaaactcaccgacatcgccgcctagccggatgggatttctttcgggagaggaagcccatgtgcgagcttgagggctatccctacttggatatttcacagtggtaaaaggtcaatcaataattcaaaatatttgtatttcattttttttctttatttctttactgcaataagttcggtctgactcgcttccatctaaaccatgagtaaacgcctcgttcagataaaaaaggtgggggtaaaaactaaaaccctaaaatgtataggtaaaatcagtattggacatcaaaacaggaggagtataaatgaaattatccaataaaataaatacatattgtttttcttttattatctaaaaataaattttgttataaacaatgtgtcgcacaacaaactcataactataatagtcttatgcgataaacttttacattttcaaaaatataattcataaatttctataatcatccatgtgtgagggtaaaatgatcatttatatataaattagacgatcaattgacaggaggggtatggaagggattgaaagcaaattttaagggtatgcaagtataactatataaaaaagtaaggtgaggtatagaagggattagatataattttagaggcatagaagggattttctctagaaaataacaggagctaatttataaaattgcaagagtggtggtgaggtgattgtgtgtaagtgacagattcactgccatcatcgctaatttttctaaagagtaaattacaccgccggtacatcaacttggcatgtaggtgtaatatggtgcaagaacttgagaaatgagcaatctaatgcaacaacttggtaggtaggtgcaatttagtataagaactttataagtgatcacataa

SEQ ID NO: 77086 - DNA, 51761 bp, Oryza sativa
taattggatgtaaattgtatgtgcagtataatttttaaagattaaatttaatattataaggtaatatctataggattactatgatggtgtattgatatcgtgaaaaaaatcacctagcatatgcttagctaaattgatgcatcaaaatactaaattgttaagttcttatactacaagatatcacttatcaagttatcgcacccacttgctaagttggtgtaccatgtgtgtaatttactcttttctaaaggagtatagatgttaacgtcatttgttctgacgtgacggaacgggacaggatacgtgtgacgcccgagaataattggagaagaaaaagaaaaaaaaatgaagagagcaagcaacggcagtggttgctggttggttttgggccttggcccatgcatttgcttgcggcagtggcagtggcacactggccctagctagcagtgcatgcagcggcagcccatgggatttgaccaaagcaacgagaagcaagcagcatgcagtagctagcagggcagcaaatagcgagcataagcggtgcaagaggcagcaaccagtgcatctccttaaacagagtggtcctcccactcttcaagttaaaaactggcaactatagactaaaaacgagctctaacagtcttgctaaacggatggccaaaccatctggctagccaaactggctcgctcaatggccaaatttggcccgtccaaattggcttgccaattgtgggccccacatgagatgctttctccctcctctttctctcccctcccacactctcttccggtgactgattgaggtgatcaccgtcacctcacgcgcgcggggatctgccgccgccgtcgcctcccgcctcgtgcacgcatactcaaggatggaattatggattgatgggccgatgcagtacaagataaagaggaggaagaaggcaacgaaggctgacatgtgggtccctttgttagagactgttggagtgaacacctagtttgactatccaaatcagttgaaaagttggctatataagtatttggagagtctaatttggagatgctgtaagagtttagtctcacatcggctagctaggttgttgagcactactttgtaaggttaagaacccgttggctaatgatcccgaatttgaacttttgcgtgaagtgagtgtaaaaatttaatactccctccatttcaaaatgtatgatactgtttattttttcataacgtttgaccgtttattttgttaaaaaaatttgtattaatataatttattttgttgtgtggcttgttttatcattaattaaaatataatcttaacttatacttttatatatctatactaaagtttttaataagatgaattgtcaaacgttgtaccaaaaattaaagacgtcatatgttttgaaaaggaggtagtatgttgcgtaagggtgtgttcggtgttatgggttcctgatgagcacccggcggcgaatgccctaatttatccctctctttcacggtaccaataataatcaaataattaaaattctgaattttcctagacaacagcaaatttaatgcacacgatagcaaatcaagcagagcgaccaaattaatccagcttaataatagcaaaatataaaaaggactggtcttggcttacagtagcaaaaaccaaaccctggacagtagtactccacccgtgtaccgtgtacctgagagacgatcagagtaagtggactcctagatgaaatccagatcacgtccccaggagatggatctcctgatcacgtcactctccaaacatcagccggtggcagcgattcttcagtacatagcagatgggagcgccataagctatttccaagagaacaaatatatctcgacgaaacaaaaacaaaacctaatcttctacttacatggccaacggcctatttatattcacgcaggcatagtaaacataatgggcccttctctaaaccagactcggcgacatactggtccagatccaaaataccaaagaaaaaaataaaactaataagttgctaacccaaactagtcaaagaacacacgtccaggaatatatattaaatattccggcaccattgctaattacctttgctaatcaagataattaaatatacacctgctttatgctgacatgaaaccttgctttgatacattgctcttcatggtctccagatcaatactccctccgttttctgttatttcttcctgcacagtaacatgcattgtaccaactagaaatactcggggcttggacatatcagttccgaacacccttccctcgttttccgcgcgcacgcttttcaaactactaaatggtgtgttttttttacaaaaagtttatatatgaaagttacttaaaaaattaaattaattcattttttaaaaaaatagctaatacttaattaatcacacgctaatgtattgctccgttttccatacagggagatgggttcccaaccccaaacttacgaacataccctaagtatggttcaacaaattgcactaccatccactgtaggacacccaagtattgaaggatcgtctggcactagggggtgaaaacagtcagaaatgatattactttttttattttagtgtcaacttcaacgtgaaacttacagaaattagaaaaactaaatttctgaaacagtaaccatcggtaaagatattattattataatagcttgcggaaacgacattggtctgaaatttctgtatggttttcacccctatcacattggccgctccacatttaagaattggaaacccaaacgaaattcacggctcatctttgtacccagcaccagctatgtcagccacttgtcttcatcgtatgacgacgttgtcaaagcaaagccatcgtgtctaacatccccctattccattgagcgagattggcatataggcactatgtgacatgggccaagccatttaccaccaggcccctctacagtctagtcatggctcaacggttaaccctccgtcgttgcaaaacccttctccatccccttccacaacaacccctcttttttcttttgtggatctgcatgtactaggcctgattgataccatataggtaccaagctagtagctaggtatcaggattgatgcccgcacatatcgccctggtagcgatggatatcaggggtactaggtctgataccgaccgatatcaaatctagtactggtccaacatcgagtactgtttggagagattagggcgggatcccgtcctcctgtcctatagggtgggtatcaagcttgtgttctataggatggtaccaagtctgttaccgatcggtattaaacctagtaccaatctggtatcgagtcctttcactgatgctggcataagctccgtcctatagtagttctctttggtaaggtgctcctgttttaattgtagagataagtctagaatatatttgtcatacattatattttttatcatattgttacaagaaacagaaacataagatctgtcacagcaggactacacatcttgaaatgcacaagagatatgagccgatgagcgcgccaaaagccgatcaacttcagcacgtgcaaaatcaaatgaacaaatattggccaacatcatcaatcttattatagataagcaaacaccgtatacgttgaagcactggatcctaaagtcggtgcagccgatttgattattaacaacctaaaataaacaaaataactacattagtacttgtaatttccatttctttgtatctaggagtatgtgtccttcaagttatttgctttgtagagatattcatcctcaaggatcaacacatatatcacatatcgtccaacacattctaccaattctggctcgtttatacgtacttcctccgttttatattataagtcgtttggcttttttcctagttaactttgttaggtttgaccaaatttatagaaaaaattagcaacatataaaatatcaaattagttttattaaatctaatattgagtatattttgataacatgtcttttttgttaaaaatactattatattttgctataaatttggttaaacttaaagaagtttgactagacaaaaaggtcgattgacttataatatgaaatagatagagtacgtagatctattatattgaccaggcagagcatgtgagagagcctatgagaccgtgattctaaaacaacgctcccaaaggagggaagctaacaaatttcaatctcctcttcagatctaattaatagcatcctgatcaaggtttcttgctgaagttccgtgtgtttgagaactaaaattataaatcgatggtatagaagtgtactgaaagttccaatgttataaagctaagcatatataaaatgttataaactttttggtttgtatagaaccaattttccgagcaaattaacaaatgcaacaaatcattattctagctcctccaatgcccgcatcaaagccactactacataaatcctaaattatgccgattgggaaaccccttaggtgccagttttcccaaccggcacccggaaggcgacactaattagccatggtcaaaggtgccggttccataaccggcatctttgatgcgcacaggagccaaaaaaaaccaggtcgatgcatcagctcgggatcgagcagctccctatcccacatacaacaaatcatgattcatcatcacagaaatttatcaacatcaattcatcaatatcaatattaacatctcaccatcatagaaattcaacatcagcattaattcatcaacatcaccatcgattcatcaaccacagcatccccacacaaagcacagcatcccacaaaaatcacagaaattgaatccccacacaaatcacagaaattgaagactcacttgtcaaattgccactgatgccgcctgcagaaggccggatccagcagcccccaatgtctaggcagccggatccggcgcggtacggcgaggaggatggaggggcacggccaccgccgctgctgaggtgcgccgcctcccctccagccggatctatcggtgaggagggcgtggccccctccgcagggccgtcatcgccacccggccgccgctattgccactccgccgggcgagagagggcgagagagatcaagaggataaggccgctctatcggcttggtataggtgcccttttttaaaaaaccgacaccggtttgttttaaaaaaaacgacatctatagtatagctgccggtttttctttaaaaccggtacctttatcaattacaggtgctgggtttttgcgatctcaacccgcggaagtaggaaaatgcctataggtaccggctttagtacttccggcacttatagcgccgacacctatttaatattctatagtagtgagcaaatctcatcactatcactattgttagaacatcacatatatagtgcaggcaaatctaattaatctgctcagtgctcactaattaatatcacagataaaaacaccagtattagtggtgttattaattattacagtaacaatggttattagttagatggataaaatgtgattaaccagcttgtcaatgatgaggcaagaagagccagccttggtgatgcactccgccgctctgctcttcagctcgccggctctccgccgcattccggcggcgtcgtcctcttccatgagcctcctgatggcggcttccaccttgcccctctccatctcgccgccgccgccgtcgagcgcgaggccggctcgccacacgcgctccgcgtacctcgcgttgcccggctggtcgccgaagcatggccggagcagcatcggcacgccggcgcagacgctctccagcgtcgagttccagccgcagtgcgtccagaacgcggcggtcgccgggtgcgccaggacctcctcctgcggcgcccagctgaccaccgcgccgcggccgcgcgtcgcggcgtcgaagccgtcggggagggcggcggcggcggcggcgccgcggacgaggcccgggcggagcacccagaggaacgggtgtccgctgttggcgatgccccacgccgcctcgacgagctcgccggcgctcacgctggcgatgctgccgaagctgacgtagagcacagacgccggcgcctgggagtctagccactcgaggcagccgcggtcctggcgcagcaggctgctcggcggcgccgtcggcgagagcttgtggagcgggccgacgtcgaacaccgggacgtcgaggtctcgccgcagcgcggcgagctcgtcgtgctcgagcgcgtcgaaggtgttgaggattagccccgacgacgtcctcaccgcctcgacggcccgggataccagctcgtagatctggtcctgcgcgtggccaccgaagccggcggtcagcatcacgtcccggacgcggtacggcgccggcggcagcaccgtcaccggcgcgtccagctccgactctgcgcgcagatcacaaagctcatgtccgtgtagatcgagccatggaggagcattatggcgcgaacacgtatacgtacctcgagcggggaggtagcccatgtcgcggagcatacgatgcgcggcgaagacgcggaaggaggcggcgctgccggtgcgcagcgccagcgtcggcacgacgagccgccgcgcgacgtccatcagcgtcaggaggtgcgcgtcggcgacgaggcacgcgacgtcgccgccgccggcaggagcagcctcctcgagcagcgccgcgagtcgctccctgaacggcgcctcgcaccggcggttcacgtcgaggatgcccgccagggtggcctccaggtagtcgccgccggcgccgtcgccgtcgccgtcggcggggacggggacgaagtcgaacgccgggtggagggacgcgtcgggcgcgttgacgccggccggttggaggtggaagacggtgaccgcgaagccccgcgcgtggaggacgctggcgaggtggaacatggggttgatgtggccctggagcggcagcgggaggagcaggacgcggcgacgacggtggccggcgccggcggcgacagcggcgtgcactgcttccgtgcccatggatcggaatgaccaatagcagatggctagctagctcttttttcacaagaatccgttgctacttgtaattcatatttggcttcgattctctctaaaatgaagtagaagacgatggattttcaaatttaattttcatgtgcgcatgccggcatatgtgctgtgcacggaccacctcggagtctcggagcacgcggggcggcgaactgacaatgcaagttgccattgtaaaagggaaaatactccttccaatcacaaataatcagcgtatatagtttgtgcagcgacaccgttacactctcacatgtcacttaaatcggcatcgatcaacatgcaacattatttcgtgtgtcctacgcattaattacatccatggcagtttatgccaatgatatcgcttgcatacatgcacgcaccgtaattgcagttaattgaacgatagatagaacaatgcatgcaaaatgatcatttaaaatttagcaccacacagaaaaatgaaaagtcacatggaagattatcaaatatgttgatcgtttctgaataacattgaaaaaaattatgtgatgatcatctgcgaatggatggagaatcatgtactacggggtgaagcaatgaaacggagtgggtaatacggctaatacggctataggctaatacgactgtatgagtttaaattgagtgggatgtatatacgatgaaaatagataaactatagttttaaaaacttgtacaataaccttgcgattaacattactagaaaaatcattttttcagccggccaaaaatcatttttctatgcgggggaacggtccgcctgtatacaaacgcctattttcgcaagcagcccagtcacccgcctatgaaaatcctctggccggatctgggaggggaggggaggggagcagcgccgtgtgccgccaccgccgccccgcgcgttgtcgtcgccgaccccgcgtgtcgccgtggccgtccctgcgcctcgccatccccgcacgcgcgtcgccgtcgccgtggccatccccgccgaacgcccacggccgctaagggggagggagaggagagctgggggctgtgagggagaagagaggagataagacttagaaaaaaaaattgtgcgatttggcgcctatttatatgctacatcaattttggcaggcggaccctgcagatataaagggttcttttacagacgcactgcttaggtggtccgcttgcgaaaatagattttcgcaggtggacaaccatctcaccccacggttgttattttcgtaagcggtcatttagttccgagaggtctacccgccttcaaaaataaaatgccatcgtcgggaaaattggtcctagtagcgtaattttccctcactggatcagagtaagtgcaccagaggctcacaacttgcattcaagagggccacttgtcaatttctttcccagttttactgtgggacagcggtaaccacgtgatacgtttccacgagtgcaaactgcaaactcaattttgccaattcatggaggttcaatatttttcttcgtcggttctctaaaactctcaccactggtcttaacaagttgaataataaattttacaaatattttggcccaaagtttcacgatgaattaggattaactaatgttttcatctgttacactagtttgtattgtactaggatttgaggatacctgcaggagaatatgttatatgtaacgtgagaactcgtaagggttacacagagatgcacataaaaaaggcaaaacccctagtatgggcttgtttggtaacttgagggaaggggattgggagtttacacgagggaattgattatgagattaagatggtaatttgatttttaatcccaatatcttgtttggtagaggtgatggaaattgatagggagtttagttggagattagatcattaataaaaacggatggctgagattttcttagacaaagtacaggaggaattccctcccaattacctgcccctacctaagtattgaaaaggagggagttccttcctcaattcctcatccccatcccacaaaattgccatgtctcccaaccaaacaaaacacttaatagtctcatccctctaaactcccaatcccttctaataactccctccaactaaatagtccgtataagtttttttcgttagttttagcgtgagtagtatctaatcaactagctccatttatcttttttttccgccctttgtacagataatttgcaccttttttaaaacatgttcacatcaacatattgtgtgatccgctaaaaaatgtttttgtgatttgggaaaaaaccatttgatgggattatctaaaggtacttatcttaaggaaaaaaattacgaatatacttattttttcaataatttatgtttataaacataaagggaaggatttacaaaaatatacccgttccgcggggtgaaaacgcgggaccacaacggtcccgcagctctgaaacgcgggaccgatggtcctgccgcacgacggtcccgcagctataaaacacaagaccgtgaccgttctgcacgaccaaaacgcggcaccacgatagtagccattttatcaatgtgatgacactgtcactacagtgattggtactattgagacactgtttggcactgttcatagggcggttccacgcaatagaaccgtgggaatgtctcgtgaatagtggtaaacagtgtcaaacagtgccgaatgcataataaaattgctactgccgcagtgcctcattttggtcgcgcgggaccgtgactgtcccgtgtcttgtagcggcgggaccgttgtggtgccacgcaaccatctcgcgagactaacggtcctgcgttttggtgctgcgggaccattgtgggacggatatattttttcaattcttttttatgcaagtatataaacgtaaattattaaaaaagtaagtatatttgcaattttttttcttaccatgacacactaaaaaacgaattcaaaaggcaaaacaaagcgtatgtgtaagccgcggacgtactccttggatgttctcctctttggactcggcctatttaaaaacaggaataagtccacattgactccctcaaatatatgtccaatctaatttatatccctcaattgtaataccagatttcttaaatcctcaactattgagagtggttttcgctgacgtggcttgttgacctaattcaattgctgagtcatcatttgagggcccacatgtcatcctcactctatatctcttcttcctcctccctctcactcccccttatctcttactctccccttccgttccccttatgcacagcatgcttctggttcactctccacctcctctccttttcgtccatgctgctaatttcctcagtccgtcatgcgcacgccacgctcgccagccatgacgagcacgagctcaattttgaggagactcgtcgaattccaccgctgcttcctcccttcccacgaacgagcaagtgcgctcgagctcgacggggttcgtcaaccactgcctccaccgaagggagctcaaggctcaccactgctgaaggggaagagagatgagagatgtgggggagagagagcaaaggaggaaggatggagaatgagcatgacacgttggtctcacaaaaaaaaattccacctttcttactgactcagcgttcttgaccgtgccacatcatccaaaaccacccttaaactgtcttaggagtcaatctataccggttttatcaatttagggagtcgttttatccggttttgtcattgagggatatgaatcagatccagtctatatttaagagagtcaaagtggacctattcctttaaaaaaggaaaaggagataggctaagctcgaatggaaattactgtatgcccaaaaatggaaatttggctgatcgcgtaagcgagtggcacgctaccgctcgcgcaatggtcttctcggtagacaacagccaatagcttggcagggattttgtgttagattcctctgcttggatatgcgaacttctgggccgaatttacctacatatttgggtcaaacattcaatcaattttgggccacatttacgagtaactttgggccaaaattacatgcacatatgggcaggatgacagctgcaaaacgtatggatgaattccatgcatcaaactattgactatgagaggcaacaagtccctctcaaaaagagagagagagagaggaaacaagtaatttactttaatttattttgtttagatagataatagatattttattaagaaaaaaaattaaatccgagcaaaagggtatgaatgaaaagtatcccagattagggaccaacaccggaggagtcgccggtgaaagcctccatggctgagttcctttgtgactaaaacatctagaacatgcggttttcttgaaagaacaagaaaacaaaaaggaaaacaacgatgagtgactcgactatgatagtctcgtttctcctcgccggcctccgttgaggcgcttgaggcagtgaagaagggcgaaactgtaggatcgaaatacaaaaaccaagcttattaaaggagggtgaatggtaggaacaccaaaaaccaaaacttttggaggaattaaaagttatatcaaatccaacgaagttcagtctgatcacaatgtgtctgaccgccttattgcccggtctgaccggtgttgtcatgccagtctgaccgctctgcttgtcactatagcctcctaaagtcattggtccaatcgccttgaggccgctggtctgactgaaccaaaacctctagcctgaccgcctgtgccttgccgttctaaccaccgagataggaaaaaacacaaatcaaagaacactctgaaagtagatcaacttgattgtttctaactgtatttacaaagcacaacagtagcatttaattctctctcaactttcgactaaactcgtaatccaggctaatcagtaacttttctctcaactttccttacacacaatcgatactgagagaacttgaccactcttctatttataccagagttggctgcccaaaagccatgaatatgtcataatccactaggaaatcttctatcgaactcatcaaactccaaacataccatatcctttcaaattcaattccgcatcccatacacatacaatctccttttgtatgttgtatgaaatcttcaccaccacgtgcattgttctttaattagcctaagtatcccacttgatctcctgttcgtccggacatcatattctcccaagttgactcccgattcagcaccgacaatgctctcccggggcatcaagatacacctacacattaataaacaacaaacgtatcatatccgagcacaagttcttctacctcttaactctaaatcagcacaaaccagtattacatacacatagtaatcatctagctagtagtcataaacatgaggtaatcacgagtaaataaataactagaaatcgaaaccgacacaaattcaaccggttagaccgttgggttggctagtctaaccgccaccacaactccgatcagaccggcgcactatgtctgctttgatcagctccatcaagccgaaacctgttcatcgtcagaaatactattcatcgtaaccacccggtttgaccagtgcacaccccccggtcagaccggccttagaacaaaaccactttatcaaatattagcaaataaaaaccaattatttcataagataattatttatcacaaaataataatcaaaacatattttgatttcacagaaattgggggagagaagagacttggtggactcactggaagggcagagagagaacgacagagaaagagaaggtccaaaatagtctctagcatgtggacttgataacaaactgaatgacccaagtcagtagtatcaggtgggtgtgggttccccagattaattttggggctatcgtcgagtaaagactgatcgatttcaaggcaactgcaggcaatagcgacactttacatcatattcagtgaggaaagacttcctgtacatccaatatctctaattgaacattttccattcgtgattaatggagaacatttagatgaaagtgacgaaaatgtgatgaagaaaactcggttaattcgcaggcatcagcatttggctccgttatatttctccctagctacatgcaacggacaaagctcacaactaaggatatgacagcgcccagtccggcttcaagaactcatgaatgactttcctgatcacttaatagagtttacctcaaggatatgcattaaaaaagtttgattgaaaactgtttataactaaaattatcacagatcgttctatttgtacaaccaaagtcatactttcgcttatgcaatattccacgtttgctagcaccaggaaatgctacctatgttccatcaggaaataaagtaccattctaattgaagagcaagaatgaagctcagtcatgagaagttccctgtgccattgtaaatttcacccaatatattaatagtaacttcagaagatgtttatgttttctatggattttatgaaacagtttattgatataagataatgttcaaaatgacattatgagattcaccaacatatcaattgcagtatttgaagagcctcctttctcaatacaggtcgtcgctttgttcttcagatcctttgccctgtgcctcatctccttgccttcttcactgcacagtaaccttcttacagccctctcaatcattctcctctccagttttccctctagctcgaaccctatcttccatacctcttggacatacctagcattaatcatttggtccgcaaactgaggcctacagatcatcggaacaccatcacatatactttctagggttgagttccacccattgtgcgtccagaaaccaccaaccgctcggtgcttcagcacatcttgttgtggggcccaggaaaccaccatacccctgccacgtgtcgcctcctcaaagccatctggaaggcatgtttgctctgatccctggaccgagttaggcctgatcacccaaagaaacggaatttcgctatcgaccaatccccacgctgtctccaaaagctcttgagagtccatagatgccaagctcccaaagctcacataaagaacagactctgcctcctgcttgtctaaccattccaaacagctttgatcttgagttagcaagctgctctcttggcctatggagatcttgtgaagtggaccgatcgcgtaaaccggaacacttaggccattggcgatctttcggaggtcagaattctcaaggtcatcgaaggtattgagaatgacacctgaagaacaccgtgccgagtccaatagacgttctaagcaggtagccattgtaccatgtgtggtggttgctgagaacatcatatctcgcagacgaagtggtggaagctcatccaatggcatgtccagttgcagctgatctggaatttttatggaaatgaattgagatcagtcattggatgcaattatatgcgaatgcatggatgatggatcagctgagtgcatatatattttttgtagctatagaggacagaagtaactaaagatgcatgtatttagaaattttgtttcctttattttttgacaacaaaattaaataagcctctcaggatgcttccaaattgtaaaccatcatgaggtaactagttatatactttgcattttgccgtgggatatgtggataaatacatattatacattataaaaacgatatatgtatatgtttaaataatattaaaatgatgtggagataatgatttgatattaagttctaaaaatacaacaaaattgtaaaagatatgtcatgtttgtataatatttaaaatactcttaaataataattgctacttggtgatgatgtggcacgcttgtacgtgattttaaatactttagataatactaattgctagtgggtgataatgtggcatacttaaatgttgagattaagtagactgagtatcaactatatatatatagtatagattcgataagcctagctacttatgcctcgctagggtttgatttacacgttgattttcagaaggaaaaaggttaaccgtatgtctcagacttgaaaatagtggccaaatttcgggctcaactttactttaatttatgtacaacccgtatataattatatatactatccctatcaatgtcatatctattttccatggctcttcttacttggtcttagttttaaaggagggagttggcggtgatggtacatttataggtgatgaattggtctcctacatagcgtaaatataaatattataatttgtacataaataattatttgttgcatttgatatttatagatttagtacatttagatgggagccattgcaacgtgcggatatgattccagtcatttaaaattatgcaatttgacatattcaattttggaatttgaaaatattacgaattaacttcctatacatttgcttctgaggacagtgagaaaagacaaacaaaataaacaaccctagcttgcatatctcttatctatacttatagcccactaactctaaagcttaacatgcaaccataccacatcatcacccactaaccataattacatattcaacctcatgcaagcatgcaagagcatctacaatctatttaattctacaaattaacatgtgtcggtgatatgggaccgggagtatcgtgaccagaggcttgaggcagacacaatcgtccacgtggcctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtaagcctcacctaaccaccatttattgcggtctggtcgaacgtgtcacgctgcatgcagcgtagtgcagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacaggcaagatgctatatgaagaagggcaaaaatgcacgttgctaagctgacacgtggtggacaaggatgactgatctgtgaccggtctgacactggtcgcgtcatcaacagacagccataatcccacgtcgcacctgtttccggcggaagtgggggtagatatgggccgtcccgtcagaagggcacccggacagcaaccgtaccgatctccgtccatttatgaagagaagaatagtccagtttggagagggagaggggcatgtggtatccccttgagatataaaaggaggaccttgcccacttagatagagagaggatttttggacacaaggccttctccagatccgatcccagggcgattgggggctggttgacactttgttacttgttcatacacaaatccactagaacacaggagtagggtattacgcttcccagcggcccgaacctgtatacatcacccgtgtctcgcgtttcttcctagctggcgatctttccacataccgaacaaatccaccaaaacacaggagtagggtattacgcttcccagcggcccgaacctgtatacatcacccgtgtctcgcgtttcttcctagctggcgatcttttcacataccgagagagcttgagatttcaccctaagcccccggccgaaccggcaaaggggggcctgtgcggtctcccggtgaggagccacgagctccgtcatctggcgcgctaggtagggggctcagcgtgtgttttctgagctctcgtactcctccgtgtgcgccaagtttttcttgttcagcctaatggccgagcaagcaaaggtgcacgacctctctccgagtgtgagcggcgacgacggggagccaaacccacgccgtcgagctcgtactcccccacctcctccacaccaaaatcctaagcagggggaggcactcgagagggtcgaaaaatccgcagcatcgccagtcgcgggtgatgcaggagaacggcgagatggggagcgtcgcctcctcgtctacggcgacggcaacacgcctcagggcgcgcttcaggctgttggcgcgctcctacgtaacccgcccgtcgtccctgacccggagtctccagcccagcgatggctggacgacgtggccaacttggtcatgacggcacagcagcgcctgggtgctggtggatggtccgccaccaccaagacctccggcgccgccactaccggctccgtgtcgtcaaggcggagggcgcggcgagcggcggctgttgcacgccattcggctgccactccctcgtcggcacctccgactcgggaggatcagcatggagagccggatgcccgcctcgacatcgagcgccggcgtaatagccggcgtactccccgcgcaacggagggcgcctcttcgtccagagtgtcacctcgacatggacgtgaggaccagccctccgtgcccccggctggtggtgtcggctgtagagcctttgtggcgagtcttcggaatgtccgttggctcccaaggttccggcccaccatcaccgagaagtatgatgggagtgtcaaccccaccgagtttctccaggtctatacgaccgggattgaggccgctgggggtgacgacagggtcatggcgaatttctttcccatggccctgaagggacaggcgcggggttggctaatgaacctgccacctgcgtcggtccactcttgggaggatttatgccaacagttcactatgaactttcaaggcacttatccgcgcccaggtgaagaagcggacttgcacgcggtacagcgaggggatgatgagtcactcgctcgtacattcagcggttttgccaagtccgcaataccataccatgcatccctgcacacgcggtgatctacgcgttcagggggggtgtgcggcacaaccgcatgctcgaaaagatcgcttccaaagagccccagactaccgcggagctttttcagctcgcagaccgagtggctcgtaaggaggaagcatggacctggaacccctccggttccggagtggcagcttcggccgcccccggatccgccgctcagacagggcggcgtgacaggaggaggaagaagaggtcggtccattccggcgacgagggtcatgtcctcgccgtcgagggcgctccgcgggccacccgaaaggggaggcctgcgagcgacaaaaagaaagaggctggtactcccaccagggagcgcccagccggcaagtggtgctccgtccacaacacctccctccacgatctcgcggactgtcgcgcagtcaaaaacttggctgagcgaacgaggaagtgggaggaggacaggaggaaggaacgccgtgagggcaagtcgccggcaactccctccggtaaacggcgaagtgaggccaaacagaaggcccccgctgttgacatcgatgacggtgatgatgacctaggtttccaagaacctggggccaccattgccactgtcgatgggggagcgtgtgctcacgtctctcgccggagcctcaaggccatgaagcgagagcttctggccgcggcccctactcatgaggcgacgcgccgggcgcggtggtcggaggttgccctcactttcgaccagaccgaccacccaccgtgcgtcgcccggggagggcagattgcgatggtggtttcccccaccatctgcaacgtgaagttggggcgtgtcctcatagatgggggagcggccctcaacatcatttcccccgcggtttttgatgccatcaaggccccggggatggtgctccagccgtcccaaccgattatcggtgtgacgccggggcacacatggccgttgggtcacatcgacctaccggtcacctttggtggatcagccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctgaaagtcgcgctcgcttgcatggagcagcgcgcggaccacctcgctgctgcgtccaagcccgagggtggtgacgagaggcttggcacctccgcccccaccgccccgaggcagcggattgtcacatgcgccgaggtcccggtcaagggggttgccctgggcgacggcccatccaagaccacacggatcggtggtcttctggatggcaaataggaagacgtgctcgtctccttcctgcgggcaaacgctgacgtctttgcatgaagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttccaaaggcgaatggcaagcttcggatgtgcatcgactacaccgaccttaacaaggcatgtcctaaggacccttaccccctgcctcgcatagatcagattgttgactccaccgcggggtgcgaccttttgtgttttctagatgcatactctggttaccatcagattcgcatggctagggaggatgaggaaaaaactgcattcattacccccgtaggaacctattgttatacatcaatgcccttcgggttaaagaatgcaggtcctacttttcaacgtactactcgaatttctttgggtagccaaatagggcgtaatgttgaggcttatgtcgatgacttggttgtaaagacgcgcaaccaagagactttactctcagatctagcggaaacttttgaaaatctccgctccgcccgcataaaactgaaccccgataagtgcgtgtttggtgtacctgcgggcaagcttctcgggttcttggtctctgcccgaggcatcgaggccaaccccgagaagatacgagctatagagcggatgcgccccccccagcaaacttagggatgtgcaatgcgtcaccggttgcattgccgccctaagtcgtttcatatcgaggctgggagagaaggcgctacccttatttaagctcctcaagcgctcggggccgtttacttggacggaggaagctgaacgtgccctcactcagttgaaggcatatctcagctctcccccagttctagtcgccccggggccaaatgagcccctactactctacttagcggcgaccccccaagtagttagtgcagcgttggttgtggagcgcgatgaagacaatcctcatttcgcgcacccccgccctgtgctgacttggcccgggagcgagcagggaggagaagcccccgagtcgaacggtggcctaaggcccctgacgaccggagtcggccctctgcccgcttgtcagacggtgctgggtgcccccgaccctcaggaaggccccgaggccactgcgggaaggccgcacctatcgccctttggccccgaggctaaccctgtgctgactcgacccgggagaaagcagggagaagaggcccccgagccgaacggaggcctgaggcccctgacgaccggagtaggccctttgcccgcttgtccgacgacgccaggagcccccgacccccaggacggccccgaggccactgtgggaaggccgctcctgtcatcctccgaccccgaggtcatcggcacagaagacgagtgcgccccgagaggccacttggacgaagaacgccccggggatgcggcccctagcgaagaggatcggccccgccgaaaggtgcagcggcctgtctactttgttagtgaggccctccgggacgccaagacccgataccctcaggcccagaagatgctttacgctattctgatggcctcgaggaaactgcgccattatttccatgcgcatcgggtcactgtggttacgtcttaccccctcggtcaaatcttgcgtaatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatccccgaggccagcacggacccctctcagctgcctcacaccgtccactgggtgatgcagttcgacggttctctgtctctccagggcgccggtgcgggggtcacgttgacctctccgaacggagacgtcctcagatacttggtccgtctcgactttcgagtgactaataatatggcagagtacgagggactcattgccggactcagagtggcagctggactggggatccgccgcctcttggtgttaggcgactcccagctggtcgttaaccaggtctgtaaggagtaccggtgctctgacccacagatggacgcttacgtacgccaagtgcggcgtatggagcgccattttgacgggatagagcttcggcatgtacccagacgggataacatggttgccgacgaactctcacggctcgcgtcctcgcgagcccagaccccaccgggcgcctttgaagaaaggcttacccagccgtcggcgcgacccgaccccttaggggagacggatgcgcctgaccagcccccgagacccgtcggagtccaggcctcgggacccgaagggagcgctccaagctcccttagattgattgcttggatctctgagatccaagcatacctcacagataagactctacctgaggaccgtgaagggagtgaacgcgtccaacgcatttccaaacgctacgtgctggtagaagggaccctctatcggcgcgcggctaacagaatcctcctgaagtgcattcctcaggaacaaggcgttgagcttcttgccgatatccatgaaggcgagtgcggagcccattccgcctcgcgcaccttggttggcaaggcctttcgtcaagggttctattggccgacagctctcaatgatgcagttgatctggtccggcgatgcagagcgtgtcagtttcacgccaagcaaatccatcagccggcccaggccctgcagatcataccactttcgtggccatttgctgtctgggggctcgatattttgggaccgtttaagcgggccccgggcgggtttgagtatctgtatgtcgcgatcgacaagttcactaagtggcccgaggcttatccggtcgtcaagatcgataagcactctgcacttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcatggcgattcgtggatcgaggagttgccagcggtgctctgggcaaaccgaaccacaccaagccgagcaaccggggaaacgcctttcttcctcgtttacggcgcagaagcggttctcccatccgagctcaccctgaggtctcctcgggccaccatgtactgcgaagctgatcaagatcagcttcgcagagatgacctcgactacttggaagagcgaaggaggcgcgcggccctccgagccgcgcgctaccagcagagcctgcggcgctaccatcagcgccacgtccgggcccgatcactctgcgtcgatgacctcgtcttacgccgcgtccaaacgcgtgctggattgagcaagctctcaccaatgtgggagggtccgtatcgagtgatcggtgtcccccggccgggctccatacggctggccacgggcgacggcacggagctgcctaacccgtggaatatcgaacaccttcgtcgcttctacccctgaggggggggtcgagtgtcaggttttggctcgggccaaccccgcacccccctcgggtgtgcagggttggccgggggctaccacgcatgcacattcttatttctcttatttcagcatttcaataaaagcagtttcaatttcctaaaggttgtgtctgtgccgttttttccttttgaagaatcttgacttgaaataaggtcactcgtgctcaaccttgccctcgggggctcggttcggtcagctaaaatcgccaaacggggcccagaaccgagccgtgccccggggcgtggtgaacttcgggggggaatcggcaaaaacccacaatcgggtcacccataaccctcggtcaccacgttcccggcctggccagcctcgacatgtggatctccccaggcactagccccgacccgagccattagaggactgggacttgggcacgagcccttaaatcaagctaagacacaaaagaggaccacagcacagatcatcctcatctcatacgcatagcaaaataaaattgacacgaattttttcatcatttttgattgtagattaagttgatctatacaaaaaagaggcatgaaggccttagaagaaagaaaaagaaaaaactggagtctggcgggggcctgggggctcagtccgatgcgcccgggtcgccggcctcgtcgttacggtcgtctgcaccgctggcatcgccctcctcgtcggagttgggggcgaacgcgagccgaggggccgacccatcgaaactgtggacgatgtggtcggcggcatcccggacccgcgcgcgcgtcgtcctcggtcccgggagggaactcttccagcgccatccatggagagaagttggggtccctggcctggtaactcgctagtacgagttcaaccgctccttgggcgaggtccctcgaggatgacttgatggtcttctcgagctcctcggggagttgttggaaagcccaggccatctttgtgaggtgcggagcgaggccttccaggttggtggggtgcgtcattgtctggcctttccagaggcccgcttgccgaccggcgcgatccaggcgggagaccgcatcccaaagcatgccgggccctatttcgcccgccaagcggagggcctcggcttccccggcggatgagtctagcgcgcactgcatgtcggcgatggtgagttcggcagctgcgaggcgggcggctaagtcgctttcgcccgcagccgccccgctgacacgcgccctcgcgtccagctccttttcccgcgcctcgaggtcggcagcccgctgctccagtgcggctctctcggcgcggacggattccaaattgcggcgtgcctgctccgccagcgctgcctcacggaggggaaggctatccgccaaccgttgcgccgcggcctcggcctcttcgagagctcgctcccgctcagcgagtgcgtcctcgcggaggcggagcgcggactcctcttcggcgcaggcggcctcgtgcaccgccagcgttgcctcccggatagcggcggcggcctcgcggtccgccaagcccctctccacgacgccggcgtgttcctccaatgccatagcatgggcctcaagggcctcctcgcgccgccgggacgccgcttcgatctccgttgcccgccgctctcgggcagcggcggtgtcaaggaccccttgggcggcgtcgagctttttctttagctccgcctcccagctcccgtgttgaaggcggagggtgtcctgcgcctcgatcatcgcggtggtggcaatgagggcggcctcccgctcctcctccacctctcgggcgatctctgccagcgccgctttgcgggcttcaagctccgagacgtgacggcggtgagccttacggcccacctccaccatgacatccaccgagcgccgcccctcctcgacacgcgcccatgcggcctcgagctccgctcgttccactcgcagggcctccacttgggcgctgaacccatctagcaccgcggtgtttgcggcggccaaggcctgcagaaggggctcggcgctcagcggggcgacagaagacgaggagaagagccgccttggagagaatgcgacgcggctcggcccgccggaggacgcactgggctcggggatgtcccccggacccgtttggtcatgggcgtcgcctggggaagtgggcccaggcgatccgcccgcggcctcgtcgcgagccgccccggaggctgtcgcctgagcgtcgcccgagggagtgggcccaagcgacgcgccagcagctttgtcgtgagctgcctcggaagacgccatcgcctcagcctgacgagcccgggcggcctcctccttagcagcttcttcggcttggcgagcccgggcggcctcctcccgagcggtatcctctgcatggcgagcccgggcggcctcttcggcttcccgaaggcgatctgcggcctctcgccggtcagattctcgcctccgttcctctgcggccgccggatcttcggcctcggactggccggacttgggatggcgggaggaacgtgacgggacatcgctgaagcaaaagaaaaaaccagaagacaaacaagatgggtaagggaaaacttgcttttgggataaaagaaagacggtcgcaatgagagtgggacgaacctgcgagggggtcggttaaatgaccaccttggaggggaaatcaggtttccccgggatggttccgtctcccccatcttgcggagccgcttcttcttgcgctccccctcgggctgcgatgtcggcgcggccccctccgggtgccgactgctggcacgcaccgccccgccccctcggggaggagatgggggaggtgttcctcccagcttcctcttcccctgggcgtcggcagggcggctgctccccgagcccccgacgcggggcccagaagcacgaccccctcctggggtagattgttccccccggcggctctcgcccgcgctgtcgtggcccttaggagtttcctcctctgaggccccgacccccatcataatggtcagaatggaggcgcggtcgggatcgctgcagagggggaggattccttgaggaatgagagatgcctccacggagctgagattcagcaccctttggaccacgatcttgaagtcctcgggagcccaatcccatctgactccctggtgggtccgcatgtagtcttcggacccggtgtactcccaggcgccccgggcgcgccgttggagcggcgcaatccggcgacggaggtagtcgccgtacaccatggcccctgtgagcccctgggatcgcaggcccgccagtcggtcgaggacggcgtcatagtcatcccccagatctaccggcgcccgccagctggagacctgcgccgggggctgacttggaagtcggaggcgcgcttcgttggcgaggggggtgtagaaccagtcgctcttccagtcgtcccacttcttgcggagggcgcaggggatgtagtggttcaacaccggcccccgcggctggaagtagcagccaccaaccaccgacggcggcgacaccgactgcacggtgaagaaccaccggaacagccgaagagatgggcgcaccccaatgaacatctcgcacaggtgcgcgaagatggccaatgtcatcactgcattgggggtgaggtgcgccatctggagatcgtagaaatccagaacatccataaagaaagaagaaaatggcggaaccagccctgccattgcgaaggggaggaagaagacggaccgccccgggtagtctggtgccgggcgtccctcgcccagcatcactatctcccggccggtggcagattccggcataaagcggcgcggcagcccggcatgcctctcgctcacgatgcgagaaggcggaagtacgcttccgtcgagcagagcggaaccccgtgccatggcgccggaggaagggatgattgagaacgagcgcgtgtggcgaaggaaaggcgcagcagagaaagagttagggctcaagcagcgaaggcaaggggaataatggcgaaaggaagggagcaaatcctttcctcggtgtctttatacccttgccatcgctgtgcccggctcctcgtttctcgcgcccactatctcgctccctcgtttctcactatctcgctccctcgtttctcgtgcccacgtttccactaatcccattcgcccgcttgcggcgcatgaggtggatatgcggttgtggcagtcgagatagatcgtatcgtgcgcgcgttaattacgctcgctgaccgaagcgacgttaccatatctccaggcgaagcaaatcggttcacccagattcgtacgccgctcaagtgatgtggcagtcttgaagagaccgcccattatggacagccaagtcaccattaccgatgtgcatgatttgagaccgttgggtttctgcccaaccatggagaccggtcccacctgtcaccaggctttaggagtggcgtcacgcccgaccgcttcccttgagaagggcgatcgccctggcataacgccgggggctactgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtaagcctcacctaactacatttattgcggtctggtcgaacgtgtcacgctgcatgcagcgtagtgcagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacaggcaagatgctatatgaagaagggcaaaaatgcacgttgctaagctgacacgtggtggacaaggatgactgatctgtgacggtctgacactggtcgcgtcatcaacagacaccataatcccacgtcgcacctgtttccggcggaagtgggggtagatatgggccgtcccgtcagaagggcacccggacagcaaccgtaccgatctccgtccatttatgaagagaagcatagtccagtttggagagggagaggggcatgtggtatccccttgagatataaaaggaggaccttgcccacttagatagagagaggatttttggacacaaggccttctccagatccgatcccagggcgattgggggctggttgacactttgttacttgttcatacacaaatccaccagaacacaggagtagggtattacgcttcccagcggcccgaacctgtatacatcacccgtgtctcgcgtttcttcctagctggcgatctttccacataccgaacaaatccaccaaaacacaggagtagggtattacgcttcccagcggcccgaacctgtatacatcacccgtgtctcgcgtttcttcctagctggcgatcttttcacataccgagagagcttgagatttcaccctaagcccccggccgaaccggcaaaggggggcctgtgcggtctcccggtgaggagccacgagctccgtcaacatgcaagcatattcaatcattacctcacatcatttccacaatagttttacaaatttctttatcatttttataatatttaatatatacttatcaatatgttttacattaaagtgtaaatttgataaatattgataagcccttagatttgatttttttttctttttactcctagctaaattgtaaaaaaaataacattaaaattacttagtaattcccgcagcaaagtacagggaataccttagttctaatattgtgccttgccaatagaattgatataattcactcacgtgtgacaactactactatattagaaaaggaataattcgatttcatgaaaatagttctatcgcttaggattagatttgattaaacttctaaaacattattaaatatttgtgataggagggatatatatgtatatagtacttcgtaataagtttttttttgcgggggtatatagtaataagttgacgcaagggccctggtactttaattggtgatactaaacttgccaacaattggtgggccgttcgagcttaataattactaattagtgatgagctaattacggatctgggctcggataaaccagaattaattatcaaaatcgaaatctccgatggcccacttggccggccggggttgtatacctcgcgacagcggcgggaggacgcccttgccgcagagctccgggaaggccatgtacgccacgaggcagcacgcgccgccggtgcgcagcgccagcgtccgcacgccgcgccgctccgccacctcctgcaccccgcgcaggttcgagtccaccactaggcacgtcgccgccgcctcctcctcgtcgtcggcgaggagcgcctggcggagggcgtcgtcgaacggcgcccggaggagcgcgtcgaggcgcatcagcgcgccggcgaagtcgctgccgctgccgcccgtgggcatcagcgccgccgcctcccccgccactccggcccccacggtcacgaagcggtagtcctcctccgccgccgactgctcggcggcggcgggcgcgttgacgggggcgtggaagacggtgacggcgaggccggcgcgggagcggagcacgtcggccagctgcagcatcggcgtgacatgcccctgaaacggaatcgggaacatcaacaccctcctccgccgccgccccacgccatcgctcgccggagagatcgccgccatctttgatctgatcagataagctaagctctcgctccttcttggatcaatcttgatgattatcttcctgtgcggaacgatcagtatgatttgtgttaattaatttataagaaggtggtggttaggatggatgaggacggaattaagggggaatattggagttatattagcaagagtgtgtagatcgatcacattgaatggtaggatcaataggttgatgtcatgggggatttgggttgtggaggtggtttggtttgggaaatgcgtgatttgcttgggcacaagccaatatgtgtgcatatcgttagggggtgatccacggcaaacagacaggtggaggaggtgaatgacttttgtgactgctgctgcggcgaaagctggggctagctgccatttccatgtcgatctgttgtaatgattgttgtgtgtgatggcaggcacgacgacagcttcgcgtgcatgcactgcatgactcctgtaggtaggcctgcgcaggtacttacctatcttgtgcatgtatagggtgtgtgcctattttcttgtggtgctacgcaacgcacgtactccctccgtaaaaaaaaaaaaaaaagacaaaccttggtttttgtgcccaacgtttgacaaaccctgggtcttatttaaaaaaattatgaaaaaaattaaaaagacaagtcacgcataaaatattaatcatgttttatcatctaacaacaataaaaatacgaattacaaaaaaatttcatataagacggacaatcaaaattggacacaaaaacttaggtttgtcttttttttgggacggatggagtaagcacgtcactactagcttttgaatgcttgatcgtgttgtaccgtggcatatacgaaaacgtattttatgcccacgagttttttgcacactcttcatacacattaattagtaaacgtcataattgtttttttaaaaaaaacttagacatgtgctcctaatgatgagtattatacatatgtacaaagttttttattcaaaattaatattacagcttagaagaattaaaaaaatctaacagttttaagactaaaaatctattagacttttgtctgtgtgggttgggttggaacgcacgctacccgcttccatccacaaacttggttaagatatatttttttaactatagttcgtatgtttccaccacttagtataaattcagacactcatataaagctatatttgatcaaaagcagagtaaagcagttaagtttcactcctaatttgttttagttcatcttgactccgtgagtccacattggtagttagaagggcaatataactcttttttttaaaaatgagagggccccttgcctcttagactggggtgagaatggccctttttttaatgaaccctacagttttcaatggagtacttagggcatccacaatgtacttcaaaaacagtccatagtcaataaaataatacattcagctacctaaccacacagtggaagtagttcataggagagaaatagcaaaagtcatccataagcatatgggctgtccatatagaataaaatatgtcatttgtctctatttcctctctcctcctcctactacttactaactatatacattgtgaatgttgcaatagttaaagtccacaaatgtaagtcccatctatatggactactttaaccatatatattagtgttgcccttatttccaaaacataaactactccacttggtttgcttgcttgctttaatcctgtgcatacaccatatctaattaacttgagaataatatgggactcttatggacgaagaaccacgatgaaaaatggagagccacagtcaatccaaatgaaccacgacgacgtgttaattagtagaacttagaacggcacccgatgaaaacttggatcaataatatagtactccctctgtcccatattataaggaattttgagttttttttattgactactcgtcttattcaaatttcgtcttattcaaatttttttgcaaatataaaagacgaaaagttatatttaaaatactgtagataataaagtaagtcacaaataaagtaaataataattttaaaaatttttgaataaaacgagtggtcaaacgttgcaagtaaaaacttaaaatcccttatattattggacggagggagtatcttggatcgtacgtcttacacatgatgacaagacgttgatggcgtattgatcggtcgtctcgaatttaagatcgagttaactgcggatgcaaatttgtcacatcgtgtcgtgttcaactattcatattcgtcagtgtcacgaggattgcgctgcacagactgtaaaggaaacctgtggcatactcccctccgtcaaacaaaaaaaaaaaagacaaaccctggtttctgtgtccaatgttggaccgtcttatttgaaaaaattataaaagaattaaaaagacaagtcacgcataaaatattaatcatgtttttgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaaacatgtgtggtggagagaagaggggaaacgcgtgcgctcgctcgcctcgcctcgcctggcagggcgacaatcaatctagggtttgcctcctactctgtactgcgccgtcgctcgtagactactccatcccgctcgccggcgtgcaccagcgatcgggagagcaggtctccggaacctctgcctttgacgtcctgcaccggcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatatcatgatttatttatggaataaattaaatcattatatgcccataatatcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacagtctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgttctaatgtggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctattgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctacgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgagataccggacatgcatgttggtacaattatggagtctcgtgatgctaccttctttgagagctttttcccaatgaaggatacacatagtggttcgaaccaaccctctgaaataattcccagtttaattacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcatgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattacactcttgcagtcccattatgtagagaagatcttgaatcgctttggctacattgatagtaagccttctccaacaccttatgatcctagcttgttgcttcgcaagaacaagagaattctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgttaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgccttaatgagttcttttggctttaattagcaaagatgttgtcctgcagagcattcttgaaggaactcacctttgtgagcttgactgttggtcgcagtctatgaagattttgggtgaatctgctaggaagcttactaaagacctaggagtatgacttatacgctccactcgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctgttatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctcgcctggcctggcagggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcacgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatagaataaattaaatcattatatgcccataatatcaacagttttatcatctaacaacaatgaaaatacaaattataaaaaattttcatataaaacgaacagttaaagttggacacaaaaacccagagtttgcttttttttttgacggagggagtatagtactatttttatgatacgtcatattctacgagtttaagatgatgggagagtatttgctgagaaaactgtacgtcgttgcaagcgtttgtcatgcgtatcagtatcacagtatatatatatgtgtgcgtatcatgcgtgcaccgttgtgcttgcatgcttgctttccgagcagccttttttttcttttccagtgaatggatcgatggatttacgtgtatgttttctaaactcttaaacaacataattttttaaaataccttttatgtattaatttttaaaatactgttttgaacatatcctttttaatttataacagttgattagtacctcaaataattattacaaatgcattttgctattcagctattcatccattcatggaaaacacacacaatagccagttgggtacttacgcgctctagggcattcctaacccaagacactaaatatagtttccataaactctacatcattaagaaactagtattagacactactcttccaatacaaacactactattccatacttaaatttaatactatttatctcacataatgtcttggatgttgtgtagaaaccatgtctcatgcaagacatggtttccttctctttcctcatttatttacttgccacatcaattttttatcctagatggcagcttatttaatgctatagacaccatcctaatcattgggttgggaatgccctagtgatctgttgtcgtatacacgctgcttatgagttatgactgaatattttttagcgtgattctgctgattgtttatttcttattttattttttttatacaagtgcgaacacacattaattatggtaaactcgtggtgcatataccaactggcaagtagtacagtacagtattaaagaaaattctaaattagttggaagcattcatttggattgcataaaaatggcaatctgtaattgtttttggatccttgcaacaatgaaagatgtgtggatgctaacttcccgttgttgttcgtgtcttagctggcctcatgcatgtatcaattgattggtgcatgctttcttagggcccatctccaattgaggaaatgaactgggcctagttcattttgggtaattggatgcccattttggtggcaaggatttataaggactattttgcattctcaaactttttttaaccaatcaacaagctaccaatttcattaaatatagcatgaaaaaactgtacaaaaggaaagtgtaaaaaaatgtacaagctagtcccctaggcccaggtagcggctatggtagccaagcagtgagattcctaacccccgctagggcttatgtttcggcctcctcctttaccttgtgttaacgaccaaatttggtaatccaaggatcagaggtgagaagaaaccaagatggaattcaagatggaaatcgtcccggaaacagagtaaggatcggctaaaatccgaatcggctacgactaagatcggcagagttcgagtcggacgaggttagccggttgagccgaatccgacaatatgacacggcatatgttgtcggtttaggttgatgtgcttcatgatgattgccacgcatggatagagtcctgagaaggcaattgtatctattaattaggatattttatgtaatttccttagagctatgtttgggcaaaagtctgccgcaaagacttatgatatcttagagtttgttagagataagagtcatgtccgatatggacatattctgtaattctcgggtataaatagaccccgagccccatgtaataaaaataacacacgttcaatacaatctcggcgcatcgccaccctttttactttcgttttgtttcgatgagttcttgctttcgggttgagctgcatcgatttcgatcttcaacaagaggtaaaacttgttatggtggcttgctttctcgggattagtgcttccatctttatgatactctaatcttgtttatgtaattcgtcaagttatcatatattttacataatcttcgacgatatcgttatctaacctacaatcggctaacatctgctaatagaaagcagccaattaggttaaataccgatgttgacttagattatataagatatccaccactctatgacacttccaacggcttgattgtctagatattgtttttcttttcatacttatagctgcatcagctgagtttgatcttatgagtcgtgattagaatctcaatctctagcctgtctttggttgccgattagggtactatcggggtttcagccgatcttatctgatttaactacatttatcttgtatgctttattgacatgttaaatctgccctttatgttaagatcttgttgcatttaagtatattaggctttttgtttgatatattctacttgctttaatatcttagtatatagtagtatcggagtattagccgatacatgctaaatctatttgatcggctatgctatgaatatatagtcttgttgttaatatatatttcgattaagtgatttatattgtctcggcatggcgatcgatctatcccaatcacttaatttaagtatatgtcgacatgaagattatatattgttaatatctacagccgatcgagtagatttagttctttcttacttattaatgaccgctgatcgatgcatatatgacatcggctcaaagataaataatatgtcatcggcatctagccgatcggctatcgtttatggatttaaccgcggtttctttatctttgtttcttgttaattgtaggatcaaatcaactagcacgctagcatatccaaaagcaagttttggacctgcactggagttaagcagatctctgaggcctcgtgttacacatcaacaccttgttgactaagtggggcacgacaactctttgtgttgaaaggtcctttaattggtttctttcctaccatatctcccagaagattagcagtactaaagtgcggaccgcttgttttgacgctcctcttgtgttagcagttaccttccaccattcttgcactggtgtggttggttcctagggtttagctgatcgcacaaatcatcccttctgctagagtcctccaaattcttttttttttatctacatctaactaagaggtggagggttgtctcttgcatctgaccatatagggggcatatggagttgtttcattattctcaaatttcagcaaattctgaatatatccttaaacttcaaaaccaaacactattaatgcctcaacttttcaaacagattattttgcattcctagtttgaaccaaataaaggtggttatagccgattttgcatcctctctcttccattattcttcttccttttccctaccacaactaggataccacataagtgatatgtagcctaaaaccatcctaggttaggccgagagatgcaaagtaatatatttgaaaagttgaggaatgttacttttaaagtttagagatcaacttaagattataaaaaatttgggaatgtaaacaggacttttcactaagaatttctccgtagtacgtacaatcagtttacaatatcattatgacatcttagtacggtacttgagttggttatctctctatccatgattatgaaccatcttataaaatcttatgaattaaatgtcccatagcaaattttacctttagactaaagcttcactcaagaaggcaaatttgttgtcctttttaaccacacataaaacaaaaacacacattagcttatgattaattaagtactacctccgtcctagaagaagtttagagttggacatagttattaagaaaataggcagaattaaatagtgggaggttgtgattggttgagaggtggaggtaagtgggaaaaaaggatggtggaggattgtgattcgtaaaatctatttcgagaggcatctcgatttagacttaacgagtagtagcgttagcgttacagacatgcatgcaaagtagtttttgctattaggttgtgcatattttttttcttcttatgaaattttctcttaaattactcatccgatctataatccgattacccattgtgttcgtaacaattaaatctttacaacaagatctcacatgattatattttgatgaaaaatcacaaattacttttatgatatgtctaaattacttttagatttcactaagttacttcttaggcatacaaaagtaaattcagtaaagcctaaaagtaatttacatatattatagaagtaacttagaacaaaacgaatgtaacttagaacaaaacgaatgtaactttggcatgtcatttgaagtaaatccgttgtagagataaaaacatgactctatctagaaattaaattaatcagcacaaattatgaaattaactaaaaacaataataaaagtaatcacctcagagcattatgaatgtataggaagtattttaatcaaatctaaaaaagtaacttatatatatgataatttgttcaatgaaaaaagagtattaattaaagttactttctttttttataagttacttctataatatatgtaaattacttttaagctttactaaatttacttttgtatgtctaagaagtaactaagtgaaaactaaaagtaatttagacatatcataaaagtaatttgtgatttttttatcaaaatataatcatgtgagatcttgatgtaaagatttaattgttacgaacacaacggtgtaatcggatcgtagattaaatgagtagtttaagagaaaattgtatttgaagtataggtggatggtgtctcttatagatgaagtggtagctagtttctaccactagctgtgtagtcacgtccattgtgattggttgaggaaaaaatattggtggagaagttgttatattttggggaaaaaattgtgggatttagggaaaaattttaagtgctaaaagttgttatattttaggatggagggagtattaaatattaaaaagttggaaaatgaatctaatttattttttagaaatcttctatatagatttttttttttacaaaatacatcatttagcggttcaggaagtgtgctaaaaaaaaataggaagttgtcatttcgagttactgaaaagaactcagcttaaactcatcttaggtaactgtgcatgatatccctgtacgtactagtggcaaaatcctaatttaagtcttgatcccgaaacctagttggttgcacatattgtgtgaaatcaataccaactctcaaatatatgaaagaaataatgcattcacgaagctttttcagggaccatagatacatttcataagttgatcattttcgataatagttctgatgaagacattctccactattacccgcacgcaaagacgcaacaaggggccaagtggtccagttgtagtcgggcggcgaccttgtgagtctctaaataatcccaccttgcttagcttgggaggaggaagccaccttaaaagagagagccacccttccccaattggactagtcttttagggagattggatctttccccgagtgggtgtgcctaagaactgttgactattacccgctggcaaagacgcaacaaggggccaagtggtccattccccgagtgggtgtgcctaagaactgttggggtccggacaaccttaatttgttgggcctcggccaacccccccccccccccccgggccggatcttggggtccgggcaaccttaatttgttggtgtcggtgatatgggcctaggggttgatcgccccaaagccctcgcccggctgccacgtggcggctgtctgagggcttgagcgggctgaagcgccgtccgctaggcgcatttatgggtggcgccccaaccgcccccgtcgcacttaatacggcgtggcaggttgtgcgccgcccgctggtagacgtgcaccccaacccccccgggccgaatcttggggtccgggcaaccttaatttgttggtgtcgatgatatgggcctggggggttgatcgccccaaagccctcgcccggctgccacgtggcggctgtctgagggcttgagcgggctgaagcgccgtccgctaggcccatttatgggtggcgccccaaccgcccccgtcgcacttaatacagcgtggcaggttgtgcgccgcccgctggtagacgtgcacccggtgaccgctttttgaccggtctgtgacccgacgatggatggatgggacaggcggcagcgcactcacgtccgacttcgtgtcagacggcgtaggggccagtatggcatgtcccatcatgtgcagggaaaggacgtgcaggtcgccacctcccatgcgcgtgtgcccatgaagtcgccaagcatttaatagggaatgacggggatgtcccccgtgttaggcgaaagacttcagtggggggccacctaagggcggccgcatggatcgcttccagcccaaggcatgggcgctctttaatgtaggcaatgtgggcccctctcccgggcggagagggtagggacagtgcatgtggtatccccttcacctagaaaaggagtacctcgtcctgcgggtaaaaggggacgactcttgataaaccagattctgggtagaggctggccaagccctagtttgtgcgcccaggatctgaactctctgtaaccacgtgaagatcatcacacacacaggagtagggtattacgctcaatagcagcccgaacctgtataatctccctctcttgtctcctcatcatccacctcgcaagcttgattcccaccgatacacctcgctcgcacaagaatacgttcctaagcattgtacccagtcccctggctgaactcagaaaggggggcctcacagcctcccgctagagaggatcacccctcgacagttgggcctcggccaacctcacctgggccggatcgttatcattaatgatgaggacatcctccactattacccgctggcaaagacgcaacaaggggccaagtggtccagttgtagtcgggcggcgaccgtgtgaacctatgaataatcccaccttgcttagcttcccctattggactagtcatttagggagattgggcctttccccgagtgggtgtgcctaagaactgttggggtccgggcaatcttaatttgttgggcctcggccaaccccacctgggctggatgcatcatttggtatcagagctgggcccttgtttaaaggggtgagaatgatgaggacatcctccactattacccgctggcaaagacgcaacaaggggccaagtggtccagttgtagtcgggcggcgaccgtgtgagcctctaaataatcccacctttcttagcttgggaggaggggcaaccgtgtgagcctttgaataatcccaccttgcttagcttgggaggaggggcaaccatgtgagcctttgaataatcccaccttgcttagcttgagaggaggaagccaccttaaaagggaaagccatcattcccctattggactattttttagggagattaggcatttccccgagtgagtgtgcctaagaattgttggggtccgggtaaccttaatttgttgggcctcggccaaccccacctgggccggatgcatcaagttctatgtaagcaattttaatcaatttgattaaatgacctactaaccaaagatctcaatcgagcatgatagacccgttggtaaatatggtggagacacctaagcacaatggcaaagccaggatttagagattgggggacccattggtaaatatggtggagacacctgatctcaatcgagcatgatagacccgttggtaaatatggtggagacacctaagcacaatggcaaagccaggatttagagattgggggacccattggtaaatatggtggagacacctaagcacaatggcaaagccaggatttagagattgggggtgccatctatgagatgtgggaactcacttaatcgagcatgataatgatagacccgttggtaaaaaatggtggagacacctaagcacaatggcaaagctaggatttagagattgggggtgccatctacgagatttgagaactcacttacggttcgatgaacagtactttgtagcgttgatgcgtggttggcaacttggcatcatgcatgttacagcgattagctacaagagagaacgagaacccatagatcatgattcgccaatttaaaatccagtaatatttttaatatatggatgattgaacggtttgttccatgtttttaattggagtcttgcaatcacttctgaaatgatgaattagttagctaaggttgtgttcggcattgcctgtttccatcctcgtttttcgcgcgcacgcttcccaaactgctaaacagtgtattttttaaaatattttctataggaaagttgctttaaaaactcatagtaacccattttttaagtttattttagttaatacttaattaatcgtgcactaatccatcgctcggttttccgtgcaggaggtgagggttcccaaccctcacccaataacatagcctaagtcattttagaagtcctatatagctatgcagctgttctatatagtttgtctcatctacaactaatggtgtaattaatggctagattatacgggttaatcacccttagaagaagagaggggaggggaggtcgcataagggttggggaggggggtgctggtcctccccggcccccacggtggcttcgccactgcctaagcaaagcatggacattagcacataactctagaacaatagtaggagatgattcctcctacgaaatataaaagggacttgatagagaggaagagaataatgaaaagttatgtgtttcgtactacgtctaattctcatagtaaacgtctaattctcatagtaaacaatttctagatgattttttatgctcatgggagtgtaaataataaaatattactccctccgtctaaaaaaacccaacatatcacttcgatgggacataatctagcacaacgaatctggacagactgcctgtccagatacattatactagattatatcatatcaaagtaatagttgggttttttttagatggagggagtatttgtaactcgttccatcgctttcactaattttggttatgtaaatcgttttcgctctaaacattctgataaaaccaaacggtggaccccagaaatattaactactcaaaaccaccctaaactctcaaaatatttcttgatagaggaacatcaaaatagaagagataaaggacatctacaccgattgtagcacagcacagctaagagcaaggtcaatagtatagcccgctgttggctccaaaaaatagccatgtcatctatagtaagcagtatagctaatgtctacaatagaaatactataacacaaatattttattgtttcatgggacccaccatcttctcctacctcccattctctctctctttctcccatccgttgttccgttcatgtcttctgttctttgtttggttcttgagcaacagagatggcgggcggggggaaaacagcggcagcggacacaggagaccgggcggcggcgggcggaagagggcggcggccgtgcggcgggcgtcggagacggcggcggccgggccgagcggcggaggcggaagaggacggcgggcatcggagatggtggcggctgggccgcaggacgaaggtggccatgcgtcagcgccggcgagggcggtggtccggtggccgcgggagttggcgacggaggcaggcagcgcaagcatctaggcgggccccacgaactcctcgagcggcgcgtgcagcccagcgacaaattagtcgccggctcactctctctctcattccctctctcctccagatcatcacaaaatcttacgtggaaccagtatcgcccgttattgtacctgctctaagctgcagagtgatagagcccaacacaccacgccttgtcctgtcctccttcgatttgctcacacgtgctcagctcaccgaccgccctcgcttcgcttcgcagctcgattcgatccccacccaaaccaatccaagaaaccaccgcgaatcatggacaccggcagcggcggcggtggcggtggcggcggcggcggcgggggcacgagcatccacatcacggcgctggacggcatcgtgaacgtgaactcgctcttcaccctggcggccttcatcggcctggcgtggcgcccctccgccgacgggcccgagctcgccggcggcgccgaccgcctgggctccgcctgcgccgcgggggaccgcgtcgagtccgacctcgtcctgttccacgtcctcgccttcgcctgcttcctcttctccagcatcgtcgcgctctgcctcaagcagatcgtgcgcacccacccgcactaccgcctccggagcggcggcggcggcggatccgccgtcagccgcacggccatgatcaaccgggtggcgctccgcgtcgggatcctggcgtcggcggtgggctccgtgtgcgggtgcgggttcctgatgatggcgctcgtcaacgtcgtgcaggtcaagctcggccgcctcggctgcggcgccggcggcgccgccgcgtggggcgccgtcgtgccgctcgtctcgctcgtgcccaccgccatgctcatctacatcggcatcgtcttctacgccttcacccgctagcccaaccaccggatcaacaactgaagcgcagcaatgctagtattgattttttgcttgtgattttgagagatctagatgatgctgcattgctgccgacacggcgacattgtatatacaactatgcaagtgtatgcagcttgtgtgttcttggagttacctgctaattacctaattaatatgttcgatgttttttatttcttccttgcaagttgatagatttgttgtgatgtgtttggtcaagtaccaagaagattgaagtcatgcagtgatgaaacttgagtgccagctgctggttgaaatgataccagctcagattcttcgattcaggaaatatttggtttttgttacttactctgtcggcaaatgagcttattgtggtttgattcagctgcaggaaatctcactgctttcatcattcatggttctgtttcttgttactctctttaccacctactaaaatacttcaaatgattgaaagaaagaaaaaacaagttgagttacacagctactaaaacatcctggctcaaaacactaagaattgtggcatgactcgaataggatattcaacaggataccaagaaaactcaggcagacccagagttcagagcaaagcactagttctcatatctcccaataatcagtagagtttttttttcccctgttttctaacactatcttctttctacttcttttgagccgattttttttttttggatttaagttaaatttctatctaggtgaccttttctttttggattttagttaaatttcattctcttaaaaatgctctttttcccaacttcctagattaatcctatgctcttttttatttcaagcttcccagattaatatagtttctttgttttctgtatactatatttctcagtatacctgtgcatgagtaaaggcataaccggataagatgtggatgattaagccatccattcataaggttccgtaggttatctgacgtctatctgtaaatcagaatttagaagtggctgttatctgaggtctatctgtaaatcagaatttagaagtggctgtaccactgtagtaagagtttatactacagagtctagaaattttttttttgtctggttattagttgagttggagaagtataatttccatggacatgatatatttactaccttgtctgagaaggatatggtgaaacgaggaaaaactggacactctaggagagcttgatgaaacgagttactttcagtctttcagccatttcagctataacagcaaacaacagaggcgaagcaatgtaaaaccagcacaggactcggacttgattagcccaaaccaagatgaccgaatttattcgacaagagaaacaaccgaattcaatatacatccaatcttctaaatcttggagctactgatttgcgcatatggaaggctaagcactatgacatgctgaaactttcctgattttacaatgaatcctgttgcattctaaacagaacatacgacctcatttattttggagctctgcagcaatgcaattattggtaatagcatcacatctttaaatagagacggagcaaattcgacaaattttgggagtctatggctggcaacactccacatcgctgtgaatgataactgcaataaaaagaatagttcttagaagcatgtcatctagtcgtaccattgataatgtaactatgttgaccatcggttactcaaaagaaagtccttttccagaacattataacgagaagagatggctacatttaccaaaatcacattcatatgtgagaaatggaaatcacctcaccatgaaaataagaatgccttcacctcattgacaaccggtcattctagcccagtccacaaactgcattcctccataaatgttatttgcaaagcgcacaccgacagtgaatgccagagaaacagctgggacacgcttggcaacaggtgaagcctcaaccacacgctcaagcccattaataatctgataacgggtgttggaagacacaccaaggaatgcacctgaaacattgagcacgatttctgtttagggagcatcaatatatataatcaagtatacttaaaaggtaccgtaaatgtaacagaaataaacagttagaattctttgaatcatgcaaatattatattgtgagcagaacttaaaaacttttgagttagttagcatatagcgaagatacctaagctcagaagtactgcaggttttggctagaaacagaatcttaacgattggcaatttcattcaggcccactttaaacaacccaatagcagtatgctgacatggggaa

SEQ ID NO: 77087 - DNA, 15152 bp, Oryza sativa
ctcgtctcgccgtcgtcatcgccctccgtcgctcgccgtcgtcgatcgtcctcggtgattctccctctctcccgcgctgcttagccgccgcactgccgcctagtcgcttagccaccgctatcgccgctcgcgtcgccgcgacgccgccgccctccgccgccggccggtcgccgccggtcgccgcctcgcgtcgccgctgcgtgcgcgcccctccgccatgcgccatggccgccgggccagtttgagccgtgcccgcgcgcgccggccgcgagccgcatccaacatccgatctaccgggcggtagatcggagccgtcggtttggctgcccgcgtggctgccgcgtggccgccgcgtgtgcgccgcgttggcgccacgtgtgcaccacgtggtgcgctgctcctccccggtccgtggactcggtccaccgtggaccgccctccccgagtcactgacatgtggggcccacatgtcggcgcctccctctctctccccatgatcttaattattgcacaataattcaattaaggatttttctgtttatagtaaaaacacagtgaatcttctaaaattcatatctaattcatccgagctccgtttaagcccattcaagtctcagtaaatcaagaaaaatgtgtagaatccattaaaatggttttgttctctgtttcagtagtcttatagcctgtttatattgtttgctttgtatgtcgcttagattccggctctcccgacgctccggtgtatttcaaaatagtcgccgaggttcctccagcagcagagcaaggcaagtcatgcttgtcacttgaacatgttgatcctatattgcaaatgttctattgtttttcttcaaatattgcattgttttacaataataccatgggttgtttacctactattatagccatactatttttgtaccttgcttctttgttagcttgggatataacatgactaggtattggactagggattgcttagccatgcttagttcaactagcacacaatgggggaaatcatattaatgtatagactgtaggttctaatattaatgttggattagtgccaccgtcctggtgttgcttaattaaaataaatcttatggtaggctgtgggtgcatggttttgttggtcgcgcccatggcagttaaggaccggttcgcgggatgccctggaagaacttatcgtacttaccacaagccagcgtgggcaacggctgggcttgtagtgtagctttcctctagctgacgcatccaggcaagggtgggcgtgatggagtttggatgggccctacgacggcctatgcggcttccagattcacctaggcacgagaggggactgcccgctgccttgcgaggagtgggggtaaaacctgaggtgtggtgtgcttggttagagggggttatgcgaagggtcctgtcacggccttgatatgtcatggtggcatgttggcacacggaaacgtgtcgtggggctgtgtcttgtgggtacagttgtacacctctgattagagtaaaactattcgaatagccgtgtccacagttatgggcagtcgaccagattcaccgtgattagtctcacccctagttagcttctggaactggttagttcaggtggtggtttgggcctgctgcaacgtggtgtaacgttggacagtgattggttaatatggattaattactacaactgttttactgctttcaactactgcttttaaatgctagctttatgcaaatgaacctctagcctcctttggttataccctgcatcataccttcttttccggtatgacttgcttagtacagtgggtagtactcagtcttgctctcttttcccccacaccagagttgaagtccttctcagttgaagatgtctcgaagaggttggtttcgtcgcggccgtcaaggatgcctgtggaatagagtcgcccgctgcaggagtcaagtcttcaggcttagctcgcttttatcttttccgctgtatttgtaatcttttatattttttgtaagacgtggatatgtatgtcaacaattatcgtttgtgtatcctggctagttctggacagaggtttaatacatattcagcttagaaattctagttcgtgaatttttggtcgtgacaaccacctagctcaccacctctctcctggtgcccctgactcctccgccccaacctccatcactaccggcctcccgctgttgccgatgtgctacgccaagccgtgtgccctactcatcggccgggttaccggctcccttgcttccgccagcctcaaaactccccccccccccctcctctctctgtttagtgttcagacatggagtaggtagcgggaggataaggctgatgtggggtcggctgacattgggttttgacaggtcgtggacttggtctatggaccattgagcactgtggattactgggctggttactgtgctgctgctagcttgctgtaccttttgttttttctctcgttcatagagtgggtttgcctctctcagcgcctcatcgatatctgcacgtctccgacatctacatagactttgcttcgacttcatccttctgactcgcatatcttcgacttgatcacccattcaagtgcttggctacaatgacttccgcaaatgatcatcatcaagtgtctacgccatgaggctccgggttgccgctgcgtcaccctctcgggcttcagtgccaccgctcgtggtccacctctattagttgttgcagtgctgagaggtgccctcctcagcatgacttcatcaccgatggacttctcgccgctgcattgacatggagctacaactgtgtcatccctttggaccacagcgtcaccgctctcgtcgtctccatcgccgcccgcacatcgacatcctcgtcgtctgcactggtgatcttcagctgctaggttcttctttgtctacttcgagcatcatcgccgcgtctccacgctgccatcatcactgctctagggcggtggtccagctacctctacatggctaccgacatcgccgtccaagccgttggtcccactacttcatcttcatctccgtccagaatgcctcattggcagcgtcgtcgtatcttcctcgactacaatttgctcttctccgacaagtgcgtgttgctcaatcaattctctctcttcactgctctcgcgccacgatcatctcggaggccttctctgctagtctcctctgatattgccaaagattcatggtggtctcctacctcgcccgtgcggtattgacaacatcattgcgcgtgtttgtcctcccgggtctggcaaacccggcggaacgtctcgtcctccacggttcggcaacatcgactcttcggtgtcatcttccttaacgaccaccgcattctcgtcaccgtcatcatctttagttcgtcctcgctcacgactactctatggtgccccatgcacgccgtgcggctcggctacctcgacatcagctttccgatttcggctacatcgatcatggctactctacgcacggcttcatcgaccacggctccctcacaaccttcgttttggctacgtcgactatggcacaaagggctatgatatgtattgagtactctcgtcggttttttctctagtctaagcgttcacactgctcacgctcggaccgtggggagatattagagtatatatggtagttctagaaataataggatataattgatttgattagagtctttccttatctctagtacctttctaatctttacccgtgtaatctctatataccagcctacgaggctcaatacaaatattcatgttacgcagtattcctctctttctatactattcaacagcatgatccatctctttcatcctgtacatcagcttcactagattaattggcacatcatctgacttcttgaattgattgcgcaattgagttatgtaaccaaagtgtatactttgaaaattttgacacggttaaggtacgtagccggtgacgttaggttggatagatttttctagagctacctctgaccggtctctgcagatgtagggcccacacacaaataaataaactttgaattgaaagaaatgtgtcaataacggacaaaacttctacgagataaataggtaaaggacgatgcaatatatatgtaaaaacatatcgtaagtatgaggctttttctactatggccctttttttttgtgtgtgcggtgctttatatacagttcaaattgttgaagcaacatttactgtcatggattatgtcaacagagatgtcagtacataatataagctttaatgaaatactctctccggtcacaaataataagtgtcactttagaatcagtgtagtcaacaagagttaactttgactatctttgttttgaatacatcacttgtgtattggcatagccaaacttttaaaaacaataactttcataatataatattagtttacacacaattcgttttggatttatacaaatgaattaagtgatcaaattaagttatctcctgatgactttgcaaagtttaaaacaacacttatttatgattgattggagggatcaattaattactcattctccattcttaccgatcgagcgtcatgagtgacagaggtttggtcattcaaactgtaaacctcatctatttaaacccaatcgcgagtgctaagcttgcactcccccagcttgaacttagaggtgggttgcttagcctggttttacaagaatctaaaccagcaatggatggaggaggcgtcgatggctatgagatggagatggtgaggaacaggaaggtggtgctaaggaggtacgtgacggctgggtaccctacagtagatgatatggaggtggtatcctccaccatgatgccacgcgtgcctcttggaacaatggcaccagcggtgatggtgaagaacatctacctttcatgcgacccgtggatgcgcggtcgtatgactaagcacgacgatgctaccgcggagatagccgaagacttcgtgttaggagaggtacatagataagtaattgttcttgtcaaaaattaataaattctcctatatatataacacctttataaaacttttgaaatctttttttggtacataaaagataaaaaattgtaagcatagatttgtatcgtaaaatatttttataatcctataagcttatctgaataaaacttatgatccaaaccacacatgaaaaatacaaagaagtcaaaaagttatatacaatgatagtagtgaacctagggttcacggttttggaaaccaccaaaatttcataattttcgtgaatttcagacttttgttacatgaaattatttgaaattttaacaaactcctacttaattcaaatatattttcagaaaatatcacataaatttggaaaaccctaaaatttcggtcgagatggttattgcttgctaggaggtcagaaattactgaaatttcaatccctgggtgaaactcgcctttttaaaaaagaggggggggggtacagtggcttctacatgaagactttgcactgactttgttatattattttgagagaaaaattgggctgacttgtgctggtgatggtgggattgacaggccatggttaatttcggtgtgagcaaggtggtcgactcaacgcacccggtgttcgctgctggcgacctcgtgtggggactgtgtggttgggaggagtacagcctcatcacccaaccggagacactgcacaagatcaaccatcctgatctaccactctcctactacaccggtgttctcggtgagtcaattcttgtgcatggacggacacatcagttctcggtagacaagaagatcggtttggttacatcttttctcttttctttgtactaatttcagatgatatgtggtgttaattgaccatgtaggtgtgactggtctaacagcatatgccgcattctttgaggtcggcaagcccaagaaaggagagaccgtctttgtgtcggcggcatctggtgctgtcggccagattgttgggcagcttgcaaagattgccggctgctatgtggttggaagcgctggctccgacgagaaggtcacccttctcaagaccaagtttggctttcacgatgcattcaactacaagaaagagagcaatgatcttaccggtgctctccggcggtgcttcccagatggaatagacatctactttgacaatgtcggcggtgcgacgctggatgcggcgctggtcaacatgcggcgtggtggtcgagtggtggtgtgtgggatgatttcacagtacaacctgcaggagcccgagggggtgcacaacgtgatacagatcctatccaagaccatccgggtggagggatttgccgtattcaaccacttcggcttatacccgatgtttgaggatgagatggctaggtacctaaaggaaggtaaggtgaccgtcctgcaggatgttgtcaagggcatcgagaaggcatcggaggctctcattggtatgttttctgggaggaatgtgggcaagttgttggttgctgttgcagatgaatgactctagttaattaataataggcagttatagtactgttatagaataagatgcaggacaatatttccaattcagttcatatatagcaaatgttgtaaacccactttatactcataatcttatatatatcacagtgcaaatttcaggttctagtttaaattccattataacactcatatttgaatatcaaggaccagcgacgttacgtgcggctccttctggccccctcctccacctctggtgtcctcgacgaacatgaggcagaagggagggaggggtgtctcttgtccgtttgcaatatatttttagcattttaataaagtgtttagaaatcaatataataagtcaggttaggttttctttccatggtgtttatgaattcaggtttgtttagagccttttgcattttctatctctttgttggtggctacttcattcgcgaggtctccaacaaaggcctataaagtcttgtctaccaagttgtcgatcaaatcagcatcgctggatttggtgtccaggtgaccaactctgttggtggcatcggttgcctactctgttagagggacggagatggtgatctatacttgttcatatgcttttatgtgtgccggagttcatcagcattgtggctgtgctcgtctgtttgcatttcctacgacattccaagatgtggagtcttttttttttaccgaattttatgctgggtaaaccaaactgatctattctcaatcttttatttaatataatcacccctagtggcgtatctaggatttatggtctgggtgatctgacttagagaaaaaaattctatacactgcaaatgtgatgacgctaatatatacaatacaagtatagaggataaaataaacccaaaaatgcacaattcacaagagttcaaactgaaaaattgaaaaaggagcacaaggagaagacctaaatacctaccactgctggccacagccctgctcgtcgccgttgccagccgacgcaccgcatcatcagcgctgccacgcaggtcgctgcatgccccacgccggccgcgggctgccggtgttgttgcggtgctgagcacctgaggccggagatagagaaagagaggcggagttgcggactcgcagtcgctgcacacaccaatcgtgcaaggtaggtagccgggagagtagagtggagagccggagaacgggagaagccagaagccatcaagcgaagttgacaatgagtattcacaccgttcttgtggcggaaaagaattgatgctagacattgtgccgcgttaagtttgattctttcggctgtgtatttcttacgccctctgtcccaaaacaagttaacctagctgttggtatctttttttggtaagaagacaatcacgatcgaggcacctaaacgccttgcggtgatatggagtcgccaaccaccccaacctagcaaaaagctagaccaagatgggttttgataaattaaaccggctaacgaagccaatttagatagaatgatggataactacccgtctcgtgtgcaaatgaaaggtttacgggacaaacccacaaaggatttcgcactgtcgcagcgaaggtggacaatttacggtgcaaatcgacaaagatggacgaactaaactagaaacatgtgaaaagtagatgcaatatttaaaaaagcgattcaatagcttgtatgtagattgtgggttgtatattacaattgaaccggccttgtcccttatatagaggttggtctttcctcctacaggtcctcctccatgtccaactcggagtagaaaccaaaggaaacccgaaacatacattttcgagcaaggaaatccaagacccgacgaaaacagactcaggctcggactctgccagtctgaccagccacatgtcgccggtcagaccggccacatgccgccggtccgaccggcccttaagctgcggtctaaccggcccatactcagcggtcagaccggccctgtgggggaaatcgatgactttcccaaatcttgacaaatttccttattttgaacctaggtgccaaatttgggtgtaaacactagctagtacgggatgtggcatatcttagcactataagtatcaacaatacctgtcaagattcatagtactgggatatgttaaatctcgtaccaacttaacttatattttgtaatggaggaagtactttccttttctctttatttttttttttacaaaatctataccttgatgggccttgggcgggaattttttggttgtccggggacctacaatccgcctatgatcacctctagtttcgccaaaaaaaaagaagaatattcacgtgggtggacttattccccccccccccccccccgcccaacaaaaaaaaaagaagaaaagggccaagcccaggaattgcgccacaattataattcaattacaccgtaactacactatgactatattataacttttatataacatattcaatcaagatgccatccacctgttctccaaatgtaaacatgtgaagctagcatggcaaactctgaaccttcaatcacttggaggaaatcttgcgctacagtcaaaaggaaaaaggagtcatggagaccatttgtgtgaaatacgagaaacagagaagacgaaggtgatgctgcttttgtggcacgatggaatgaaagaaatcgagtcagggatggtgaaggaggtcccccagccgagttagcatacatagttgcggcacaagcggatgaatgggtggcgttgtcgacaaaagacaataatgaatagggttacaggggcaacaaattaacgacaacgacgtggaagaagcccggggcagatgtcctgaaggttaattaactctgatggagcttttgatgaggttgggggtttgtcatcagaaatcaccagggagaggtggtgacggcaggggcaggtaaactttagcatatgatggatgctttccaaactgaagtattggcaagaatgaaggagactaaatctgcaagtgaaatgggaaacaaaagtgatagttgagacacgctcaattcttttgaagataattaacggtggaaggctcatccttcaatctcttgccaatgggtgtcatatatgaactccaaagggagattagaagcgggtttttttttctgatttttcaattgtatattgtcccggggacaatgtccccgttcttgaaattgtgtggcgcatgctcgggcggcattaggatgtaagtgctctcagctctcctgggatggcatgtcggaaggcatagagcctggtgacaagcgatttagctgactctataagttaatggaaagtttttttttccaaaaagtatattaaaaaattgcatgttagtaattatgatatagttacagtataatcatactatagttaccatgcaattacattataattactttaaaactataattatattaaattcaaaagttcttttacctaaaaaacttagttactacagttttttaggaattcccaattttaaattaaattctttcgatacgatagatatatatatatagtaatataacaaatgacaccgttttttctattttggtttactatctgatatatatatatatagtatgtttgataaagaaaataaataatttactagctttcctattgcctacaggggagcgtatcctatgcacacaggctctcgcgtctacacaccgtgtgcaccaactaaaaattatcacaaaaaattctaggaaaattcatacatgtactttcaatagtattacatctacgtgcaaagtcacatcttcaaattcattctacatagagaataacaaaaaagataaaattctgacaaaattgcaaccttaaaactgtcagattttttgttttttttattacggctaaaatataatgaatttgacgttaagattttaaccctaggtgtaatacaattgaaagtatgtgtattattttttctagattttttggtgacattttttagttggtgtgcacgtatgtacacgtgagggcctgtgtgcataggatatgttgccttcctacagtgcccaaagttgataagtatatgtgggttgtccattcttctggattcaacaaaggatttgtcatattccatacttataaataaagagcatatggacagcttttcaagtttggtgaaatgctaggcagctgaaatttgagaagtgctcttgtataatgggattcaagtcctcttaagaaatgactacagggatgcgcgcgattgttcgttagtcttaaccttaaccgtaactagagaccctctatacgaattttctatatatatgtcaacaaattttactcacaaatttgtcaaatgtaaatatattatagtgcaactagtacgattaataacattgtaactagacgattcaatcatgtgacctctcttccctagagcagcacgcgctaccacagggtttataacaattacatacagttgagttatattacaattacgagttaaaatgtaattatattacaattatttgtacttagcaaattattagaagaaaaactatcgatagatgtaatatagtcccctgcttatatgtacaacaattgaagtttcgaaaattcagatatgctgttgcgccggccgcaggtactaaaaggccctttacaaaaaacggctagcgggagcaccacactcataaaggcattgccgtacatgtttatcccatctttccaaactgaaaaaatgtgagtaaaacagacacgacaaatcaattatttaccagcaagtgaccatatatatgtcacattctgaaaccgatcaactagatcatcaattaatttagaccctcgtgaaaagttctggcatttcacatcggatatgcggacacacatttaaagtagagttaattacactttggtccaccttttattaccaaaattttactttgggctatcctctagctcatattttcactttggaccaggtaagattacctttggtgcactttggaccaccttctttagctgtatttactctataatgttgtaaaaaattacctacgtaagttggaaaagattaccgggttacgggttgttgatatgtttaaagttggaaaagtcttttatgtattcctaaaaagtttatgggatggtccaaagtgaaagaaaggtaaagtaacctagcccaaagtgaataaatatgttaaagggaggtccaaagtgaaactttggtaataaaaaatggtcctaaacgcaatttactctttaaagtattaaacgtggactaattaacaataaaacaaattatagattatgcctgtaaacggtaagacgattttattaagtctaattaatctatcgttagcaaatgtttactgtagcacaatattgtcaaatcatgtagcaattaggcttaaaagatccgtctcataatttacacgcaatctgcgtaattagtttttttttctatatttaatactccatgcatatgtccaaatatttgaggttacaggatgaaaagtttttgcgttggaacgaaacatggccttaaccgcaacaagtactccgatctaatcaatccgccatgcatgatctgatcaatcccccagcaagaaaaccaaccaatcatgtaacatgcacaaggtagcctccgctttaattccttccctttttttcttctccccaaaacttatccggccatgcatatgatcatgatcgccaaccgccaaaaagtttgtttctaacttcccgccatctcccacctctcccgccatctatctctgacctctcctctccacatgctcatcgatcagcttccctttcactgctcaaatggcgttttgccgccccacgctacaactcttatcatatcttcgcctatatatatcgctcaagttccagtttcgtttcagctcattgaactgaataaagtcggtgtgctatagctaccattcccccggacctgtgtgttggcgctgtcggtatctgggtggtgatatattttttctttttttttttacgatctttctagagttgtaatcttgtaattttttttctgctctatcaatagaacttcgcatttccaaaaaagttcatttcagctcactcaactgaataaagtcagctagcttgtattttaggtgaaaaccgtgcgaaatgctgaggtgcttcctggtcgcggcggcggcggtggcgttggctgcggcggcggcagcgccggcgagggctatcccgttcacggagagcgacctctcgtcggaggagagcctgcgggcgctgtacgagcggtggcggagccggtacaccgtgtcgcggccggcagcatcaggaggcgttggcaacgacgacggcgaggctcgccggcggttcaacgtgttcgtggagaacgcgaggtacatccacgaggcgaacaggaggggcggccggccgttcaggctggcgctgaacaagttcgccgacatgacgacggacgagttccgccgcacctacgcgggctccagggcgcgccaccaccgcagcctgagcggcggccgcggcggcgaggggggctccttccggtacggcggagacgacgaggacaacctgccgcccgcggtcgactggcgcgagcgcggcgccgtcaccggcatcaaggatcaaggccaatgcggtaaaaaagcgtgaacatttttttctcgttctaaaaagcatataacatttctatggaaaaagccaaatgcagtcaaaaaaacatatggatagatatagtacaaattatgcaaaatcattagattattacggcacattattttctaacaggatttaaaatttcggtttccgaaattttggaatccctgttaacacgaaatttttggatttttttctaattattcttaaatttagtcaaaaactcaaaatatatttaaattcagttagatttttaaataatttcttgcataagtgaaaatacgatttttttttcaaaatggttttttactgttggctacacttttttctcagaatattttatctatccatataattaagcatatagtttatggcaaaagatcttatatttacttcgaaaataattaactatttgccactcttacgagtggcgataaaggatttgccactgaacccacatgtcatagacacatgagagccacatgtcatatataacaagtgacaaatccttaatggccacatctcaaaagtggcacaaagttaaatgtcccatttacttcgtgcacgtgtgtgctagtcactcggctcttattggtgtgattttaagggagctgctgggcgttctcgacggtggcggcggtggagggagtgaacaagatcaagacggggaggttggtgacgctgtcggagcaggagctggtggactgcgacaccggtgataaccagggctgcgacggcgggctcatggattacgcgttccagttcatcaagaggaacggagggatcaccaccgagtccaactacccatatagagcggagcaggggaggtgtaacaaggcaaaggtaattgcacggtgaaatctcatgaaaaattatatttatgttaactatactaaaaaaaatcaatgttgaatttgaagaaaaaaaataacttaatttttgcgcaaagcgttcggaggaaacataaatgtttatcatgaaaaaagatctgctccgagtaaagaaagatgcatggttaataaacacttgttttaggactaaaatgaagttagtctgaatacaaactgaaaatttgccatctggtgtttatgttgcaggcaagctctcacgatgtaacgattgatggctacgaggacgttcctgccaatgacgagtcggctctacagaaagcagtcgcaaaccagcctgtggctgttgcagtagaggctagcggccaagatttccagttctattcggaggtaattaacaacatgaccaacaacctagctacacgatatgtctgaaattaatcaacagttcaacacatgatctacacatattcagtgtgcgtgtgtctaattatactcaaagatactaataccatcatatatatatcacttgggaataatcaaactagggtgtcttcaccggagaatgcggcacggatctcgaccatggtgttgccgctgtcggttacggtataactcgagacggcaccaagtactggatcgtcaagaactcgtggggcgaggattggggcgagagagggtacatcagaatgcagcgtggtgtgtcgtcagactcgaatgggctgtgtggcatcgcgatggaggcttcttaccctgtcaaatcaggagcacgcaatgctgctgcaagtaacagagtggttaaagacgagatgtgagcctgtgatcgatggagggatatgatatggatatgatcgatgctttatgtgtgcttcgctgaaagtagtgctagctaagctttcgttgtcaactggatttaatcttctactgttcacggttgtactgtacgccaggtgtcaaatcagaagttaggtaaaataaattcaaagaggagcatgactaacataatgtgctcaactggattgctgaaaaatttgctcaaatcgacattactgggaaaatattttttgcagacaaggtgcacctatcttttcaacgggtactccctccgtttcaaaatgcttgacaccattgactttttagtacatgtttgaccgttcgtcttattc

SEQ ID NO: 77088 - DNA, 17534 bp, Oryza sativa
  unsure (1)..(17534): unsure at all n locations
ttctattttaaattttttatgacgctgccacgtcaacatacttaaaccaagtcaatgtgccacgtcatcagaaaatgctttcaaaagcagcgaaggagtcaatttgcaccggtttttaaagttcagggaggcattatatccggttttacggttgagggatgcgattcaactaagtgcaaaagatgagggaagcaaaataaacttattcctacattaggtaagtttttgaaccccaagagtctagtagcccacaatatatcatttccagaattttttaatttatttttgaaagatttaaaaataagtcgtcgttttaaagttttgcgaaattatactcctcccatcctatgtaggacgtgctatgcgacgtggcacaaggctggaggggcgcaccatggtaattttgcaggcgccccttctcgccctccctgagggtgatttatcgccggagaaggccggctacaaaattgccatagttggtccctcctacgggttccattgcacatagattgtcttaccatatggtgatttatatgccccatcctatggtagggcgggaggagtatatttatatacaactttgaaatggaatttattttttaaaactcttaaaaataaatataaaaataacaaaaaattcatcatttccaatgcttgctttttaaaagagtaaattttgtagaacttcggatttatggtccaaattatagataaccactgaaattttgacatatatcacataatcacatatgttcctttttggtattgtagtttcacaagacctcaccttaattagattttaattatgctgacatgtgggacccgcttagctctacttggtgtaatcgtatagatggggcatatagccggcccaatggttggaataatcgcgtccacacgtactctgtagaaatcgcgagtcgcggcgagaagcacacacgcagccggcgcaattgtcgcacgtacgatcgcctgaaatcagtacaagtatatctatgcaggcaaagttccataaaccaatttatatgtatatataataatctcatttttacaacacactgttaaatgtaattgaatttacatcaaattaattagcctgtcgtcatgtcactgattgagtcatatacaaatcgatagcatcaagattggctactcgatccgtatttgttaagaatcagccccattgactcaatcaagtatgatgccgtttacagcagcaccaggaggggatggcctgatgccggccagcgacgagtcagacgagaagcagggggaggcgacagcagtttaggctggtcagggttgtcaatttgcgtaatttcgcaccctaccggcattcaaataatatccgtcgaaatttttggttttttttaatttggtcaaagtttattaaaattcaatcaaattttattaaattttcaaataatttcggataacagaatgaaaattttcaaaaaattcggtgcaccaaaatttctgaaattttagcccaaaacgaaattgaccacctcattcggccccagcctcacacaaagagaggagaagatagagcagcagtgagagagagagaggagagaacgagatagaaattgactgagtttaagagaaaacttggcagtgatagcatttttcaattttacaaaatttcagtgacacctagctgatattgtgaatagtaatggtatttttttaattcagcatatttgtaatagcatgatcaaattaatccaagataaaagtccgtatactattttaaaaacgatttttttcatggtgccacacttttctttcgctagcggttgatagtgggtcccacctgcgaaggcatatcccgtggggactggggagggggcacggcccactggcgtagatctattatcaccgatgggctacgtaagttaactgccagcacaaatatctgcattttaacggttggcgtctaccatcgcaaatagttatattcactggcctttggtttctgatggcactactaaccacctgcaaaagtccattttggccgactggaaaaacccattttatagagtgatattataattcttatattgaagaccatgctagctataacttactaattattaatttcgaatttttacgttaacttaataagatactaaattgagtgtacaaaatagacgctgctttgaatttattatgaatactccacgaacgagcgaattcactcgttccaaaagacccagtaggagtattttcttgtgatttagtttaaataaacaattgctgctgaaaaaagaaacaatcatccttagatttcatatcaatattttataactgcaatactacataggatcaggatctgaatggtccagcaaggctttgaacacaagtttactgtgacatggatcatgatcctgacaacctaggcagtagtaacaaaagttcagataaaaccctggaatatggcatagcccagagtcaggacatgcactacatactaggtcagagtaaaacatgcaagcaccacttttcaagggaaacaccaatcctgaaaacgtggcatcttgactcaaaaccaaagctacatgtgctcataaaataaatcacatccaggactcttccgttttgattcagactaattaacaagagcttgtgtcagaaaacacccagctaggagacatgcatgtgagcatctgtgattcagatttccaaagcattctgaaatctgggaacaagctgttagctgaccccatatatatatatgcagacaaaagccctcagtttgcattgccttgggcttcaattgacagacctcaactctcttgttttggaacttcatttcatcagcactagtaactgcaatgaagagttccatggtattggcttctgtcatcctcctgatcatggcagcaacagctcatggtaatgtttcaggacaagtaatatctaatactcgttttcatatttgagttcagctacattttgtttctacctctcattgttgtgtatcatgaatgtaaaggtactgattcttgttacatacaatccatttcatcttgtataggacttaggctggacatggggttgcatgcagctctgaacaatgaggtcagtacaatctgtgagcctgaacacagctccactaattaacatgctgaatcgcagcacggaaatgtagtgatcaactgaacttgaacacctaaattgacaggggatgctgaactccaaatggcagtcaactgctaaccgtccgatcgacacgcgtcgcgcatccaacgacaggcgtggcccaggtagaagtagaacgaggccaccgaagatgagcaatccccatgacatggatccaaggttcagtgaggactactccgggcccggtggtcattcaccgaatcaccaccgaacaactccctgcggtccatgctagattgcaagtagcagatagatcatagatgatgaaaacttgtccagttttctctgaagatgctacctccatcaatcttcagaaagatgaactggaccatgtgagctctgtggctcactagtttttcagcacattagttagttctgaagagtagtttttcttgtatgatttgattatgtccaattgaattcagcttcagtctgaagagaactgttaaggaacaggattagtactgttctaggattgtcattcaggcaactgtaccggacggctacatgtcattcgacagtccaatcaaactgtcagttagagtaaactcaggcttaaaattatctttgttttcttgttctcaaggcattcaggttagacagggttgcaggaaacgctgcgcctttttgaaggagagtgtacagtttgtgctgcaaattctgctccctaacaaaactctgacgactactgatgagcagagagatgattgcttatctcttcgaatgtcggatgcttcctggataaagacaggggagacagctgcaattaaaataagaggagagatttctttctcaagcaaggcgttagtggcaaaattatattcatatcacagttgcaggagcttacaaagttactagcaccagaagcaaaatctcaaactgtactcctgagctaaaatttgatttctttggcactatttacacattgaattgtttcctgtagacaacaacaacatatagcaaagcccagacgactgaaaacagttatcatttgattcagtatgatgtaatccatattcaggtgagcatttcgccccgggtgatgcttaaaaaaaaaagaaaaaggtatgatgtgatgcctattattgacaaaattctctaggttatggagatagattcatgaaggaccagcaggatacttctcaatcaagtcgaataattcatctcctataccgaaaccaagcatcctggccatgtcagccgtcttgagtccaggtttaggatgttcctgctgctttagccatgagtaaacaatgaacaccttcttcatcacaaacagctccagcgcctccgggttgaagaccacaccaagcctcatgctcatctgcagatttttgcaaatatgaattcatcttaaactccaaaacgacatggaagtatatgtaggaccaaattatttggggatgcaaaattcaggttatatcttgttacctggtgaggggccagcattgcggcatatctggcaagttcaccagctctccaatcaagcacaacagggaaccaagggtaacaagcatcaagcctcacaaaccatagccttatatcagggaactctgacagctccctcacatcatatggatcctccctctcatagtttatagtaaacccgaccgttcgatccaagagatttcttgtttgagctgaatgatacacataagattcttgttaactataacatggaattgactgttgaaacaatacaatgtcatgactttcattgttgcgcacctggtgtcagggaattcaagtcaccaagtacttcatgaacaggcgaaaggtcgagcgtccggatgatatcggtgttgatgacaatctcaaagcgaccttctgtaggtggtggtggaggctcaacttgtggggcatctacagcaagccgtcgaagattgtcatttgcaagcaaaagaaatggatttaccaaatcaaggaacaggtgcatattatacacacagaacgactgataggcaacaaataaagttttaattgtaacaaattttactaggtaacatgaggtcaacccagcatgaagaaataaaatcacttccacccttgctttgtttcaagcataataacaacttttacccttcagggaacctctagcaaccaataaacagggtttcacataaatgaaccaccctgtggttaattaggcatttccaagccacatccctcccatgcaattgaagtttgagaacatctttgactgaatcaaacgattgagtgaaaagctcaaatgttttagtcataacaagattagtattcttgcaatttgcacatcaactgcgatggttatcaactgtgatggttgatgtaacttcactaagagtcaatcatctcagtcagatactcatatgtagcagattgacggtgcactgtaatagttagcaatggaagaaaaaaaaacaagtcagtagtattgtcttactacagaaaattatatagttttcaaactcaaacacaaaactgaataaaatacggaattttggttttcaaccgctctccatggagaaatttatttccaaattggcagtagtttttactcctagtcgctcaccgtcttggtcggtggagagggagaggtcgaagttcccggaggggttgaacgcgacacggagacgaaacccctcctccgccgccctcctcgcctgcgccgcgacgggccaccgcaacccagagtaccgacccaacgagccgctgccggggaaacgcctcagcgtcagacgttgcgagctggccactgggagttggagtgcggtggcggccatggcggcgacggcgacgcgatggacgcgcggccgccggcggcgaggaagagaggtgaggtcaccgcggcgggagacgcaacgccggcgaacggtcgtggcttctccccgccaaattttattatcctttaattatctcgctttttcttcttctttttttattattattacaagtaatttatatttattttttttatggaacagcacatttgtgggcccatatgggccttttagcttctcccggcccggcccatgaaatgtgcggcccaatttgtacagctcagctcctggtgttgactgtcgagacaaagcagggcacagatcacatgcagtttgacatcatctaactccattttcttctacttcaaaattcaaggttgatgaaatatattaacccatgtgtttcacatacacatgttcgtttcaattttttttttaaactagtgcgtgcatgtgagatgaatcctcacaaaatcaaaagtagtatggcctttcagaacatgcatgccgtcgttttggagctccaactcttgttggtatctgctgtgcgtcaaacgataagacatggaactttcttagctcaaaaaagataatctttgctcgattatatagagacaaaattaacatgcacaaggaggtcgtgacccatcacaccaagtttcatcccagcttgaaaatgatattagttgcataatgccctttattaatgacatgttataatatcacttgatgtgtaaccgagcaaaatttggatgctttcatgcttaggatgttgttgagccgttttccatacatatatatgatatatagtcactccgttttcgaataattggtaataacactattcaagtttaaattttgaccacttgtttttttatgaaaatttataggtattcaaatatactccctccgttatatcatcgagtgtgtgtagcgttataaatataatcataaaacttttattcatcataatatataaccatttaatagtaattagcaaatcattttagtcaaattgttagttattataagcatgcatatgtaacctattaaattttcgtgctttatcatgtgttcagtgtgataaaatcaattaaataggtatagttatatcctggtatatgttgtgtacaatacaaatacaaatatgaaacccttcacaagttcgatcacatgcttctttctttccgtcgttacacttattataattgcgttgacaatatgtaatgattttttaagaccatttaccggctctgccttccattggaaatcacaaactatttgcaacagcgattacaagtggccaaagaaaaacactacgtacgtactgattcaatttcttttccccatttgcggtatacgtaagttgttcattaattcagccggtattatacgaggtgacataaatgtaatcaaaatcataatgcaaacacaagtacccatcaactcatataattaaccaatctgtgtgttactctaaataatcatcgtcgttagctagctgaattaagctgtaccgtactatatatatacttaactccacatgcatatatgtctgcaagacggcaacgctgtatcattgtcctagatcgatgcccttatccactgttttggccagtttcaaaaaaaaaagaaaaaaaaaacactgtgtggcccctccacgtttgcaacgtttctttaactagggctcaacagtataatatgagatgctcatcatcattgacatgctgtctaattaattattaagaagttcacataaagatggagtttaacctaagtcacctttgtaagaggtttttttttgggggaaggaggtgacgattgaagaccttcatctttgcatcaactccaaagtttcttagaatatatgagcatgattcatgtatgctcttgcttatgacacgttttctaacctaaaattattaaccttcgagagcgaatccaggataagattaaagggactcatctcctttttcctccttcagccctctaactttttcacctctcctcttcttcatcctcccctctctccttctacatatcaatggtgatctagtggaatacggaactcaagttctcccagcatctacgcacgttggatccgtcccagaatccagtatgccttgatctcagtggtggagccctgtagccaaatcttatatatatagaatttcgaagttttcgggttttccgtttatacaacaatatatatgagtcgtttatgaacttatttacaaaacctgtgggggatgacttgacatagtctatatatactacatagaacttacagtaattaacaagttcagatataaaatgttcacaacctcatcaggagaagaaattaaagtctcacacgtgcatgcatgcatccgtgcattcccgttcttcttcattcactcggtaaggacgactctgtgcaacttgatatatatagatcacatatatatgatgagcatgtttcacgtagtctctgtggcttacgcgctgtctagccctaattaatctaacttaatcccctttttaactccatctaacctcccacttgcactaatccatcattcccttgacctaataactaccccacatatactgctatagtgctatatatacatatatatagaacccaactcaattttaaagcaagctaaaagaagccgatagacgacgacgacaacgcgccgaatgggtacggccgccgaacaaaatgcagagcctgaagaacaagncaagtttcgtggagtgccgcggggaaacgccggcgtggggttcaacgaggggcggtggctgaccagggtgagggagagcatggcgaagcggccgtggaaggagctcggggcgccgccggtaaaggtgttcaacgtgccgagggtgctgaggtcgacgaggcccgaggcgtacgcgccgcaccatttcgccctgggcccctaccactgccgccgccccgagctgcgcgacatggagcgctacaagctcgccgccgccaagcgcgccgagaagctcttcgccgccggcaagaggttcgacgacctcgtccgccgattctccgacatccacgacaagatcctcgccccctaccacaggtatatatgtactgtgtattgcctagcttccagctgaaactatatacacttgggtttgtaaaacggacactaaccatgcattagtctataattaatcaaatgtttagtgccataaacttgaaattttgatttattgttttaaagaaatttctattaaaagtgttttcataaaacgtactcgctctattataagccatgatcaaactcgacatgattttcaaaattaatctttggtttataatttctcgtatactgtaaagtttgtagcaacaaattataaccgtatgaaacatattcaaatctcaatccaatgatattattttcagcaaataaaaattcatattatttatactaattgttggtaaaatatttttaaagttaatgttgaaatatgtgtgcgccttttatattatttgatggacggagtatcactgtattagagagaaaaataaaacgcttgtaccacaacattttctttttagaaatcacgctcatggatgacaaattgtagaattgattactaattgttagcaaaatgtccctcaataaacataaacaaagacatagaccctgtttggatccggagggctatctattaaatagccctccagaatcttgctatttaaaagtattaaacgtagattactgacaaaacccattccataacccctagtctattttgcgagacgaatctaaagaagtatattaatccatgatttgctagagtgatactcactggtggagaaaggggctttactcccggttcgtaacccccaaactgggactaccaatccgggactaaagatagtgatctttagtcccgagtgaaaaaaccgggagtaaaaattcatctttagtccaggttggtgttaccaaccgggactaaagatagagcctttttagtcccggatggtaacaccaaccgggactaaagacagagctagcctagctagatccgattgctctattattattttattttcttcattttgtttttaatatattgatttcactccatccccatcccaaaatcccaaataaattatccccaaatcctcaaatccccaaatcggccatattcaaatagatcacaaaatcttaaaacaaaattacatcacaacttctacaaaattcatcacaaatatatcacatattcacagacatcacacacaaatcaaatacacagatctgaatcacaaattcttagaaaaaaaagaaaaaaaaacacaggctgctgcagccgctgccgcgccgcccgccgcgaggccccgcggtccgccgccgcaccgtcatgaggccgcgccacagcgccgtccgccgccgcccgggcctctgcccgccggtgcgccgcggcgaggccgccggccgccggatctatcagtgggatgatggggagggaaggagaggagttagaggagagaagttagagaagaggaagaggaagggatgctgggggagggaaggagaggagttagaggagaggaggagaaggaagaggaagagatgggatgaagagataaggtcagtggaggaagaggtgaagagataaggctgctcgtctcctcctcctcgatctcgcagatggcagatgcctcgtactctccgccacgatcttttgttccggttggtaccaaccgggactaaaaatagatctttagtcccggctggtaacaccaaccgggactaaagattaaaaagcagctctaaacttttgaaccgggactaaagataatctttaatcccggtttttattgtaaccgggaccattgtgggttttggccgaccgagcaaagatggtttctccaccagtgactacagtaatcagccgctaattatggattaatatacatcattagattcgtctcacaaaatagcctagtggttatggaatcggttttgtcggtaatctacgtttaataattctaaatagcaagattccggagggctatttaatagcccggaggattcaaacaaggccatagtggtgacatgacactctcgttgaaagccaacactaacaatcagacggaaaatagaagattaaaacttgagaaggagattcgtttagacgacgctcctgtcaaaaccgtttgatctcctctgcgttaattccaatttaagaggtcaagaggatgtgttagtcgtctaaggcgagtctgagattatataagtattatgcccaaaatttatatctcatgtacgggtcttattatatatttattttcatttttatccttgcatctatcctaaaaggcaatagccaataggaatgcagctgagaaaaaacgacaagcaaaaacctttgacatcgagcttgtttttgaccagttggcttgatgtagctttcaagaaacaacaacgaactgggctatctacgtggcatggtgtaatctagcacgtagatatatatggctatataaaaccatttctacataacatcattatcttacgtatacataagaggattaagttaggtagagagaattgacgcgttaacatctcaatgagcaactaattgctagaataaatcaccaagcttgcaagagagcgaataagttagaaagtcaccaagctagccaagtgagaatgagtatcctcttagaaacgcccaggggttttccggctagctccataaggtggtggactagtcgatctgggttcgaagctccatcccttctaattatttaatattagttcctccctaatattcgcgtattttagagcgagtatcctctcgttgtagtggtgtagttgtgggtctacaaggtttaaattctagttagttgtgtgttcatattgttagtccaacctcattgttaatttgtttgctgagtacattactagcaaaaatgttcatgctttgctatggattaaaatatattataatatatgttataaaaatattctatcacatatggcatagtatcacttgtttgtttattttaatataaaatattcacttttaaaataaatattggattacttcataatatcataaattaattttgaaaaatgcaaaagtagtggctaatattgtttttatagtatagatagcaaaagatttttgaatttttatattttctttaccattttcttttctgatcagccttggcttctaagccacttagagctagcggaaatatatagcccaaccataaaattatttttaattgactcgcttattttctatgccttatcaactgaggcgaccattaatgcccaaaggtaagtaaataaacatactccttcatttcatattataaatcattttttttctaatcaaacttattaaaaattcgattaagtttataaaaaatgtagcaaacaccaaattagtttgattaaaactaacatttaatatatttttatagtttgtttgttttgtattaaaaatattgctatatttttctataaacttgattaaagctaaaagagttaactagaaaaaaaatcaaaacaactcataatatgcaacggtggtagcactaaaaaaaaattgaaactgtgtttgtggttagtttccccaattatgggtttgcctttgtaattcaagcagtttcttgtgctaaattaactcaatcaaattaacacataaatcgatgcatgtacgtaggttactggagctgaacgagcagacgctggcatggatgatggccatcgacacgtgcttcctcctcgacttcctcgagagctaccaccgcgacgaggccaccgacatggtctcgtcggcggccaactggatcaacgccgtcgtgcgcgacgccatcatgctcgagaaccagatcccgctcttcctcttcgccgccgccctcgagctccgccacggcaccgaccaggcccaggccgccttcgccgccgccgacgcccttcggggtgttctcggccgcttcatcaccgaggtgtcccccatcaagaccaccgccagcgccgccctcgccgtcgccggcgacgacctcgccaggcacgcccacctgctcgagctgctctaccacttcctcgtccccaccgacgccgtcgccgaggccgtcggtaacgagccgccgccgctcgtccccgaggacttctccgccgtcgacgtgttcgaccaaatgcagaaggagatccccgactacgacaaggtgaagcaggcgtgcgtgcaggtgtccagcctcgacatggcgccgatccggttcatcaagaagaacctcatctcccggccgatgggcctcgcggcgagcctcccggggaagctgatgcgcaaggtgccgctgctctcggcggtggcgccgctggtcgggaagctgtggtcgtcttcgtcgtcggcggcggacatggaggcgcggctcaagggggtgaacctgggcaccatcatcaactccccgctggcgcaggagctgatgatcccgtcggtggcgcagctcgcggcgtgcggcgtgcgcttcgccccggcgcccgagggcatcgccgggatcgagttcgacgccccggctgcgacgctgaagctcccggtgatcaccgtcgacggcaacacggagacggtcctccgcaacctggtcgcgtacgaggcggtggccgtgcgcgggccgctggtgctggcgcgctacacggagctgatgaacggcatcatcgacacggccaaggacgtgaagatcctgaggcagagcggggtggtggtgaaccggatgaagagcgacggcgaggcggcggagatgtggaacgggatgtgcagggcgacgcggctgagcagggtgccgaggctggacggggtgatccgggcggtgaacgagcaccggagcaggagggcggcggttcggctgaggaggatgatgaagcgctacgtgttccggtcgtggcgggtgctcacgctgctcgccgccgtcgtgctgctgctcatgacggcgctgcagaccttctgctcggtgtaccagtgcaaccgctggttcggcaacatgctgcagatgccgcagcctggaggtaaagggccctagccctacggccttgttttgttttcgggagctttctagcagctgcagcttctctctgtattgaaaatatgcttgaacggttgaaaaaaaaatcataaatgttataaatagtaacaaattcagtatctaaaatttcatggacttgttgatgtacatgaatggtataagctgatacctgtaaaattcgcgaagttttgtgtgtgcttttacccatatggtttagtgtatctctactccctcccaccgcaatgctctgcttggcacgatagagccgccgacgaggtgttatgggctggtttgttccatgtcatacgggccgtaattttccgggccttgccccgaaatccctcgagcattagcttacacgggctgaaaacaaggcgtttcatcggcccaccaacctggatgaaacaacaaaaaataagtctattcaccttcctcctcttttgctcctaactgaaccgcctccctcaaccgtaaaaccgggtacagcacatccccatctttaaaaaccggcacaaataaacttattcagtgatttgggaagcggtttctgcttacgtgacaagttgatcgcggttggctcgatgagtcaggaggttggacccacatgtcatcgactatcatctatccccccccatctccctctcttctactactctcttttttttctcctccttgctcctcaacgagtgcagccgagtggcactatggtggctacgggtcttggagatgaagccactggatcggtagcgagcagtggccggaagagcagcgttcgggtgaggacggatcaactcggcgtgtgggcgacattcgggattaaggaggtagcagtggtggaggtgctacagcgaggggaactcagcatgttggggttcacggctatcagagaagcacggacatctagcgatgagtgggcttggcaagaggtggtggggtagaggagatcgagtggtggatggcatcggtggggaaaaagagaaaggtgctggagcaagaaggtagagacgttgttggacctagggggagggggtagccggggcgccagaggcatggagcaggttaacctcttgattgtttgaaatgttcttcatcctcgtcatgttcttcgatccaccggtccaagggacggtcatgacgtgtggcgcaaatcatggtagcaggtgaggcgtgcggcaatacgtagatgacaacgagcatgaccttggcgtcattgatcctggtgaggaatgtggcctcactacctcaatgccggaacgccgccgccgctgccttccgatctcctgcttcctcccacgccactatagcctccccgagcttctgctctaaccgtgactctgaggacatggatggagcctcgtctctaaggccgttcccagtgcatcacacaaatttgaggaacctcgaggtgccatgtaggctagagctacaggtccaacctttgggttcttcacagtgcaagtggctctaggagtagctttaattttgtattttagcccctaacactttatgtttcagttctcatttttccaattantgtgtaggtctaaatttacaaataaacaccctcaaatctagaaaaaatattaaaaccccctttcccctctctctcccttatcttttcgctcatctcgcattctcgttgcaactctccggccgatgcgcctcccctcctccatctccagccgccgcgcctccccctccttcggccaccgcgcctcccccaactcctccagcgccactctccctctccccaccggctgccccctatctccctccccatctccgcgacttagagccaacagtagctcgacgctggcaactccgcgcccctcctcgccggatctggccttgggcgatggcgggtcgacgacggcgggggcggcggtggcggctcgacggctagggcggcaatggctcgacgacgggggcggagacggatgacgatggcggcgacgggtcgatggtaggggcggcagcaagaggaaggtttgcttcgcattttgggacatggtctctacaacgtagtgtcgaccctctctcgccgcgtcacagggtttcttcctgacaagttatgacgaggtttgggtggccaaacgatgctccgcgtacttcataggggctcgctccacgcctagatggctcggaatctctgcgctggtgaggtaaggccgaacgccacctcaccgcactatgaatggcctaaggatacagatggaaccgaaaattcccttgcctctaagaatgcactgccattgcgatctccctgatcttccatctttccatgccatcttctcctccctgagcgttcgctcccgttatgacccacaagcctctcggattatgaagccatcaccaataccatggggggttgtcttcgccatcgcctacctcgacctccatctcacggaccttgcgagggttccaaggcagcatcatctttaggatcatcactgacaacccgacaggccgatacctccctgcggacactggctcctactgccgcttggacttcttggacctctccatcaccctctctatcttcacaaaccagttgtcctcgagttcactgtcctatgcctcgggaaccctctctgccctccctgcttgtctcgttgctactatgcttctcacggtgagacaatgcttaggtcaccctcgaacccagcctcgggcatggggatgactcaggatggaggatttgtgccgctgccctcggggaagagatggaaaatagaggcgaggtggagagagagagaggagggaggttaggagagtcgatgacatgagggtcccacatgcgaaatcagcgagtcaatcatgatcaacatgcgatgtcagtaaaagccattttctcaaccaatgaaggaaccaatttgcaccggttttcgaagacaggagaggcattacatccagttttacggttgagggaggcgaatcaatcaagaaataagagttgagggaggccaaacagacatattccaaacaaaaaagtctatgcaggccgggctatactgctataaatgggctcgtctgtttattggacagattgggcccaaacctgaacctacactagtggcatatggactgatattcaacaaaagccgggccccaccacggtttgtcggaacgtaatcgccagccgcccttccgttccttggcctccacgcccgtcctttctgaaatgttgactttcttctctctctgccgctctgcgttccttcaacgcaagcaaccacgcatcaggtcaaccgacagcatctactggtactagcagcctagcagtacaaagcttcgaaattcttgggccaatccagctgtgctctgcatcccgttgacccgttgaccgctgaatcaaaaaccgaccacatttcagcgtgcagcctccctctccactccatggaatatactaaagaattgataaactcctaccacaagaaagaaaccagcgactcgtttagttagttagattgattagccggtcaagttcgctaattacttgcatgactcgtacttgacgtcccccaatctgaacgcaacagatacgcgcagaaaatctttca

SEQ ID NO: 77089 - DNA, 5287 bp, Oryza sativa
  unsure (1)..(5287): unsure at all n locations
aacgtaatcgccagccgcccttccgttccttggcctccacgcccgtcctttctgaaatgttgactttcttctctctctgccgctctgcgttccttcaacgcaagcaaccacgcatcaggtcaaccgacagcatctactggtactagcagcctagcagtacaaagcttcgaaattcttgggccaatccagctgtgctctgcatcccgttgacccgttgaccgctgaatcaaaaaccgaccacatttcagcgtgcagcctccctctccactccatggaatatactaaagaattgataaactcctaccacaagaaagaaaccagcgactcgtttagttagttagattgattagccggtcaagttcgctaattacttgcatgactcgtacttgacgtcccccaatctgaacgcaacagatacgcgcagaaaatctttcactatagcgactttattctgtacgaaatttcactaatcatttctgcagatctgaattaacgtacgggaggcttttggttaaatttccatccacggatcgaattaataaagaacaaagaaattgttgacacaatgttctactaatgctagtagtaataatgaacaacatgttgagatttgacgaagagatgagatgcactctactatgaacagtacaaaaatctccggcgagaaacaggggcatacaaggattcaaaattgccattggttgagatcgtaggaggcgtgacggattcgcggtttgtgctcatggcgacgaggcggcggcggcggcggacatggcggagaggcggctggggcgcgggcggaaggcggcgcggcggcgctggtggtgggaggacgggcggatgagcgccgccacggcgcggcggacgtggtcgccgtcctccaccgccgcgatgcgcaccagcgagttcgccatcgccgacctcctcgcgtnctcgcgcagcccgccgcacgccgccgncacggagggacgcgacggcgacgccgcgccccggtgcagcgcgcaccggaaggagcccgggtgcgtggtgggcgagcacgcgcactccctcctcgtgctgcgcgcgccgaggccgccgccgccgcgcgacgacgacacgacggcgaccgtggcgtgggggagcgcgacgcggaaggcggacgggaggaggccgccgccattcggctggcgcgtgggcggcggcggcgagcgtgcaccggcgccggatgagagcctgacgcggcggcagacggagggggacgccggcgtcggcgtggtcgacctcgccatcggtccaagcacggcgtggcgtggtggcgcttcggttgcggcgcggccaaacctagcgtcgccgccgcggcgtgaatttataggcgggaagcgggtccatcactccaagcccaagcaagtggtctcttcttcttcttcggtgtggctgcctttgtgggccctgggccgaggcccacatgcattgttcacacttcagagagcttctagaagcattgaagacacaagactacctcaaaggaggagaataatgagagcctcaagtcctgtgatcttgcaatcaaaagatcttgtaagatcattgacaatctgcttacaaatgattatacactactagtagtatttacttgacaaattcattgctttgattttgaaggattgatgtctacaagatttttcaccgtgcgtcttggattctgatctcatggtagctactgacataaaattagtccgaactagctggtagcccgcgcaattgcgcggctagcacccaaacaaaatcatatattttttaagtatgattttacttaaaatttattaaataactatctcattttcttaagactttaaaagaccaaatcttatcatcctcgtgtttctaattatatagtttttaaaagtaacaccagttgctacctcttatgtcatctccttctttgtttgcttgctcgatctaccactatttctattcatttttcttggaacctttaaaaattggattttatagtttttagagtttattgtcacgttgggtttcgtttttataatatctagatgtcctgtcaaacgttgccattatactcctctacggcccatccactgtttcttctctttattgtcattaagattttaaaaatcgaacataatttatcgtttttgttcattttttactttctagaagtcccgccaaaccgtcatcggctttgccattgtactcctctacggctcgcccactgccttccttcgttattgtcattgtgattttaaaatcgaacatgattatcattggtttttttttactttttggaagttccaaacctttaaaaattcgacgtggaggttcattttttttataatttttagaagttccatcaaacgatgccactatgcccttttacagcccgtccggcggctactctttattatcattatgattctaaaaatcaaacataactattgttggaattcattttttattttctagaagtcccgtcaaccgtcggtggctctgcagctatactcttatacaccctgccccctgcttctcctttttattgtcattgagattttaaaaatcgaatatgattatcaatggttttttttttttactttctagaagtcccggcaaccgccctacttgtttgctttatggcctgcctgacgtccttccttttaatcgtcgttaggattctatttggtattttattaataatttttatatatcgtatcaactgtcaccactctactcctttataggcatattacttaatttatctcgtcatgtcgtcatgtgctttagattgttttttctttcaataatctttatttttatcacaaattttagttatttataaattttattcctaattgaaatcttattttcctttttctaatttcagaatttatttttaaaaaaaatttagttactaccatattgtgttcttttaatgtttttattttttcattttcaatttcaattgtttcaaaattgtattcatacttgaactttcttttaatttttctaattttggatattattttattttttttcagaattttaattaatctcgtattgggttcttacttggattcttcttttaatattccttatttttaattccgaattttagctatttttaaattgtatttatacttggactctcctttccttttctaattttagattttattttatttttatttcgaattttgattaatctcgtattgggttcttatatgaaaacttctttcaatattgcttatttctaattccgaattttagctatttttaaattatttttctacttggactctcctttccttttctaattttggattttattttatttttatttcgaattttgattaatctcgtattgggctcttatatggaaacttctttcaatattgcttatttttaatttcgaatttcagctatttttaaattagacttctacttggactctcttttttcttttttttctttttctctgattaatgtgggaatttctagcccccacagcgatcatggtgtcttttttcaaagctgttttaataatataatagattccatgtgaatttaacagtggcgtaattgttctgtttctttactccatggttctaaattccatttcagaattcagttatgaggtgacaactgtcgagatttgacatgctgaactagtccaagccaatatggaactggtttcagaatgggccactcgaattgagacatttcaacaaactgaatctttttttgtttctcacttcaaaatcccaatggcacttagctcacatcatttcatacgctgttagccttatgttagcccacctgctggaaaactctgctcaaacctcaagcttcagcaggacatcaaaacaacaaaagcaacaaaaagtaactgctatatgtacagaatttcagatgcagaaaaacagtgaggctgttgatttttgcagaggaggagggtattcttattcttcagggttcagaatagcagcagcacaatgcacaagcatcttttctctgtatacattgcacttcaatcccattgtgctctgtgactctgtcctcaactccacactgcaaaaagggctttggtgcactggcacatccatgcaagaattattaggcttcttgtttattttttatttggacagacagctgaattctgtttgtgaggagcctcataaaaaaaataccacttcaatttggaaagctttatgaggagattaattaattaactaaaattgctatggatgacaaaggagataactgaatcagcagtggcatgaaaaaaattgctggtcagagccaagctgcagctgctgcagggtttgtatagtgttcttgtattgtacagggttgagggttccaactccctttactagcactagttattattacatgatggaacatgtcatcatctcatctctgctctcttatacttaattaattaactctcttcattaattaatcactcgattaagctataaactctctgggtgaagcagcagcatccatccaagaaaattaagaagaaatgaaacttaattttccagggttaatcattaattgacccttcttgttcttgtcttggatggatcagcagctctagctagatggatacttggatagctgacgccgccggcgatggcgatggcgacggcgagcttcaccttggcttgaggcggtccaaggcgaggtaggcgatgacgcggtagccgacgaggaggagcgccatgacggggacgtcgacccagtggttgttgagcccgacggccttgatggccgggaagtcggcgacgaggcagcgcgcgccgccgccgccgcagtcgtagtgggcggcgccgtcgccgaactggatgccgatgaggaggcggtagcagtagaagctgtagttgagccaccggagccagccgacgaagggcgggatgtgctggacgtagtagccgccggcgatgaggaagaccatggtgatgacggaggcgagggtggtgccctgctttgacgtccatgagcacggcgccaatggcgagcccgaggctctgggcgacgaggacgctgtagaggaccacgaggagggagaggaggaaggggccagggcgcgggtcgaggccgcccatccagtagaggatgacgacgaaggcggtggggagggcgagctccatgggtaggtcggcggcggtgcgcccggcgaagtaggagaagaggcggtacatccccgacgacctctccttcaccagcatggggcgctcgagcgggaaggtgaacacggcgttgtagagcgggaagaagcccc

SEQ ID NO: 77090 - DNA, 638 bp, Oryza sativa
accaccccgcggccggcttgccgatcttcaccttgtacaccacctcctcgaactgcaccaattatcacaaaaaaaaaagcatggtcacgtctcatcaccaacctccctcatgcacatatgtcaacatgctcatgcacgtagctctacaagtacgtacgtacgtacatacatacatacccctccgtcccaaaaaaagatcaacctagattcgtaactaggaattcattttttttgacagagtagtatatatgtatatatacacaaatgtgtacttgtctactcaccttgaggacaagagggtaagagttggcggcggagtggtggccggaggcgacggaggggtgacttgaggtagtggggtggacgatggcggcgccggaggtgttggtggaagaggacgacgcggcggtggcggtgggagaattggtagaagaagaagaagaagaagaagaagaagaagaagtggttgaaggtggagaactgaagtcgcggtggtgaccgtcaccggcgccgcccccgccgctgccagcgggtgtctggtggtggtggtggcggccatgatcatcgccatgcaactcctgaggcggcatggcgatcgatcgatggatgaaaatctctctgtctctcgggtgtttttc

SEQ ID NO: 77091 - DNA, 787 bp, Oryza sativa
acatgtatagcctatagctactcatcagatgctaagcttacaagaccctgaggtcaccaaagtacacgtctaccagtctagtactggcagtggcattgcgcagtgatactatatatggatattcagttgggccttggcattaacacagaaaagcagactcataaaatatgatcacgtgatccttactgcaagcatattgcagtactctatatttgttgaaacaaataacatgctgtataattagaataccagtaaagagctgcttaggctttattttgtactttgaaggcactttgtatagccttcacttcagtaagtgctgttctccataccacaatagcacaagaagaattgcttactattaaaaaaactaatggaatggattgtcacaagtaataatgtacaacatatccacatatctattgaagctattaaagacaaaaaaaaaacatttttactacgcagtagccctatagttcctaaaccaaggtcagaaggagaaacaacagtcttcagatagtacttacacctatttaacgccaaggaacttaatcctttgcaaagaacagtgagtctagattcttttccacagaaaggacctacattttagtgatgaagtatgctgcgcaaagagcatcatgtgcggaaatcctctgcagaataaataaaagcagaaaggtattagattgtttccacgttcaagaccccagtaaaaaaaccttaagaatattcttctatagagagtacaattgattctctaaatcatagtataaaagggctgcaggaa

SEQ ID NO: 77092 - DNA, 1769 bp, Oryza sativa
cagatatctgatttaatagtataacagaaaagttaattatccacaataaaaagggaaatttatctaggttcattagcatcaatatgaatgtgagaaatgctagaatgacttacattgtgaaacggaggaagtatatgtcaagccataacacatcgaccttatacatgaacaagttagaaattagagacaatccaagaaatatcattgacacacgcccaatttctagaaatgttatcgataagtgcgagttccatgaaataccttcgtacaaatgattttgtcccaaaaatacgacgtcgttagggttccgtccatctcgcaccgttaaattaaatacactatttatcctatagcatttaatagagagttgctaatggaactctaatagcgatgacattttcgagacaaaatcgattgtacgatggtattttatagaactcacacttgtcaatgatatttcttggattctctataaattaataagagatcatagctaagcctttgcaatatatgtatgcatgcgcaaaatttaattacaatgaccagctacagttagtttgacatattccatgagagaaaaggagtcaacttgctctaacttttggaataatttatcgaagtcaatcataataacacggatggttaggttaaaaaccacatgagctcgatctggttaaacaaccacaacgacactccatcatgcatttggatcacatgcaacagtgcaaggcctaattaataagcacatgcgtgcgtagggcgcataaccaaaatgaactaattgcgctcttaggaagtggtccatatgtgtagtactttattttaactatatataggcatataattaattaagcacacgttgccgcgcatggccacacgcttaattactttaagctagctagcattagtagtgatagattatatatatacttaaaatgtgatgtcctagaatgagtataaatacagttaaattatgatatataagtacatcgcaaattgttgttaatatataaaaacatattgttgacattttttttacttggaccacttcagggggagtaattttgagatttgatacgtaaaatagtggtgtgtttgcacgggtagattcttcattttttttagataatagaaatgggttacatctctggcctctatccataggcacacggccaacgattatagagtatacatttatagttttaataatttttataaatacatagttaagtaacctctagttcttatagttaagaaacacattattaagaaactagtatgtcaatgccttcgtacaacatactacctccgtcccaatataagtgcagttgtgagtttccatacatatctggtatttgatcgttcatcttattgaatgattgatattattattgttattagatgataaaatatgaatagcattttatgtgtgaataatttttttaattttttcataaatgttttaaataagacgaacggttaaacattggacacagaaacccacaactgcacttatattagaatggatggagtaaaacagaacggatgtatactagctgaaagtgtgttcaatttcaaaaaagaaaacctagctagctagctagacctaggaaacaaaaggagtcgagataaataatattgggaacgagtgaacgacacccaaaagtaccaacattgctttgcaagttggcatgtcacatgtgtaatagaggtgtggcaaaatagattattaagagatgatctattgaggactatgaaaaaaaaaggaa

SEQ ID NO: 77093 - DNA, 6936 bp, Oryza sativa
ctatgtattttttttagataatagaatttatttcgtctttagcttcaaaaaaggtacaacaaactgtttcagatgttgtagttcgaactactgcagattataatatcatatcttcattaaaaacaagaaaactaccaacacctattgctaaacctatatctatagttgacgaaaatgtacataaccattgtttctgcgtagaggcttgcaagttgcatgtagtccttgtctttatcaaaaaccaggaacaaaatctccgaaatcagcggctaattgttatgctgatcgaatttcgtgcacatcaccaccaacaaccaacatcgaaccgaagcaaaagataaccaccgccacaaccattggagctgacccgacaaggatattgacaatggttatgaaggttgccactagacagatgacactcccatcgtctcaatcactggatcttgcagacgggacctcgaccacgacctgagctagccaatcattgtcatcgtatattagctcagccttgacatgcccgcgaagtcacggacatgagcttacaacatcggagccgatgccaatgatggtgatggggaacacgaggtgcgtgaaggaaactcaaagccaaagtaatagatgagcaagttgaaatctccatggtgccggggaatacgtactatctccattctacgtgcaatcaattctttaattttgaatcatgataatagattaaaaaattaaaatggccatagtatatggatgggatgcaggtctcgagggttggtggaatgataggacccactaagaatatatcataaaaagtaatagggtaaaagtcacattttacgtatcctatacagttctaccaaaataaaatggcaacatcaaattggggcaaaatagaagatcacactggttaacgtcagtacgtcagcatacttgtactttcggttgtatcctttgtaataatatcaaaattattaaacacagtgtggcacatgccctataccacatagctagctagctagctgctacacatccatcttgtgaaagatcgtcgcggcttcacttctccgcagcgacaaacaagggcaaaaggcacaaaattaaagcacatattgattgattgtatgtacgtacgtacgtacgtactgtgcacttgccttttctcaaacgtgcttgttaacatcatatattgggcagcagtacaatattccttctaaattttgccaccaaactgtccgtttccaaacctcttgttttgcattgcaagcagtcttgcggctctcctcccacacggagaggttgaccattaccagcatgcgtgttgttatccatcgcaaattaaagctgatttaaatcatatcaaacaacacgtcttccgtgcactataagtataatctctcactctctcctctttgatcatcatcagctcatcgatcactagcatagctagctggctgcaaatctgcaaaatgaatatgatgagtaactaatgcgtacataggagagtgtgtttcttgcctatattagtgattagttgcgagcttagctagccatggatcatattggaattagcggcggcggcgagggcggggtggtgtctccggcgcagccgtcgtcgccggagcggcggtacaagggcgtgcggctgcggaagtgggggcggtgggtgtcggagatccggatgcccaacagccgggagaggatatggctgggctcgtacgagtccgccgagaaggcggcgcgggcgttcgacgccgccgccgtctgcctccgcggctcgcgcggcgccggctcgctcaacttcccggagtccccccctcccgacgtccgccgccgcttccccggcgcggctctcacggtcgagcagatccaggccgaggcggcgaggcacgccaaccgcccgtttccggcgaacaccgccgccgccggcgggtcgtcgtcgtcgtactcgatctcgcagcggcaagaagcagcagcccctgcgcggtcgacgagcaacgacgacacggccatgtcgtcagtgccctccaccgacggcggcgctgccgactacgacggcggtgatgatgtcattgactggtcattcatggacacgttgccggcgatgtcgtcgtcagcggctagtaccaatgctgatctggtcccggccatggatgatttcatgtacgggttcttgcacacaatgccgccatcgccatgcgaagacggtggggaggatgtgatgatcgacggcaattgcaacatggatcagacatttttctcagtagatctttggagattttgatcctagaaatctactagcaactggtacccaagaacacaaatatggcggcggcctatatatttaccgcagtcacattagcattctcaccagcatagatacagcatgatacgaaattaattaattagtgcattgtgtataaggttcgatttgtatttgctgtgctatacgctgcgttgtgcttatttttaagttgatatacttataatcgccgtacattgttttacggatcaaattatagttttaaactagttagataaataaattaaaatatatatgttaccatacttccagtttttcatagttctcaactttttttatttcctattttcaaactgtgatattacaactactaatagaaaaacaatttactactacgaggctgattaactacaggctgactgtattttcagttggggcggcctggttgcaaaacaatatgattttcgtaaacacatgctaagtggcgggctgtctgcgtaaagcgatttgatcgcctgaaaaaatggttttcatagtatcgaacaccaaaagaaaataatttccaaatatgaaaatgtgtggttgtatccagtggcggatccagaacaagatttaagggggaactcatttccttcttcctttttcagtcccccctactcttaattttcttcctattcttttcctttcatctccccctttgttagtggtgatccagcggggtaggggggactcaagtccccctagcacctacgctggatccgcccctatttgtatcagactatatcatactgcactgcaatactaaatggagcctaaagttgggttgcattcatcgatttgcagattcttccgtgggatatataattaagaaagtccaaaggaattaattaatcacttgcaagttaatcacttgcaagctccatttctagcttagctagctagatgatggtcaacattgatttggccaagtaagatgatgtctatgcctgtgctgcttagatccaacaacaacctcttgcttctggtaggaatccccccatccattacagtcatggcgaaactcagtggcggataggctaggtcatggcacctgcaaattaaactgagaatcagtggaggtgctcaaaaggatcccatggaagtgaataatggcaaagaatgctactgatcattgtctaaattaatggggatggactagacctagaggaaggggccggggtggctagaagccagaacaaagcatcggggtattagagtatttcttccgaaagatggtaagttatccactacctcaaaacatcggattagtgccagttggtactatatttattttttataagatggagggagtaacatttgaacaatatatgaatgcagggcatcaccaatatatatgaaccaactaatcaataatgctattcggattcatagtactaaaaatatgttacatgttgtactctctctgccctataatataagggattttgactttttccttgtaacgtttgagcactcgtcttattcaaaaaaattatgcaaatataaaaaacaaaaagttgtgcttaaagtactatggataataaagtaagtcacaaataaaacaaataataattctaaatttttttaaataagacgaatgatcaaatagtgcaagtaaaatgtcaaaatcccttatattatggatggagggagtataagatttcttttttatgagatgaagaaagtatgtcctaacatcttaatagtacatgcatgcagggcatcaccaatgtatatggaccaactagtccatataaatgggacccacacaagtgaactcttcttgtttccatttccacaatgtatagcgatagccattggcattaagataggatatactccctccgttccaaaataaactaatctaggattcggtgggacatcacctaaattggttatgtactagatgatgttccaatcaatcctagattgttttatttttggacacatggagtacatcataaaataatcaatctaactaataagagttctctctttttcagtgaccttggtcctcgttttatatcacggtggcatgttttttataaatggaccctgcataggggtaaggtgtctttttggtcttgttgcttcttggtgactgggcccggttgtcaggccgtgcgcctgccgtcggaagaaagtgtgcgatgactgtgaactaaacgtgcgacatagtactcaacagtgccgcctatagcacacgccttttcgcataggagagataaaggcttgttgcagggttggtatgtgttgtcttgtcgcgtgttgtaccggtcctaggctaggttggtataccccagatacttgggaacaggtgacagatgtgctccgagaaccgcccacggaggccaagttctagagttcatgcccgaggggcgaatgtgccccgagcatcgcttgggggggagggggcgcccgaggtgcactgacatagcccacaaaaggatcatgcttgtgggggtcatgcctagggacgaatgtgtctcgagcactgccacagggagcatcacatgggagggaacaagtgtgcttatagctagttagagaaatgggaacatgggtcgaccttacaattaatgtgagacaaaaataatacttatagcttatctgagaaataagaacaaaatccttatcgacaagttataagagtacttttgtctcacattatggatggccaattagccagttggccttcattttattttgagactgtcacacgttgataagcataaagtgtcaggagacccatgccgttctcttgtttactgatgagaagtgtattatataagtgcaaacctatagctagtgtgcaacgcgtgcgtttttgtggtttcaaattgcaggcacatccccgtggttgtacgtgttcctgaatttatatattcacacaggcagctgaagtcctgatatacatatagtttatttgatcaacagcttggctcctcggaactgaccatgcgtcaacaggcagggcccgtgatgccagtgacgtacgcaggatttattaattgagtatacattcaacaattatataattacatactccctccgtttcattaaaaaaactaatgtagctagtaattaatgtaacacatcctaacactacgaatttggacataattttgtctagattcgttgtattaggatatgcgccactggtggagaaatcatctttcgtcggtcgggcgaattccacaatagttccggttgcaataaaaaccggaacttggcgatttgatcatctttagtcccgattaaaaagggtaacatgcatatttgatcatctttagtctcggttcaaatgctgtcagggcttgtcaggccccccgggatctttagtcccggtttgtaacaccaaccgggaataaagatcgtaactttagtcccggttggtgttaccaaccggggctaaagatcccggcgatctttagccccggttcataacaccaaccgggactaaagttccacccctttatatatgtctttttcctccttcagcccgagcaagcttcaaaatttcttcaaaaaagaggggaggtcatgccaaaatttctagtgaatttattttggtgattatatacaaatcagaggtgcctaaaaggttagcaacttcatcctccaatgttttttttgtcatattacatttggagctatgttttgctcacttttttgtctccaaaattttgttgttagttgatgagagagaaaatttgtgtgggaaagaaagaatatatagaaattttgttaatttgctaaagaaggttttataaaatagttgagaaggaaaatatagtgaaagttaatcttaaataatagaaaacaaactaaattgaaaaccaaaagaagtacaacacattaatattagtttaaaagttcaaaaataataaataagaattatttggtggaatattttataatttttgtatgaataatgatatgtcattattgtatgacctttggaagagtttgtgattattttattattattgtatgactgtcattattgtacgaataattatttgtgtacgattttttttttcatttcatgtagatggatgggcaatgaatgacgctgaccggcggtctaaagagtttattgtcggcatgcattattttttgagagtggccgaagctaacaagcataagggttttatttgttatccatgcaataagtgtaagaaccagaaggagtattctgcattcaggactattcatttccacttgtttaagtcggagttaatgccaagcgataattgttggacatctcacggagagcaaggggttgaaatgaaagaaaatgaagtggaagacgacaataatccggactttgcttagtacgctggatttgaaggaaatcaaacgggcgaggaggacagggatgctaatgataacgatgttgcggatgatcttggtcagatgttgcaggacgccaaggaggactgcgaaagtgaaaaggggccccataaattagacaagatgttaaaggaccacataacgtcgttgtacctaggttgcgagcaggggcacaaaaagttggataccactgtggagttcttgcaatgaaagaaaaaaaatggtgttagtgacaaggcatttggcgatttattgaaactcgtcaagaacattcttccggagggaaacaa

SEQ ID NO: 77094 - DNA, 2119 bp, Oryza sativa
tgcatgattgcactgaatggggagattgcaccggatacttccccatgctgacattagcttctacggacagcatggtcaaaacacataaattacatggtgtatatcaactatcaagcatagctgttatataatactatcatgctattggttaggaaaatcatgtctaatgccacatacaaataagcacagtaaatggtttctcatcttatgatacaagttattgcagacaaacttacgttgaaaacagaatatatatagcacatataaagcagctttgaaggttaatccacacattgccatatcatatgctaaccacaaaacacaaaactaggtgaaagttaactcttatgttcattgtaagaaaaataaatatgaaccccacaatgtattcattacatgcatgactacctatttatccacatcctcccggtacaaaaactaatttgttttagtatactgcacagcaacagaggggaaaaaataatgatatagacttcaaataaaacggctaaacacaaaaatacgcttaccccacaatgcagaagttttgagcagaggtgggacaggtacatcatcatctgacttctttacactcctgaaattcaaaggaaaataatatattcgagatgcataaagactaaacagtacaaaaatacaatcaggtcaaaaacatattctgcatttttgggaggaataatatgagtgtatcatgtacatttaaatcagaactcaacttagatatccagcaaccagcatttgaaaaggattagtataacatccagtgtcgattgtcaaatgtaagaataacaactaaatgaacttgtgcacagaaattgacttgcatatttgatcttacgaacttctcaataactgatgtatgcatcacagcaattaataagctttgatagaaatgcgttggtgttaatatgagcatttgcatatgttagtgagattgtttttattagtaccattccagattatgaactaataattaagtaccaaggggatccatacaatgtatatgattattctgttaaactctaattttgctcatgtcaatatgtgatacatcgtgatctaaatgttatgatggataatcacaaaatgcagccgcatagtaattattaagtcttcctatatctcctgatgatttacagaccttgtctgaggctctgagccctctacttagacgcataacaatttttcatgttactatcaattgtaactagagaagtatataaatataaccttaccatgcatggaattacagtaaaatatgtcaataaactaggagcttaagtctttcgttttcttagcttcagggacatgaaatgttcttgtttttacacccataaaactggtcaaagtaccagaacataaagaaaagtgagataccttttggcagtcattatcaagttcgcaattccttgacccacaagaccacaaaagaatccaactgtaccatataaaataccctgttcgcaaaggtattttagatattagaatatacaatataagtcagcatccaaacacgaggtgaaattaaaaaagagatgcagcaaacacaaaagaaaattaccttaaaaaagtatgttcctatccgttgttgaatggaaaaactatatcctggcctttcagcttcaaacacgctgcaaaacatcagtttcatcagcattacttaggacagatggtcagatgcactattattattttttactgaacaaagttctcataagcagatgtaattaacaaattctgtatggtgtttcaaaactaagagctaacatcaaaagattcaatctatttttggtaatattgtatttcacagcagttcaaggcaattaattgactcattaacatctagaacattttgaaacatatgttacaaagtattcagtgccacagtataatatagtccataccactcaaaagtagatgccattttagactctagtgcaggaactaatgtatgaagtaataaaggaaaatggcagtgatcaaatatgggaagggtataagcaaggatggggctcaagttaaaattctcaagaaaataatagaatgttctgtgtttaaaaacaaaattagaaggctaaaatgagatgtatttgaaacagat

SEQ ID NO: 77095 - DNA, 8212 bp, Oryza sativa
ccaacaaggggtataaggcttgcacttattgtatggatgaaacagaaagtacgtatcttaagcaccgaggaaggttgtgtacatgggtcatcgttgatttcttgctgcaaaccacccagtatggaagaaaggcaagcactttgaacataaggtagaccaccgtacgaagcctaaacatcgcagcgggaaaacagtgtttgctatggtgaaagatcttaaagtagtatttggaaaggggcctagcagctagcctatagagagcgaagatggtcacgcggcgatgtggaaaaaaaactccatattttgggagttaccctattgggaattcttggacgtccgccacgcaatcgacgtgatgcacctcactaagaacctttgcgtaaaccttcttggcttcctaggtgtatatggaaagtcgaaagatacactggaagcacgtaacgatctgaagcatatggaacaacgcggcgaccttcactcggaaccaaaggagaaaggaaggccattacttgagtccagccagctacactcttagcaaggcagagaaggaaagtatatttgaatgcttggagagaatcaaggtaccgtccggatactccgcgaatataaagcgaataataagcacgaaggagaagaagttcacaaacttaaagtctcgtgactgtcacatgttgatgacacaactgctaccagttataataaggggtatcctcccaaacaatgtccgggcaacaataacaaagctatgtgctttcatgaacgcaatttcgcagaaggtcatcgatccggatagattagaaacccttcagaatgatgtggtgcaatgtcttgtcagctttgagttgatatttccaccttcatttttcaatataatgacgcatctgctttgtcaccttgtcaaagagatcggtattctcgggcctgtgtacctacacaacatgtttcctttcgagaggtacatgggcgttctgaagaagtatgttcataaccgtgctcgtccagaggcaagcatcgccaaggggtatggaacagaggaggtcattgaattttgcgtagaatttattgaagatcttcgcccaatcggggtacctgaatgacgccatgaagggagactacggggaaaagggactctcggaaggaaagcaataatgacggtagacaacaatttattccgtaaagtccatttcacggttctgcaacaatcttcattggtggctccttacatcgaggagcacttggctctagttcgcgccagaaacatcggtaagtccgatgcatagattacacggcatcacattgatacttttcccacgtggctgcgataacatctcatgggcaacgagacgattaaccaacaactggccttcctggcgaggggaccatctggctcgatcgtgacattccagggatatgaaatcaatgggtacacattctatacgagagcccaagacatgaagagcacaaaccagaacagtgttgttcgtatcgatgccatgggacacgatggtacaactggcacgcattacggtgccatcgaggacatatgggaacttgactatggacctctcaaggttcctctgttccggtgccaatgggttaggttgactggtggaggcgtaatgattgatgacagtgggatgacaacggttgaccttaacaaggttggatactcggacgaaccttttgtccttgccaatgatgtaacgcaagttttttacgtgacggacatgtctagcaaaggaaagaagggcaaagggcttgacgagccgaagcgctacgtggttctcctagacaaaaagaaaaatcgtcggagtagaggacaagactgacgaggattacgatcagtttgatgggcaacccccctttcacggtgacgattgaccctagcatcctcctatcaaatgaagacaccccttactcacgtagcgatcacaaggaaggaacaatagtgaggagaaagtacgtgccgtaaatcgttaccgccgatgtattgccgtaattgttgtgtacacgatgtaaactattttggatatattgaatacccatataaatcaattgttgtatggcatatgttaattatgtatgattattagaatttttaacaaatttaaatcatgcatatcttagttatatacgctaattagaatttttaaaagttttaaatcatgcatgtggtatttacatatgttaattagaatttttaacaattttaaatcatgcatatacaaattatatatgattattagaatttttattaattttaaatcatgcatgtggtatttacatatgttaattagaatttttaacaatttaatattatgcatatgctaattatatatgattattagaatttttaacaattttaaatcattcatgtgcttattatatattatccacttaatttactacagacaacaataatttttcgaaggttttgtcattaattttttgactttaaataattttaatgcattatttactattttagaaacacatatgtaatgaaattcaatattcaatgctattatctttagtcccagttcttaaccctaaccgggtttaaaaagaatttggaaatagcgggaaaatatctttagtcccggttgttcttacgaactgggagtaaagatatctttagtcccggttgttctcaccaaccgggagaaaagatctatgggtatatatattcccgatgtgccctcgtcttctccaccaacacttagaagtttttcctccgatctcggcttctccttcgccgccactgcataggccttctccttcgccgccgtcgtctctcgccgtcgtctcgccgtcgtcgccgcctccgccgccgacaccgccgccgcatctctggggtgatcagagccgccgctgcttctctctctctctctcgatctctctctctctccaaaccactgccgcctcgttgccgacgccgccaccgacatcaacgcggccgaccccgactccgcctcccgctgatgccgaccccgacttcgccgcggccgccaccgccgccgacataacatgcacgcggccgtcactgccgacgacgccgacgccaccgccacgccgccggccccgcctgaagctcggcacgccaccgtgccacgccgacgcgatgccacgccgctgccgacgccgctccgttgccaccactgccgccccgtcattgccgaacgtgaacgaaacgtgaatgaacgtgaacgaacgcgaacagaacgtgaacttacgtgaacgaacacgaacttaacgagaacgaaaacgtgaataaaacgtgaacgaacgcgaacgaacgtgaacaaaacatgaatgaccgtgattgaagcgtgaacgaacgcgaacgaaagaggacgaacgtgaacgaaacgtgaataaaacatgaacgaaatgtgaaggcacttgaactaaaagtgtgagaacgaacgcgagcgaaacgtgtacgaacgagataattaaacgattattaaacttagcatgcatatatatatatatatatatatatatatatatatatatatacttgaaaacgtgaaatacaatatatgttcctttgcgtttagactaatacatttttttgcatgttgcagaaaagacgtcgtcgtcgtcgtccctcaaacctaagtggtagctagccctcgaaggatttcgcgcatgcaagtgatttagagatgtgattgttagagattcaatataagattcgtagtcccggatttaatatgagatttaatattaaacattatttcacccgggactaaagatagttatctttagtcccggattcatagtcccggttgtgggctacaaaccgggactacaaacggtttttccaccggcatgccacatccaatcctatgtttgtttttcgtgggatggagagagtatgtattacgtctaatgtttaataatgaacttgtgttttgtgttagaggatttaagtttagttgactactagaatataaatattgtgagccaaaagtctaggagaaataaatttggtgaagaaaaaggcaaaaaataaagtattaggcgtagtagtttcttttcgaattaagatttagattttacctcggttctcattagcacgttttttaaagtaataaatgatgtttttcgtacgaaaattttatatatagaagttgctttaaaatattaattatctatttgtcaagtttgttctaattaaaatttaattaataatatgctaatgtcttttttgttttacatgtaccaacttaatcttcttcttccatcagtttcaaacacccctcccgtaacctttttttttttctgaaatttgtgggtaatcctgtacatacagtgaatacccactgtgtcggccactgcgtgatgcagtctgagaaatgctactagatccaacaaacacccggccacttgaatttatatacttctaaatgcaaaggagagctagtgaaagatgcaaagctatagcagagatcagtactaaagagaataaagagaataacgcacgcatgctagctaggtttgctaggctttcgaaagctagctctagctgcaactgctccagtcacggagctctttcgtcattagtactgtttgttaatacaggagtcacattagtaggtttcaaatgcattagatcatcaatcagcagtcctagactcccagccagtagaaaaggtacaaatatatgaccagattttgcatgtgaaaacacggatgtgctaaaacacacccaaatttgtaataactaaaacacgttacttacataataaaatgtttactgcaaattagatcgtccttaaaatatctcttcatataccctttttattatgcaatactcatagtaattaaaatctttattacaagtagaattgcttccgaccagtcattcttgatatatcttcaaattgataaagtcatcatagatgtcttattatcaatagatatatgatctaccattgaaagaagtaggtaaaaccccgcgcgttgctgcgggagtttagtataatatcaataggtaaaaacaaagtgtaaaatatatagataacataagattacgtaattatgtgggatgatgatttaacatacttgcatttcaaaagctctaaaatttaataattataaaattattgaaaatatagtatatttgcatgatgcttaaatttaatgattgttagtggatgatgatgtgacatctttgcatgttaagctttagtagttagtgggttataactttatactaagagaggataacaattaatccaagcattcatattaaacctagttcttaaacccagatgagctggttgcattataagaaacatattaattagttgagttacgccatccgcaatccgacggttaggggagagagacgaaagctgaaattgcacaacaccacgtggaaaggctatttcacgcgaatccgtatagacttcggcattataagcattactttatctcttttacattataagatgttttgatatttgaatagattcatgtatatgtttcttacatgtatccaaattcatatgaatgttagtgaatatattggacccacatttcagtgtgcctctctttttgcacacttacctctctctcctctacgaggaggagtaacatccgccgtgctagcggggtcatcgtttaggcggctccctccttgatgccaccgtgccgaacttaacaccctcgcatgtactccactgcgagatctctcccttctcaagcatcatgtggagtcgtgaacccgaagcagccaccagcagcagcggctgcgccatcgatgcactcgcacgcctccctatcaaataacctacccaacttatgaatccagcttgataagtactccctcacattacaagatgttttggcctcttcatctctcttgtagattcactaacatcatataaatttatgcacatatatgaaacatatatgtggatcaatgtatgaatctattcaaaacccaaaacgccttatagtattatcatatgaaacataggaaatagtaccagcggagagctagaaccgcatggaggccatgaggccatcaaagtcgccgcacatctgtggtactccgagtccccaattataagagtgcgtcgaggacatcctcatcaacctctacaaggtcacccagcaagatacaaccatacttcttgtaagagctactggcggatgtaaggggttcttgggtattcccgagaatattcaaaatactatgaaacaaaattagtatatataggtatatcatatatccatatacttaatttgacctgatacttgattctagattttttcttaacaaatctattcttcaagacttcaactcacaccacttctaacatggtagtcaactatctcaaatcccctaatcaccaaacataagggacaatatacttacaatgttgagtgaatatctagtcttaaaatcctgcatccgtcattggtaagagagctcacatttctcatttatcgactcatgaagcttcaactgttatcttggtcgtatcaattcaaatcaatatagttgataaaatttcttcttgtcaatgatgcacgcatcaattaatcttggtgggcgctgatacaaaagaactacatggaagcaaaggggacatactgtcgagcgttgctcatcaagccgaacaaaaacaagatgtgcaacctaggcatctattgctgctcctccgccgttgttgctgctattgtgtgacatcccaacccaattagaacatggcatgtgtggtccatgagagttgtgtgcgcatatttagtaccatcttgctagtttagcaaggatggaaccaacttataatggattatccctccaaccatatctcctgacttaaaccttttacacgaagcaagaaggaaagtgtaagtggggtggtatttataaatgggcccacccatcggatgggctaggctatgcgattctggagggtggactattacatatcaaagcacaagctcctctagtgggaaggctagatacccttggaagttcatccaaggtgcacgtacccgagctcgtgttagggtcgagggtcctgtaaaaatgtggacaagcaatgaatacatcttcgggccacttgggagtgtaataccctattcctatgttcatcgctatatgatgaagtttaccatgcgttcttagaagttgttttgagtgctaagggatgaactcaccctccctcagctatagcttgaacctaacttagttaaaccctcttcttagtggcattggtcctccttttatacgacaagggggtaccatagggcccatgcatgtgtacataggtaggggctagctcataggagttgataggattaatcttgtcattgtccctccaagagagccggtcggatgtgacgggttgaccttccatctaacacgtggagtagggtagctgaagtcgtcatccaagctaccattgggcccatctgtcagctactgaggatgatgaaagggggttccaccgggtgagtgtggagcacgcgccgcgtcgcccacctttccttcggggtgatgtgggaaagcggggggaggcatgcaccgccacgtccctacatcatctgtgatctttccacatgaatcaaatcacgccgcaattaaaatgcggaatgatggggaaaggctgcacagagggttcggtcaaatctcctttatgatgtagattcaaccggaacatacctcagggctctagcccacttccagaggacatcatggcctcgggctgatgctagctagggcccaagctgatgttgacctcgggtcaccttccttgctttgggaaagtacctaggtccctgcgtcagttctccgattactctggttactaatgtggtggatttccataaagatccatcgacaccactaggggtgggcgttcgatctagaccaaaaatctggtctagtcttttcgatataaaaataggagactggaataactagtagaaatttgtaaattggtggttcggttaaccgaaatttcagtctagtcttcggtcttactgaccagattgaaccctcctcaaatccccatggcatgcagggaagcatgccagctttgagaaaaatcaaaaagataacttagaggaagattgaagaacatcccaaatcaactcgatgatctagtgaattagaggaaaatcaaatcatgcaatagaatgtgggacggcggagaagtgaagatggatgcccgctaagtcgcagcta

SEQ ID NO: 77096 - DNA, 11109 bp, Oryza sativa
tgtagtagttctcttctcaatcaagttgaatttaaactactccaacaaaaaatgcaattttgggaaccactagtctatcatatcacgaagaggtgacctaagaagaaaccaatgccaacaaaatgtaactttgataaccactagtctattagatcaagaaaggatggtttaagacaaagctttactctgccttccaaattatgcattgtccctgacttagaaatgagcagtggattaatttgtgcaaacttttttatgagtctatcttttgagctgtcatcttagtaagctgcaaataattatgcagtgtaattttatttatttgaaaaaaagaataaatctgatcatgtctgtttctgttttgtcctctgttgtagtgccaataatatatcaggttcatcgggcgcgcgatggaacaagctttgccaccagaaaagtggaggcaaagcaaaagggccttgtcattttcaccttgattgcttcattccaggtgtttatccttctggtacccagttttgtgaacaatgtacagcctcaggaaaattttggcatattagtattgatcaagcatttgattctctcgatggcttccattttgggcctgtttggttctcttccattgctagccttgccaattttttggcaatggcaagatttggcaagccaaaaaaattggtggaggtggctgttttgagtgataccaaaatttttagactaggctagtgcttaagttaaccaaaccaaaaaaaattggcaatgacaaatttgtggcttcattcctacaaaccaaatgagcgacatttttgtagcagtgcattatttggtaaggttgggtttggcaaagaagcaaacaagctcaactccctcccatcataaatatttggtgtttaggacaagaattattaaaacttttgaaacttcgaccatgaatagcttctcaaatgcttagtttaaaaacaaaaaatgggtatagacagatttatttttaaaaataatatcttaatatcatgaacttactagatttggtaagcctattctaatataaaactgatagttaaagttttaaatgtttgacaatcttgtcctaaacgtcaaatatttatgaccatagggagtaaaattttaactacacttttaacaatatattacagtaaaggtagtggtcaaaactgtgttgtggagaccacatcattgtttataaactttttttgtgactagagggaccagtagaatgttctttttgcaatattcaatattcatactgaacgctgtcaacgataacgaactgtttgaactcttgttaaatcctgaggaaatgtgtattttcatgtttatactactttatacattaagccaaaaggttcgtgagactaaatctgccagcagaagaatagatggtatctaacttctgcatgatcaattatgttgcagaaagacgaattagggtttgagcatcaagctgcaatcatgcctgatgttcctcctccagaagaggtaattttttttcctttcctgtaatgtatatgggaaagaagaattgataattaataggtaatcaaatgcagctcctgaatctggaagagatacgggaaagaagacttactgatcctcgcttcccaatgtaattttcatgacttccaaccatatatttgatgatgatagtttcctagctaatgcagttctcagatgattcatctttaatcttcagaataaacttcttttatgttattgagaaagcattatatttgtcaccatttatttctcggacactatatttgtcaccattactcagatgaatctagcatctggtattacataaattagaaattatctggtagtatttctcacgtttagtaaatcaagcattctatcttcttaagcttcaattataactgtatttggttcgtgccacagtcgcatgccacctggcaaagtcttgactgttagtcatctgcaggcaatataggaactcagctgccaagaaaaagttcgtaccttggcccatagaaatgaggttttgtgaagattcagcatctcaacataaaccaaggtatgtacacactgtgttttctttcagtgcagcctgctcataccttctctcctcccctagttggtgataactgataagtttaccacgaaattcttgtgtactttcatattcacgattctaaattccactgtgaaaacatccaattttaattccattgtgcaagaatttatcgcatttcctgctacattgcaatttaatacattgttctgattcattagtgcatctattccattatctaaaaaaatgtatccaatttctttcagcttaaattattggtttagagccagaggaaaactttctgatgatccagcactgcataggtttgccatctaatcactataccgtgtttcttgtattatagatgattgggcacgacattaaaccatggtattacaggtgtgttgtagcatatgcttcggatctactatattctggtgtcagcctaaatcctcatagggagaagggtctgaagacatactcactcagtcttgatcactcgtatgtttcagcaaaccgcacccagtactgcgattttaattaatacaactcgctagtaaaccgtttgtttgttactgttctgcaggatttggttccacaagcctgtgaaagctgatgattggcttttatatgtggtaagccattgatttttacctctcaaatgatacacaaaactaaatttctgcttgaggttcttatggcaacaccttcccttaataaacacagatcgacagcccatctgcacacggtgggcggggttttgttacagggcgaatgttcaaccgacaaggagaggtatatgccttcgttgtttcaaagcttagttcagttctgcattgcttctgtgatggaaatgtttatcaacttactatgatgtcttcgcaactgctttagctcgtcatgtcgttgacccaagaggcgctgattaggagggcgaagacgccaggacaaccgtcacaaaccccaaggccaaagctttgagaggtgcagaagagcagtattatcgtttcatttttggcactttcacagttattttccttttcaatggaagtctataacacgtagacgtgaagccgaagtatagcatactgcatatatgtagcaagaaaaaacgatggtaaaactggttctgtaattcacgaacagcttactgacataccacgtatgtattggatcgggaaaaataagcgaagaacttggtatcgctttttttttatctcaataaagccttcaattatttcaatttaagccttcatggagcataaatggttggataagtacacatctgataagaagtttgtctaagcacacatctgaatagttgatatgaaaagcacgggtaaaatttgtctgtgacgctcaggagatttactaatattccagttacaagcagctcctcgtgaaggattctcgcaatatttgaagtgtcaaaacaaacagtatgtcatcatcatgtagacacacgacattttacatccagaatcaatctagccgtggatgtccagtacttaagatagtgaaagcaaatcacacaaaaaaaaatcctacaaattcaacgttgtagtattccacacaatcacaatggtcggttgggattttgtcaacagccttacaagcaagagtggtgacaaacagctacatgttgctttctgattaaatacaagtagaaaacatattacaagccacgcctaactaaagctgtcttgttagtagaaactcccactacaaacttctgttgaatcccttttcaaactacatgctgctgaatcagcctattccaacatcaaaatgctacaaatggtatactgctgaatcaacacaaagacttaccatcaaaatgctacagatggtatgcataatgaatcatacaagaacatgttaccatcagtccatcactaccgtttagttttgaaaacgggatggatattcacattcaaatgctcaagcttctcgatctttgcgatagattcaccgattctcttcaacaccatgggcatagccccaatattcgcctcacttttggccttgacgatccttagtttttccttcttctcttggtcaactttcgcaactggtgttccagcaatatgctgcgatgcagttgtaacttctgcaatgtacataatgttgtcagcatctgacactggaattaccaagagaaattgccatctatatcttctacgttaatttgctcttttaattttttttacttattgatggcaatggcaattaaactgggacaatgcaaacttgagagtcatttttcacatacttagattaggttgcagtagagaacaggaacaggaaaagcctcacttttctatgtctaacacttcaacaacatactttcatggtttacagttagtgactggtgcaaataattatcatcaacaaacaggtttgatgccgaaatcatcgagcttgctaggtaactgaacaggaatctaccgatacgggaagggaaggtacattttcaatgcatactgtcaaccagggggtagggaccaaattcaccgattatcacaaccaaagaaaaccaaatgtcaaatcgcagtttagatccgataagtcgtcctctcttctttccaaatcaactgagccctaactaactggtggtaagtaacactagcattgctcgtatatacgataaaccccaagacctactatactaatcacgcccaaattatacgaacaccaacaaggggacgaacaaatcgaaaaccctagtacgccggaagcgcgcataccgaggaggcgggggcggagggcggtgaggcgggaggcggcggcgttgaggaggcgggcggcgtcttcgcggcggtgctggaggaggcggcggcccagacggtccacctcccgctccagctcctccatgtcctcctcctcagccgcctcgtcctcccgggccggggcggcggcagcggccgcggggaccttgcgcttccggtggctgctctgggctccagttcggcttggggtgagcgaggcgcccgccatgggggggagcttggagcacgtgaagccgcggcgagcggagaccagagagagatgctcgagcggaaggagcggagcggagcggagaggcggattcaatttgggaggggggagagatgggactttggatgagtgggacccacaaggccacaacggggaagaattcgattttgaaagtcttcgagaaaacacagttcctgcccctggacacgcatgtcagtactagtgccgatcaaccgcaataatactgtggccctgtttagttctaaatttttttttccaaactttcaattttccatcacatcaaacgtttcatacacacataatttttctatcacatcgtaccaatttcaaacaaactttcaaacttcagtgtgaactaaacaagttaaattttcttttagacgatggcgctcggcccagcttttcataaaaagcatacgaggttcatacagcaaaatgaagaaaaacaaaaactgggtaagccagttcgagagaagagcaaatgctgctggcacagccagacaagccagagagattgcatctgaatgcactaagagaaagagaaactagattaagcctgaaccgcgccttccactgtcctggaacttgccgcatccccttggacctcgagtgaatgctggcacgcagtaatgtttgaaccgtatccagctccccaatcagcttctgttgcgccaaatttctccactgcatcaaaaacgacatcaccttatgaggtaattgcatcacgtcttttagcaatttatcttcgaaaacccaatcattacgaacaagccaaatagcccaaaaacaggccgcaaataggcaaagaatagccctcctgttgctcacaattttccatttaaaatcatttactacccgaaaaattatttgaattttttgtattttaaaattcaaattttatatagtttaatcaaacccggatggagatatgaccaaaataaaattggtagatctcaatgagttctacaactttgtttttgacagttttttcatatgagtttatttagtatcataaaattcaattcaaaatttatttttgcctataaggctaatttgcctcctcaatgagttctaatacttgctaaatatatatttgatccaattaactcggttttgctagtgaaatatgtgaatggatgtgaaatatgtaatcaaaatagatgttatgtgaatgtggttgtgttaaatatattgatggttgtgtatgtgcatggatgtttaacttctttggaagtcaatccccaaagaactttgaggttaagcgtacttagggtggagcaattttaggatgggtacctgaccgggtgcacatgagtgaggacaaaatgtgtccaaaaaacaaaatttatttttttttattatactcatccgtgacgggctatagtttaggcccgattgagatgagagccatccgtgacgggctatagtttaggcccgttagagatgagagttatccgtgacgagctatagtgttggccagattaagatatgtgtcatccgtgacagccggatgcccgattgatatattttcttacatcagtgacttttgcttgggccgctatccgatagagatgaggcttagacccgttacagatgaccgaatctgttctagtgagggtctatggagcagcgagttgtgaaattcagaatacaagattgaatgctccttgaaatgtggagatcaaacggaatttcttatagtttagtttagtttctctaaaattcttttaaattcctccgttcacctgaatcttcagtcatatcgaccgttatataaccagcaaacgcaagtagcaacagaatactcctatcaatttgctgtgttcaccgaatactcctaacaacgcaagtagcaacagaatactactagtgttgcaagttttaagcaccacttattcggtggcctttatggtgctgatatttctccgggttgcgtgttgacgtgagtcagatataactggaaccatgattttttgcgagaatattccttcctaaaaggaagcctggaatttgcagcaaaccctctcccccaacaatttggcatatcctttcccatctcttttcatcacccttttttcttaacagaaacagccaccaaagaatcatagtactattctgtgcaactagtatatgattgatcgagacgcaagaacaaattccacattagcagtaggcataagtctttgtttatgtgtatgtagtgtggtgaagaaatagacggtgcgatcaagccgcatttgtgatcaggtatgcacaatttgcgtaaagcgagatggaagtttcagcagcgtgtgttcagtctatttggaaacgtagatgaagaacagaagaagggtcagtactcaataagtcactattcagtactcagtactcaacacaccgcttatgactcggtactcaataagtcactgagtatttggaatggtgaaatttgatagaactttgttcggattgccaaaattcgtttgctggacagaggggatcatttcagtgaaaatcattgcaagtctgcacaaaacgctgaaaacatatagagtagatcgcgattagctagcctatgcgaagattatttcagtgaaaagattttccttttccttcatcgaaactgatactagactatatcaaaataatctacttactccctccgtcctaaaataagtgcagccatggttttccacgtctaactttaacaactcgtcttatttgaaaaatttttgaaaaaaatttaaaacataattcacgagtaaagtagtattcatgttttatcatcttataactacaaaattgctaattataaaaaaatttcgaataagacggatgatcaaagttgggcgctgaaactcatggctgcacttattttgggacggagtaatacaagttacaagccatgatccgttcatctgaattctgacatgtatgtacattcatctgaaaaaacatgcggagtacgtaatgacagtttaccactgggcgaacaaagctacagctatggcaaaaacaaaccatgtaagtaagattaaataccacatgccacgactcgtcatgccgaggccgccgccggcgctgcgggcgggagcctcggcgagccggcgctgcgcggtggcgcgaacctggcggtgaccgtgaagtccggctcgaggcagccgtcgtcgaagttctgcgcgtagctgagcgggtcgtagttgagccccccggcgccgaggatggagcggccgccgccgcctccgccgtgccgccgcctccgccgcgccacgctgagctgacgcagcctgtgccacagcgccgcgagcccgagccggccccagcacgacgacgccatcgccggcgctcccccgccgcgcgccgtcgtcgtccgtcgcccgtacgacgacgcgtccacgtccgcctccccgtggtcccctccctcctccgccatcgtcgccggcagcctccccggcgatgcccacatggcagacaggaggcacgcgacgcgagagcgcgagaggtttgtgcgtgatgcgtgtgctggctttggtttttctctcgggtagatgaggcgcgtggagggagaggtggcgagccgttggatgcgagagggggacggcggagatggggacgtgggggaggtggtcccctttgccccgcgggcaaatgtggcacgtcgcatcgtgccaggcgggatctcggctgacgtgggcgtcgcttgctcgcatggcgacggttgggcacatcattttcaggttctcggtacaagcaacgtgttgctcgttgccgtgttcaatcgtatggttttctcttctttttttttttcagggcaatcgtatggttttcgatccaacaatcaaaattataaatactgaccacggtaacactacgtgtatagaataaaaagaaaggttcagatagatgaggatgaaaaagataaaagtgcaaggcaagaaatttctgtttaagtaactaactgaacgggatcatcttattacaaatataattcttttatataaaatttaaatgatagaaatacaattattacggaatagaatgtagtagttttcttaaaaagaaaattcaattaatatccagtaaccagtttgatctgctactccctccgtcccaaaaaataagacatatccatccaaaattacttatattttggggcggagacatcataagatttgttctatggattgttaggctgtgttcctctctacactttcatatcctctacttcctcgtttttcatccacacgttacccatacggctaaacggtatgttttgtcaaaaacattctataagaaagttgctttaaaaaattatattaatccatttttcccacttatttagctaacactccctccgtcccgctcattaaggcgcacacattttaaaattcaactctttaaatatttaaccaataaatattttattataaattaaattttatgtaatgaaaataatatcattggattatcatttacattcacttttactatatgattaagattttgttatgaaattggcagcttgctcgttcgttaaaaaatatgattttgttactacaaacattatagtatatgagaaatttaaagttaaatatgaattttaaaaaatgtgccaagtctgaccgcgtcttagtgaagtacttaattaatcgtggactaaacccacgagatctgctgtgagaccaggaacaacatgctaagctcaatggaactcctggtcacagaacatagatagatgatccccatgaccttgcatgccatttctatattaagcatcttatcgtttgaccacacaacatatacgaccatttttagaccgcgagaagaagcgtccaatatgtaacgttagttatcttggacatctccctcctagacctcatttcgtttagctgccgcactcaatggacaatcgtaaccatgggcggtgctcgttgccgcggctcgccgttggcgccgccgtcctcctcctcgccgtctccctagcggccacgccggcggcgagccatgccgggcacgatgacaccggcttgcacagcaactacctcgtcatcgtgcgcaagccgtacgcgtacgacacgaacctgtacaagaacgtgtcgagctggcacgcgtcgctggtggcgtcggtgtgcgacatggcgaaggaggcgctggagagggacccctcctccgtgtcccggctcatctactcctaccgcaacgtcgtcaatggcttcgccgcccgcctgacgccggaggaggtggaggagatgtccaagaacgactggttcatccgcgccgacccggagaagacgtaccagctccagaccacccacacgccgcagctgctcggcctcatgggcggcgcccgccgcggcggcgtgtggaacaccagcaacatgggcgagggcatcatcatcgggatcctcgacgacggcatctacgccgggcacccgtcgttcgacggggcgggcatgaagccgccgccggccaagtggagcggccggtgcgacttcaacaagacggtgtgcaacaacaagctcatcggagcgcgctcctacttcgagtcggcgaagtggaagtggaaagggctgcgcgacccggtcctgccgatcaacgaggggcagcacgggacgcacacgtccagcacggcggccggctcgttcgtgcccggcgccaacgtctccggctacgcggtcggcacggcgggcggcatggccccccgcgcgcacatcgccttctaccaggtgtgctacgtggagaagggctgcgaccgcgacgacatactggcggcggtggacgacgccctcgaggacggcgtcgacatcctgtcgctgtcgctcggcgacgagcaggccggcgacttctccgacgacccggtctcgctcggaggctacagcgctgccatgcatggcgtgctggtcagcgcggccggcggcaacaccggcccgggaccgagcaccgtcgtcaacgaggcgccgtgggttatcaccgtgggggcaggcaccaccgaccggcggttcgtcgccaccgtgaagcttggaagcggggttagcctcgacggcgagtcgctcagcgagccc

SEQ ID NO: 77097 - DNA, 3469 bp, Oryza sativa
atgcgccggaagcgggcggcgacgagcgccgccctgagggtgcgcatggccgggacgaggccgccgatgagggcgttgtccgccgtgttgatgatctcgttgccgacggccacgagggagatgtccgtcgccgggtagtacggcgcgatgttcgccgccacccaggcggcggcgccgtccttggtgcccagcgtcgggatgtcgccgtttccggcggtgaccatgaccgtgatgcccgtgccggcgaaggccttgacgatgtccgggttggtgtcgaacagcttcacccggtcgatgcgggtgcggttcgcgaggaacttcgccacggtggccggcggcggcaggttgtctcccttggtgccgtagttgacgccgattgcggcggcggaaggcagaaggatcgtgaggaggacagggagaacggcggcgaccgcgtccacatgccgtgacggcggcgccatggcggtgggggaggacggcgcgcgcaatctgactccggtcgaacaggtggtgacgagagcttctggcttttattggtgcgctaattatagcactagattattagctagccaataaacaacacgtattcaccctggcattgattgctggaaggaagggattgcttttaatagaagtttatctatcagggtattaaacacaaggcaccgaaatgccgttgatatcattattgttcgaattaagaaatgtccattatcagttcttcgcccccgcgtcgtcctccctcacggaagacacaggaggtggaaaccaccaccgtcgcccgctccccccctccttcctcctccgcctcgccgccgcccgagcggccgccggcaaagccgcacggccgcaaggatggtgatggaggggcttcgtctcgtctctccctcccgccaggggtgggggccgcacgggacggcgaaggccgcccagttcgaggccatcatgaccggatctggcagggagaccgccggcgatgggtcagcgtggtgaggcggtggcgattggcggtggtggcggcggggatggaaggcggcggcgaggatggtaacggcgggcagggctcggtcgctccggaggcggacacccccccccccgagggccgatccagtgcggggcaagctcacggcggtggtggggctacgggactcgcggcgacggcgtcggcggcgatggcgtcgagcacgtcgcgacaacgacagtggcaacggcgtggagctcgtggcgaaggtggtggtagcggctggacgatggcgacagcacagtggttggtagacggcactgccggctgctgtggcaacggggcgcactcacggcggcgacaacggcgcggagctcgtggcgacggtcgcggtagcggcgaggtggccatcggcagtagtggctgcaatggtggtgaggcatggcggtctcggaaggctagccgggggcgtggcagacggccgcacctggccggtgcggcagtgattggaggggtcggaggccggcttggcgtagagaggcacggctgttggcagtggaggtcggcaaggcgcgagaggcatggccggtggcaaggaggccggcatggcgtgagaggcacagccgatggcaggaaaccggactggcgcgagaggctcatccggtggtggaggaggacggcgcggcgcgatgaggcacggccggcggtaaaggaggcgaccacgatgtgaggaggagctgcggggggtgtgacgcggtcttcggcgcacgaaggttggccagcgggaggcgccggtgcagtggtcccacatgtcggcagaggttgagcagtggtggagcatcggtgcatcagccgtggacttggaggtgagcggcgagtgaaaacctagcccggccttgcccggaccgacaacaatggtttccccctcctaagggcgttgtcgtgccgtctcatccctcaagggtgtttgtcgggcaaaagcccaatcttggctcttttgagtccccgacggacagcgacggcggttttccgtcgcttatctccttggagacgtcgtttaggcatccccttgtcaaaaccactcgaacgattggtgcaagcacactctagatagagttggctttgtgtaggttgtaagggcttttgagcattctcgtctatgttcctttgttggcctagcggcggtcggtcacgcttagccgcggccggtccagtgctagtcttctctcggacctgtgtgttggcgctgtcgatgtgtatgtggtggtatattttttcctttttcctgattaagaccttctagggttgtaatcttgtttttttttctgctctatcagtagaacttcgcaccgtcttgtgcgagtcgttaacaaaaaatgtcctttgaagtaaagaatcagtgtgcctaaaatcaatttgtttgaaaaaaaactcattgcaattgaaattttgttgctaggagatgttgcattggatttttttaaacccttttcatctcaatttctaaataagccttccaaaaaatttatgtacatatatgaatctgggaaactattttcatcccttgaggggatgtctacttgtttacttaaaaaccatccaaacggatatgaattttttttgcagcactcgtacaacatatctccatagaatcttaggtctaaactcaactcacaaatcaagatataaaagagataaatttaacgtatgaatagtagtgtattgtccacatctaaatttgttttttttctcgatgtgtagctcgaatttgaacttgatttttggggtaccatagatatcactatgttctacagtggaaaaaagtttagaatttttctacaactatttgtatcaaatttaaaggaaaaaaagtacacaaatgacattccctcgagggattagaatccactctctatgaatcttcaagatatgctatttttattggtgtggcaggacaacactcccgcacccaagtatgtaaaacattgttgtgtgtttgtcgccacacttcatgatgtacttcctccgtcttaaaataagattatctttgctccctcttatttatctcaaaataagttcattttttagaaatcattacattggggtttgtgaaaagtatgggacaaatgcattggaattggttaaagtgaggggaattgataaagcgaagagtattatttttccacttttatactagaatgtgtgggttagatgaaaaataagcttattttagaacgggtagtagtaacttgccaaaccattttggtggatggccacatagtttattctataagggcaagctcaatgtatgtgcaacgatgaccgtaagggtggggcctaatgcaagtgacataagttagtaccaactctacaacagttaaaggttgtgaaatcgaatttaggtacccctcgggttcatcacccaatgaactggtgtgaactgtgaatcaataaaaggatcctatgttattctcttatggcacaccttaatgttaaggtcaatctttg

SEQ ID NO: 77098 - DNA, 2275 bp, Oryza sativa
  unsure (1)..(2275): unsure at all n locations
ctctgtgttctttagaaagacaaggaaataatccagacatgacaaaataaaaggcagagtagggatatatctacaaaggtgtttatgtagcacgcactacttgacaaatgcgaggcataccacctgcatgtctaattgtaacagaccagatttttgtaatggagaagttaccctcttctaaattctgtgcatagtaatgaaagtctgaaaccaataattactgatcaaagcaaaattggtcataccttgtttggttcactaaatgaattttcatccagcaagttgctggatgtgagaacagtcacagttgattttgccgtatctacaccagcttgaagtccacttgaagatattgtgaggttcacagcatttggcccgaagtttactatctgtggaagatcatttgaagatcaggatgttctaagatccaaacatattactccagcagtaatacatataaagacagatgcatgttatgcaagtatgcattggctgaatcaattttgtatcgttgtaactaaatcattccaaacaataaggcgcatgtctaatgaattgaaccaaatgcatataagtttagaagaaactggaatggatggtttaccttcactctcagaaaggtattctcagcgtcttgccaggtgattgcagaggcagccaataaatcagagtagctggaactgatcataattggatgaatcatagcaccgcttgattcacggaaatatgtctgcatccaataactaggagttccatactgttgccaggagttgaagacaatcgcatctgggttccagctggttatcacatttatacattagcaatagtcagagaggaaacagatgctagaatccttgaacaaagaaagtataagaccatgtatacaacacgcgatcgttgtcattcacgaagagtggtgcataacatgccatctgaacgacatccctgcaaagaagcatgcataatgagagccaattcaataacttgcaataaggaattactgttgctcaatgtaaatttttacaaattatacatttactcaaaatattttccttgtgnagaagtacaaagatgaggtagtagttgtcaaacaaaaatcaacaatttatccaggaatcccattgaacgatctcttatattcatgcatggtctggatacaagtagacaactctgcgcatgattttatatttactctgaacccaagataaagaattaagagagtatccccagagggatcacctatttttctctaaaccaattaggaaagcagcttctgccaatgatgcaagaaggcttccattgccagcatcctcaccattaacagcatactcacttccaaatacctgcagtgaaacaattgcatagtcagtggttcctgctcacttatattctgtctatccaacatcaaagggtaatgagatgaataaattgccgggccggccaagaaaggccaaccaaatttacttaagattgaagaatatatacaaatatacaaagttataacttcaacaagaagctgtcgaagtaatggaagttgtcaccggagcaacctcccaaaagcaaaagattacactaagggactactctcctatatttctgaaaaccccagcttccttccaaatcgccacttcctctttgattgaaccaaacaggaaaccggctgagcgccgctggttctgaaacacacgcgcatttctttccttccaaaccatccaacaaacatgggaaaaggaagaacagcgtcttacgttttgctattcgatagttaggcttcttctcatgggaaaaggaagagaagaagaagaacatgcttgttgtcataattactaactatgcttgttgtcaatcaataccacagcagattgctctaaagcgatctggagttcaagttatgaagtactagtagattgctctagtttgggatattattcaagttatcatatattctgatcttatagattcagtctcagtcatggaagaagatggaagaaactaatacctagaaacacttttttttcgaaataactaaaagcatatttcattcaagaaaatgtcgaggataatggcgcatgagagaagctgcctttgtaagactgatctaatctaagaacttaatttcctatggagcgaatctcctagtacccaaggtcctgagttcaaatctcctatggagcgaatttcagattgggttgtttgtggggctaagttccaaattacaatggccgcatatatccggttggatgtagaggccgggtaaaaaatacccttctctaaa

SEQ ID NO: 77099 - DNA, 1020 bp, Oryza sativa
ggttcccgtggactcgatagggttcggaaactaattctccaaccccgcgtaacattcgtgacgcctccgacccctctttcctccgcatcgttgcacattctcgatccaacggctcgatcgtgtgaacccaacttggggagggggttcggagaattattcttcaacctggtgtgacctcccgctaagccgtcgcagcgcctgccgtgcctcggataccccattctaccggccgaacgcctccggcaagccattgtgttgcgctcgggcagcaaacaccacgagacttatggcgctcactatgtatctcgagataaaattcgatacctctagatactaagtatctcgagatacatctagatatcagtgtaaaattttctagttaaaatctaattcctatgtatactaagtatctcgagataagaaaaaggtgtaaaatttaggtgctaagatatcttctcaaggatcgtaaaatttcacttgttttagagatgtcggtacatgatgattacaagcatgcatgatgcatatcatattttactataaagttaatgctcaataactgctaaatcatttttttttgaaaaccgaagccagcttaagctggagttatattaaggaggagagaaagtatttacaatatcaccaagaaggtgaaagaaattagagggggcgaggaaaaaaacctaaatagagctacacattgaacaaaaacctaagtgaatattctcgcgatgtcttttgctccacacatgctccatagcttgatttcgtcttgtattttggcaagtagctgcagcattgtttttttttgacttcgaaacaccctcctgttatgttcacaccatatttcccatgccaccaacaagtggattgacttgagtgctttagccttgctttttccaacttgagatgttcttttaatccaccattccaaccgagcttcattttcatcatgtgggtggtctatgtcgtggcagtataggctacttagaaccctctcccagatctgacgcacgaaag

SEQ ID NO: 77100 - DNA, 509 bp, Oryza sativa
taatcttggactaattcacgagatgaatcttttgagcctaattaatccatgattagcctatgtgatgctacagtaaacattctctaattatggattaattaggcttaaaaaatttgtctcgcgaattagctttcatttatataattagttttgtaagtagtctatatttaatactctaaattagtgtctaaatatagggactaaagttaagtccctggatccaaacaccacctaagttatatggatttgcaaagaaagaaagaccatacagtgaagtacatgattacgtagtatgcactcccttcgatgaggaatataagtcattttagtttttgacatggcctttgataactttgatcattaatttctttgatagtttatatcaatatattataaaattaacttcatatgaaatacgaatatagcgtcaccacatgtactatatatctacatgttttggcgtaattttaataaaaactaaaatccatgattagtctagaaaaaactac

SEQ ID NO: 77101 - DNA, 504 bp, Oryza sativa
catcttgtgaagaatggagaatagaattcatgcactgaccccaaagattttagccactacaccatgccaggttcaatggacaccctgttcaaatcatgtctgctatttgatattattcaaacttatttaaaaaggtcatcataaaaattatcaatttattcacattgctatctgacaagaaaaaaaagtaaattaacttatctgtaatcagtaatcccgtagagatggcagatcgagttattgttccttaatctacatttgcttactatgagtccataggagttgttgatcgacatttttcttctacatatgcagggccatggttttcgcaaggaactcatgtacatgcttttggacttaaaaccacggtttctacggtttcctggtatttcgaatgttttccaactggcaatcaatttcggttgccctgtaatttaatcgctcgcattacatttggcagggggttgctttgtcgaaggcaattggttaaaaaatgcattcagg

SEQ ID NO: 77102 - DNA, 9239 bp, Oryza sativa
tctatgcggcggcgagaggttccagtgttggaggtgatggggatgaggaagacaaggagcagatatctatgtttctctcggtctttctgaagaccatgcatatgtgcttgttcaggtaagagcatctccaaatctccatttggccggattgccaaaaaaaagatagtcaaatttgcctttcactgcaatagactcttcattacactctccaatctaacgatagatcccatatatcattggctccatcaccttattcctcaccacctcctcctctcactcttcctctcatcttctcctctctctcctcttctacggccaaatctttgtcgttgtcatcatgccgcgcccaagtccacactgtctccatcctcctcctatggcaatgctggcactgctagacggtgcctcctgcagtcccgcgtgtcccctcaccttcgcctccacctccgtctgctccacacaaccacagtggtaggggtatctgcttccactgccaccatcaccgcactcatgtccaagcccatgctagctccatcctcctcctatatcgatgggcggtgcctcctactatcccgcccgtcctctctcctttgcctttgtctccttctcactgtactcacaaccaccacgtgcgggtgcatccgcttcccccaccgtcgtcattgtgcccatgcccaagcccacgccggctccttcctaccacgaagtcctccttgagcacctccagcaacgacacctcgagggcatgtccacggctcctccgtggctgatgcaagggaagaaggagagcggtggcagcagggattccggtggaaggtggcagcagtgacaatgtagagaagagagagatgtggtagagcaagagagagaagatgagaggagaaatagtacgtggggtgcaccattaacaagtgagtgtggctggacaaatttggcaagtgaggggaggaatttagccaaccgaatggccagctggagcaagattgttttgctggaattgcccaaatttggcctggagagccatttggatatatgcattaaggaggcaggctttgcttccggagggtgttgggttgctttggggactcagagttagatcgcgtggaaattgggcctatctcagtcacttcgggtagcaggctaggacaactaaatgggctcaaatttgttcggtctttcgagcaccgatatcttggtcttttctggtttggttttggtcgttagtttttattgtcacccctaagcacttgcaattcctatgaaactattttaccgactaagccacccaacaggtcaacatatactggcagttcccacgaaaactgaagaccccacccttcatccactaattgtagacctaaaccgcataaaacaagcagaaaatttagccacctgacgagttgtatctggctgctcactcgatggaatttccatccactgctcatcccgttgatgactgggcccgatggttgaaaaccactgtcatccacgactcgtcgcttcgcaacaaacaaagcgggcgtgcaaacacgcgtcggatgacgaacaatagaccaccgaccgatcactgggccttcattgtgtcgggcccctataagtcaaccaacatacatcttatttaccagatagagaagctaccagagaggttattgaaccacttatccataatttcattgacccatcgaaataacatgcaggccttccagtcaatcaaaagagagcagccatagtaatttcgcaactataatttctaaagtcacatagaccagcatctgccccttctttcaaccttaggttttaaactataatacaaggagttgctcgaactctggaaaattctgcagaaagatccaactattaccacgcataaatagtgatgtcatctaccaagctaaacaagttatagcagcaggcaaattcttgttgccattgtgatgctatcccaccacaatggcatacaaggcctcaaaaaatagtttaagaaagcagggaattacatcaagttgcaccaaaatctttaacaaaggcagacagagcatagagcctgattcaaatcagaacacgtattcagtctgataagtctacaactctccataccaagtcttccaagctccaaaatcttcaatacgacaatatccaattcatagcttttcagtcttcctgccatcaacttgttctagtagtttgggaacccgtcgaagtctttctttcctggcctccagtttggctatttcagaaatccatggaaagagagaaaagatcaattcaatgagattagcaggaaaactctctctaaagtgggcattattccttgctttccaaatggtccagcacacaacaacaatcccacacccactaaagattgtaaatttctacaccttcccttccacatcataagacgttttgatctctccatccctcgtctaaattcgctaacattcatatgatcttagatacatatatgaagcacatcaatggatccatgcatgaaacccgaaatgtattatatatgatgtgaaatggaggattgaatttatttaatcaagcaccaaaaggttgttgaatgttatgcacaggttcaacatcatatgcacatttattcacatttcataagaaatgagcataccatcaacactaagggaccagaaagtcaaagggacacgaggaaagaacttactaaattacttgatctttagttgccacatcctcaaaagcggagccacctagagctattaccttctataaagcactctgaggctcttgcccaggcacagaagactccgataaaaacaagccttattttggctgacaccaattgcaggtcaaatcccacctggatcaactatggaagtttctttacaaaaatactcttgagctgaaacgaccacagaagtgtagatttgatcaagcaggatgttgcatgtactttgcattgttgttgcactttgagaaacaaatttggttttactccatgggaaagacgtgatattgctgatggtgaagacaccactatatcttgcccaggtacagaggtggccccaatcaacgaaacatgccttgctttggctgacatcaattgcaggtcaaatgccacctgcataaactctaagagtggacggctgttaagtaccaaattctcgccgtcactactacataagaccataaatataaaacatccaacatagtggtagggtttatttctaacaatttccacgagtgttggtgtacattcgtatgcaggtggcaaactacctaagttgagaagaaatatacatgaaggaaaaagagaatcaaacttatatccaaacttatggaggtttggacccaaagacccaattaaacacctccaaatgggccaaacatccatagcaatagaatgaggggcccaaaatgagtgtctaagccgaaaaccggagccaacgaagccgtctcgggtttagccgaaccctgacggaggccgctggcccaagcccaagttgcgctgagtggataacgtcctcccaatgacggttgtgagcattatacctgaagaaactgtcatggacacttgtcaataggagagaagagatgctctttggatgcttaagcatctccacattcccaaggcacctctaggcctataaatacccctctcctctccctcattcacacacacacacaccccaaagcatgaactgaattataagaggctctattgtactttattgtatactagatttgggagacagtagagtagaggaagtcggaggaatttcggagttgttagtaatcctctcttatttcttatactttgttaattactatgctttaatacaaatatcattctgagtaattaagatttattctgtgagagttacctcttagttcataatcaatgtatgggatcattgttcagtatagtcgattaagatatagtgattgctttagtgagttataaacactaaagtagttattaattgcgtagacgtggtgtctgggtagttaatgtcacgccccgaactagtcccgaccggaactagcccgtgacgctccaaattaacctgttaatcgataccagtcccaggaaatagtgctggtatcacagggagacagagtatcacaacaacagaggtctctttattatagagtagaagtacagtcatattgggatgcggacagatcccgagctcacaactgcattataaaaggaaagcggaagccaagacttggaccaatcatcacaggcgcgacttgggaactaggccgaaaccctataactcatcgtagccgacttgctcctagaagaactcctcgtcagcaggatccacttcatcttcttcagcaactggggggggattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacatttcaaacagccacccgggcctagctgatcccgtcagctgctgatttttcaaacatcgaacccagtttcacaacagcaatttcacaagcagtagtcagacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcatacttgtcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgtttctcagattttaagtttgaaggcgaccgtcgatactcgcacagagtgcacgaatatcgaggtgcaactgggtggttacaaggggacatggtataacaattaacaaaggaaggatcaaatgcaacaaattaggtaggtctgccaatctgccttgcagacgggacaacagattaagtgtgatcctatcaatgcataatatttcgcaagcaatataattaaatttcaaatataggctcaagatgttcaaaggtggcttgccttgctcgagatctggagcttgatcctcgaaatcctcgcactgcgggtcttcgggctctgaaactacacgcgaaacgggacaactcaacaaacggcgaaaataaagccctattaaagacctctaagcgtgccattagatagatctcaagatttggggaattttggaagttgaacggagtcaaacggattcacggttgggaagatattgaatttctaagattattgaatttttgatctaaaggaaaaggatttaattaaatcctttttggaaaagaaaaagaaaagaagggagggagggaatatagacttttctcggacggctaaggcgcggcccaagagaaatggagcggtccggccgagctaaatgggccggctggcccaaggcggcccaaactcgcgcgcgcgggggagggaggagagagagagccggtggaccgggctcaccacgcgcggtcccgggtgggacccgcttgtcagcggctcagctcaccgtgcggagggagcacgcgacgcacgcgcgcgggcggggaagggacgcggtgcatgcgcgcggtccgcggtggacgcaggtgacccatctggttgcaccggaaacactgaactgctgacggtccctgcggtgacttgaaagaggtaacactgttaggcgcagtattgccactaggggcacgctgctgtggctgaggtgccggacggtttatctgaggacgaggggcgtagcctggctggcggttagcctgagtgaccgactggtggtattgcatgggttgaccgtagcgagggcgaggtgcgcctcgggaagaatttccctgatggttagacttgcgtttcttgtattcttcggtagcctcttttctggcatcctcaagtagaagtgccttgttgatcatatgttgaaaagtggggaagtcatgagcaagcaactggagtctcattccaactgcgattcctttcaagaatttcctgatcttcttcttgtctgtgtccacttcctcaggggcgtaccgagccaacttgttgaactgacttaggtactcattgatactgctgttgccttgcttaagtctgttgaattcttctttcttcatgtcaatagtgctttcaggcacatgagctgcacggaaagccgtagcgaactcatcccaagcaatgttagtgggttcagggtgtgcattgcagtaattctcccaccaatctgcggcaggtcctctttgttggtgagaggcgtagagcgtcttctcaacaggagtacactgcactaagttgagttttctatcaacatctttcaaccaatcgtcagcctcgacgggctcgacggtctgagagaactctggcggacgagacctcagaaagtctgtcagcttggatctgttgttgcccatgtgagggtggccatttccatgcgcattatgctgaaaactggctatggctgtgtttagtccttgcaagatttgtgtctgaactgccattaagtgttgcatgttggtttccacatgaggtggggaagggaggcgttcttctccagaattgtgactggcagtgcggtgagagcggtgagactgtcccatctctgcatcacgggaaactgtgcgatgcgagcggctgctgtggcggggttgctcaacctctgcattgcgggaaacagtacgatgcgaatggttgctgtggtgagactgctcattagctgatccatgattttcttctggctcaactctaccatcctcaaaaccaaagcgggctggtgcacgagctgcacggcgggggcggctagccatctaaactcccagaagagggcggggtaagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctatcacacggacggctgctgaagactgcctcctctactcctcgtcggcctggctgcctcctgtagtcggctcctcagtcgaagaaacgtcgatcggctggcgcgaagggaccggcggaacctgtcgagggccggcagcagcacgggccgctggcggtaggggagctgggtagtggaaacggaacacagtggcagaaccaacaacacgcttccgcgcagtgcggataaagcgtgggccacggcgggaggaagcaactggggtgtgtcctggggtgtaggaagggctaactgggtgtgggtagggcgagtacactggtgagtacggcgcacgcgagttgggggagcgcgggccactgggagtgcgggcagagccgcgggagctgtgggaggacaggtggctggcgtggcagaggcggcctgagtcccaggagatagtgtcaactgaggtgacaccctcctcggccagacgggcctccaaggcggcgtagcggcgggcaagggagcggtaagcctcaaggagtaggtcgtgctgagtggcctgagcctccgaaagctcaaccatgcgagtcagcactggctgagactcgctgtatggacaagggtacctggcgtctgagtggccagaaggaaggcgtggaagctgccggaaggaggagcctccgagacggtggctgtagtcgtgggccaggcgacgaagcgcagtccaggagaggtcctggtacgcgatctggagagtgggcctggctacagtgaagtggtgtgggcgaaggccagctccgtgtatacctccacgggggtaaaggtacacagagagctcacagtgagggggaacacggtccacggagtaccccgtgtactcgggacacgagaagccaggaaacgggcgaggtcacgaagctgagcgacgtggtgaccctcaccaaaaccgtgggaactgaagctggcgttcactgccatctacaattttgaaagagggagaaagatcagtaaccattttagaaacaaactattgaaaataaagaagacaaaacaaaccttaccttttcgcaagtagttttgaacttggtatccttagggttgtcctaagtgtcgggtttcgccctagggccaagcctgtgctctgataccatctcttgtcacgccccgaactagttccgaccggaactagcccgtgacgctccaaattaacctgttaatcgataccagtcccaggaaatagtgctggtatcacagggagacagagtatcacagcaacagaggtctctttattatagagtagaagtacagtcatattgggctgcggacagatcccgagctcacaactgcattacaaaaggaaagcggaagccaggacttggaccaatcatcacaggcgcgacttgggaactaggccgaaaccctataactcatcgtagccgacttgctcctagaagaactcctcgtcagcaggatccacttcatcttcttcagcaactggggggggattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgaggggctgcaggaa

SEQ ID NO: 77103 - DNA, 55155 bp, Oryza sativa
aaatacgcagcaatgttcataaatttttgactgaacgtagtgatgcagaaggcaaatgttaagttcttatgcttctgaaagcgttctatcatccatgtgaatgttgcacgatatggtatatctagtctcaatccttttcgagtagtactctactatgtacttgcccataagaattatttccataacctcatgccgattttcttatcgtatatggagctttaccgtacatactggcatattctatattccacgactcgtacaccacccgtagtagaattttcagtatatgtcatcctattcgcagcactttcagctgttgccacttaattcgtaacaccttcagaacataccaccagagacgcgaattgttttattccgtgacactccgtccatccgatgccgcacccgtcaattggtccgtgcaagcgctgtcgttcgtccatcgggcggggagcagctcgctcgtcccatcggccgacgaggtcctcccagcgctccgccggccagcaaggacgtacacacgcgtatctggctgccgtcgagcgcagccggccgccgaggtcctccatgggtggccgccgtcggcgagctcctcctcgcgtaagccatcagcagtcgatgtcttgcccagcgtacgcatccggtcgccatcgagaaccgccagctaccgaggtactcccgatgggctcattgggatgttcggccgccatcgacgagttactcctcgcgcacggcattggccggcggggtcccctcacacgcagcgtgctggccgacgaggtccagtcgtccagccgcgtcggtcgcttctccaatgcatggcctcaacatcctggacattatcagcgagcatgcacacattacttcatagcgttcatggggtgttcttgcttgtgagcatgttgttcttgctcgtgaccatggtcagaggcgacgcgatatggggacgaggagggtgctagtgacacagggatggggccgttgggtgcgtgctgcgcggccggagcggcgagtgcgcgccggaggagatgaatgccctcgtcggcagcgcgggaaatccgactccttctttgtccacttcgacggcagccgacgccgcgtgcaggaaggaactcagcggctggcggcgcacgcggggaggaccgacaagctgctccccgcccgatggacgaacgatggcgcttgcatggaccgattgacggatgccacattggatggacggagtggtacggaatgaaacaatttgcatcctccatggtatattctgaaagtgtgacgaactgagtggcaaaatctgatagtgctgcgaattgagtggcatatagtgaaaattctcccctacaatggaaactattgtaaagtggttttttattttagctcctacagtcttacatgtcagcctctgctaatttttttattttcagataactaaaacttttatacttcacaccctataacaataaaaaaacacatataaaccctatactcctggtagttctactgtgagcctctcactttcattgtccttacccatccttgctcgctctcctcacggaatcccccactgttggtgctcttctccgcctctctccctcttcattttttccaccagtggtgccgcctctcccttcgctcttcccgcaaaacggaccactatcggtcgacaagctcataggccgagggtgacgagatcggagcggatcgaggctccttcccgaccatcacggcgggatccaggcggcgcaaattgaggcgactccatcgcctcctctccttcgtcgaccatcgcgtggcccagatcaaggtgactcccttcctagctgccatcgtattctctccttcttcggccaccgtagcagccctattgaggcggctccctacctggccgtcaccatcacgcgaatggaggatggctctctccctaaccgtcgttttctcctcttcttcttcggccgttgccgtcggcgcagatctaggcagctcccaccccatctgccgcccctgttgttcgcagcgttttccgacggtgacctccagattcctctttttttctctggtctaagtctctaacaggattaccaagatgtcagggttatggataccatatacctaatagtagttgactaaatctcggcaggacccaccacacaccatgtcttatacggaaactgacttcagatatggaggcagttttggataaggaaagacaaccagagttctacatggaaacgacaaggactactcggattgtatccattttggtttccctagttctacttggaaatgggacacctatgggtataaatacaaggccctctaggagaagaggggacacgaccaccacaatcaacatacacggaacaatagatcaaaccacaagatcaatatacaagtcaacatacgccaagacaagatgccagatatcgacttcagggataagcacagctagtctcctacggtgtctccggatactgtcaggagagatgaaagcgctatctctgatcttgccgggcacggattcgaggaggaagactactctgttgtcgacttcgagtcagagcttcagaccgccatgtcgacaacagttagataggctaccccaaatattgtactggtatgattatggtgaataaagagcaacgaccggctccggccaacaggatgtagggttattacctgacaattcaagggctcgaacctatataaaaatcctgtctccatctattttacctcagtctcgcatatatcctagtaccaacaatccccatactatgcaaataccggaatcgcgacatcaaacgtcgacagtggcgcgccaggtaggggggttttggtgcttcaggatttggacgagatgggttcaagagatggattctccgacaacatattactcgacgagatctccgaaccatcttctcgtcgactacaagggaaagtgctcctcgcgacgccctgactggtcggccctacgttggttttcgagagatgcagacatatacagcaggaggacggcgcgccagccacccgccatcttgcatgtagctgccagagatcaggaggacatcagcacgcggaagacagaagtcgacatcgatcgattatcatgcatatcactgtgcgtgtgcgtccagatcctgtccatgagtcaccgagtcggactggtagccaacagatgtctgtacacggcacttgttggtaaaaaccaggatatacactcgtatacgtgaccagggcacgtgaaggagttacatgcacgtggcttcttgtctacttgttgatcttgatgctcagactgtaaaaagaaaagggtaattagtggattagttttttgaattaatctactaatttcgtagatatctacacaggtacgcaatattttatatgcaatgtactgtacttatttttcagataatataatattgtcagatctataatttattatgtttacctagagcatgttttttatacaatctctgttatacgagcgtcttcaatattagaccaccgcggtctaatactgggggctcgctttattttcttctgtataaatcatgcttgttcacggtttatataatgcttgatatttaatctgctcgttatatcctgataatgctagaagatccatacagttattcgagtacatactcgatattctctgctatatgtcttgccttctagaaaatatttttcaggaacaattgagcacatgagtaggttgtcatcgagtacactccattatcgagaacattctcgacaaatgcggagttatcgcacccaacctgccaacgaagaccaacgacctatctcatagcaccggccatggctggaatagtcgagaaaaggttgttaacggataattcctcgcgaatgtcgtcggcttgattgcccgacatgattgcgaacagatatccggatatgctataagttgggtatgtgagtcatgctggccacatgagatgcacatgtaataaaccaactctagcgtctccattggtgttcgagagataattctactcgctcgctggttcttgaaccagtacgtaacaatctctcacaccgcaaacttccattggtgttcgagagataatcctactcgctcgcaggttctcgaaccagtacgtagcaatctctcgcaccgcaaacttccattggtgttcgagagataattctacttgctcgctggttctcgaaccagtacgtagcaatctctcgcaccgcaaacttccagtggtgttcgagagataattctactcgctcgctagttgtaacgccccgattttcgttcgggattaaaaatcgtttaataatgcattttctagaaattaaataaaagttaaaacaaattcatcaagtgaaataatgggaggattaaaattttcccttgaaaatcatcggccaggaatattttgtaatattctttgtgccctaaatattttctaaaaatttcccgagaattttcggagctcgagaaataattttaaaagtcacaaagttcatttaatcaattaaaataaatagaaaaaccaagttaaatctcccctccttcactttgggccacttccggcccaaagccctccttccctccccacgacccgttccctcccctcttccttccttcctccttgggccatcgacccatcttccttcccctcgcgcaaagtctaaataaccccctgggttctcctccctttctccgttcccgacaggtgggcccggcaaccccacctgtcaggcccttcctctacctgcagtctctagagcagaagctgccatggacggccgttgccgcccacgtcgccgccgattccgggttctcccgcccgcgccctcgcacccaaaccacatgaaatcggctccccaccatctcctacacattttcccccacttttccccaatttttggcgccaatttgagctccacttcacccacgatgtcgcccacgtcgccggtcggttgccgcctgattccacccctctcagccatgatctccctcccccgcgcccataaaaaagatccccgggctcccctcctccgtttccccctctctcccaagctcccccatgcccggaaccccctcctccccttgaggccgtgcgccgccgctcgcgggagctcttcggtcggccgctgctgccgctcctgacgtccccgcgccacgccgcttgcgctaccgcgttcgccgctctctgccgcaaccctgcagccgctccattttccccaatagccaccggaaagccgccccaccgcgccaccaacctccgctgctcgtcggcgtcgttcagccacctaccgccgccactctagctgcgcccgtgctgtgccactaccactatcggcatcgccgtaccgagctccaccccggcatccactcctccgcccccaaaccccaccgcaaccacctttccacctcacatcccgagctccaccaccgcctgtcgcctccagccgcgcacctccatcgcctcagccgtcgccgcaccgcgccgcctgcgccactcgcttcgcaacgccgaggagcacctcggttgctttttttcatcgccggaaccccaccaaaacatgttttccgtcgccggtgagtcccttctttctttttcctcttcggccggccatgctcacgccttctcccttttccctaatccctccaatagcttccccaggtgtagccgcccctcggcctcccctcctccttcgtcggaagccaccgaatcgtcgccgtcatcgtcttcctccgtgccggctgctgcttccggtgaggatccctcctcccccgtcccccttcctttcctgtcccccttcccgccgcctctcggccgcttgccaccattccacaccgccagtggccgcgcgctgcccatcgccgtcgttcggctggccggctttgagccgtgccgtgccctagccatgctgcctaggccgtcggtcccgtggaccactcccgtggtccgggtccacggtgctgccccggccgcggtggaccgagtcaaccatgcacccgtccccattgcccgctgacgtgcggggtccacgtgtcggcgccggccgctcctttctgacgttagcgatggtcttttcctttgagaaaatatttaataattgcacgataaataattaataattccagaaatccattaaaatggctcaaaacttctaaaattcatatctaattcattcgaactccaaattaggccattcaacttgcaaaattcatctaaaattgagatctacatgtttgtttactttttatgtactgtttccttgttgtttatgagagcttttcctcattttacgtgccagcgtgtagaattcgctgtttcggaagttcgcggtcgcgaggataagagttcggaagattgcttgaagaagcaaggcaagtcatacattccccttgagcattttgatcctactttacaaatgttttaccgtttgcaaataaatatgaattgttttgcttattacatgggatctgggtattacctatctgctcgcttgtgccatgtttacttgatatatatcctttgtcaaccgtgggtaatagatcgactagctcatgttacttatgtgacatagctagaactatatgcttagtcatgcttaattaccactagctcagttgatgggataattgcagtattagacctttttagtatcagaacgagctgtgtgctcgagacacctgaccatgttgcattggtcgtaattatccaactaaaatgcgactgaatggtgggctgtgggtgcatggttttgctggtcgcatccatggcaattaaggaccggttcacgggaaaccctggaagacttacagtgcttaacacaagcgggagcgggtaactgcttaatctgaagtatagctcgaccctttcctaggcaccggtggcaagggtgggcgtgatggagttgggtcggccggggagaccggttgtccagctgccggattcaccacggcgcacgaggggactgcccgctgccttgcgaggagtgggggtgaaaccttagcgtggtgtggatggttaggggagggttatatgaagggtcttgtcacaatcactcgacgtggtgacatgttcatcatgggcacatgatgacatggtgacatgccggtggattgtgtcttgtgggtacagttgtgcacctctagccagagtaaaactattcgaatagccgtgcctgcggttatgggcgatcgaccagattcaccgtgattagtctcacacttaataaatcgacccaatgcactgtagttcaagtgggttggttgggcctgttcaacgtggtgtagcgttgatatgtggagatttaatattaccttaattactcaactgttttactattttgctcaatgaaatgttttacaactgcctttacgcaaatagccacaagccattcttgtatccccttgcacgtttgcatcattggtgtggcttgctgagtacggtggttgtagtcagccttgctattattcccccttttcagaagtgtagtacttctgagctgaagacaaagttagaagaccaaggcttagaacccagttgagttttgcctatggagtggagctgaagccccgctaggatcgcctttttccgctgctgctgttttcttttggtgtgaggactaagtgcctcttctataagtattttacgctttatttatgtttggaactgtttattatttgtcgttttgtgtaccctggctggtcctggatagggatttaatacacaaaatagtctggaaatttgggttaaatttctgggcgagacactggttcccgaaccagtacgtagtaatctctcgcaccgcaacttccattggtgttcgagagataattctactcgctcgctggttctcgaactagtacgtagcaatctctctcaccgcaaacttccattggtgtacgagagataattctaatcgctcactggttctcgaaccagtacgtagcaatctctcgcaccgcaaacttccattggtgttcgaaagataattctactcgctcgctggttctcgaaccagtacgtagcaatctctcgcaccgcaaacttccattggtgttcgagagataattctactcgttcgctggttctcgaaccagtcgtagcaatccctcccaccgtaacttccattggtattcgagagataattctactcgctcgctggttctcgaaccagtatgtagcaatctctcgcaccacaaacttccattggtgttcgagagataattctactcgcttgctggttctcgaactagtacgtagcaatctctcgcaccacaaacttctattggtgttcgagagataattctactcgctcgctggttctcgaactagtaaaacgtagcaatctctcgcaccttaacttcagatggttgaggaacagctacgactgatcttcgaccgacagcatagtggtcctcgtaccacgagtcgaaatgatcgagagacacctattcactggttctcaaccaattaatcgtagcgatctctcgtacatctacatctaatggtcgagttacaactactacctggttctcgaccaacggtgtagcgattctcccactatttccactttaagtggtcaagttacgactactacctggtcctcgaccagaggtgtagcgattctcccactacctctactccaacaaaactgatatcaggtacataatatcgccaagtgttttacccagagatcccttaccacgacgacacctagcgttaaaacctatcctactgttcctttacgccgtcttgacaaggccttcgagtaacctaagggaacttcggctggggacgcccagagccgataaggccttgtcagagcctgtagagacaaaagaccatgtaagatctggtcgtgtaagagttctcgccgtgcgtattaaccaagccgtgtaatcggaaattgagttttccaacttcatggctgggggctaggatcagtgcttgttcaaccaaggcaggtcaagggtccaaaagccttctccttcgagaacgattctctgacgataaggctgggggctaggcagagtgtatgacttaacaaactgactgatcgaagtcggtaagagagaagacgctcacatacaaaacattggtctgtaaatttaattcattttcagttttccatacatattataacatgtcaccctttgagcattcgctcgggggctatttctatctaatattcttttctgagtattaatttcaggaaaattctattcgacattgttgaagtctccatgtctctatggttttataccaagatcgactaaggcgagtacgacaaatgttgacaaggctccatcgcagactctgcgccttctcgatcactcgagaacgattggtggatctcgacaaggaatacggaatgaagagagggtgtacccgccgagataaaatttcttgatttcaatccaaattctcgattacagcaagacaagagacttagtcgtatattctgtactttcttggttgacgttggagattgactcagacaaaccctttaggtgcccgcacgaggctgataaaggaagtctaacattatctctgaactcatcaagaacagtcacgtgagcacgacaacagttactctagggtctgcggttgagaatatgaatttgttcatttgcattgaagtcgggggctactgtcagggttatggataccacatacctaatagtagttgactaaatctcagcatgacccaccacataccatgtcttccgaactatccgagaattatccgatccgaaaagtatccgtatccgtttttgtccggagcggatggaaactatccgctccgttttcatccctagctgtatagtggtagcatgcttttatcctcttctttgttactataactactgtagctgatggatttttttttcacttgagggacatcctatcgtttgtccatgtagtataaaagtcatcacaaaatttttaaacgattgataaaatagattaatatgtaatatattattatacaaatatataagttttaagtacgacctatataattagagtttttttttaccgttcagcactgagagacgggaccaaatactgatcattgatcggaccaaatccaacggctgccagtgtacagtaccgcgaggtaccacttttgtcccttatctagtaccgtacggtgaagagaggtgaaaaggtaagatagtaatttcgcttagtagggatggatgaggctgaatggatgggtgaggggttgaggtgggccaaaaaaaaaaatcctagaataggattggatcgaactcgccgctgctatgtttatcctccaccgccgttcccctattcttcttttcttgctcgtcatctctctttccctcgctgccgcgccaccattttgcaccctgctgccgcggcgctacgaggggatggaaggggagaagcggcgcaaagggatgggtggcgtgcgctgggaatgcgaaaggggatggaaggggagaagggcgcacggggaatggaagcagagaagtgacggcggcgcgggttgggaagggcgaaagggcgaggcagcgcacgctaggaagggcaaaggcgtcgaggcaaccaccctaacttcgattcccatcatacccccaatgaattgaacagtcggatttgttttggcacctataggttgtaggtactagtactaggcggtactttttgctggataggaacaaaactagtataactaaaataataaaaaaatagatttgactccaaattacatgttatttttaaagttaaattttttttctacttgcatgagttgaatttgaatatgtatgttgtgtatttttgtggacatccctttcaagtaagagaaaattcccaacataccccttaaaagtttcacaatttcttctatacccctaaattttgtcccattcctacatgccattgagttttcattttgatctcctctatctctattccattagttgaccgtgagttgatcgttagattttttccaaaatgaccatatcgcccatttcccatacttacatgctatctatgtcagggttacgggtaaggtataccctttacccttcgatatacgtcacatatcgatatggtatacctgcgcgtatacagacgttctctgcatacattaaggaaattcatcatggagttcacagatggaaggagtcctactcggacaggactgggtcgtcactgtatcgtgcaaggtccgatgtctccgagttctacttggaaaccgcctgacctgcgatataaaagggaccccctgggaggacctaaggcatcgaatctcatagccaacacatccaccacagcctacgaagtcggaatctacaggagccaagtcgtcgggagatttagtcgaaccagctcgattacgatctcgccggtatcattgagttccattgttccctttgtaacctgtgatttccatcatataatcccatatcaactggattagggctattacgtatcaaggggcctgaaccagtataatctgtgctttttgtctgcttgatgtcgtattacgtagatcctcgtaccagcgtaccacagtacccactatatccggtatcccccatcgacagtggcgcgccatgtagggggccttggtgctcaaggttctactactatttcatctagcttcgtcgacaacagcgtcaacaccaacctcgaccaaggagttcctgcttcaacaatgctggtgtgtactcaagtcggcgaaatcgtcttcccgatttacaccacggtgccgatctcggctggtccatcagtgactggaagcgagaacacagtggctacaacccaggacgacttcatgtcgaaggatcctcccgccgaagcggagaacggaacgtcgacgacatccgagcccgagaaggatcctaatgcggccaaaccttgtctcttcaacaagaatcacgagccgacgaggataacttccgaggtgataaggtcctggtgccctatccacaaaaccagaaaacacaccttgcaagcctgctgggtttttctcaacgtacatgccgaaattcgtgcctgcaaagagcgtggaattcagcgtacttctccaacccgtgatatctattgtcctatccacaagacaaagaatcacgacctctcaagctgcaaggtctttctcagcgccatgaagacggcgcctcctaaggtccagcagtcatgtatctctcctagggatgcggacaaggaacaaggagcgacactgatctcggatcgattcgttggggtaatcgacatcgatcctcacaagccgtcagttctacacttgctcgaagactatggctcatcatcaacaagtacgccacgcgaggtattggctatcgacaggactagcacgtcagcgcgcgctaatgcggaagtagaaaatcaagtgactacactggcccagcatatcagggccatcaacgcaatactgagggaggccccctacgatcccgttctgaacgacgatctcgcacggtggacagaacggctacaggaatcagtaaccaacctcagtaacgcgtttgaagaggccgtcgctacagcgcacccggaacagccaccaactggtggtgctaatggcgaaaaccctgaacagcgggaatcgcctcatcgagccacccctccacctcgcggcaccggcgatctccgcgatcacctgaatggccgccgagaggcacgacgcacacgagacaacgggaaccgttcctgacatcgcgtctcttcacgacgtcacgataacgaagaacgaggaggccgctcaagtgaagaccgagaccgtgataaccgccacaactaccacgatcacgacgatcgcgaatggcgggtgccgggcgatacaggtcgaggacgccgccataatgacgacgacaatggagatcggcgctgggacaacaacgggaggcgacgacaggattctcgagaacccggccgacgcccttgtaatcgcacaccggagtagatgacaacgcgttttcgaattatttgccaactgcattgaaaggctctgcacgttcatggctgatgcatctcccgccctactcgatttcttcgtgggcagacctgtggcagcagttcgtcgtcaacttccaaggaacttacaagcgccacgctatcaaagacgacctacatgcgttgacacaaaacccaggtgaatccttgagagattatgttcagcgctttaatgagtgcagaaatacaatccccgaaatcaccgacgcttctgtaatccgcgctttcaagtccggtgccagagatcgctatactacccaggagttggcaacgaggcgcatcacaactacttggagattattcgagattgtcgatcgatgcgcccacgcagatgacgcactgagacgcaagaacgacaagccgaagaccgcaggagagaagaaaccagccaaggacgcacctgagtcaagcaaaaagaaaaatcacaagagtgggaaaaagaaagctcaagcggaagttctcgcagcagaatacgcggaccctcccaaacgcccagacctacaaggtagtgacgcgaaggaagcatggtgcgctatacacaagtcggacagacactctctggaagattgcctcgtcttcaaaaagtcgctcggaaagcacatggcatcggaaaaaagcaagcgagtacgtgtggtagagaaggacactgagacggctacttaggaatcggactcatcatacccagactccgatctccatgtctcgcacatctttggaggttccacggcatactcctcaaagcgagaatacaagaaagtgaaacgtgaagtctgttcgacgtggcagggggctacacccaagatgaagtggtctgaacagaagatagaattctcagaagaagaccaccccaagactgccgtcatcccatggcgatatccgatcgtggtcgaacctactattcggaatatcaaggtcgcacgagttctgatcgacggcggcagctcaatcaaccttctcttcgccagcacattggacgcgatggggatcccacgaagcgaattgacaccaaccgatcaacccttccatggaatcactccccagtcatcgtccgaaccattgggcaaaattacgttgcctgtgactttcggccaagcaagtaacttccgaacggagcagatcacctttcatgtcactgaattcgatacagcatacaatgccatcattgggagaactgcactcgcgaagtacatggccgcatctcactacgcgtatcaagtgctcaatatgccgggaccaaagggaacaatcactattcaagggaacgctaagctggcagtgcaatgcgacaagcggagcctcgacatggtcgagcacacgcccagcccacccgccacagctgagccactcaagaaagtgagcaaaacaaacaagacgccgaaaccagacggcgcaatcaggatcgttccactctccagtgctaaccccgacaggaccgtcaagatcggggcatcactaggcgagaaataggaactcgcgctcatcaccttcctccgcgacaatgctggcgttttcgcttggcagccgtccgacatgccgggggttcccagggaggtgattgagcacaaactcatggtgcgacccgacgccaagccagtaaaacaaaaactacggagatttgcaccagattaaaaacaagacatatgagaagagctcgacaaacttctcaaagctagtttcatcagagaggtactccatccagagtggctagccaatccagtcatggtgcggaaggccaacgggaaatggagaatgtgcgtcgatttcaccgacctcaacaaggcgtgtcccaaggatcacttccctctttctcgaatagaccaacgggtggactcaacagccggttgtgagttgttgagttttctcgacgcttactccggttaccaccaaatcagcatggcaaaagaggacgaggagaaaacaacattcatcacgccattcggggtattctactatgttaagatgccgttcagactgataaccgcaggaaatactttccagcgcacggtccagggcgcacttagcgaccaacttggaaacaatgtcgaggcctacgtcgatgacattgttgtcaagaccaagacaagcgactcattgattgacgatctgcgggaaacgttcgacaacctccgacgatatcgcctcatgctcaatccagagaagtgcacgttcggagtaccatcgggcaagctactcggttttctcatctctagcagaggaatagaagcaaatcccgagaagatcaaggcaatcgataatatgaagtcgcccacaagactcaaggaagtacagaagctatccggatgcatggcggcactaagtaggtttgtcgctaggatgggagagcgaggacaacctttcttcgctctactcaagaaacaaaacaaatttatatggacataggaagccgaagaggcattcattgcactcaagtgctaactatcaaatccccctatacttgttgctccccaacctaatgaagaattatttctctatattgtcgccacgccatattccgttagcactgtcattgtcgtcgagagagagaaggtacaacgaccaatctactacatcagcgaagctctccacgacgcaaagacaagatatccacagatccaaaaactgctctacgcggtaatcatgacatcaagaaagctacgccactacttccaaacccacaggggagcaggggcaggattcatcttgacatcaccttcaggagatcaattcaagcatgcaattcacctcaacttcaaagcgaccaataacacagccgagtacgaaggactactcgccgggataagagctgcagccacactcgtcgtgaaaggggattccgaactagtcgcgaaccaggtgcacaaagactataagtgctctagccccgagttatccaagtatctcgcagaagtcaggaagctggaaaaaaggttcgatgggatcgaggtccgacacgtataccgtgtcacgtcccaaaacgactctaaaatacatcctctaaattatgcctagaataattaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaaactctaaaaagtcccctttccctccctctccctcttgggctggctcggcccatctccctccccctccctctcctctccccgcggcccatccggcctctccccgcgcgcgcgccactgacgggcgggcccgcccgccaccctcgctgatgggtggggcccacccgtcatccccttcctcccgccgcatccttgccgacctcgtccaccctccgtttcgctcgtcgaccgccggagcgccgccgtccccgtcgacccgagccgcgccgccgccttcctccgctccagccgccttttcgtcgtctccgtcgacctagggtgagccgtggaccgccgcctcgtttccccctttccctcccttctctcggccgccgctccgccgtgcctatggccgccgccggcgaccataggggcgcgggcgcgccgcctcccgccggccgtgccgccgtggccgccttcgggcgcatcgagcggctgccgcgtggggcccggctgtcagccgcccgcgccctcgggtgcggctgacgcgtggggcccacggcgccggccggtgtgagcccgggtgcacccagtccaccgtggaccgtgaggctgccgcgtgggccccactcccgtggacccggtccgcgcgccccctcccctcggctggcgcaataaacttttttttaaattaaaatttaaatgaagaaattcgcaaatattcacttaaagagcatataaacttcaaatagccataacatggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacggttgggaaagcgagcaaggcaagtcacatcatccttgaacatattgaatcccagtttataaaattatgttgatttaaattattgcattatcggtttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgtttcgccgcttaattaggcagcattaggtggttttacaactctagactttgggatattcatatcacctggacactatggaatggttggattattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgcaaggggctcagtcttgcctacctgtcccgggggttccggccgtaggtggggttgggtcggtactcttgtctatggctaggatgggttggaaactatgtcacgtcttccgtccgtataccgtggtggtatgcggcacgtggttacacatgaggaagatgtgtcttgtgggtaaagatgtacacctctgatcagagtataatctattcgaatagctgcgccctcggttatgggcaagccgagcaatgtacccaagttagtgttttaattcttaaaacctgcttaacaactaaaatgtggaatggttggcctgggttgacttgggacgagctgggacccagggtcgggttgccagttcggtctgaatcatcgtaggccttgggttaaggcaggttcgtgtgggttcacggccttgattaataatattgtatagctctggaatcgtgtttacaaaatagctttgagcaactaagtgtcttttaatgctgtttactgcaaaccctaaccctttatattataacccccttgtactcccttgcatttatcctgcacttgtgggtgtgtcttgttgagtacggtggttgtactcagtcttgctcaatttttcccaaacccagaagaggagcccctggaagatgaaggcgttggtgtctagctcgtgcctgccgtcaagcgcctgtggtcgtcgccctagtcttccgttgtttctcgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttggattaattccggtcatgacataccgcaaggacaacatcgagccggatgatctagcatggcgtgcatccagacgagagccactcgaacccggtactcttctggacgtcctgacaaagccatcagtgaaagaggcaagcgacgaagatagcccagtcgcccccgacatcagcttgggggctacagaggcagagcgcgccgttgccgatatcgagaccacagatgactggcgcaccccactgatgaaattcatatgcagcgaagagttgcccgaggacgacgaagaagccgacaaaataacctgtaaagcaaaaatctactgtatgatcggcaacgatctatacaagaaagcgccaaatggggtacttctcaaatgcgtctcgtccgacgacgatagacatctcctcctcgacatacatgaagggatctgcgggtcacacgcagccggtcgcacattggttggaaaagcttttcggcaagggtttttctggccaaccgccctcaaagacgcttgcgacatggttcagcggtgcgaagcctgtcaatttcacagtaaacacacaaagctaccagcgcaagcactccagactatccctcttacttggccgttctcgtcctgggggctcgacatactcggaccattcccacgaggatagggcggctacaggttcctattcgtggcgatcgacaaattcactaagtggatcgaagcgacacccacggggaaaatcaaggccgacgccatcaaattcatcaaagggatattttgcagatatggactgccgcaccacatcataaccgacaacggctcccagttcattagcgccgacttccaggattattgtatcgggctgggagtcaagatctgctttgcctcggtttctcaccctcagagcaacggataggtcgagagggcaaatggcatagtactagaaggaatgaagacccgcgtctatgacaggctcatgtcacaggacaagaagtgggtcgaagaactcccatcagtactatgggccgtgcgtaccacaccgacaacgtctaacaaggaaacacccttcttcctcgtgtacagctcagaggccatgctccccaccgagctacgacatcaaagtacacgagtacagaagtatttcgatgagaatcaggaggagcagtgaaacgacgatgtgaatctactcgaggaacatcgtgaacgagttgtcgtccgagaaaccagctaccaacaggcccttcgccgttaccacgagaagcgcatccgagcacgcacgcttttgatcggtgactacgtcctccgacgggttcaaagccaagcagggcgaaacaagctctcacccaaatgggaaggaccgtacacgatcacacatgtcttgcggccaggcgcattcaaaattgcagacggcgatggtcgtgagatggcaaatttctggaacattgatcaattacgtaaattctatgtataagtcaatagtatccatacttgtaagacatcttacagcttcaataaagcctattttcaggtacagattacaaccaaagtgttccttcccgatgatcccttacccagatgacacctagcgttgaaatctatcctcatgtccctttacgccgtcttgacaaggcctccgaggaacctaagagatctttggctggggacgcccaaagccgataaggccttgtcggatcctgtagagacgaaagaccatgtaagatctggtcgtgtaagagttctcgtcgtgcgtattaaccaagccatgtaatcgaaaatcaattttctaacttcacggctggggctaggatcagtgcttgttcaaccgaggtaggtcaaaggtccaagagccttatcttccgagaagaattctccgatgacaaggctggggctagggagagtgtatgactcaaatgactgatcgaagtcgctaagtaataagacactcttacacactacatccagagtaagagagcttagttaagatagatttcttttctatttcacaagtacttcttacaattccgtaaaaacccaaaactatattacacttttccctaagatatttgtcacagggtacagagactaccaggaaggccaatgccagtccatagactggaagtccttccctgccagcagcgccatcgacttcgccaggtgatctatctccaccggagttcaccgagaacgagaaaacccttcgtggaggaactcgaggtgcagttgcggacgatgatgtcgtatgcaagccaacacgtgccctccggcatatcggctcgatcgacggcactcctgcttcagggcttcgtcgatacgctttgaagcatctaggcccccgttgttaattttggtaattaatgacaagcgctaattgtggactaaccgttgctattgggataatattttaagttagatccacatcatgtgtgtgcatggatgactatcgatggattaaaatttgctagtttattttacaattgatcgaggtgtagggcgatcaaatttagaattgatcgaggtgtagggcgatcaaatttgctagtttattttctagtttcgccgtactattaagaggggtaatgacctagcaaagagatgattaaattgccacattaggtcattatgcatttagacgtgtgctcgcttttcatcacacacacacaatcacttgggatttcactgggctcggcctgaacaggggcggtcagaccggccacatagtggcggtctgaccggcgtaccttggccagtctgaacggccgcaagaaggcggtctgaccggcgcataaagccggtctgaccggcagtacatgcgcggtcagaccggcccactggaggccgggatggtgctgctccgggtggccgatacagagccgatggagccgtagtcggtcagaccgagccgatggcggtctgaccgagccgaggccggtctgaccgcccactcaacgccggtctgaccagccaggccgatggggccctctgatagcacttcaacggctagttttctagccgttgcacagtagcacggtctgaccggccacatacctccggtcagaccggcagagcacaaagttgggggatttcacccctaacggctagttttggtgggtgggagtataaatacttccccaccagcagcaaggggactctcttggcacccaattcaattgcatacatcccttgcacctctctcacacccacttgagctttgtgttcatccatctagtgtgttagagggttgattagccaagagtcaagtgcattgcttccatttgtagagctagtgtggcacttgattgatcatctccacgccgggtcattgcttgttactcttagaggttgccgcctcctagacggcttgtggaggagttgcccggtgacctctccgagaagattgtggaggaggcccggcgtcggtttgtgagtggtttggagttcagcaccttcggagtgaaggaagaactaccctagtgatcgaggcttgggtagtcctctccatgggccgctcccgccttgcccaccccttgacgaaaggggcgtgcggtggtttcgtggttgagcggtggagttgggctcgcctcaacggggtgtaggaaacaggcgagtttccgaacctcggtgaaaaatctcttgtctacttgtctaatttgattgtcgcatttacatttgtgcaatttacatttctagagacatacttgagatcatatcaccctaggattgctaaacattgacataggagtgtgatttacttttcctagagatataattgagccactatcaccttaggtttgcaaaacataacttagttacttagttagagttgacccttaccaagcctagcaacttaggttagttttgattaggtgtcatttagttttaaatcgcctattcacccccctctagttgacctctcgatcctacaagtggtatcagggcttggtctctcttgattgggcttcaccgcctagagagaagatgtcgaacgaggtgaaccatgtagggaaggctcccatgtttaatggcacaaactattccacttggaaaattaaaatgtctactcacctcaaagctatgagcttccatatttggagtattgtggatgtaggctttgctatcaacggcacacccttgacggagattgatcaccgcaacctccaactcaatgcccaagccatgaatgctttgttcaactctttgagccaagaggagtttgatagagtgagcaaccttgagaccgcatatgagatttggaacaagttggcggagatccatgagggcacaagtgagtacaaggatgccaagcttcatttcgtcaagatccaatatgagacattctccatgttgcctcatgagagtgtgaatgacatgtatgggaggctcaatgttattgtgaatgatctcaaggggcttggggcaaactacaccgatcttgaggttgcccaaaagatgcttagggctctaccagagaagtatgagacccttgtcaccatgctcatcaactccgacaagtcaaggatgacaccggcaagcctcttggggaagatcaacaccaatgacatgtacaagttgaagaagaaggagatggaggaagcctcaccttccaagaagtgcattgctctccaagctgaagttgaggacaagggcaagggcaaggtgaatgaagccaatgaggacttggaggaagagattgcccttcttgctagaaggttcaatgatctcttgggaaggagaaaggagagaggaaggggctcaaactcaaataggagaagaaatagaagacccaacaagactctctccaacttgaggtgctttgagtgtggtgagaagggacactttgcttccaagtgcccttccaaagatgatgatggagacaagtcatccaagaagaagagtggaggatacaagctcatgaagaagctcaagaaggaaggcaagaagattgaagccttcatcggggaatgggactcaaatgaggagagctccgcctcatccgggtccgaggaagaaggtggtgatgatgcaagctccaagaagaagaagatggccgttgttgccatcaaggaggctctatcactcttcgctccactttgtctcatggcaaagggttcctctaaggtaacatctcttagtgatagtgagagtaatgataattgtaatgatgtttcctatgatgagcttgtgagtatgtttgaggagctccatgcttatagtgagaaaaagattgtcaagttcatggccctaaagaaggatcatgcttctttggaggtcttgtatgaggagctaaagacttctcatgagagactcaccatgtggatattatgggtaccccatacccatacggcatggttatccgactagtcataggggataacttatatatatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgacacaactagatcgtcagatctatatacacccggcggattcaaatccccaaacaggagtagggtattacctttcattgagagggcctgaacctgtctaaatcctttgtctccgcatccatccactttaggtctcgtacgctaccctcttttattattgccgaattcatgtttcgacagttggcgcgccaggtaggggttgcgtcgagtttcctatcaacgagcgcgatggaatcaatttcatgagtcgccgacttcgttttcgctttgggagttttcacttcctttccgtcgatcacttcttcaagctcctcttctctgacttgatccaaatcagtcagggggaaactcaatctgatttttatcattatttatcatattgatttttaatctcagattaatctcttgctattttttgttgttgttcacatataattacgcggcactattgaggcgattgatgctggtcatggactcgaagcgtctcagctttccggtcgatcggccgcgagtccactctgccggcttgtcttcgccaccgccattgctgataacaacaacgacttcaccgaccggcccgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgttaccgctgagtggtgcctccgcctacacggctggcctattatgccgccgctgttgggcatctacgacttcaccgccggcctgcctccgtcgccgccgattggtgcctccgcctacacggctggcctattatgccgccgctgttgggcgtctacgacttcaccgccggcctgcctccgtcgccgccgagtggtgtccccgcctatacggtcggttggtcacaccaccgttgaagggcatcgtcatcttcaccgccggcccgcctccgtcgccgccgactggtgcctccgcctacacggctggcctattatgccgccgctgttgggcgtcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagcagtgagtcgggggctatagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgactaacgcaaggtgctaagtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatatttataaatattttaaaatacttgattttttttctcgagtattatatttatatcagatactactcatcctatatgtttgttctgcaggatccagatccagatatgcataaaagggattcatggctttaagcttatctcttacgctctaggaatggatcagtcagaacatcaccaccggccgcctcgtccgccgccgactagtgttttcgcctgcacggttggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctttatgccgccgttgttgggcgtctacgtcttcaccgaccggccgcctcgtccgccgccgactggtgcttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggcttgccttcgccgccgccgactggtgtttccgcctgcacggctggcctttatgccgacgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctattatgccgccgttgttgggcgtctacgtcttcaccgaccggccgccgcatccgccgctgactggtgtcaccgcctgcacggctggcctgttataacgccaactaatgctatcttcttcacggctggccacgtcgccgtcaccgctaataggcgttatcatcttcaacgcaagctgtctacatctgctgccgactagtttattcacttccatggctgcatgattccgccaatgttgattggctttatcttcttcatcgccggtcgtctcgtctactgctgactagtgccctcgtctctacatctggtttatacagcctaccactactgatgaacatcatcgtcttccgtcgccgactagtgcttttattttcacaactgcgcgtcttcactaccagtttgcttctgttgccgacgactcgtgttcacttcatcacggcaatgcaactttgtcatcatggtagagcgacttcatctttattatcttcggcactggcaaactctattgctgctacttcacaagttttgctacatcaccaaccatgacgttgttgtgaatctcgacatctcggcatgcgatgccgtgttattttactacaacaagtggctctccaacattcatgatttctacttggacatcttcaatacatatcttcaatcaagcaataactattcgacgacaagaggctacagttctcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcggtttagacgagttgggcaacaacatcaactctcctccaagtgaagcatctacaacagctataacattaatttgatggattattgtcactgacatcatcaccagcacctctgcttcatcgaccctgacatctccgctgttgctaatggatgattatgttttcgccgacttattatttcaccttcacggttgacctactatgcaaatgctgatgagcgtctttgtcattatcattggttgctacactgctattggctggatcaccgacatcgtcttcttcatcatgtcggttgcgtttgtcgtcgtcaactattttcttcatcttcatgattggtggattttgtcatcacctttgatctacctcgtctgtcaccgactgattattttgctgccatggctacacaattttatcgctgggctccttcatcttcattgtagttgatctgtctgccgccgactggtttcttcgcctccatggctatgcgacttcattacttttgattggtatcactatcttcactaccaccagtattgttgccacctctggtgggcaatattatctctatattggtcgtcttgtctatatgccaactgcgtcagctaccatcaatggacaattgtgactacgacagaaggacaagctatatgctcaggggctcatcaactcaagcgtgaggattatatctccaatttggacttattccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccagaagatttattactcgggagcatgttacatgcgtcatcctttaaagggtgtcgaaggcatattttttggcctaggcctaatatgtctgcagcccatattttcaggtgtggcctgtcacgttcttttagggacttaggcatttttcgcttaggccaaagtgcgcgtgatcaagtgcccaataccttaaaatccttttataccgcagttactcgactttttaggagttggtacaatgcatcttaaaaggtgtcaaacagtaaagctttatatagctgccccgctgacttttttatatagtcaaggtgctgtttgggtttatcaagcaattgattggatacaatatcattgctttttgccacgtaagtgtgcatttttattgaccaatattatggcttaggctgattatatattatggtcatttttcaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatgcaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatatatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgacacaactagatcgtcagatctatatacacccggcggattcaaatccccaaacaggagtagggtattacctttcattgagagggcctgaacctgtctaaatcctttgtctccgcatccatccactttaggtctcgtacgctaccctcttttattattgccgaattcatgtttcgacacaccatttctcctgagaagcttaaggaagctcatgacaacctcctttccactactcaacatgaagctctcattgatgttggcatatcttgtgatttgcttgatgatagtgctacttgccatattgctcatgttgcatcatctagcatttctacctcttgtgatgatcttgtggatatgtctagctctagatctagctcttgtgtttctatttgtgatgtctcacttgttgttgagaacaatgagcttaaggagcaagtggctaagctcaacaagagcttggagaggtgcttcaagggtaagaacactcttgacaagattttgagtgagcaatggtgcatccttaacaaggagggacttggattcattccaaagaagggtaagaaaccttctcactgtgccactcgttttgtcaagagcaatggtaagtattgctccaagtgtcgtgaggttgggcatttggtgaatgattgccctggtggtaagcctcctaagacatgcatgtttgattctcattatatgcttaggaaggctcatgatggtagcattgttgctagatatgtgggttcccctatactcggtggtaaaaagaatgccatttgggtgcccaaagctttggtctctaacctccaaggacccaaacaagtttgggtacctaaaagagcttgatcttcttttgtaggtgaactaccgcaccggtgggagccattgggtgcttgacagtggatgcactcaacacatgatagggctatgttcaccacatttgaggtaggaggaaatgaacaagagaaagtgacatttggagacaatagcaaaggaaaggtaattgggttaggtaaaattgctatctccaatgatttgtcaattgataatgtctctcttgttaaatctctaaattttaatttgctttcggttgctcaaatttgtgatcttggcttgtcatgtgctttcttcccgcaagaagttattgtttctagccttcttgacaagtcttgtgtattcaaaggttttagatatggaaatctttatttggttgatttcaattctagtgaagcaaatttgaaaacttgtttagttgcaaaaacttcattgggttggctttagcataggaggctagcccatgttggcatgaatcaattgagcaaactttcaaaacgtgatctagttgtgggcttgaaagatgtgaagtttgagaaatataagctttgtagtgcttgtcaagccggcaagcaaattgcatgttctcatcctactaagagtatcatgtctacatcgagactattggagctcttgcatatggatttgtttggcccaacaacctataagagcattggtggtaatagtcattgtcttgtgattgttgatgattattctcgctatacttgggtgttctttttgcatgtcaagtctatcgttgccgagcttttcaaaaagtttgcaaaagggcccaaaataaatttaattgcactcttgtgaaaataagaagtgacaatggttccgagtttaagaataccaatatcgaggactattgtgatgatcttggtattaaacacgaactttccgctacctactcacctcaacaaaatggtgtagtggtgaggaaaaatcgtacattgattgagatggcaaggactatgcttgatgaatatagtgtttccgattccttttgggtggaagccataaacaccgcttgccatgcaaccaataggctttatttgcatcgtctcttgaaaaagacttcctatgagctaattgttgggaggaagcctaatattacctattttcaagtttttggttgcaagtgttatatttaccgaaagggtgatagtctaaccaaatttgaaagtcggtgtgatgaagggttttttctaggttatgcctcaaatagcaaggtataccgggtctacaacaagaacaaaggtattgtggaagaaaccgccgatgttcaatttgatgagactaatggctcccaagagggacatgagaatttggatgatgtaggtgatgaaggcttgatgagagctatgaagaacatgtccattggagatgtcaagcctattgaagtggaagacaagccatccacctccactcaagatgagccgtctacttccgctatgccaagtcaagcttaagttgaagtggaggaggagaaggcacaagatccacctatgcctctaaggatacacaccgctctttccaaggatcacccaattgaccaagtgttgggtgacattagtaagggtgttcaaactcgatctcgtgtcgcttcgatttgtgaactttactcatttgtttcttgtcttgagccaaaacatgtagatgaagctccttgtgatccggattggatgaatgctatgcatgaagaactcaacaactttgcaagaaacaaggtgtggactttggttgaaagacctagagaccacaatgtcatagggacaaagtgggtctttaggaacaaacaagacgagaacgggttggtggtgagaaacaaggtaaggttagtggcacaaggtttcacacaagttgaaggtttggacttcggtgaaacttttgcccccgtggcaagacttgaggatattcgcatccttcttacatttgcatcatgctttgatataaaactatttcaaatagatgtgaaaagtgcttttctaaatggtgaaattgccgaacttgtctttgttgaacaacctcccggttttgaagatcctaaaaatcctaaccatgtttacaaactctcaaaagctctttatggtttaaaacaagctcctagggcttggtacgaaagattgagagattttcttttgtcaaaggatttcaaaattggaaaagttgacaccaccattttcacaaaaatcattggtgatgatttctttgtgtgtcaaatttatgttgatgacatcatattcggttctactaatgaggtattttgcaaggaatttggtgatatgatgtctagggaatttgagatgtccatgattagagagttgagcttcttccttggacttcaaatcaagcaactcaaggatgggacgttcgtgagccaaaccaagtacatcaaggatctactcaagaggtttagcttggaggatgcgaagcccatcaagacacctatggcaaccaacgggcatttcgaccttgatgagggaggtaaaccggtagatttaaagctttatcgttctatgattggtagcttgctttaccttaccgcatctaggccggatatcatgtttagtgtttgcatgtgtgcacggtttcaagccgctcctaaggagtgtcacttagtggccgtgaaaaggattctaagatatttaaagcattcctgtactattggcttgtggtacccaaaaggtgctaagtttaagcttgttggctattccgattcggattatgccggttgcaaagtggatagaaagagcacatccggtagttgccaaatgcttggtagatcccttgtgtcatggtcatccaagaaacaaaactccgtagacctctctaccgccgaggcagaatatgtttcggcgggtagttattgtgcccaattgctttggatgaaacaaacattgttggactatggcatatccttcaccaaaaccacactcctatgtgacaatgatagtgccataaagatagccaataacccggtccaacattctagaaccaagcatattgacatacgccatcacttcctaagacaccatgttgccaagtgtgacatagtcattagccacataagaaccgaggatcaactagccgacatctttaccaagcctcttgatgaaacccacttttgcaagttgaggaatgagttaaatgtcatagacttctctaatgtggcttgagatggtgcaccatggttgcttcttttgcatattgtatatttgctcctatttgctcttatgctttggatttatttccatttggttcttcattgcgaaaatggagcatgtcacattaagggggagttttgcactcttgcatgtgctctacttccttttatatgtgagcaaatcaactaaaagtgctagtagtgtttttaaaatgcccaagtcaacataagtcaaaacttttgcaaaatcaatgtaatttgaaaactatctcttggaaaatgtttcaaaaggttccctatatgttttccaagcctcacattgcaagaaaaatgatttttgaatgaaaatgccattttgaccctcttttgaagaaactagattcttacttttggctaaaatgagatttatccccaaaatgagattgagaaggaatttgagaaaagtttcaaaacaaagttggtagagaagaagatttgaaatgtttttggtattcaaacctatttcaaaaaccaaatcattcaaaagttatttgaaaatcaaattcgcccaaaaacccctatagaccataaaaggtcacctcctagcactcaagtgagttttgttgcaaatcttcataattttcaaatgttatgaatggttggaaatatttcaactcacacatttcaaaattgctccaaaaatcaaatttttgttgaattttattgtgtggggatagccgaactgtgtaagagctgtgcacaggcggctgggggccaggcggtctgaccggcctcatatagccggtctgaccggccggggatggtgggcccaggaaacttccttttctttctctcttcttcccctacccgactccatctcctcccattcagccttcttcttccccaactcgaaaaaaactcctcctctctcctctcccaaaccctagccacctccctccaccaaatcccctcggtttgaccgcggatttctctccgattacaccgtaagtgattctcctcctcttcctctctctaatccatggattagttcgtgtttttgttgagtttttgatccatggcatggaaccctaggtgaagcacgagttgttcttcgatttgcaccaatagagggtagtttcttggtgtgattcaactcctccaaccggtaaatcactctccctcttgtgcattctctcaaatcgatctatttcaccctagggctatgggtagttgttccaatcttgatgaaataggtccaaccttttgatgttctagttccaatcttgtgcaatattgttctagcaatttttagactcttagtagatgtgaaaatttttggatgcttgaacttgtgggaggaggtctgcccggagccacaggcggtctgaccgttggtcagccgccggtctgaccggcgtgtgcgcccagtctaaccggccggcagctgtcggtctgaccggccaccggtgggcggtctgaccggcctgatgccgtcggtctgaccggctaccacgggcggtctgaccgccctactggctgcggtcttaccacccctccataggatataggcaaattttcacctctccaaattgtttctagaattattgctaatatcctatcatcctttgttctttgacagtgatgcctccccgcactcgtcatggtcgtcgtgatgcttctcatccttccagttcggcgcgtcctccttctcctccacaagagtgaagaccttttttttggtgcttgatgccaaaaaggggagaaaagtgtgttttatgttttggtgcttgatgccaaaagggggagaaaagtgtgttttatgttgggttgggactagtagtagtaaggatagtgccctcatatctaataggttaaggtggtttgggctatattatgtacgggtatgggctattactctatattgtgtgttatttgtcgttttgttaaactctaagtcatttggacccttcgtggtcttgtaatagcctatgttttatttgtgagccctttttaggatgttttgtgacttttgtgagttaaatggttaagtgatgtgaacttatgcaatgatggatggtgtatgtgatattgatgtatatgtgaccatcttatgcttatggattgaagtttacattgatatattgctaatgtgtctgtgcttgttgaaatgtgcattggctccatatttgttgtttatgattgatatgcacatgtttaggggagcttttgattgttattgcaatatatgtccatgtgttctatgtttgattatatatatatttgtggtgtttgtcatcaattaccaaaaagggggagattgaaacatctaggcccccgttgttaattttggtaattaataacaagtgctaattgtggactaaccgttgctattgagataatattttaagttaggtccacatcatgtgtgcgcatggatgactatcgatggattaaaattgacggagcaaagcaaagagaagacggtaaaactagtgctttaatttagaattgatcgaggtgtagggcgatcaaatttgctagtttattttctagtttcgccgttctattaagaggggtaatgacctagcaaagagatgattaaattgccacattaggtcattatgcatttagacgtgtgctcgcttttcatcacacacacacaatcacttgggatttcactgggctcggcctgaccaggggcggtcagaccagccacatagtggcggtctgaccggcgtgccttgaccggtctgaccggccgcaagaaggcggtctgaccggcgcataaggccggtctgaccggcggtacatgcgcggtcagaccggcccactggaggccgggatagtgctgctcggggtggccgatacagagccaacggagccgtagtcgatcagaccgagccgatggcggtctgaccgagccgaggccggtctgaccgccaactcaatgtcggtctgaccggccaggccgatggggccctctgacagcacttcaatggctagttttctagccgttgcacagtagcacggtctgaccggccacatacctccggtcagaccggcagagcacaaagttgggggattgcacccccaacggctagttttggtgggtgggagtattaatacttccccaccagcagcaaggggactctcttggcacccaattcaattgcatacatcccttgcacctctctcatacccacttgagctttgtgttcatccatctagtgtgttagagggttgattagccaagagtcaagtgcattgcttccatttgtagagctagtgtggcacttgattgatcatctccacgccgggtcattgcttgttactcttggaggttgccgcctcctagacggcttgtagaggagttgcccggtgacctctccgagaagattgtggaggaggcccggcgccggtttgtgagtggtttggagttcaccaccttcggagtaaaggaagaactaccctagtgatcgaggcttgggtagtcctctccgtgggccggctcccaccttgcccaccccttgacgaagggggcgtgcggtggcttcgtggttgagcggtggagttgggctctcctcaacgggtagtaggaaaccggcgagtttccgaacctcgaaaaaaaatctcttgtctccttgtctaatttgattatcgcatttacatttgtgcaatttacatttctagagacatacttgagatcatatcaccctaggattgctaaacattgacataggagtgtgatttacttttcctagagatataattgagccactatcaccttaggtttgcaaaacgtaacttagttgcttagttagagttaaccctcaccaagcctagcaatttaggttagttttgattaggtgtcatttagttttaaatcgcctattcaccctccctctagtcgacatctcgatcctacacgcttgtcgatgccttcgagctgggtgcaggccccatacagccacgagatgtatccggccgccgactcctcgggatcgccacggggtactcggagctctctacagactctcgtcatggacgtgcagcaactcttcaggtacaagttgaaccacacctcgcgacctcggagtgtttccacggcctgctccttcttcacttctagcatagtcttctcgagctccgctacctcaaatttcgtcttccaatattggatgcgacgatcttcgttagcaagcacactctcgaaatctgctcagcatggaaacaactaagtcaagctgctcttctcttctaagaacacagcaaattaagtcaatccagacggaagagtaaaggagatgaaaacaaagatcaccaacctaaggaagtcgtcggcaagcccgtttccacgggcaaattttgatctacatcgtcctgtgacacatgtggctcaaacgcaagtgccggaacgatcactggcaactcaggctgcccgcgctgctggacatcctcgacatcgacatctctataaacaataacaaagtactcgggatcaaaatgctaaagaaaattaaggtgatgacttcacacgcaaaggcagttggagccaacaaaagttttacaaagcatgactgattaaagagtacaagggaactgaagtcctactcttcaaaaagtgggagaacagactctcccagatcgccgacttcttccatcacgcccttacgcacgtcgttagtcgctccctgatccaagatccgctggagatcaagttcagggtgcgccaaccttatgaacgcgaggatttgacatgccccagtgtaaatcccattagatgtctcctctccgatcctggccgcatgcttggagggtatcgcctccatcgccgtggccagttctgcgagcgaagtcgtcagcgagaactcgtcggggttcaccgggatggtggtcgtaacaccacattccccggcgagctggtgtaggccggtgtaggtgacccgcgacgagccacggatctccgacaggttgttctcgagttccgacatgcggttctcgagtccccgccgttgtcgctcgttgccagccactagttccctcattttctggaggtcttcatgaacctccgccaggtcacacgccagcttgtcggcatgctcgtttgccgatgacgccgccgccgccctcgcctccgcaatctcacgacttatgccgcgagcactggcctcgaggatgcaccccatgtcgacttggagctccccctaggtgaggacgtcagcaggcgggcctcgagtgggcacaagatcgctggcagggccgctgggcgtcacctcacggctcctgggcacgagcacgacatctgtcgaggccactgcaggagacacgctagagtttcctctggacccatcttgcgccgtcttcgcccgcactgacctacaaaagattgtcatcaccagccttcaagacaaattcccggaattcgatcaagtgaaagacctctaatttcatccacttacttttcgccaagtgtcaccagcctctgccgccgcggaggtgacggagacgcatccaaggcctaagtaaaccaagtacgacgtgagggagccatcttccaactacgtaattaataacccaagagacttaccgacggggaggacgctttccggcgaccgccgagcacggaggtgaacttcctccccttcctcgggacatggctgccactggtcgtggcgacagcagcagtaatggccatgtcggacgcctcctgggcgatgccctccttcaacgaggccgccgcctggtggtccacgagcggtccaatgacgtcggtcagagggagagcctgcaccgcacgaagtcattgtgcgatccaggagtaaaaataaaggggtcatcgaatacactcacattgattgcggcttcacgctcggccgtccccttctcgcaaagggggatggggacgttgctcgccgttgtcgagccgctgatcatcaactggccgacgcgacgctatacggtctcgctgttcaaacctgtaagtcaggaggaacatgcacaaaaggaagtcaaattaaacacaagaaaaataccccgaagagaaacccgggtcacgtccttcggccaataatagtcaaaggctgggtggactcgagcctggagcggctggatccgcctaccaatgaagtcggcagcgacttcataccccgacaaacctcttactcagaggtcatcgatggcatcgatgaacgactgaagagaaggggtcaaggcgggtttggcggtccaagacagagtcttgactggttgttcctcaggaacaacaaagattggatctggatcctttatctgaagatagaaccacctcgcccgccacttgctacgagaagaagggcactggaaggggatgtagtgcgacttcagcccaacccaaagtcagaaaccgacgcatccagataccctggtggatcccatccaacgcaactcgtagtagaagcgaaagaggtcgagaaacggctctaccccaatgtaggcctcacaaagatgcgaaaagatactgaggaaggcgatggaattggggttcaaatggagcaaagaaagaccgtagaaattcaaaatgagaaggagaaactcagaaggcggggggagaaaaccacagagaatataatcctcaaccgcaaccatgcgacctaggacaggttcaggttcagtacctcctggttccctctccatggtcccgcgaccggggagagcaccctcctcctgcaacttcttcagggatgcactagtggaagtggacttgtcgaggtccattgccgcaggagatcgccggagaagggaccggcgataaacaagctagggtttggcgggagcggagaagacgaggaacgcttggaggctgaagagctttttcacaacaggcggacttcaaattggatccccaaaatcctcttaaatagatacatttctgacggtgcgaattccaaggaaaggagaaagagatggccgccggaaatttctgggtccgttacgcgcggcagtttttcgaacttcaatttaaattcactcatgaccgttgggcttcacacggtgttgtcgattactccctgtcacctggagaattagtcgaaccaactcaattacgatctcgctggtatcatcgagttccattgttccccttgtaacctatgatttccatcatataataccatatcaactggattagggctattacctatcaaggggcctgaaccagtataatctgtgctttttgtctgcttgatgtcgtattatgtagatcctcgtaccagcgtaccccaatacccactatatccggtctatgggtatcccccgtcgacaatctacttcataattcacaacgtcaaaaattgtacttcatgataaaatcaaacggggcctaattatttattgtaaaattcaaaaaataaaatttatttttttgaacaaatttattttttttgacaaaatccatataagagttttagctagaaattatgaaccaaaattatttatttattgggttcaaagtttgatgaaaacaatgtacgaatttcataaaatttaatttaaaatttatttaaatattttagatttatttttatataagaattgtgtttttatcactaaactagcacataagtataagagaggggtaataaagtctatttataaaacattcaatggtcaactcatggccaactaacagaatggacatagaggagatcaaaataaaaactcaggggtatataagggataaggcaaattttaggacacacaagggattgaacaaattctcatgggtacatagaggattatctcttcaagtaaggattcggatcaggtttagtcactgcaactttggcagtaccaatcatccaaccatccggcaaataagggatggtctagattcttgctcaattttccccaacttttcacctaccctctaactcccaaccgatgccttttggagggaaaatgctgagaggtggtgagagttggcgccaattctaccatgggatcagaagaatacttttgagaatgctctacgacaggtgcccgatcaaacgaacaattatcggacgctcctctgctacatgcaatggaattctctctttcccttttactccgcattgctatgtcgcctgctatctttcttattcccattcccatacttgagtagaataatcgcaaaccatattgcatggcatcaaattataatcaagaatttgggctcacttaactaaaacttatgttttactagttactaacaaactgtagctaatacagaataaaagcacctagtcctcgtcgttggtccacagtcgtcgaccgccttcatcatcggatcaaatcagggcttgacaaaccacctccacaagggttactataccttccttggttgggtggtttcaccacaagaattaccttctccactgctagagattcacggacgaggaccaccttctccatggacattggatcccgctcaagagaaatataaggagaagggtgaactaggagggaaagctttgagaaggagactgcaatgggagagtgtcacggatgagtagcaggattgggcctgcgtgcctgtgttgggtgtaatttaagtcttgggcctgcgagcccacaaacgatggctatttaagcaaacgctgaggattgtaggcggcataaaaacagaaataagaaatacgccttcctcctcaactctgtcttcttcctccagcttctccgttctctcacgtctctctctgcttcttcctcaatccccttctctagatcgaatcgcgtggtgccggaggcgtgtggcggcggtgagttcatatcagagagttggatggctaccactcatgcctagtcgcgaggatggactgaatccagcgctagtcaaaggtctaaactgtaactgtgtgtaaaaaagagatacacagagttgaaagaaaactttaggtacatttgatccattgtaaaactctagtcaaattgacttttgtttcaacagaccattaattcagttttagatatcaacaattaaattaaatcacacattttatacttacagtgttgattgccacaaacgtgcttttttttatttttcaataagttgaggggtataaaatgggaaattaaatgtcaacattaatttattagcttaactaaaattaaggggaatataagaacgactgtataaaaaaatattttctagtttgcccaccttttgtgaataaatttcagaggacctagtttcacagttgttgttaacccaaatctatatatgcagcaaaatatttataaaacccatgcactctttgaagaataaatatctggtaattttgtacctatacacatgcattagccattttcttttgtaagtatatgatttgatggcatatttattaattaaataaagtgtaaaacctttgcattacggataaaaaaggattttagggttttgcgaaaattttgggctctgtttggtacggctccaaatttcaactttcaactctaaactctaactccagtaagagtaggtttctataggagctgaggtgggtatgaaagtgtttgtctagattactaaactccatactaccacgttccttgtagttatttcatcgaacatcttgttggcgttgccctaccgctgttgccgtcatcgtcgtcggtgccgccaccagcggtcagcccgagcgccgccaccgctgttgccgcaggtctgcccgcaggccgccttcacaggtccgccggcacccgccgccatcactcaacccacgcgtcaccgccctgccgttgccgccgtcgtcgcttagcccgcacatcgccttgccaccaccgccactgttggtcataccgcgcattgccggcactagcaccggtgcccatcgctcaacccgcacgctgccgttcgctaaaatatgagagagaacaggcggagaggggtagatgaggagagagaacggagggagaggtgtaaaggggtagttcagtggcatttttatgtaaatactccctccatttcgaaatgtttgacaccgttgactttttagcacatagttgaccatttgtcttattcaaaaacttttatgagatatgtaaaattatatgcctacataaaaatatatttaacaatgaatcaaatgataggaaaataattaataattacttaaattttttgaataagacgaacgatcaaacatgtgataaaaagtcaacagcgacaaacatttcgaaacggagggagtacactgaaaaggcagtggctatggaacagaaaaacctagctccactcccactcctgcagtagaatctatactgtttggtacagcggaagctgtaggtagggcatcgtccaaactccaaactccatttgcatttctgggcggaggaacaaccgccggcgatcagggctagagagctcgccgtggacagcctcctcctagctcccctctccccgccgcacgccgtctcctccaatctgcggcctgacctcctcgcgcgctcggccggcacggcaagaaaggctgacctccgtctccgttcgaatcggagccgaaggtatatccatcccttcttctctccctcttcctcctcgccacttcatgacgcacgtatgacctggcctggccgtgtgacctgagttggagatcaatccgagggggtttggattgatttcttaatttcttcctttccctcgaatcaacccatccgactaggtgtgtttgattcgtcatgttgtactaatgtcagttcgtttccaagattttggggtccatgccacacgttaggtaggcccctgatgaacgcacgtatgctccctgattggggtaaaataaaaaattggggaaaccctggtagattctccaaaacctcaccttgaaatttgtccaagtgtgtccgttgcttgactatccaatcaagctgaaatgttgacagtaatctgtaaaatcctattcacatttgtagctacttagaccatcgcttaggcagattgatggttttattatgaagtcttgattgattttgttcatagtgcagctcacacataaaaaaaaactctgcacgaattgaaggctggggctaattagtacacgttgaatatagaaatcacccttcctaaatcggcgcggtctctttcgattatatgaggctgtattctacaattgtgtgtatgatctaatgatggcagagatctagtaatactagttaagatgataaattcctggtgtgcggttgagagcagggaaatgcactagtgggaacaaaccagttcaggtcactagtttgatcgcatgataatatagagtgtatgcattcatgtagcttccgtatgataaggtcttgtacaagtgcttttttttttcgccgggcctgtgaagagacaccagccgatttcattggattggaaggaaacaaattacaaagattgttcaggttatatgacaacagtcagggcagttggaagggaagccattccccagtaggggggacaagctacgagtataaagcagagaaacgtataagtgcatttgcaggaaacagtggacctgctatcttatcttatactccatccgtcccataatataatggattttgagtttttgcttgtaacgtttgaccactcgtcttattcaaaattttttgaaattattaattattttatttgtgacttactttattatctacggtactttaagcacaacttttcgttttttatatttgcaaaagaaaattgaataagacgagtggtcaaatgttgaaagcgaaaatcccttatattgtgggacggagggagtagtataatagcgtaagcatttccagaacgtttgtttgagaaggtcttatacatgcgcatttcacaataggaagcaatggaactgctagcccagatggtttgtcctcacttgagttagtttgtaggtgccgggctcaaaaccagctgtgtgggctatttctagcatttgtgagtaactgcgggttgggttgcctcggccacccaggcaaatcaaaaatctccaggccagttgtaacttctatctgatggacggactggcccaagtgatgctttttttctgttcaaactgcggggtggtccaagtctgatagcaatatgctgctgcgcaagggtttgagattttcttatttcccttgtttctcctggacaatagagcacagctctcttggtagatccttttttaaaaaaggaaaatcataagcgtccttttctacgcctactgtatgtctgtatgtggtgcatattggtagatatctttaataccgaaatcagggctatggatctggctttttattgggccacgtggctccctaaaaatttggttacacccctccaaaaatttgccacgtgtcaaagcgacggtattcactctccgagagatcgggaaaacgttcgcctatatacgcttgcaacgtgggccaggcatctcgcaaggccatgcgagcttgggcctggcgccgcacggcctttctccgcaatgtacctgcgctgctgcgcatggtcctcatgcagcgtgaagctagcacatacaggtacagattactaagccagtttagaataaaataatatgtataaaaaaaaggagaaaaaaataataggatttttagccttttcataataatcttttaacaaatgcaatttactacagattactcggaatgaggaaaagtcacttcatgttaatatcatgtgtttcaagagaataaaataaataaatagttaaatcaaatggaaaaaaaatagtgacagcaaggattgcgttaggacaattaaaaatcttcagataagatttacttgaaacgaggaaaataccttaatttctatagaatggaaggaatagaagtgaaatttccatgtgaaccgagaagtttataactactttcctattaattcagagtatttttgtttttttttctcctcacattatacttttttatgttaggaattcatttattttagaacattggtaagtaacaacaatcatattgctatttttttattgcgaaacacaatagatatagatgttcatatacacgtgtgtatacatacctgtaaacgcacacatacaaacccaatcactacaagcacctccgaagattgggccgtcaggcatatcttaggagtgatgaagaatggtgggtttcctaccattgaaaaaacaaatagccgtaaatacaagcgtctatgctaagtttagaacttaactcgtataggtagagaacctgaccagctgagctctacatagtagtatatctggatatatgaaatcaaaataagtgtctttaccatgtcatcgtcctttatttctaaatgaaattagtataaaatttaggtaatcgaagacacgtttatttcggatatgtatttcctactaatacgaactcaatggcttacatctatatgttggatattaataaaacatatatttttactaatgttcagcatgacaataccactaatctagatgattttactattctaccttattttgttcacaaacataaaaataaaagggaatggactttcaacaatccttttcgatgtatgatttctgaagggaaatacacacatgctataaactaacttagctagcgtgacaactggcacgctcattttctagttacattcttaaaaatgtgtactagcatagaattaaggataccattaaattgaactttaattaagtgcatatgcctaaaattgttggatcacggttttacatgatgggttacaagaccgaggcttattatatcctatcatttccagcatgtacttgcattatccattttttctttaccatttaattttttgctccttagtgtttatatgctgaattgttggtgcaaacatgagaaaatttggtttatatgtccttgaaaatatctgcaaaattttatattctttgtatcagcacagtaagtatgcatatttatgcccttgatagcataagacacaacattcctagctttgtgcagtaatctcttaagcatttgtggatgttattctgattcaaagattgacacaaccacataggctgacatcttgtatattgggacctttggcaggcaatcggccatggttttccttaaggtggatatgtcttggaatgtgttgatctcacctagcgagctgagccccaagggtctcttgctccgcaaggctgtcattgttagtcttctggaggagatagcaaacaggaaggcctccaaggatcatggttactacattgctgtcagtgagctgaaggcgatatcagaagggaaagtgcgcgagctgaccggagatgttcttttcccagtgacattcacctgcatcacacagaagcctacgaagggcgagatcttagttggctctgtggataagatcctcaagcatggcgtgttcctcaaatctggaccaatagaaagcatcttcctgtcagagaagacactgagcgactacaagtacatcggtggggagaaccctatgttcatgaatgaccactcgaagctggagaaggacaccgctgtgcgcttcaaggtgatgggtttccgctggatggaagctgatcgccagttccagatccttgctaccctggctggtgactatcttgggccactatgaactgcttccacaggttagtggtgatgaatggatctgaaatgtattatctttaacctgctgtctgtagtttgatgtcatgatgatgatgattagaccagtagctgtgatgctggctgttgatgtaagtgacatttggccctatgtttagcatttcagcatgatgcgaattgtcatggccgtttaacctctgtttcctatcgctgctcacagttctcctatgcatatatttgctgcattcctttctgagatatttgcctttgcaacgtcgaatttgcaatatttctctatgcaattgtttccttgtgttacaatcagcttaatatgcaagtaacatcaaaataccccagatgttaccctgacaagcaaatcatttttgccacaaattagtctatgacagctagtagtagttggcacttggcaaatcgtgttgtctgcttcagtttgctctttgctacacactttttgccgagagaagtagaaagcttttaaattttacaaagaaatttctttttttcctatgttaattcaaattgagtcaatcatatggtgattcgtgaacgaccatctagcttcaggagaaattaacgatctgcaaccgggtttcagaggaagtttctctgcaaaatgcatctctgatttacagtggagctcgagaaatgaaatagatttaagtctgaattccaattaatctatccatagttggacgcagggctagtcactgattttggcaagtggcaactgattaatccggcccctaaatggcacagtgaattgatgttttttataccgaagggcaacaatttgtttagatgtacaataaaattatttacgacttgttaataatgtgaggcaataataaagcattcactgtccgtagccaacaatataggagatggacttcaattgtgcaatataattttgaagaataaatgaaagaaaaaactgtttttcttttctgaaagttgaccaaaagtcatcattccaagtcgttgccgtgtcgtgtctgatacatcatttttgttttctctatctatcataatcatcatcaatccatgtgtatctttagcatgactgaacaaagttcgccattaacaacctgacttgcctagagccatagcagcctgtgcatgttcatcccatacggtaacaccattagctatgttttcttgtgctttgtactactgcttttatgcctttatcatcctcctttctacctcccatgccgaagaattcatctacaatggattcactgatgctgatcagctaacactcgaaggtgaagcttcaattgacaggaatcgcttagggctaacaagtcgccttaacataggaggttttggccatgccttctacaagtatcctctaaactttagaaagaactcaaatagtcccaatgacccctcctttgctacaacattcgtgttcactattactacttggagagatcagcctcaagaagcaggaagtgatggtattgcctttgtgctttcttccaccaacaagttgataaaccactccttgggaggtcagtacctaggccttttcaatgcgtcgaatacttcacaaaatatattagctatcgagcttgataccttcatgaatcctgatttgaacgacatggatgataaccatgttggaatagatgtcaacagcttgatttcaatcaactcccataccgctgggttctacacctctgatggtggattccaactccttaggcttgccaatggtagatctccaatattgcagctatgggtggactatgatggcaaagctcaccaactaaatgtcaccttaggtcttccctattcccctaaacctgaatatccgctactttcgagcatcgtcaatctctcatccttgttaccaagttcttcgtacattgggttttccgcgtcggtaaattcaccgaaaactagacattttattctaggttggagcttcaaggaaaatgggagagtcccaccccttccttcagtcccagtcacagacccagaaacatatggatggggaggcaacttctttgcgccaccaccacctccacagcttaacacacaccaagttcacaaacactccttgcaaattctcctaccaatagttatgacttcagttatcttgcttcttcttgttgctttccttggttggcggaaaaaagctgggccacaagaagactgggaaatgaagtgcaggccaccatctttcatatacaaagatttatataatgcaacttctgggttcagtgacaaaatgctccttgggaagggagggtttgggaaagtttacagaggatttcttcctgcctctaagcggaatgtcgcgatcaagcgcatctccccagagtcgaagcaagggatgaaggagtttatgtctgaagttgcaatactaggcaatgttcgtcaccggagtctttcagttacttggctatcgcaggaacaagcacgagctcctcttggtttatgattatatgcccaatggcagccttgataaatatttgtatggtcgacacaaattggctttaggttggtctcaaagatttcgcaccatcaaaggtgtcgcgtgtggactcgcttacctccatgaggaatgggagcgtgtgatcatccatcgagatatcaagtcaagcaacgtattgcttgacgaggaaatgaatggaaggttgggtgattttggccttgcaagattacatgatcacagagttgatgcctacaccacacatgtagcaggcacatatggttacattgctccagagctagctaggcttggaaaatcaaccaagggtaccgatgttttcgcatttggggtgttcatgatggaggctgcacgtggaaataggccaattgaggtgaattcctgtggagaacctcaagcgctagcagatcatgtgctcaatgcgtggcaacgcagttcaatcataaactccatagatccaagtctggaagatcacgttgcagaggaggtagtattagttttaaagcttgggcttctatgttcacattcatcgcccaaggtgaggcctagcatgcgcttagtgatgcaatacctggaaagggaagcaacgctccaggacttcgcatttagtttcttcagcatcaatgaagctaataatgaagtttatggtcagcatgttgtatcaaatccctctgtagcaaccaccataaccactctttctggaggaagatgacggttgttgcagcatgtattttctatatgatcatatacaattttacatcattgtgtcgactgtaatacaatgttgaaaaaatactaataattgttaatccgtgctcctgttccttgtgaaatacaccaaagagctgttcaaattgttttcgctagcacattacgaaacaattgtagactttgttcacaaaccagaaggagaaatctatatcgtgatgcaggaataatccgattgttaatcaattttacaaaaatcctcgtactatccaattaacaaaacgagattaatcacatcatggaataatctatcacgcaatagattaattttgttccattggaaatctgcagctcaatgtagattattgaagtcgttacatttgtgttcatcgctggctaacacaacaacaggtaagatgatgtccatacattttattttcctaatcatctaacttgtacatacattcttttacactacaacataggctcccgatatgagtcactacacttgccctatggaatccttctaattaactagtgtggtggatgtcacaactactgtaaatcaaggaatgattttgctacaacaaacagctgatcatcagattggggaacccagattccttgatctgatcccaacagataaatggcatgtcctaactcctaatgctattcactattcacgagaaagggtggcaacaagaagaggagcagcttttgtagcagagcattaatgtagatggtgaatttcaatcaaaccaacgagggaaggaactcaaatttgtgccttctgacaagggtgtttgactaggcaaaccctcttaagtcatgggagaatgcaaagttgggcggcagcaacataaggggatcgtctccagacttcttcaggtaggccatcgccagggcgtatccaagtgctcgtccaacaggtacggccaccgcatttccaatctggcgatacctgcagccaggctcatcacgtgtaacctgtgctaaagaaggctcaaaaactaccagtagctatacatattatcactcctctttgggcaagaggaccgtgatctgcacgtggacatactgtcaaccttggccacctgatccaagttctaattatagggtcgactactcagggtatctgaatgcattgactgctagaaaagaaaaggcgcatccaaccttggcccccaggaatggaccccaaccctgaactacaaaccctgaactactaatcatgtgaggccactgaaccatggattttagctgaagcggtgcaggtgttccactggttttgacatgtgtcgtgaattaaattttggctaacatagcaccccaattggaagaattagcaaagttatagccctcacccatcagtccgtatcttctacttctagcatcctcgactacatgcaactcctctctgcacgcaaccacccatcgatctctctgaaagccctaattgataagctcatcctttttcaccatgcacatgatgaccaacagtaacagaatcttaatgatgacagcagtagtgagctcactactgttggccacgcaacaaatgttgctggcggagtggcgatagtggaccttgaggatggtgacaatggaaatggtaggcttcagggatgacagcagcagcggaggaccttggtgagggaggttcttcaggaagagggcaggagaaaggaaagtaaacaagggctgctttggccactgacgtggactccaaatcaaacaactaaactatccatgtatatgccacctcagctaattccagcttcaaatagcattgagtgggtaagttacttgatattgaaagttatcaatggtcatcctgtcttgcagtacagggtctttagtcgagggatcaaaagtacccaaatgatattatttaagaaaacctcatacgtgcactaacaataaatcgcagaattcaatagtttagatatgccaattcatagagcaacatggaaaaaattgagcccttcatcactcaaaataaaaaaggtaaagacaaacaagtacctgtctttgactgttccacgaaacctgtaattgtcaggaaagccttgcaaccgagcactttcacgaatagtaagcagtctgtcttgtgcaggatgtatcaaggcctgaaacataccctcagtaattattttgaatcacaaccaaagtggataaaagaaatgagagaatcaaagataacctgcatacgggcatttggaactgtcagcacggttcccactacctcatcccaccatactcgaccaaaaggtctaaaaataaattatagaacgaacatataaagcataaagaagaacaaatatgtctacgaacaacacaactagataaactgaagtttggaaccaaccttaaagatttaccattctcataagctagtatgcaatcaagcacctgacatgaaaaacaagaacccatagcatggtaagctaatcaaaatttgcacaaacagaggtatagttccacataggggagttttgtggtttcttgttaaatgtcttaccagaggacgaccagatggcaaaagtactctttctttcgttggatctaatctagccacattgtcaggaccaactatgactcctgaaaggtctctaaaattagctccctgaaataagacagatgagactataaggtttaacctaccaaacttaaatctgaatgtaaaaagcatttcagccaacctttctcttgggaatttgcaatatcctttggtagttatcattatccagtaccaatggtcgatgatcatacaattttgaggatttggaatcttttgtaacatgagctctgggaccatgcacttctgcataaaatttcattcgtgagtttctgatatagctacaagaaacataaatataattggtcaacaaaaggtgtattagttaattcttggaaaaaaaatggaacaccatatagagaaaattaacacctaaaatgttaaattattacacccatcatatgctgtttttcaatatttcgccaattgaatgcataactccttgttccatattttacaataattgctattaaacagacttataaatgatcatgggaaaataaactgaactctgcaacttagtttctttctttctctttgctaagaaaactaatctagttattattatctgcccccatgatttggacattttaatattcggtgtgtatgggaatacatattccttgttacaaaaccttaattttattatccaggttcaggaggaaaatccaagtttttttaccagaggggaaggcgatcaactcaccaacattaaatgaccgaatgtatctttggaattcagtttgaggaccctttacatacagcatttcatcacggctttccccatttgccacctaataattcaacttaagtatcaaaatgccattcaaattagatatttcaaagatataatgttgtcagttacttctgggagatcagaaagaatgtcttcaaggacaattggtcttgctagttgcattggtgtgtcattgggccaaccaaccaaattacgctacaacgagaaagaggaa

SEQ ID NO: 77104 - DNA, 5823 bp, Oryza sativa
  unsure (1)..(5823): unsure at all n locations
ctgcagcccgtctggctaagctggcgccgacgtggcgcctacgtggcggccacgtgggctggcgggaggtagacgacgacccggccgcgaatggacggcgggcggcggcggcgagcggcggagcgaaccacggcgatacgggcaaaagcgtgcacaccgggcggttgcacgtgacaaggggaggcgagccaacggctcggattcgccagaggttgctcgacggcggcggattgcggcagcgacaaccggcggcgggagaagagggaaacggcgacgaggtcacgagaggtcgattcccggcggtgagagcatctatgcggcttcgggactcgacgctagcatcggattgggcggaactacgccgagcgaggccggcgacgagcgggtgctacggagctcgggcggcgacggcggcgagcacacggcgatcgacggcaacggtcggggcggcgccggctaactacggggagtctacttaagctactaccgaaagctagggggaggagatggagcgaggaggaagaacggagagagacactaccgtgcgggacggggcgcagtgacgagaggccgacggcgcgggagtgatctctccggcctcgggccagggaagaggaggaagacgagcgcccggagtccccttccgcgtcctagtgcgcaccggctcctccggcacacacgcgacggctgcggtcggcgagagggacggcaatggcgcgggcgagaaacagggaagaatgggagaaaagggaagggagggcgcctgggtttatagggggcggcaatgtcggtttggaaaccgactttggcggtcaaggcgcgagctggcgctccggctagcggcgaaaacggcgacaggagggagggaggatgacgccggcgggaggaaaaggggaaaaaggagggagagaaaaggggcttgcccttttgccgattcgggaaaagggggagggagcggggcgactcggcagaaggagaggggctctctgcctccgccccttggaggctancgcgcggagtggcgggggccgggcgatgacgacggcgatgacggcgggcggtttggagtggcgcgacgacacgggcgacagacgcgtgcagaggctgacggcggcggcgaccgggcggtcggccactcggcacgcgcgcgcggcttgcaacgggcggcgtccgcgcgggtggcttacgcaggcacgacagagcgaggagaggggaagggggcgctcggcgcggctctgcgcgcacgcgcgcgcggcgcgcgggcgaggcggagcggagctgagcggggggggagggagagcggagcgcgccgggaaggggagagggccgggggagagggggagagagagagagagagagagagagagcccgggagagagagggccggggaagagatgggccgagcggaattcggcccatcgaactcgggggaggcaaactagacttttgcggagggattcgatttggaaggaattggattcggaattgaactcgacgatagatcggggattgagatcttgagatggcacggacactagacaacaatcaaagaaacaaatttcgcaattagggtttttaagagataattttcccgttaggcgccacgacggaacgggcgctacagttaatttccgttgtttgcttcgtatctcatagtaggtttgaggtgggtgtagaggtggtgacagtccttaagtacattgaaatcctccctgtccgggtacgttgtagagccatatctagagcagcgagctggccagcgcccgaagtaccgcgttaggattaaattgggctttccgtagacattgtctctcgctagtaaatcctctctaccttaaaataccttagcttcgtgtccttggatgaacctgaagaagagctgacacacacgttccctgtggaaatcaataccttgcaatactctcgggtgaagtgctacatcttccgtgcgtttgcgttttttatctgtgacgttaaaaaataccaacaaagagtttatttacaaaatactcttgagctgaagtgaccacaaaagtgtcgatttgatcaagcagggtgttgcatgttcttcgcaatgttgttgcactctgagaaacaaatttgggattcactccatggagaagatgtgtgtcgatttgattaagctccatggagaagaggttgcatgttcttcgcaatgttgttgcactctgagaaacaaatttgggattcactccatggagaagatgtgtgtcgatttgattaagctccatggagaagaggttgcatgttcttcgcaatgttgttgcactctgagaaacaaatttgggattcactccatggagaagaggtgtgtcgatttgattaagctccatggagaagaggtgtgtcgatttgatcaagcaggtgttgcatttacttcgcaatgttgttgcactttgataaacaaatttgcgatttactccatggggaagaggtgttgttgctaatggtgaagacaccattgtatctgctattaatggtaaggatccaacctccagtctttgttattagtatgaatattgagggaagatgagttaagagctgtaatgaatttatctgttgatggcagtgaatgtgtaatcttttgattgactgccgatgatgatgaagccttcctcttattcatcaaatgttcggtaagaatcctcttattcttcaaatggtcagcaaaagtagacatatctagcaccactttcctcttatctatagtattcaaccgatcaagcatacccctttcctcctgttgccagcgacaaaccaccggagacaaggaggaagagagatatggggagaggagactggaggagttttcacccgagcgtgttaacgagagcttgagaaagatatgtaactagctagcaagcccgtgaacctggttggatcttgtttagagtacttcattaagtacttttcacatatgacatatcaaatcaatattcatgtgagataagcttcttcggtggataagctttggcagttctgcagagttaggtcctgcggcaaacttggaatgatggtgggacaatagcaagctcgtttgctttgtgggggtgatgggtgtcatgatatatggcaatgacaacattgtagcgtccatttttgacgagataagctatggtagctcggcgagtgtggtgctctgtggcgatgatggcatggtgccgacgtacttgttcgtgttgtgatgatgtaggttgtccaggcgacacttgactagtgcttggtgaccgcaaggcagctgggcagactagttccatcctttttctccactcacagcagaatagaggagcctttttggtggctgcaatggcagtgagtaggcgtggcggtggaagggcgagctagctcagcatttccttgaagtttgctagctcagcatttccttgaagtttgaagcaatgagaaaaagcttgcaacttagacttttagtttttttctttaggttgtttgttttttttatctcggttatgagattagtagtgtatgcactcgtgtaacctttggctgcatatatccatttgtggatatagaggccagatttagcttagccgttaaaagctatttttaataaagagtaaaatacatggagggtcatctaaattgtttaggtgtgtcatataggtcactctacttctaaaatacacatctggatcaccaatgtgaattaagtgagtcatttagctatctaactattctcatgagcacatctcgtacatattgcgtgccacatatgattgaaaaaattgtttgggcatccgtagccgctgcctcttaggatttaacctgctttgctatttaagtttgtcatcgctgccgcttaggagtatgtttccgtcgctctttatattcatgacttgttgcctctgttgctaggttttatgacaagcgagagagaggattgagaactagaagaactcataaaaaaagcacaagtgaaataatttggcttctctaattttgtgtattttcaagtgctagtgctgtgagaaagggaaaaaattcacacgcgattttctgcacatgtccgggagcaattttttcaattataggtggtataccagatctacagggtttgctcatgtggatggttagatgggaaaatgactctcttaactcattagtaatctagatgtgcattttgaaattagagtgatctacctcatacacctaaataagttaagtgaccctccatgcattttactcttcaataaaaatcctaaatttcaaaattttggtattttgtgcgtacgtagggtctagtagactagtagcaagatctgaattaaaagtcattccttgtgacccaaaacctacatccaaaatgtatatctgaagtaaactctcgagattcggttcccttcctaaaaatttcaaaaccctgatgtaaaatttcctacaaagctttcctttgaccttcattcaaatcttcaccaatccatttaaatccttcaaattacccaagaatgagagcttcccttgaactctacccggagaattcaaatattaattttgagtttggaacacttctaagatcctttccttcatctatctacattttttctccagatcatctaaaattatccaaaaaatcctctcataatcccaatcaagcgttatccattgaaattcctagaaattatataaactcaaatatatcaagcataaattcaaattctcagaatatctcccaaaataatttcatgggaaattatcaaactatagtatgcaattgggccacgtgctccctccatctccgtcttctctccctagtgtagcccaacccatctcctccatcttctagcccaactcgatccagcacaactccttccatacctatcttcttcttttttcttttccagaccggcccactggcccagctcgttccttccaggccaacctcgcccatggcaaaggaaaaagtacaccgaaggtccctcaacttgtcatcgaattacaaaatcgtccttaaaccacaaaaccggatacaacgcgcccccaacttacaaaacctgtgtagattaggtccctcggtggttttgactttggttttgtccaacgtggcaactgactcagcgtgggtcccacatgtcagccccttcttcccttccctctcttcctctcttcctctcttcctctctcatccctaaatcggcgggggaggagcggcagcggcggtgattgcggcggtcgctgcagccttgggggagaagaagaagcggagtccgaaggcgacggggtcggcggacagcagcagcagccagcgctcctcctagacgtagagctccatggcggctgcgaccaggtcggccacgcgacactcggtgcgtgccatcacgtgcagcggccacatgctcggctagcaggtcaagccgtgtctgcggccgctgcttcagcagcgagtgtcactgctctgccgcgccgcgcccgtggaacgacgccgaccgctgccgcgacttagccaccgccgccgccgtcgtcgccgccgccgccacgtgccgcagggcccttccttgttgtcacgccttgaagttcccctcccttgctttaaattcataaaataaatcgccagaagaaattgtttaattaaacctagagctaatcctaattaataaatgcaatcaataattggaaatggcatggttgaccttttcttgagttccccatgctctaatgtgctaacaggatttttagtggaattttcagagcctaggaaataattttaaccaactaaaattagcaaaccgcaatattttaatccttggaaattctttttcccttttctcctttctttttcctcctggg

SEQ ID NO: 77105 - DNA, 29374 bp, Oryza sativa
ctgaaggaggggtggtccgggaacacgccggtgtcgatcacgccgacgatgacgccagcgccagctcccgagccgcgtgggacgacgacgaccaccgcttcccctgcggcggcggcggagcactcagcccgaggaactgcggcgtgtgcgtcgtctgcagcgtgtgcgtctggtccggcaccgcgctcacgaacccgggcatggcggacacggcgtcgagctcctgccgcgtcagcctggccgcgaacccgctcgcgacgtggtggtacgcgtggaccagccggccgtcctccggcaggaacgtcttgtaccactccttccggtcatcggcggtggcggccacgtggctttcctgcggctgcacgtgcacgatgaacgtgccgatctcatcgccggtcgcttcaacggcgatcgcgaggacgaaaacgaacggaagaaaggagagcaaggagagcttgaagccatccatggcgggtttcgttctgatacgacttctgagctctgcagcatttgcacaaattggcggccattttataaagctaagcgctttgtcagattaagctggccggcttttgcctggtcttcaggccgtgacaatatgcgaggattggaggcttggagctacggtaaaattggcaatttgaagaccgggttaatgaacaaaaacggagcgaaacagacacatatggctgcttgggaattgccgcactgtgatgggatcttgctgcaggaacggagcggcagccgcccgtgcgtgaatatgcgatgtttgcctcatagtacttaaaaaaacaacatagtattggatgtgatattttctaatacaacgaatctggatagactagaaaatatcatctctaatacgttgtactagaaaatatcacctccaatacgttgtactaaaaaaaaatatcgcctccaatacgttgttgcctttttttttttttaagaacggagggaatgctacatagccaaatggcattgtgtacgtcgtcttcgtttggatcacataactcatttttctgtctgttgaaaggtgacccaatttgtcgatcatcttagcaagtcggagcttagatctaaccgccgaaatcaaccttcgtatagaaacaaggttcgtttatccccagtttttttttctttcaaaggtcgcctaattctctgatcctaactagttatagtgggcctttttgtgcagcccaatactggcgattccgcgagcctagcctatcaaggcccatgtaaaagcatttggtatcggtccagatcacacgtcgcaacagccgctcccccggccgcttgccccgacagaaaacgaacatttacgctgcggcgagccggcgaccatggcgatttggttggattgtgtcgggcgcgctgtgttccgatccaaagcgaagtgggttggcagcagggtttataatatcgtgaggtcatcgtgattatcacgtacgctaacatttttaatttttaaaatcataatataccttgtagttatcacgttaactgtcaaactgtgagatggtggtaatctcacctcaaacattttggtaagttggtcaggtatgcatgtagctagcttctgtccggccagaggaacggaaaggattatgccacgcctttcgatcgtcacccgtgaagaacacgagggcgtctccagcgcctggacgtggacaacaatgaacacgacgacgatcgagtcgatcgacgagctcaccttccctgggcgcggcctcggcggcaacgatcgcgaggctgagtagtgtttgttgcatcattgcatggatgggtttgctcgaggttataatctgagttgatcgatcagttggttatcaatttcagctttttggaaagccatgctcaaatctcaatggagacgaagaattaagagagaggaaaaaaggctgtgtttaaatttaaagtttagatccaaacttcagttattttctatcacattaacatgtcatacacacataacttttcagtcacatcatctccaatttcaacaaaaatctaaactttgcgctgaactaaacagccaaaagccaaagtaagatatctgcacctgctgggctgcatgtaggcccgctacaccttttgcttttctgcacagaacatggcctggagcctgtagggaggcccagcgctgcagcgctcggcctggacacgatttgacgtgcacaaagatgcttggcgctggcgctagtttgttttgactttggaccagctctttgggcttggggagtttcttttagctttttttttttaccaagagaagctgtatttatataatccaaaatatactgaaactagtagttgagtttctcgacttcttcaaattttcctcgaattttttattatactaattttattatactgaaactagaagtcggctaccaatcaattgtttatgagaatcttaagctcgctcaaatactagcggaattgccctcgaaaccaacttcgctatgtaatactcactttgctcccaaatataaatatctctaggatttaaattatatatcataatataagcatattcctctggttttcatgatttacattatttcgatgattctaaagctaattactacatgtctaaaaaggaaatcgaagcaattcaaaatgaacaactaaagtgattaaaaaggaatattttaacctaatgttagtatttgttaaatatagcaatttataaaaagaaaggatgtacagtagtacatatttttgttttaccattgttattataacactatgcttacttttgaaaggaaacacagctatacaatactaatttatttaggattgagtttaatttgttgtgccacgcaagtttaattaagttgcgctttgtctaactatgttgaattgccttttgtgttgaatggacgaagttgtataaattgtggaaattattcaaaggttcaaacaaataaattaaatattataaagatgaaaaatagatttaaacaattttctaagaaatcatactagaaagtttttctttttttaaaaaaaaaggcccatttaaaagctcgagaaatatacacaaatatccatcattccaccttttttttagaaattaccggaggggagagcttttccacctgaaattttcattgatatgagggagtttgaatacaaagttcgagcaaactacagcgtcatgccattaaatattttgagaacagacagggcgagagagagagaaagagagtttgtttacaggcagagacaacaatctggtctgaccgccaaatacgttctgcacagatagttgcttcatcgatgcagctcggagcatgcgctggaggcaaggttgttcatttttttaaaccactttgtatcgataattcctaaggcatcagaagcacgggaggaagaaaaggttgtttttaaaaatattttcccggaaggtccattaataaaattatttattatatactaaaaatccattaaactttctaaaaacgctctcaagccgacacgtggctcttctataaacactgctttgatatctaatcatcgattttactttaaatttggtggacccacaattttctaccgttggatttgctaaccaaaagaaaaggcccacatgactgtccatatacgtacggtgctacgtatgctcccctcctcaataatgaaaatatattttgtgataactaatatttatccacgtacgttattagattatttaccacaaaatttataattcaagatccaaactaactatatttaataagtagaaaaataaaacacatttataaggaaaatcatatagatattttaatgatctatttaacaacacatatctttgattggatattttatatttatagtataggtctaatttaactacgtatatttgcataaatttgtaaagtaatatattttatatttaaattgtaggaaatcctatcaattttctttgcaacattagtacgtacatatgatttttggctttattttttctatcgtataattacatacaaatggtcttttttttcttacggcaaacagtaggtaagcttagtccattaaacatactctattttcatttaatttgggggaaccattattaccattagatttttatattttgtaaaaaaaatactaaatcagtttatctcttaaataatcccacattaccccgtgttctcgtgtgcctgtacggacgtactgtgtcccagtgtacctgtagtacgtacttaagtacgtccgtacatacatatcccctatgtctttttctttttttccctccttatacttacattagatgaaaaactaaaaagtccatgttaactactccataaaaaatatatgttttaatatgtaagaatatatgttattttaagttttattctaaatagcgcatatcatggaaacatccataaaaatattaataaattaaaaatgaagatcatataattgtatatcacttacaaacaaagttagattggacttatattttaaaaataaaaacaacttaaattgtgagtagcattctaaaaatttactcactccctactacataatagatatttctaaatgacattacaaatttatcatgaatgtatttttatatattatatgtttctttagtcatgtatttttagaaaattaatgatcatatattttttttgacaccatgtggatgtccttttatctcttaggcttcattcgttctagctcattggatgagcttacctcggacacgcgaaacaaagcatatcatcagtgtaagactaattaagtattaaatattataaactcgaatatggatttatttgatattttagaatactttgcacaatagtttaggaaacatgctcaccataaatgagggagtagccaatctgataaatactttagaactcaatcttaaatttattactaaatatatagtatataaaatatcatgtcaatcaggaatagtcaaatatatcaatcgtatatccctactaatccctatgtatataagtttcatataaaaactactatccaccaatcgtcaagttacattatgaggcatccgtacatagcgcgccaattattagatggcatttaatggtcacgtgcattatcaagtaccgataaaggacaaaagtgggcaaacatcaacgaatgataggcaagtattgataccaaccataaaagattttaacatttagaaataaatagatgtccgcactcgcattttcctacaaacttcctatgataaacttcctataaacgctctcaagctgtgatgtagtactcctacaaacgctcctaaaccgtcacgtggcgttataataaatcccagaaattcaaagaaaaaaatctaaccgttgtttttatttattctggtagacccattgtttccgtccattagatctatcttagaaaagtaccattaaatttatctttaaaagtctcaacatctagatgcacataggtacggtatgtacgtactcacgcaggccccacgtccctctcttttgtttagttttctttgtgaaatccgaaaacaatacaccattaaaaaaaatctgaattcagctcaaagctatatttgggatttacaattaaaattcaaagctcctttgaattatatgaaaaacaaacaacagtgtgcgattaggattcctattgattgcatgactatactatccttaatttggtttgcacgaataggtcatagtaattttgaaggaaaatttcctatcctaccgttaccaagcaaataaacataggaaagtttaagtccatcaaacatcttacgaacactcctaaactattgttaggcatcctagaaatgctcctaaccattacatgacactataatgaattagagaaaatcataaaataaggaaatactcacaacatgtgacaagttataatgcacacatttagaaataaatataatggtatgatgctggactccgttgtcatatagaatataattacgattttaatgttttactgcctaaatatgttaagagaaaatagaaataagatacatgcgcatgttttttttccttcgcatgggatcaagacaatcaagctgctaaatgcaaaggttgtttggttaattgcattttatttatgctctgataggtgatgatttgatctatatgggtttaacaaattttgaaattcctcttatttctgtactccatccaaaattcgtttattctctattttacacatgtatttctaacctatttatgtaccttttatattttcctataattttttaaatcatgtgttataaaggaatcttcgaaatctttcaccaagggaaaatcataatattcaaaatcctaataacaaaaaattatgatggcttaaataaaatgtccgcgtaactgcgcgggctacttttctagtttttttaaaaggtctaaattatataaaaaatttggatgaaagggttgttggcggcggaatatggcccaggtctcgaacatcccaaattgttgaactgagattgctgcccagaaattgcgagcgaaggggtaggaccgtaggggagacagtggtggctaccagtttcttcattgagtccgcagtgaagagacaattgtttttgcatggagattttttttttgttggccatggaccattccacctatttgttacagtaagaacctgtttatatgggactaaaacttttaagtccctatcacatcggatgtttggacactaattataaatattaaacgtagactattaataaaacccatccataatcttggactaattcgcgagacgaatctattgagcctaattaatcaatgattagcctatgtgatcctacagtaaacattctctaattatagattaattaggcttaaaaaatttgtctcgcaaattagttttcatttatgtaattagttttgtaagtagtctatatttgatactctaaattagtgtataaatatggagactaaagttaagtccctggattcaaacaccacctaagttatgttggaaagtaggagattcataagaatcaatctttttaaagagaaaggtaggagctttgtcgatcaagaaataaacaaaaacaataaatttgatttccacgataattaggaagaggttatttagaccctctttgtttgggcttaggtttattggtttagatttttaagttagcttattggcttatatgatttataagctggtagatttaatgttctaagtttaatggtagagtcatgcatctatttcacataagccaaaaaagcttctccaacctagtttttggtttaatagtgttagagtggcttatggcttaaaaaaagccaaatgaaaaagccgcttgtttgtttaggtttagacattttgacttataagttagcttataagactaaacaaagagggtcttagaattccctgatgcttggtctaaactttttcgatctctcattttttttcgagtacaaatgcgatgcatgttgagttatggatccaaattcatttacacttaataaagactagcttctgccatagtggagcggaggcccgtcgccggtaggattgggtatgaatcatcatcccttttagagttccaccatatatatacatcttgtaaaccatcgtgcggcgttgtaaccttaccctgatatagtgaagatattttgctggctagcgcctgtggttttttctctcctgctttgagagagttttccacgttaaatctcgtgtctttttgtgattgatctattatttattattttttatcgtttgtttgcctatagtttccgaacaatgcacacacactaaacttacgctcatacacatgtgggcgccctatcatacgtctatgccttttcgatctgaactctactttaagtttagcaaggcttgtactaacgaataacaagaaaacatgaatacctccccagaatactaataataagattgagaactaatcatggaatccacgctccacgcagtcatacccatggtgcatggtatctttcatcctgtcatctcatctcagctatgtaattacatacaaatatgattgtgtgtgtgcacttcacagggcagatcgagacccaaatattttagatagaaatctcaaccacattaccacacatgtgacatcaggatttctcctgacatggatagacagtacattattgttattgttatttattttataatgaaaacttagatctaagtctgattatatgtgtcggcatgcttgcaaattaaattaaaccttgccacgactactataattaagcaagataaatgtcgaacttcacacatgtagccttttgtgtattacaaatggatcgactaacgtgactgtatccacttacccaactacttattctagatttaatgatataatttgtgtggtttaatttgcaagtaagtttgtcttttttaaattaagttagtgagtttttttttgaacactcaatattgtttaggtgaaaaggctaaagtaaagctctgcccaggaatcattataaagtacatcaaaggatgatgtttttgatttttcatcggatcatttccatgcctgatcagtaggaattttaagttgtaaacatatattacaagtaaacaattcaatcctgcctaatcaagtttatctacaacctactactaggttccacaaacagacagcacaattcagagagaaagccagccaaagttgagcacacatttcattccatttcattagcacacacacacgcatgtcattagcagctaacgaccataggcacgtggcgctatatcgtaggctcatcatgcgccatacagcccaatcaagagttggcataagcgtgcttacgataatcctaaactatcctaacctcctcgagctaattaagctcaccagccgagcacaccccaagcagaccaagctaaaaaaaaaaaactctgctttattcgtcctctcctctgcatgaactctccccactactcccctgttacagcttgtgacaaccaagaaataccctgcctgcttcgctgtaacacttgtactcctgaattacgcagagatctcctgagttatctgcaagagagagtgcagtaacaggaaagaaggttttcaatggagacggagatgcaaaagtggcagtaaaatggagactttgcgagggcaattcgatcgggcaactcacctcctcggggcaagcaactgccggtgtcatgatcggaaaggcaccggagccggagacggaagggggggggggggggggccttcacctcgcctttgccgtccgtaatgtcgccattattctgaccggcatgctcgccactttgtgtcagataaaggaggaggcccgcttgtgagtgacatgacatccgtgctatctaatccttgcccccgcgcggccacatggctgtgtttagtttagctgcgagacgaacgcgtgctgctgctcaaagcgccaggattagtgttgagtccccatgctttgttcagccattggtgagccggcaggcataattagcttagtgacaagtaccgtactactaagagcagtacaatagcagactatgagcccgctaataaacatacttaaaaaagataaaagagaaaagagaaaagtaacgagctttaaatttatagccagctatagcacaagctccaaaatatatacgtgtataatatgtgggaccaaacaattatatagtatatgtttataggtaatcgtatgaattggctatttaatcgattatagataatttgaagccaataattgattataatattaaacttgctctaagtagctgcgctggttaagggagacaaatggtggcgtcgattttgtcattagtgtgtgcttgcagcgtcattagtaggagtatgatcatctgtcggcagagctctgtaaaaattctgctgcttcagtgcttctggtattagcgtcagggagtgcagtgatctgcactgcagtgcacatttcttttcggtgtttacgcattttcgaagggaatttacgcgcgaagaggagggggggggggggggggggcatcgtggaaagcgagggggaggaatcgcactcttttcttggcataaagcgcgcccgacccgtttacctcatcgccgtcatcgtggggcctcaccacgccacgccacgccacgccacggcacgacgtagtacgcttctccccttgccggccacttcttccgcagtcgacagccgctgactctccactgcacccagcgcagcagcgcactcgcttgcctgcggcctctgcctcgccaccgcgagcgcactcggtgtgccgatcggtcgatgcgaggatggacacgccgtcgacgacgtgcgacgagagctcggaggtcgacgcgcgcgacgactacggggacatcgacgacgtggagcggcggcgcggccgccaccggcgggaggcctcgtcggacgtgtcgtccgagtgcagcggcgagcccgggagcccgtacggttcgccgtacccgcggtggcccgtgtgcagcatagcgaaggcgccgccgccgccgctgctgcagaagctcggcgcggcgcggcgcggcgcgggccgtgaccgcaaggccggcgacggcggtacgtcctcctaccacccgcattgaggctggcaaagatctctgctgctttcttggcttggatattctccctaatgcgctatagatgggttgaattggcagagttgcagctgatcaaggagaggttctcgaagcttctgctcggcgaggacatgtccgggagcggcaagggggtctccaccgccgtcgccatctccaatgccatcaccaacctctatggtcggtacgcgtaatctcgttttcagagatgaaatcttcagcggcagctaggaacagagtagaacacgagcgtgctcaatgtcaatctgttgcttcctctgttcgcagcgaccgtgttcggcggctgccaccggctggagcccctgctggcggagaagaggtcgatgtggcggcgggagatggactgcctcctctcggtgtgcgactacatcgtcgagctcttcccttccaaggagatcatgcccgacggcaccgtgcgggaggtgagaatttgcaggtgttcgtccatgttcttcaaggcaaaagctctcttgcgcgtcactaatccatggacgcattcccgcctctttcgtctcaggtgatggcgaccaggccgaggtccgacatctacgtcaacctccccgccctcgagaagctcgacgacatgcttctcgtaagacccgattctgctcgcgctatgttcatctccatgactccatggattggcttcttgttcatcgtgaaattgctttgcttgttgccgtgcaggagattctggacagcttccagaagactgaattctggtacgtgaacgacaagggtcagaaggatagctgcgccgccgccgccgcggcgccgtgccgtccggtgagccaccgcgacggtgacaagtggtggctgcccgtgccgtgcgtcaccaagcccgggctgacggagtcggcgcggagagacctgcggcagaagcacgactgtgcgagccagatccacaaggcggccatggccatcaacaatggcgttcttgcggagattcgcatccctgagctgtacaagcaaacgcttcccaaggtacagcaacatcaaaaatctctctctctctctctctctctccccccttctctttctcgatacaagagcttcaaatcttccaattcgaggatttctcccaagaatctgaattctgatcctgtgcagtgcgggcgggcgagcgtgggcgacctgatctaccggcacatgtcgttcccgggcaagttctcgccggagtacctcctggaccggctggagatctcgtcggagcacgacgccctcgaggcggccgaccgcgtcgaggcggcgatgcacgtgtggcggcggaaggcgagccaggggcactccaggtcgccgtggagcgccgtcaaggagctcatggagtccgacaagaacgtgatgctggcgagccgcgccggcgacgtcctgctctgcctcaagcagcgcttccccggcctctcccagaccaccctggacgccagcaagatccagtacaacaaggtaaccacaccaacccatcaccagcaacgacgtgtcgcgacatcatcgccatggacgaacactaacacgaagctgctgctgctgctgttctccgtgcaggacgttgggcaagccatcctggagggctactccagggtgctggagagcctggcttacaacatagtgacgtgtatagacgacgttcttttcgccgatgagtctgcaaggaagatctgatgatcatcatcatttgttcatcctgccttgccttggtccgggatatcaaaatataagggtccatggccaaatcccacaatatgtacattatgccaatactagaatgtagccatgtaggactaatggaagatactagcacaaggaaagcacagtactctattggcctagctaagctagcaagtagtagcaagcaatgtttgggtgtttcatactttcattgcgagggtcccttcaattgtctgccatgagtgtgatcacaattggtacttaccaactgtgatgacagctgagatgattcaccagagtatatgcaagcaatgcttaaaatggagcagcactatggtgtatctgataaacaagggaaattgttttactttcatgaggaaaaaaaaaactataattaggcagtacatatacaactgaacttattcttcctactttcacacctgtacagagaacagaaatgatagaagaagcattaataagaagaaaaattcctagtgttaggagccacatatagtcaagatttatagtatgatgcaaacagtcaggcaagcctaactctactgcgctgtatacactctgtttaaatctgtcacactcactttttcaaagctttttgtactatggtttttggtgaataaaatcctgccgaagtgccgaactataaactctatcagtttccatcggatggcaacaaaacaatcttaaagccacaagtcaaacaccatttcctccagtaaatcatcaagcaaagtatcccacacctctatagcaacttcttcagtatcaacccgaaggtccatccatgatccactctccaggtctttcagcaccacccgatctaatgtacttggaacctcatcactgacaagagaatcgatgcaattatccacctcttgaatgagccctgttcctaccggagctggcctcacactgtgtttcagataagctacccaagggtcacaaccaaaaaagttatccctgatcttgcaaagagcttcttccacacaatcaaagagaaacaccgcatcgtctgtcaggcagtacaaagttcctacttcagccaatacagatgtgtcaagcagtgatccgtccacataccatatctctgaactttcctcagacaagaagtctgaagcctcaagcacaacctttatgaaggaaagccttgcctgtttatcatccaaaatagcttcttgtggtgtgttttgcaaagttggggttcccgagggagtgtcatcctctttaaacagaatccttgtgcttggcatggacaattcatctgcataaagcacaataaaattgtgctactttaccatggatttttcaagaaaatacaaaagggtacttccactatcttaaaaaagggaaattcaaaaggggaagttcttattttgaattcaataccttgcgttcgagttttgtggctggggctgataccatctcccaggaaagaatctagaacagattgagggctcagtctctcctctttgtcatctgcattctccggggagcaagaaaatgtcaagatggatggcttggttaatccaacaactgccgatggactatgattgaattgctcgttaactttttctggagtgtgcagggatacttctggtaatgcattcatggtttgtgactcttctgcgaagcacttcaacacgggggagtaaaagaaaagttagacgcaaaattaattactaacttaactttttgtacaatttgcaaaaacatatggcttacttggtcggtatttatttgttccaagctttcagttgaagtttcgatctgaatagagacttggggggtatctgttgcatcattcatgctgtcaatccctgcaaacatttggtgtatatattagatgaaaacaaggaagtagaaaactaaaaagataaacaggaggacaacaatataccttcactagttaactcctgcgagatagtgccctctttgactggatgactggcatggtctgtcttaaattcatccagctgtgtgttagccgatgtgctggtgtccaatggtattagctccccaaacttcattggtgggtcagaatttgatgaaatatcctcttgttcagtcgtcagtaatgctgatgaagcagtcgaatcctctgacagtttaacatcctcttgaggacaatcagtttgagaaaacgtatcattctccgaatatgaaagtaatttcccaaagggttctgatttgtgtacgatctgagaagtgtcattcttttgattgtctagcctctcgattagatgcttcttagctttttcgtagaagaaagagctagcacaatgagtggcatcattccccatgccacttccactatcttcagggattgttttcttgtcaactattgagggtttctcagccttttcacattcagaagagtccatacttgtcgacatactctcgagaatgaactgttgtgttgaatcatctttctggaaagtactactcatgacatcctttcgattgttactaatggcaagccttagcctccttttaagctctctaagtgagaaatggcgagcatatttgtcactttgttcctgaccttgcaaatcagcacgagtttgtactggtgacgacattgcactacttgaaatcagactagtctgacttcttccaggacttggcttcaatattactattctgctaacgccacgaggactatcattcagttttggtggtctcctcatgactagcttatcctccttcaagaaaaaattatgtgttttttgcacgctgtatttcgaaacctcagactgctctagactgttaatggtaactttcgactttgtttgtttgtcatcttctgccagttctaacatgggatttcctagtgccgtgtacaggttctgcaggcattgcaacatcctagagcttgggtctttcagaagcatcagaaagaactcttcgtttgcgctcagcaattgtaatgcatcaagaaattcattgggcctagcttcgtagctgctgcttgtgtatttcccgtttgcagattgatgggttattactgcttcagccacagcttcaagtgctttctctatactacaggagatttgtttaggatgagtactagcatcagtattgtgctctttgtcaatcaaactggaagagtgatctgatacttccgaagtgataatatcgcgactgccattatgatttctgtataattccatgagacttgtagccaagtctaggtcaacatcagatccttcctgcaggttcacagacttcaaatcatcagaacgtatcccaaatatgttcctttgtgtttccttcaagatctgcgttccactggccatctcttcttccatcagtgctttaatacttggcctgctggcatgaattgttttaaccccatagtctttgtcctcctgacaagcaaataaatttggttttctatattcagatgttatcttcaaatgcctacaaatatttctggatacaaatacttatgcatatttaatcctccataaaactaatacgacaaatattttttatttgtaaccttttctgtgagaattctaattaatatatttggcaatagaaactatttcatctgtaatataataaaagctaataaagctgtttgcaattgctaaaacaaagtgaatatgttactatatgtttcaatcggtggcactcgagtctcatagaaaatacagttgttttcaaatccagccatgagattctgtaggtaattcagctaatcacacttaaatattcgtaaaaatgtcttgaaaagctttgtacatatactaaagcttttcatatcaatgctttaacagtactatttactccagttgccagcagaagcatctgttattagtacatcaacattacaagtattcaagaatgttgatgacaatcaacattttgcccataggaatcaagcaattgtaacactgtacacttgtagaacaagtaacataatgatgaaaaacaaattgtccaacaagtaaaaagcaacagtaagttaaatttgggaactaaacttcagtctttgtttcctttctaatcagttttgctagcgcaaacgcatgttttttgtctctgtgaaacagacatgtgactttgaactttcagatacaaaaaacagatgaaataggtatatatggatgacttacatcagaaaagatgattccatggaaatcttcagaacctttcaggtcacttctgactgcatgaagcacagaatttatcataagcaatatcattacactgcagcttacatcattctttttgttcagatgacattgcattccacttaaattcctcacctgaactcctcctaatcgtcccatctgaaataagttttggactgcgacggaagtcaaacatgtggatgaggcccgacatacagcccatatggaccttctcagatttgcaccgctgtttgtaactcttctttgccatgatagaggagaacattgtcagacagattcgtttaatcaccaggcaagtttacaacctgaatatcaaaacatagaaaaccatgttagaattggtaaacagtacaaattagacatgcaaatggcgaaagagcttccaccctatcaactactcatagttggtcatgatctcttaccaacttctgaatggttgcagaatctacttacataactaatacagttgtccaagactaattgtaaaaccaaagtaaaaaaaaaaagagaggtaaaatttgaaagaaagaagagacagaaaccacattggaccccacaaatgcaaacatgtaaagttcaccgcattacggcattacatctaattgctttctaacgagaaacatgctataagaatttaatgaaacctaattaaattagagagacaaaaacttcttgtggccatacaaagaggcaaaaatgccaaatgacgaaactctgaagatttgaaagttatttcctctcttttccttgtcaagaaaggaacagttgtcctgtcggtgaacccagaatcctaggattaagaatagttccacttccccatatgcaaagaacggctacaaatgtccaaattgcattgtatagtatctgcaggcgctggctaatgcctaaaacagctcagtaatccctattggagtatgtcaaccacagtataacacaatcacccagatgaacaaaaggttgatattgggtaatgcttatgttaccttagttcgaagaacccagaccagatgaatacaggaaaaagcaaggtggcgcctgacaactgttcctacacaatgacctgctaaatcatctgaacagccatgtctgccccttttctttgacccttgagccgtgaacccaagtacccaacaatggtactagcttcttcaatctccagacaatcaaaacccaatctttgaatctcgagcaatcgcgaaccaagagaagataagcagaaacagatgagaaatgatccgatagccccaacagaaacccttgtatctgccgtgcttcctcggtttcctcaagatgccccggactcggaattcacgtcaaaattgagaaacttgacaggaaggaatatatctcatcaagacctgaacacgcaaaaggaaagaagattgcggaactgcatcatcagaccgaccctctgcttcctttatccccctccgtcttcagccaaacatgcagacctcgccgtgaagtttcaatctttccagcctcgggcgattcagaatctcacaggcaagaaaggtccctgttgcggaacaatctcagaacccaaatgcgaaaaaaaaaagaaagagagacaatctttcccccttcgatcctctgcttcctctgagcaaaccctcgaaacacgcaggaacaggcacccgaacagaattttttttccgcctccaaaaaaaccaccaaaagaaacagcgaataaatggatacacactgcaaaagaactgcccctttttcacagaacaatgaacaggctgttggaattctagttgccttttctgatctttttcttcacttcgtttccttccaaaaacaggagcatgcgtcgaggccggagaggaggattcttgggcgaggccgcgtgggaatgggatgcctctgtggccgcgccaagccgccaaccactgctcctgctaccaccatctcctcatcatatgctccgattatctctcttccttcctctccaggaaggagaaggtaggattcggagggtggtttgctttgtacttttcaggtttttttcgcagattaatggaggggggcattgccgcattggactttgatatctgtctctatcttggcatctccctctttttctacgtcagagaagcttgatcaagctcaacacgtagtggatgggaaaggaaaaaagaaaagaaaagaaaagaataaggatttgatttttcgccggagaaaaaaataataaaagaatttgattcttgtctctatcttaggctctccgtcttgtaccagtagaataaagaacacatggcatacaagggtagttttgaaagtagaattatattttttattagtctatatttaatagataattgatctcatccaataagggctaaaatttactaccatatctgaaatattcattgtgatgtgggatcgaattataccggtagattgataaggtgtagtacaaattattgggaatagtacaattgtgtttttaaactagagacgttgcatggcaaaaaataattctatcttagcttttgcgtgggaaattcaactaattttctcttaagatgaatgttaggaggcatgcacgggccagcaaaatctaatcgtaggtataaaatggacgcttgtgattgacgaacggcaaactttactcttatgcccaaaggcaagggttcgaaaccagcatgcacattaaaaatgttacacttatgacacaccaataatttgcatgtacttagaatttgtaggaggtgtccaataactcacacaaactatttcatgattttttttcaaccatttttcgtcataaacgtgacctctgattatggatgctcaataactaataacacatattttaattcctgaacgcacatttcttgcgattggtttgacgcaatggcagggccagagtaaaattgtggcgtcggctaaccccacatgtttttgcaagatacaccttgaccatgtgaaaactagcaaaaaaagtacataaaacaatgaaattttgtatggattgatcccacatggttacatatttatgtattttgatcccaccgggttgagaacctgtctctgccattggtttgacgtatgcatgacataactaagtatcataaattttttttcaaatcagtgagggaaaaatattgaaatgcgaagagataaatcattagcaaaaaatttcaagtgagcaatactactttgcttgtatatttttttagatagtttctttaggtttccaatcgaatgatgtttatttccttctcttgcgccacagtaactgagctactaatatttactgatattagtttgcagaaagcaaactatatttatttcataagtaaagttcacataattcgaaactatcacaaaaccaggacttaaatcaatgtactagttccaaagtaacacgcttccattacaaatccaatatgtgtgctgtggtttttatatagcaaatatgctcatgttaaacttataccgctatgccctttcatggtagtatctttattatggtggaaattttaaattgggaacctatatatgacgaacgaataatttctaaatatgtctaacttaggcatcgtgtagatgcttgaaataggtaatgtaactgcatttcgccctcattgcacagtgtgttctgttctttttagaagcacacgctttcaacagttgaagtatcacgagatgtccttctatgggtatcatatatggctacacctgattgcaatgaacacttttagaatagataaatattctattccctgttccatatcttgttatcctttcgagattatatcaactttaattgttgcccggtttgaaatggtgcgtacatgtacgtggattaacaacatttgaagcctgccgacaggaaggcagcgttggaagtcattgattttttttttttaaaaaaagaagaaaattagaagtttgaaacgagtggccactagaaatatttttccggcattactgcacaacagcaacagccgtcatatccaattctttaatttcaaggattgtgacaaaccaactaatagaagattcgccggaaatcggttggattaggatgaataacaaacgactaaacatttccatggcatgtctcagagacaacatcgctcaattattgggtctcttccaactacagtagcgtccattttttttcggtttgttcagctgtctacccaaacgaaaacaaacaatggtcctcgtattacacacacaattgcaaaaccgatacatgtacgtgtaaatctgaaaggaacatacatttagctcggtgacagagacgggaagaaaaatgtaccagattcaggttataagactttttagcattatccacattcatatagatatgtctagattcattaacatctatatgaatatggacaatgttagaaagtcttataatatgaaacggaggaagtagcgaggagatcagagagccgtccgatcagccatctgatgagagcaggatgtactggttcagggcgacgttctctggactgccagtagccgtcgttttcgtgtgtgcactcgtgtcggctggtggttttcgcgtctctcgcgtgccgccatggacgcttcaacctccccggccagtgtcaacccccaacaccaccacccctcacccacacacaaaaccggttgactaccagtgaaattcgatcaaattctgtcagaaatgtaagaattttctttcaaacttgactgagaaaccgagttgtttgttgcttgtgttcctaagccgtgaagttcggtcggttttgtataccatgcccgccttgaattattcgtcttctaaattcattgacaaatttcgtcagagatcgacgcctggtgcaatattttgttccgtgtggttgcatccaactagaataattacaacgtactatattagttggtgcatacatatcatttttctttcaaagtacacacatgctatatagtgatgacagtatatgacaccgcggtgtgattgttcagtatgttctgaatttctgttcaggggcttttgtcaggcgtaagccggaataaaataggaacgagcagcggaatcagcaagtgcgtgatggatgatgcatatcatacacagcagcttacatcaggtcaggaatttcctccgtggaatgcatgcgtggcgtggcgcatagacaaatacgccggcttcgtggccaccggtcactgtacgttcgcgtgccgttccgctgttgcatgcagaagcagacgaacccacgcgaaggaaacgaagccttccgtgccggagtgcgagcgtgcgacggcgacggccgcggccggtgtctctccggtagacgatcggttcacatcgcggctcccaaccacgccgatgcaacagcacacgaaatgcgatcgtgatgtcgtgtcgttgttattcaatccatccatcactcgactcaacaacccggaattgcataaaatttccttctcgtatcattatgctttcgtgcgacgtttcttcctcctccacgaacgcatgcttgatcggtgagaacacaaggctaatttgtttttataataaatttcattccggtatttactttacaaccggttgttacatgatgaacatataaccgcaaattacaaaactacagcatgattaaaaaaaatactaaggctatgttcgcatgagctcgatgggaacttttccctccgcacgaaaaacggagcggtccattagcgcatgattaattatgtattagctaatttttaaaaaaaaatagattaatttaattttttaagcaactctcgtatagaaatttttttaaaaaaacacatcgtttaacagtttgaaaaggatgcgcgcagaaaacgaggaagatgggttgggagaagaggttgcaaatacatcctaggctaacttgtttgcaaactctgacctgtttatttctgaaaattcatgtatttgggtaagtgaaccctctggctttatcataagtatatatgttgataaacgatataatcatatcaatagaactagccgaacggtattccctaaaaaatattcttacctatttattacaaagaataatctaaaagtggctttgtgatgttgccccttgcccgtgagccaatgtttacgctacaaggtcacgcacctatctgggtaggaaatttcccctccgttaatctgtactttggaaatgaacatctcaccagccggccattaccaaggacaagattgtcaccatctgtatttccgtgcttaagagtggaactggttgttagggtgttagcgttgcaggcttggctgacttgcagtatgtaagtccaaaccgaccccatgcaactgccaatctcctttcacaagtcaagagcacgcagcaggtgagctaattttgtcttatggcatgatgtatccttgcgaacggttcggcagtggttatctagagctgcagtgagtacatataaattaattctttccagctttttttcatgtcttgctcatgatgagatagtaactctcaaactaaactaaccaaaagggcaaggaatcaggggggaaatagactggtattgtagggttttctttttcagagtaacagtgcatggcatgctgttgcaaaatgtgcaagtgagctgtagtcattaaattcattatcggcaacttggcaagcatggtttcatgcctgccgtgatgccacctgacaaaatataatcaagcaatgttccatacgcacacacctaattgtccaataaatagtgccaataattttgtcctgaatacacatgagacaagctgacgacaaagttatgggccgaattgatgcacggaatatggcctcggataagcaaggagcacttatttacactggaagtatggtcagtaagaaaggtaatagagtcagaagaaacagttcatgcttctctatctctgggccccagattatttgtatactgtgtgtacctgcatatgcacaagaggtgattctctattctatactgcctgaaatgagaaaattcggtgaatttctttattgctgcttcaaacaagaaagcactatttgacaggaagaaccttaagaccgtccataacgaccaggctactaattcagttgcacagtccatcccatactgtcctccacgaggcctttctggatagccgtaagtgctgaatagagttgctgagacacagttctgaacttctggttcccatactccactctgtaatggatagcggatgcatgagaactgattttttttttaatatagagtaacaattatttaatagaacggaggagccctttctcaatgctgcatttgttcgtatttgcagaatttgtatgacatggatcactgataaagaaaaataggagaataatttggtggatacatatgctaagtttttccatttagtgaaactggtatactaacacagtccccatgaaatatgctaccggttactttactctttttttttccttttatgagacgacattgtactctgttgatagtactacaggtgtacattttcactgtatggaatgtctactagcttcacaagctcttatgattaattcaacatctcaaagattccagctagaatatcttcaaaggctgaggttgtgaattactgaagtacttaccttctcccctggtacactatgcaaccaacagaggatagtaccacagaagttccagtacagaaaacttcatcagcgtcaagcaactcatctattgtaataagacactcttcaacctgaaaaaaaatatatcagcgaacaagattgggttcatatctcatattgttgacaccagtttccatgcttgagtttcaataaaattcaggaccctcgagatctcaaaaaatttcaggaccttctgagatctcatcaagatctttcaaaacacatttgaattctgaacgaagtttcaaaaatttcaaacaagtctgaatattttggccaatatggaaagaaaaggtggtgtgcagaatgttccaacttccaagatacaaatattctgaaccatggttacagaggcagtgttagcagaggatgggcattcatgtttaggttacctgaaatccaaggctacgggcgtattcaattatacttcttcttgtgatgccaggaagaactgttcccgttaatagtggagtagaaataatgttgtcctgccagcaaaaaggcaatgctacattgtttagctctcagaacaaaatatagtaatataaaaattatctgacaatgtagcatctgataatttggaggattctgaacttaacacatcattccttgctactcctaacaagtttgaagataagctaatgccatgtctatcaaatgataatttatgtgccataaaattattcagcccgttcaacgaaatccaaaaagtatgctgacaagttacaacatcattgcaagagacatcattgagctatacttggaactgctttacactggtattttcctagatagacttgcaaaggaagtcaatttgaacaaatccagtacatatgtacacataccttcaccatgaatatattacaggacgaaagttcctcaacaaactttttatgcactggatccaagtaaagaacatcagaatgacctctctccttagctctttctttagcataaacggcctgtatacagatgtcaaatgaaaatgaagaacaagaatttgatttcagacataaaaatatacattggcagccaaactcaaattgggagaaccatgcccgtagagtaaagatatggaatagtgtactgtgtcctctatgaggaatcagatgataaagtagagactcagcttgtagaaaagaaaaggtaattactgaagcataatttccgatagtctttatatcaccagttccacctggtgccgcacactgatattcttcctcggttaacaagctgattggagataagccatcctgaatgtaaacaagacagtaatcttgcaactataaccagataaaatgaatatgcaggaaagttaagtcaacgctgccaaccttaaaatagtgcccaactgggcaagcaaagacaacaaatgtgtactctggggctggtgcaacaccgaggatagccccacttccaatcagcagcggtctgatatataaagaacctttgccagtagggggtacctgcaacggagcgcatagctcatgagaaagatgtgcgcaccacggcgcctatcactgttgaagaaacaaaatgtccttacccagcgcttgtttgctaaaattgttagctttatagcttctaggaactgctctacacttggtgcaggcatacataaccggtctgcgcctactctcatccgtaaagcattttcatcaggacgaaatagaaggactgatccatcctcttttctatgtgctcgcagaccttcaagtaaaccctatagaaattttacaagtgcattagagcttttcaaacaaaatggagcagaataaatggacaaggctcatttagtacagctctgctcaacaatcagatagtgattcttcaaggtagaattaagagctcaactaacctgaccataattcaacactccagctgctgggttcagttctattggcccatatggcaccaattcacccttggtgaacaccccttcctcggaacatctcatcacatacataaagtcagtcggcacgggttgaaacccaagagtttcccagttaaagtcgaccagttcagcagttcctgtgctgaagcatgaagctcacaatgaacagataatccaacaaaaacaggcactgcccgtaatgtgatgatgggtcaggcaaaggacaacaagttcagaaactgtttgctacaattgtttagccgttatgattcctctttttccgcccacatgtcaatgggacacccgaatgctaatcggagcgcacctgaatagatggactgtcaaatcctaaatgttccatcaagctaatagtggactggattcaacagcctcttttcgttaacccgcatataagtctcgcctaatcttgtcttgagtagcaggacaagcacagtgtgaatcaatatccttctacaggatttgaaacctttttcctgttctaaccactaagactgtaacagtacagcgaaaaaaaaaaggtaaaccgtgatagaactcagtttgtcatgcttactaatatgctgcggtcaccagagttgaccaccggctcctcctggcgacagcccctcctctgcagacggcgactgcgccgcaaaccgccgccgatcgcttcagaatctgcaggcagcgtcaaccattagcaccgtatcgaacacaccgtgcccttccactcccgctgactgtagcccctagcatcatccaccgatcaatctcgcgctctcgcggaagaggtgctcacggggtgagagggcgcgcgatgacggcgcgtcggggacggcgacgcgccgccgcgtccgggaccgggggcggccacacccacacgcgggaggagctccattcgcggtcagccgcctgccgccgccgccgccgcccttgcgcgccgccgagggtcgaggtggttgggtggtcgcgcgccgaggggaccggagacgagacggcggcgcgcgcgcgtggttggtggctgagggctgagctggtggggaggaggaacgccggcggggcgaccgaccgagccggcggcttgggttgccattggctccgggaggtggagacgcggggcccacccctctctcggggggtgcgtgggcccaggctgtcggtgggagaaatccggccttaaaacatgcggcggcggcgacggcgaccgttgtttctgagtctctgacctggacgtgccgtggaccgcatacgtcgcaggtttccacgatgggataagggctcggggggtcggtggggcccatctgtcagggtaaacttaggctgggctttttatttgttttctaggccgtgtgcgaggagccgaggaggccaggcgactcatcagacttctattcttcaatgggccacctgagtcgagatcatcggtccattacacgataaattaaggaataagttcattttatgttctttatcttgtgctagtttaaaattcgtccctaaatcacaatacatgtaacgtataccttgatttacaaaaccggtaataccgaaatcccaacacagtatagtgcccagtaaccagggtgatactcttttgggccaaaaggcttttggaagattgacttgaaggcttctttactactccagtacgtaggagaagatttactattcatactgaaatgtacggagtactacatttgaagcaaatgatattaaagcttatacgggaaaaaaacacctccttataccgtactccctcccgtttcacaatgtaagtcttacatttacattgtgaaacggaggaagtaccttataaatgacaatacagtcattatatataaattgtaaaacaagagagtagaaatatatatatatatatatatatatatatatatatatatatatatatatatatatatatatatgcaaaatagagcattctaaaacacagaaaaataacaaagataaatacactacagaaaacacacaagaatctgagaagagataaagtttcaaaactaaagttcccatgagagaaaatctatttcctctgttttatattataagacttctagcattgtccacattcatatagaggcaatgctagaaagtctataacctgaaacggaggtagtacataataaaaagaagtatcgtagatataatgttgcactggagcatgagcattcatgtctgcatgcagcaaagctggaaatatagaaggtctgtaggtagatatgtaattcagcttatcttattaagtttgatttgttgacaaatcaggaagtcagtaaccaataagggaagcaactacaaccaataattcacaaaataggactgcaagtatgcaactaccagaactccgacctcttttttcactatcttccagtagctgttaatcactttagatagtgccgtctcactctctttcagctgctaagaaaaggaagagtttgaaactacaatgaagagtttgaaactacaattacgagactacccgaactccaatctaaacctactgtactgactcaaaccggctccacaagcagcagttacagacatcataaacttccaaaactcagaagaaatgcaccggtattatgggacaacctatcagcaactggcaaagagatgcactagtccacatgataagttttgcgctgacaaatcgaagatggataaaaactgaggagaaaaaaatgattgatttattatagcagtgtggttaattaggaatgctggtttcatggtttggtattgcggcatgaaatgaaagtctgaaattagtgtcctatgagcaagggcacaatgagctaggtgaggatggtgcgattaatttcctcatcatttcatcacttctgctactgcacgaaaggatatttcattaattgttctagagaaagaaaggacatttcgggcctgttcactttgatgaaaaaaaaccttaccaaattttagcattgccaaaattttgacaactatgccaaaattttggcagaatttcttatatagttaccaaaatttggcagcaaactaaatatagccacttttttggcaactttaccaaaatttggtaatgttgaaaatgacgtcgaagtgaacagccccttcaccacgtacagatcttgacagaattttactcctagagatctggactgattagtggttttgcgcatagcaaaatgtgtgctacttggacaactggtgcacctccggacaggataatatggtaaacagatcgcttctcttatgtatttggttatctgagtttcttaagagatgaaaatttggaaggcaaagataaaatcccaatttgcacgcacaaaaaaagaaaccctagctacatacaaacataaagctaataaaattagcaattccggtaaaattaacaccataacctccgatt

SEQ ID NO: 77106 - DNA, 712 bp, Oryza sativa
cagagtgcaacaacattgcgaagaacatgcaacctcttctccatggagcttaatcaaatcgacacacatcttctccatggagtgaatcccaaatttgtttctcagagtgcaacaacattgcgaagaacatgcaacaccctgcttgatcaaatcgacacttttgtggtcacttcagctcaagagtattttgtaaataaactctttgttggtattttttaacgtcacagataaaaaacgcaaacgcacggaagatgtagcacttcacccgagagtattgcaaggtattgatttccacagggaacgtgtgtgtcagctcttcttcaggttcatccaaggacacgaagctaaggtattttaaggtagagaggatttactagcgagagacaatgtctacggaaagcccaatttaatcctaacgcggtacttcgggcgctggccagctcgctgctctagatatggctctacaacgtacccggacagggaggatttcaatgtacttaaggactgtcaccacctctacacccacctcaaacctactatgagatacgaagcaaacaacggaaattaactgtagcgcccgttccgtcgtggcgcctaacgggaaaattatctcttaaaaaccctaattgcgaaatttgtttctttgattgttgtctagtgtccgtgccatctcaagatctcaatccccgatctatcgtcgagttcaattccg

SEQ ID NO: 77107 - DNA, 2108 bp, Oryza sativa
attcgcttagtaggtttctagctagttcaaatggataaaccgtgtgtatgattaattctgaatttcgttctctttacgtcgcatgatttattatcgagaagaatatttatcccaaagagtcaggattgctaaaattatgggggtcttagtttcagtcacgtcatgtatcctatatgatactctactaagtatgcttctctctatctctctcatttcctcttccaagtagataataattaaattaattttactcctaattcttataaactgtgtactaaaaaacaaaaggtaaatattgaaacttataatgtaattatagtttatgttttgaaatttagcgtgtaattaactacaatgcaagtgtatgcaatatattgtagttacctttcggttttcataaaagaaaatgtatctccaaattaggctgctaaattatacttgtaaatgaagctctatatattaactgaaatacttgttaggaaaaattgatataaggactaacccaaacgaatgaacatgaacactgaacagaaagctgcaaactacatgtacatatgcattgcatacgggatataccgggcatatggaaaattaaatatagttgattgcattcagagaattatagatcaatatatttttatctgcttctactgtcattaaacaacttgtcaaaatcagaattgacaacttagaacttgcaagtttaatggaataaaaaaacacattcaatatgtaaaagatgatcagcaaatagttgatcattccaatcaaaaccataaattgagtgcgtcctaattaaatagactgctaaatatgtattgcaaattgaacatgcaaaccatgcaaattcaaaggaatacatatatatgtatattgtagatgcagcaatagatctgtagcagatgcagtgacggatgtgcaagtaattttttattttgtagcaaacttttttcccccaaaattcatttggttaaatttcgtttcaggttaaaatttattcaatctttatggagtaaaaacagtacgtcaaaccagagacttaatagggatgaacgatacctctggagcgatcactgattcactggaaacttttaacttctcctcgtgattgaggcaaattgtcgctgatcgggaccacagtctgggatcaaggtcgactgcagcctatgcatatctcgtcgccctcgctcacgtccttctcgatcgcgttcgccgtttctttatcgcttcttaatttccaatctgatttctcacgatggaacttggagataaattagatgggttctgtccttccatcgataactggatagataggatttgcaaggagcccactgagtttaagattgattggcccacgatgttaaagtattgcaggatctacggtgtagattaaacgacttatctaattgacgcttagatctttctggttaacgtgagagctccaaaaaagtgcccgattagtataggtatagattgcccaatttgttctgtaaccgcaagatgccatgaactatatatttaagaacttgtttcacaaaactatatatttaagaacttgttttacaaaactataaatttagtgtactcgtttatcacagaactatacatttagtgtcttcatttatcacaaaagtacaaatttagtgtctccattatcataaaattacaaatttaatgtcttcattatcacaaaactactggttttaacaatgctaaaacctgtattttgtgataatgaagacaataaaccagttttgtgataaatgaatatattaaatctgtagttgtgtgatatatcgtgcaaagtatctatagttttatgataagcgaagacactgaatctatagttttgtggaacatgttattagatctgtagttttataatagattgtgtaaaatatctataattttatgaaatatactcaatatttttttctaacatgaaattttaagaattattaaagacaaatagaattataccgtggctccactactcaaccaatcacaatcctccaccatttacttctacgtactttcttaataaccgtgtccaactctaaaaatgcttataatgtgagacggagggagtaaaacagggctgcaggaat

SEQ ID NO: 77108 - DNA, 1281 bp, Oryza sativa
tgtaaattttaatcataattatttgggacatctgtagaagcttttgctatatcgatatcactgtttaccctgatcatcacatcaccatatttatgcactgtacaagataccaaatagtatgaatcaaggtgataatatgtttggaaaccgattagccatgtgtttccttgattgaatatattcgtatccaaccagagcaaaagcttcttttttctaacaaaatctcagaattccatcccccgcatttgttttgacaagatatacaggctatccttctccttctcttcctcgatcatgaatctttgatcttcttttccctaattattacgtgttagctttgctccttgttaatgatgacataaatttcttgcagatgtattgtagcttgaacaggtgccctttggatttggatgacatcgtggatcagcctcactatcatctcaagatggtgtgcatatttggattttgtggcaacacaggccaggtggagctagcaaaatacattctcagaaatgcgttaatattggagcaaatgatcatcgaccgaaaagggagatatcggttggatggatgttttgggcgcgaggaggcagatgagaagcttgttccagaagatatggatggtgtactcacaattctgtaacttatactccgtacagtagcaaacaacagtcacaagttaaagtgttgttccttcaaggcactagtaactaggattaagtttttttttaacagagtttacagagattattcggtactgcaagagttgtggttcactgttcaatacgattatattagtatgtatcccttccgattaaaaatgtttgacatttaggaccatatttagttgcatttttaaaaatctagacatcaataatttgtcaaatgcttagttttcaaaatgatatacgtagatttgtctcataatattataaacttattggattatataaacttattctggtgtaaaatagattgccaaaatttttaaagtgtggctgaagtttgtgctaaacattaaactacttgagaaagtatgcactattcatatgttacaatgagttttaatctccaacccatggaccattttttttaagcttcaattcaaaggatgccaaggggttgggagttttaatctccgtcccccaagggactattttttctttccccaagatcgagttttttttaatgtagttttgtgcaaacacatgtggatagttttgaactactagtatattacatagtaggaaataattgattactatggaagtattcttcaca

SEQ ID NO: 77109 - DNA, 647 bp, Oryza sativa
gctcttaacacacggattgagaaccaggtatctcgtactagtaatacccagtcactatgagagcttttgtttctgtttaagcaaatgttttatatttgtattgttgcaaacttttatggtagtgtgacgaattatttggtgttctgctcccaggttgtaattgcagacgcttcacagggcagtcaatcccgtctgcctacttccattaccaacttctcattgtcccaaaaggagaaaactcttaatgaactcatacaggatcgttggctgtcatacactcccacaggaaagattggtcttggcatacgatcatttcttgatctccgaagttggttacgtagtaatgatatcccatcatgtgaggtctgcaatgaagcttgcataaaggtgcagatatgtgattacgaattacgattctacatttgcatttatcttgttacccatggtcatatactccactaatgtcattccctgtatttctattacttatttaaaacaggcatcatcttgtcctaatgagggatgcaatgtaaggattcacgtgtactgtttgaagaagaaattttctcagagaaaggtagttacctatttttaattccactttacacatatgaacaggagtggctttctaaattgtttgtgtatgt

SEQ ID NO: 77110 - DNA, 951 bp, Oryza sativa
gaattggtagaagaagaagaagaagaagaagaagaagaagaagtggttgaaggtggagaactgaagtcgcggtggtgaccgtcaccggcgccgcccccgccgctgccagcgggtgtctggtggtggtggtggcggccatgatcatcgccatgcaactcctgaggcggcatggcgatcgatcgatggatgaaaatctctctgtctctcgggtgtttttcacacacaagccactataccaacaccacagctagctaggctgtgggattggatgctatactactacagctgcagtagtggcagctagtagctagctagcttgatcgagctgagttgacacacaaccttgtgatgatggtgatgatgacgatgttgaaggagaagggatgaaggagagggctttgccttctcctactacttcaactaggctatctcactcccaagtgaagtgctgtctggtttttggcttggtgattgcaggtatatttatcatagctgaagaggagagagagagagagagagagagaatgtgaatgtgtttgtgtgtggagtgggggtgaattggcaaaggcaaagaaagaaagggagggggtaagatggacctaccaaatggggcaggggagcaacacttgttgctgtcactttttttattggctagctaggatggcaattggcaaaccctataaatttattgttagttactacccagtaatatatgtgtgtagttttttttagtgattttgtatatagttgattaacaatttgtgtggcgtattatctaaaaaaagaacaatttgtgtggtgtgcaaggtaacacaccactagatgcatatgctgatgatatccattagaagttacaaatggtggtggtagttattgttgaaacctgaaagggagtttatatcacccatatggtggttttgtagctctagcatggtgtggactgtggatcat

SEQ ID NO: 77111 - DNA, 4079 bp, Oryza sativa
attagtattattgagtatttttcaaacttaaaaaatagatttatttatttttttaaaaaacttttatatagaaaatttttacacgaaacataccatttaattagcagtttgggaaacgtgctcatactaaggccgggtttagttcccaactttttcttcaaactttcaacttttttatcacgtcaaaactttcctacacatataaactttcaacttttttcttcaaacttacaattttaacgtagaactaaacacaccctaaacgagggagagaccaaacgaatagtgtcagagaagtggggacatgggttcccaccaccaactattagggacaccgggggtttctgaaccaggccacgtggcaccaagccacgccagtcataggtgggactgagaactcggtctcttattttaacaagccgaatctagagttcgggatgcgagctcagggcacgcccgagctcagccccgttggctgctcggggcccctgttacaccttaaatatgacagtacctggagtgtcggtactcctcgtcacagagatgctcttgcatttagtctgagggatacgaatccatccactacgcgtggggaatgataagcaacaaaacaacgcatgtcgattgtggaactaaccatcattatgcctaaaaagatgggcatgggatgtcaggggacgtggttgactgttatgtcgcttggccagacccaccacaacatgacacacccagttatctaaggccgataggtgggcccaatagacgtcatctacatcctagtcacctaccccgagctacgcgtcgacgcgaagggcaagtggctagagaggagccgcctcgtgtgaagatagctccgctaggccctcctagggtcctgtagtgagccctacttgcccgcatgccgtaaaactttacctacctaatgcccttctgtgggacccttttgcaacagacatcaaactataagggagaaccaaggccatgcaaggaagaaaaaaaactctagtagctctagctaagagagtttcacaccttataaaagattgaggcagagatctaaggaagaacacaacatgagtagggtgctatggctatgagcggcccgatcctacataaactgtttgtcttttgctctttcacgtgttcatgacttagttcccacggacctgctccttggcccatatccacaaaaggggtgtttctgtactccctgctagaggagtccgggctccgacaaatagctattctgaacgaagcctcctttggacacagtgactttttagattcccaaatgaattgaattgattcttctaaaaatcgtgaaattcttacataaatctagcaaaatccgtatatatcaaaggaggttttacatatatatctttatgtttattttttttagataatagaaatggattacatctccggcctgtacccgtaggtacacagccaaaaagtccagaagtgaacagaaataagttttaaaaaggcgagatgggacaaacccccaacttttggcactaatatgatctactaaaataatgtttctaaagtcacatagattctatcacgaaattctgtagatactatgccatctaaactggaataaaagttccttggctaccaattccaaacgtgtagcaccattgcgcatagtatcctgttgttcctgtgaaagcatcatacaccaagagtggagccaattggaacacatgaagataacctgcatgatgttaggcattttattatggttaaaaactatatcattacagcaacgccagattgaccaacatatagcactagctccaaataaaatcatttttttggggtctaggcactcccttaggcagttaccaaaaatatcttttgcattgtggggaagggggatattgaaggcaaagaagatacatcgccaaacaaaacgtgcaacatgacagtcaaagaaaaaaaagtgttggatggtctcttgtatattacaaaaataatattgcttgtttcccctccattttctctttacgaggttatctttcgttatgattacttttttttaagaaacacataaatactttgattttttgtggtacctttacctctcataagatcctcttgtggatctttacattggaattgatgatcgcattatacatggatttgaccaaaaattggccatttttatgtagcgaccaaataaagcaatttttttttgtcatttaacagggttatgttagctagtcgaaaaatcaaatcattccactcaactaactttggtcctacaattgatcgtcggaatgaaaaattcaacggtgttgtgctcataacctctgccaatatctttatgtttaatgtagcgctatatttatagtatatatacaattgtaagtttaaagtattaaaactatgataacatatgaaaatggcataaactacatgtgtacgtatgcaataatatgaatgatccaagtttttttttaaaagaacatttctagtgatggcaacttatcggttttgatgaagccgttggggacaagtttgtggaaaactaagcggttttagctggtttttcatatagtagaattgaccaaaagttttcagtttttggcaaagcgacaggactggttttcaccttgaaaagggtaatgtaaaccatactacagttaacttcatataacttgtcagattattatatatcaaaatgttcaccctgctccatctacaaatgctcgcactgcatcactacaaataaagtgaagaaatttcaatgcatgcacacacagttgacacaatgtgagcaactcatgttagccatcattaattgatggaagtgtgtcacttgccactttttcctctttattttttaaagtcaagtacaatatgcagatatgttggattatatttggaatacatcacctctgataatttttggatcaggtatctcgaggcaacactagacgaacccttctcacctccaccataacttaaggacatggatcctctgcagtactgcatttgtattagcagtggctgacaggtggacccgatcccatatgtcagcggctactactgcaggtgcagtactgcagacaatctccactgttaactgaagccccttgaattagggtcattttatggtaccttacgctagtagcctctatgcagtggtgacgggaacgtatttatagtttctcggcaatggtgattaggctatgccattacacaaagcatgtttggtaaatacgtacaaagaggatgtataacatatgtagaacataaatgttgcattttgggacctgaaaacataaattacacattggacctgcaagcctagttacactagatgagacgcaatacaaacatatacatgagttcatgtcactatattatcatataggtaatcgcactttgtcttgtagaggtgaaacggtagctctgctgctatatgtattagccttttcagctttaattatgttatgacccattgacgacgagagtactgaatttaatctcagtgggctggttgtggaggctgacacaaagagatctagatcatccctcgttttccaaatgctagctagctaggaaaataagagctcatttgtgtgatgtgtctacagaaacttgtgtttcctctttctggttttactattaggatgttacatgcctatgctttagctataactatatatcctaacctataacgctatctgctatcaaagaccacagttttagtggtgcgataagtatttatcctaatggcctcgcaactgaaaccggtacatttgtgcagacggtctataacccgttttctcagacgtttatgcaaacttcctgcaactaagggcctataaaaatcgaggattatttgtgcagtcgaattccacgacagccaccatactaaaaatattatggaacttgacatcagcgaatgaccatactaaaaatatattcaaaaaaactgttaactaggaaatactgtaagaatcccatgcatagaactttggtttacttcatatcgggcttagtatatatgaattttctagaaattttcaaagtttggattttctaaataatccttgtaagaa

SEQ ID NO: 77112 - DNA, 641 bp, Oryza sativa
cgccgattcttcctcgacgccgtcgccgtcgttgatcttccgccgccgttttggtcaccggagagttcgccgcgtcattctctacgtgctggtgccctccgttcgcgtcgtcgcgccgtcgttcgccggcgagcttgtgcgcccgagccgctgccggtggtgacgtcaccgctgacgtcatcgttgccgtccgtcgtggtccggccgtggaccggttgatctcggccgttcgttttggttaggatcgatctcggccgttcgtttccgtgagccgtcgccgtgcacccggtccaccgcaaaccctagccgctgacgcaataaacccctttttccttttcaaaaataattcattattgcgtcataattcaattaaaacccatataagtgttttaatccgatttaatctctaaaaattcataactaattcatcttagctcggatttagttggttcaagtctctaaatttttttaaaattgagatctacatgttaaaaatatccacatgtactgttcatgcttgtttatgtgctgttttggtgtttttgctcttttctgtttagattctgacgtttccggagagttcgttttcgctggagaagaatttgaagagttccaagggcagcaaggcaagtcacacagat

SEQ ID NO: 77113 - DNA, 2918 bp, Oryza sativa
cgcctgccgatctccatcctgctagcagaggtggcgccggcgtcctcctgctcccgccgcatttgcatcctaatccatcccatctggcctcggcctcgaatttcgtctcctcgcccaccgcttgcgccgatccccatcctgcgagcagaggtggagcccggcgtcctccttcttccaccgcatcgtcgttcgccggtgagcatccctctctacccatacctcatcaggtattctgcgttatccctcaaaaagtttgggggttagatctgcctctacccagctccacctactttcaagttgttaattttgatttccgtttttagctgatgtaatttggttactgaatctcatccaaacacccttagaacgaaaaatgtaagctcacatactttgtactcatccaaactcacataaatttcttaagaagaatctagaccacaaactactcatagtcacacaatatctttttatcaaggtatactcttataagaaattttcatttctcaaaattttctaaaggacatactgtgacacttggcattaatctaatttaacttttttttctttatcaggttataaattttctaaaagacatttgtgccacttggcatgaatctaatttaacattctttctttatcaggttataaattgacaccattgaacgtactttatctttctgtccacacatggctaccaccgccgcgacgaccatggtggcggcggtgcaccacccccgcccctgcttccgcgtgcgcgccgcctgggacatgaacccgagcgcctcccccaagcccaaggccaagcccccgcctcccccgccgccgccgttgccgaccgcccccgcccccacccacgccgacctcttcgcccgccacagcaacagcgagggccaaggtaatctccatccctcctctccgctttcccaaaccgctggaagcttatgagaatattgtgtgcttaggtggtagtggcgctgaaccactatatatgacatctactgaatgtgtcttaatacaatttctatgaaatgattatgtagagttattgtcttcgattgtcaagagcaatagaatggttgtgccatctgtgtctctgtaatcggtttgttctagtgtgtgtagttgaaatggttggtctgaaaatgtctgaatttgatcgatggtttgttgctttggtttgcagtgccaaagaagaccacaagtatgggatttgaaaggtggtggttaccacctccgccagaggtgaagaagccccgttcgctctacaacgctgcatcattggcgtacttgggggactgcatatatgaagtgagaaacagtttgactcaattgtggttatgcactgaaaattgttattatgtaattttattacatatagctcagcctatttgtcacttctatttgtattggattagtaagagataagatggtgcatataacgtgcacaaaactttcaacttcaggtctgtatactgtaggatgatctgataagaatggttctgctctttgattatgcagctttatgctcggagacatttcttctttccaccactgagcatcaatgactacaacaagcgtgtaatggatgtcgtgaaatgtgaatcacaggtttggatttggctcttcatctttctaatcaaatggatttgatagccagattcttcttattatctatctttttgggtctgtgctttgcataccttgatggacattgtctgctataagcaaaaatttactcaatgctttccatttttatggctgttgttttcaattctaaagggcagttctcttgtttgttatttttctgttctgtttgctacatgataatcacacaataagtatatcaaatattatttacattatttttggttattttcctttattcaggaccttctgctgaacaaacttcttggagaagattttctaactcaagaagaaaggtaaaccaataattctagccttctgccagatgtaaaatatatgctaatgataaaattcttatcaggaaattttatgctctagtgcccgtgtacatgactgaacttttatgggatgttagccctttagtgtccactgtccaggacttgtaaattcatctatctaggacttgtcttttgttgtaggccatctgttcttttatttttggatttttatagtgtttgatactatcttctgtgtccgatgctgatatcaatgtgcgcatgcttcagaagtactgaatttccttattctgcagggacatacttcgttggggaagaaatattgttagcagcaagacacgtaccagaaaacgtgctggaattgcagtttataatcgagcatcttcacttgagacactggtgtgttccactatagactaattaatgattgctatattggggaaaaatcaactctaagctgcaacttctgttgtactaccctcacactacttttgttgagaagactacatccttgcgttgttggttggtatttctattattagattggatatctttacctcacaaatttcaagcgcttggagcaattgatgttccagttaggatttacaagtggtgcttcctcacatcatattgcagatgagctagtctcaggctttaagtaatgcatcgttggtttcttgtcatgtaattaaggtatttcatcttgactttctgttactaacggataaccattggcaggaaaaagaactccacttctgtacaatctcagcaacaagcagcgcagtgaatagtttctgtattgcagcaaacatggtatgatctaaacaatagttatctggtgaccacaaccagcacaaaaattcatttagttttggtgtatgacatccaaaagtggttgctcaatgaatgaatagcaattaccgtttgtctgtcaaacaagtatcgagtgaattgagcaatgtacatgtatgcaaatat

SEQ ID NO: 77114 - DNA, 9722 bp, Oryza sativa
  unsure (1)..(9722): unsure at all n locations
cgtgactgggcgctatcttgccagaagaaaggcatgcttggcaaaattattgatccacatctccatggagaaatcagtcctccctgccttaggatgtttgctgattgtgcaaaacaatgtgttgctgatcgcagcatcgacaggccgctgatgagtgatgttctttggagtctggaagctgcactgaagctgcaagagaatgcagagaataacaaaaaattcagtgaagcaacaacatcgtcaaagagaacaccagacttgataactatcatgggtactgacaaaccatcgacctactcaacaatgagcatcaccggacaaaagatcatcttctctgatatgatgcacccacagggccgatgaaggacaacagttgaggatttcaattaatttctgatccagagttcatgtattgatgatcttttgatcgcaattactagaatattgcattattgatcaattgtgtcagtttctgtctaactagaaccaaatgttagtgattctaaattccgaataaaaacccaatgctacaggtttgactagttttttcttgtttctgaatggtaatttaacttatctagctctatgcaaaggcactatatttccgttctgtggttcagctgtcaactgtactgattcctgatgtttccacatatccacattacattaggaacaaatatccagggtatctggagacggaacaaggctttgctgattctttaacattcatcacaatggttctttcatatcaatgtgaatttctgcaatgctatgaattggagcacactcgacacacacagtgttgcttgcactggctgagtgttgcatgggtcatgtgcatggtcaagaacaatgacctactacaggcgcaaatttctcatttagtctttctcgactattataaaaatagaagatctttttgccggtatattttggtacttcatccgtatttgagttggtttttaagttcgttcacttttggaaatacggattcatgtttgagttggatttttaagttcgtttgcttttggaaatacaaaagaagtcgtataagaaatttctttttaaaaaaacttgcatgctaacttgagattaaagtcagacttctaattgcagctcatgattttctaaaataaaatatccaagcaaattttcacagtgaatttcatcctagctaaaccgtataacaataataagattaaaatagcattcatccgttgcaatgcacgggcatattttctagttattaaaaaaaagaaaggtgaaggtatgagaaattgcctaaaattgattgatcgagcttgggagaacaaagctgtataagaatattaaaagccagaaacaataaagattagtttctcgacatcaaaggttctcatacttttgccaggtgcttgagcttcctccttaatcttctacatgaaagtgccatgaattgtgctgtgttgtaagcattcctctcgtgagcctcccaggcaaccaagaagcgcaatgctggtcacggattgtctcagaaaatgccgatcacggacataatgtgacaaaaggggtaaatttctaggtactgatcacatttctttcaggtgcgatgtctattgacaaacaaaaatcatatggtatgtgatgttcttcaccccctttgctaatcttccttacctcagaaaatacgaatctatgttcttaggtgttttgtttctgaggtgcaaggtgtaacctaataataacatatcgataagcttaaactgaatgataactattgaatgcttctttaaaaaaggaaaaaaaacaaggaccatggtgttaggaccacagagtcttgctcattggacaagaacactgcctcaaaggatgcctcttattgtcgcgcccgaaaatcaccctaaaattttatcgtctaaattatttctagaaattgtaaaagccaaaaatagccttcaacaattaaaattcaccaagtttcaactcaaattggcgtgtcggaatttttgtttgttcctcatgttttaaaacacttaaccaatttttactggaattttcagagcattctaaataattttaatgcaacactaacctttctcagttttatctaaaaacaaaaactaaaataaatctctctccctctccttgggccattttcggcccatctcttcccccccccccctctctctttctctacacatgttttctttagaaaaataaatcacaaattcacaaaatgacattcaaagaacacctaaaattcaaatagccatatcttgactatttgaactcggaattgacccgttcaaattgctaatttttccttaaacagtaaaagaaccccattntaatggctttgctccctgcacccttatatgggnttttaatttatgttttggcccttctttctttgcgtatgtcgtgtagacactgcatatccggaagagccgctctacctagaagttgatcaggagattttggtagcgagcaaggcaagtcatgtcattttgatcatattgctgtcctaatttataaaattatgtttatttaaattattgcatttcgttttattaaaaattcccgcgtttatcactgttttatttagccttaccgattctccttgttatagccttattatttgtattattatgatccttgataactctaggaaaaatgaaactagtgagaactttatatatgtggtgcttactagtaaaattaggaatatgcttagccctggttaaatagaaacaaatagatgttttccaataattagactttgggaataacttttaaataatggttaatatggtttagtggctgtttagccatgacatgatatttccccttcaaaattccccaaacatgttttcagctgggttcggagtgcttgcttttgctagtcgcacctcggccatcataaggaccggtcttcgggccgaccgggcctctgttgcaaagcgtactccatacaaccacctgtctattgggtaagtcttaacgcatcgtctagtacagtcataaacaaggaagacacgaatagggatggatgaagcccttgatggggtcgacgtctttggctgtatgcccgggtcataaactgtctgctcgacccagggcacctggcaggggaagtctatgtcggacctctttgtttagggcagtactaaacaataggttatgtcatggcttctgtccatatgccgtggtggcatgtggcacatggaaacatgtgaggaagacatgtctggtgggtaacgatgtacacctctgatcagagtataatctattcgaatagccgcgccctcgattatgggcaagccgagcaatatacccaagttagagtttaattctattaaaattttaataactagagttatcacctgttggcttgggttaaggtaagatagcgttggagcgcggcttggtaataattttactagagaaaggtttatgttttatttaaatgcctttaaatatttaaatgctttgaaatgctagttttctgcaaaatagccttataaattaattctttgtactcccttgcattatatttacattttcccggcatggcttgcttagtacggtggttgtactcagccttgctcctttttcccacttgcatggcttgcttagtacggtggttgtactcagccttgctcctttttcccacttccagcagaggagtatttcagagatgatggctttgatgtttagctcgtgcctgccgtcaagcgtatgtggtggcccaacgtagcttccggtttttatcgtttatctttcagtgttgggcatttggtcgcccatgtaataaagtactctatttacgcttccgcttatatactttgttatttatcaactttgtaatgtgtaccttgccttctgagataaggaattatgcactcacaaacggaatatagtgttctattttccgggcgtgacagtcatccacatcatgtttccttcactagtcatattcagaaggctgagaataaatgcccaagtgctgccactgttcagaaggcttacttgcttagtactccctccgtttcacaatgtaagtcattctatcatttcccacattcatattgatattaatgaatctagacatatatatctatctagattcattaactaatatatgaatgtgagaaatgctagaatgacttacattgtgaaacggaggaagtatgtttttttttctctttcaaaaaccatttagaccaaggtcacccaacgacagattcaagcagataaccttgtatgggctaaaaggctaactaaaactcacctgtgaacacacgatctcacagtgatctgttgcaacggccttgtactgcaacctccgtctctctcctagacattatatcgaacacctgtcgaacacactgttgcatgccatgtaaacaagcacacgatctcaccacaccattaagaagtgaaaagataaaggcaaaatacacatctgtttgactaatcccaccaaaggatgggggtagtaattttggtattactgcacaattaatctcaccttgttggacctcgccatatccgagccaccggtgtccaactcccagtgtctgcggtgcctttgcctgtcctcgcccggcgtccgctttgccgacgccgcttgccgactgttggccggagccgcggagcgtcgttgcggcgacgtcgtccagcaaccgctcgcaactgggcgtcgccacggttgatcgatccattcaaccttgtgatctttgttggtttggttaatagccaccgagttagaaatttcaggaaacgaattaaccatcactatgctggtcatatatgtctactgaaacccaacaattaatcaaaaacaaaaacccaacaattaagctctcggaattctctttccaacggatccagtttgatctccaaattccatctcagacaatcgtaataacagaaacaaggtgttgattatttaatatgagagagagtatatataccttgcacctatacctttgagatatacaacatagttgcaactcctgatcaaagtttttgtttccttttgtccttcactcgggacgagcaaaggtttaagtttggggggttttgttgacggtcgttatcgatcagcttcgaccgtcaatattaccaaaatagagaagaactagtaatgtttgcaatgcatatatatgttagaataataatattccattagtattaggtttactaaccttttgcagagaataaccatgaaacggaggagaatcgatatcaacacagacgataaatcaatcggacgatgtcgagaatcagacttatgcatgaatgggccaataactcagaattgacacgacaaattgggctaaaattcacaagtctgcggagaagaacaacggaggaggccacctgccgaattagggccaggttgggccggcccctggttcggccgaaccagggggttcgcccgaacccccctggcgccgttggatgcagggttgcggctggacggtgtggattagctcccaatgatggttggagggtatttccgaccattccaaccgtcacaaccgttattgggaggctatataaacccctcaccttctcacttcacttacacacctcaagcaaggctctctcatattaagtttagtagtatcaagctagtagaataggaatagagtagaaatcaggagtccggaagtcttcagaagagttcgggtatggctctagtagctttccttttctcttttgtaagctttgtacttttattagaatactcttctatatacatttatggtattgaaatactttccgagtatataaatgcctactttacattatgttcatgttatactgaatatgctgctagcttatctgggaaatgctttggtgcgggtataatgtttgcttatgcaattgctctatgtcatgacgatgatattagaatagtattgtagtttagacatggtatttagattacgggatatcattatttggggttatatgctgtggatgaaaggtgggccgcagatggtgacagctcagtacgggtattcctccgcgcgtgtatataatcctaagttaaatccttggggagggtactcctccgtatttagccccggttgtatggtcatacaggctgtcgtaaggaactcggcagtcaggggtggcttctcaaagtacgaggagggcatcggatagaggggattagctagtatattggataactataatgtatgtatactatgtatactagaagtataggagtagattatctttctcttttctttccacttagcttatataatatattatgagaatgagtagctactgcttgtgtgtcactcccttggattatcttaacccctgcttaggatttgattattacaagtaatatataaattattagttctctctacatgatcttcccacgggataaaataaatacgatacccttggaatactctcgggtgaaatgctacaatggtatatccgtgcgcttgcggatgaactctgtaaccataatatactagaagtatttctgcgtcattgatgggaattatatttctagtaatgtcgttaagaaataccaacaagcattttcggcgccgttgccggggaagattcataatagagattacctgaactaatactttatatttacctctgtataatcactgccctttgcaggctaaccttggttgttttcactttttactgtgaaaacagggtagtgcatgattggtttcaacttgccagaaaacttcaaagaaaatccagaagctttcttccaaagcgtcaggccgtgagtcgttgctccgcagaaaactctaccggcagagaaaccagccgtactagcgccaccgaccttcaagactatggctgacaagaccctccgcgagctcgctgctccctctgctgacaatgtggccattgggccgcagatcaacatgggagatgtggatttcaacttaaagtccagcctcatcactatggtgcaggctagcccgttctgcggcaagcctaacgaggatgccaacgctcatctgcagcagttcctggagatctatggcacgtacactataaagggtgtcagtccagacaccgtcaggctgaggttgtttccgttttccctcctcgggagagcgaaacactggttttacgccaacagtgctgctgtcaacacctgggacaaatgctctatggtattcctcttgaaattctttccgatgggcaaaaccaatgccctacgtggaaagggacgagtccattcctgaagcatgggaacgacttcaggagtatgtggccgcctgtcctcatcatgggatggacgactggttgatcctacataacttttataatggactcactccaatgtcccgtgactacctggacgcggcagctggaggaacattcttctctaagacggttcgaggagccgttgatctaatagagaagatggtctccaatatgggttgagcgaggtatgcacaccgtcaaggagacggaattacttactgccaagctggacctcctcatgaaacgattggacgaccacgacaaacggccacaaggcaccgtccaggccttggattcacacgttacgtgtgaggtctgcgaccacacgggtcattctgggaatgactgcccagaaacccgtgaggaggcgatgtacatgggcaacaacaacaacggatatcatcgacaaggaggtcaagggtggaaccaaccacgcccgtatcatcaaggaggtaacaacaacggtaacttctctaaccaaccctccttgaaggatctcgtctttgcgcaagctaaaaccactgatacgctaagcaaaaagctcactgccaatgacaagatccttgaaaatattaatgttaagctagatggcttcgcttccgcttttcaaaaccagctgagctttaataatgatagaaacccagctagctcaattggcttcattagtccctgcaaatgaaactgggaggattccagggcaacccgacacctccgttgaaaatgtcaaggcaatcacgacgagggaaggtaagtccactcgtgatcctccatatcctaaccctgcaggaactaacgggattgcaagagaagcatcatccagtgagtcggctgacaaagaggttcagccagaaaagactgtgccacaggagtactgcaacacacgattgctgccgtttcctcaacggagtaggaaaccgtcagtggacgagcagtttgctcgttttgttgaagtaatccagaagatccacatcaacgtgctattgttggatgctatgcaagtgccaacatatgcccgttatctcaaggatatcctcaacaacaagagaccactcccaacaacggaggtggttaagctgacagagcagtgcagcaacgtcatacttcacaggctcccggaaaagaagaagaatccggggtgtcctacgatcacctgctcgatcggtgtacatcagttcgaccaagccctatgtgatcttggagccagtgttagcgtcatgccaaaggacgtctttgacaagctcaacttcacggtgttggcaccaacaccgatgcgcctacaactggctgactcgtcagtctgttacccggcggggatagtggaggaaaatatatttttataataaatttatcttgggttgaaaatattattttttctataaacttggtcaaacttaaagcaatttgactttgaccaaagtcgaaaaatcttataacctaaacagagggagtacattccgatgacttctagaacacaagaatcaaaatcagtggattggtcaccgcgatcggcctgcagcaacctcatcgcgaggagcgaactgccagccatgacggacacccttgtcggtcatcttcgactgttcgtacggatcatcttcatgatggtcaggttcgaggcttagagctcctggccagcacgccaacgcagaagcaatgttttaggatcttttttagtgtacctttggttcgatgtggaccattgaacggatgagataactccttgctactacatctagtattagagtgtagtagtgtagtagaagggtaattgtgaaaaaattattatagcattattgtaaattcaccattaggattaggtgtaatatgtaattgctaatgggatcagatcgacgctaggtttaggggcatcagccaggaaaatgcttctcttcggatgtcctatcagatacaaaacatcggacgcctaggaccagctcactcctttacttactagtttctcctttctctatgttgacgtcaggaaaatgttgcaaatcggtagcatgtgaattggacgaacccctgtcagtgtaaacatacatgcctagccgtttcttttcattctttcctcatctctttaaatatttttctcctaaattacttatccgatctacgaaccgatcacactgttgtattcgttgcaattaaatatttacaacaagatatcacatgattatattatgtcaaaagaaaaacatgtgtttcaaaccgttaaaacaaaatgtttcatacgtgatagtgatatgtttcaatatgtgccttcggtgtgtttcacaaaattcctgaaactacctgctactactctctccccacctcatgcatgcatgcatgtattttagcaagcttcaaaataatttttctcttaagttacttattcaatctatgatccgatcataccgttgtattcgttgtaattaaatctttacatcaagatatcgcatgattatattttgataaaagaaaaa

SEQ ID NO: 77115 - DNA, 1237 bp, Oryza sativa
cttgataatgcattgcaactagccgacttaaagcatatcttgcaagtgttgcatcagcaaatttcaatatatcaaggacgttttccatgtacacatatttgggcttcaaaaattgcacaacatccataaaaactatgatctgcttgtttttctcacatttaaatggtgcctcgaattctctattgcggttgtagccactaattccttggcatggtggacccccacatacaacgtccacatcaccctgaacacatgataaacatgacatggaaatgaatatcaaagagtccaactgtagcaagtatatgtaaaattaaaataattactcttatttcctaaaataattcttagtagttgtcgatatgagataaagtatatttgtcaaagactgaattgatacgctggtattaccggttggcacctataccatagtaatcaaaatgttaagtacatgtacccttgaaaaaagctacattatattgatttaatttgttttcatgaatgctaactgtgtatggaagcattttccttcccatttatttgtttttctgtgtggacacataacatttacatgtcttagtctaatatatgatgatccaagaaattaacaaatacaggtaacagaaatatgtgcttcaccaataagctgagggttgttcgtatctcgggtatatgggttaatctagtattggagccaaattcaggttcattgtgtttgagtggattaactgatatgtactctatatggtcaaaaccaatgtttctgacatcaaaaccaccctaaaacataatttaaccaacgatttatatgctacctaaaaaaaatttgagtttatctcatataggaaatttatttttatacaagaggtctatttgaggatgtctttgtccatatttcacaaatataaacatgacctatcttaatacttccccattaacattttaattttagaataatttaggtcgttgataaatataatatgtaatctaatcattaatgcaatgcatattgttttatggaacaaccagtcctgcagcaattcgcgtaacaactcctagtaacttaaaaactgctactcaacctgaaagaaattaatgaaaccaacataaaatctgccatgatgccatcaaagaccacttggaatctacatttgtggctttgccatcgatactttttgtcctttttctctatttagttagtcaagagaccaatttaaccttctactaaaattaattc

SEQ ID NO: 77116 - DNA, 1578 bp, Oryza sativa
ctgtggtgtagaaaacaactgaacactttcaaccgtttgaaccaggtggttttgtggtgaaccagaattaaaccaagactggctggaccagctggtgtagaagagtcaagttattgcctcaaaggctcgctacaccatttttaacccaaaaatgcctcaaaatcgttggtggaggtttgatcccagactggcaagctacaccattccaagtggtttttgtgttgaaagtggaatatagaatatatcgtctttgactgaacgacgggccaaacatccaatcggacggtcagacaacttgaccatggaaccgaaagctcagccggttggctcaccagagggaacttcgatggtcgaagcaagaacacagctatgtttcttcgctaaaggaaattaataatcaaacacagagtagacttctcaatgttaatggaaactaaaaattggaaaaggaaatccatataagccccatcaaatgcaagtgcacttctcaaattctgactacacaaaggtttaatctaccacaactattaagacagtaaagaaataacaaacacttacagggcgtggtagtattctttgcctgtggccttcaataacaaaatccctaattgcctctttgcagttcctgcactttaaaagtcaaactgttcaaactttggtggaggcaagttatttgggaatgcagtcttcacatattttgcataccttaatccttcaactggctcccatgtgtcatgatgagggccataacccttccaacggacctacatgcatgataaatcaacccattaacttagcataaaacagtaaaaacaatgaacacgaacaaagaaaagggcagtgcaaccatggattgaccatttgtaattttttttcttttcttttgtacataaaccttgaaattaatatctaccatgggggcttcctccactgtgctttcttcaaaaaaagaaatgggcagtgcatgatctatggaaataaatagataattacatgatatgcaaataatataacatcaaatgatcaaaaagagcttgtaccaaggttaaggcaagaaaatgaacttatttaataacatgaatgcacaatccgaaattctccatacttaatatcaataagatttagcctacaattacatgaatgatagatagaatcaaagacattcatcatttcaacgagggctgagactcaaagttgaatccttatcttataatcactcctacacaattaagatgccattaacatagggattctttattactacgtcctgcagtgttaactgttaatgaagagtagtactttttgtttaactcttagcaattctatagacattatgctggactatggagttatattatttctttggttgctatggcatcgatcaatggtcaaagtattttactacattacacagttgttattaatggataacatatgttcctggtcacccgaatatttattcaaatgtccatttgtatttcagcagtctaaacaccttggcattcctagatgtaaaaacatatttcactacaaaagccatatcactcttgtgttcagctcctttataatagaaactac

SEQ ID NO: 77117 - DNA, 8939 bp, Oryza sativa
cctatagcatgctctaacattaattcacagctcatcggtgaaaaatgtccgagaaaaccatgcgcctgcaatggagaagtgaatacaaaatccaacatatttccttgtgatgcaacatgcaagcagcaacaacggacacctaaaaagaggcaattgaatttaggtattttatcaaataactttgcaaacaatacaaagtgcatataaaacggatgcagggcattttatcaaacacatagtgcacatatgattggttactatgcatacctgtgccaaaccggatgaggctcctgacagacttcctctggatccaaatgatttgggaataggagtctgtccaacaacgcgtacttgatctaacggggactggggaggcaactgatccagagcttttgaggtgactgatggttggtataggatgatttgaaagaggttatgaagaggattagttgggttaattacggcacctcatcttcgcgtaggtggttgcagtttcttgtcactgatttacttcaaagagaaaacagaacatggcgcagttaatagaaggcgatgagtcgtggctgtggcatcgttatgggctgggccaacggaaaaacgtttcacgtaacagaggctgagtaggatgggctggtctggcctggcccaatattgttgaatgtcgatctaacgtccatccggagacctgcaaataatccaatggctcaagagaaaaggatgacgtggcgcaatgtggtgcaagctttatagtctagtgggtaccaactatataggaagaaagaattagctctataggaagaggccttagtttgaagcagattgggcctgttcagtagccccttgactacagttgtacagctactacctccgtcccaaaataagtgcagccgtggatattcgttcccaacgtttgaccgtccgtcttatttgaaaaatttatgaaaaatttgaaaatatttagtcacacataaagtactattcatgttttatcatttaatagtaatgaaaatactaattataaaaaattttcaaataagacgaacggtcaaacgttgaacgtgaatagtgcaaaactgcacttattttgggacggagggagtatatctcttgtaatagactagttgccgtgtttcttatacaatagctgtactgtaggtgtaactgcaaccgctgcaccaataatctaagctgaacatgctcattattgtgtggattgtacacaacatttgcctgattatagcgataaattaaatattttgataataaacttaataaatactagaagaatgtattttaaggaaatatattctttagtcgtgaagcaaataatccggcaaataaactaacaagaattgagaaattttgatttattttttttcccgctgacttgactcatgtattggtatcactggaccagccgcttttcctgcaggagaatgggatccggatcaaacccgccacgcccgcatggacgcaatagtcaactagaagtcagaggatggccctgaccaagagtactacgactatgaataagagtatgatgcgcaaatacgcaatagctttgaccaactcatcttcctggccccttagcgcgtactcatattttagcagcaggttaatcgagtataccctatactactgattaatcagcccaagtgtttggatccaaactttgaatccaaacttctaatttttttcatcacatcaacctgtcgttttcagtcacattgtaacaatttcaacccaaacttccaactttagaagaaactaaacacaaccaaaatttcaacttataatctctccaaagcatcgagtactgacaatttctcatctcgagattcttgtactgacaagtttttattataaaaaaaggaaaaaaaaatcgtaaattagaaggcggcgcctacaaattaagcgagtcaaacattttggtagaatgcaagcaacggacggcagatgtcgcggaccaccttaaaaccatactcctcgatgacaagagcgaggattaccactagttagctttgtaactaggagcctaagccagggaggagcaatggcgagctcgagcttgtcgcgccgtgccctcctcctcttcttcttggaggtagccgtcgccatggcgctgcttcttccgggcggtcacgcgcgagtgtgcccgccgtgcggctcgacggaggtgccgtacccgctgagcacggcggacgggtgcggcgacccggagtacaaggtccggtgcgcggcggcggcggcggggggcacggcgcccacgctcctgttcgacgcgctcaacggcacgtcgtacccgatcacctccatctccccggcgtcgcagcgcctggtggtgtcgccggcgccgttcgtgtcgccgggcgcgtgcgtgtcggtgggcgcggcggcgtcccccggcgtgcagctggacccatcgcggccgttcaacgtcagctcgtccaacaccgtcatgctgctcaactgcacggagctgctgctgcggtcgccgctcaactgctcctccaactcgctctgccacgcctacgcgggcgccgcggggtcgacggcgtcggcgtgcgcgccgctgccgctgtgctgcacgttcgtggcggggggctcgtcgacgtcgtaccgcatccggctgggcccgcagtcgtgcagcgcgtaccggagcttcgtggggctcgacccgtcgcagccgccggcgacgtggggcagccgcctcgggctggagctgcagtgggcgacgccgagggagccgctgtgccgcacgcaggccgactgcgaggacggcgccgccgccacctgcgccgacgacccgtcggcaaccggaggcgcgggcacggtccggcgctgcctgtgcgtgtccgggctcgtctggaatcccatcgctggcgcgtgccagcagcagagtacgtttaatttttttgcttcgacggctgacagctcggctgtgaggcgcctctaatttttttttatggctgttaattttgatgcagatctcacggatagcggatccaaccatgcgcctctcattgctggtaattatattgcttccttccttcagcgctagctagcgtcttaatttcttattactgtcatcctgggaaattaattaggacctctgttctcgatcgggatgcatgcttgacgcctactatctagttacgacttcaatttgcaaggcgggcgactagccgcttgcttggttttaacggagagagatcgaattgtggagtcgttattcgttgctttggtgaaaactcagtgattaagtaggccgctattacccttttgttagttgttactgcgagtagttactcgctccgtgcacaaatatgaaaatttctcttagcatggagtaaaattaagaaggaaagaatgaggtatggataggggtagaagtgtggtcgttggggataagacgaaaataaatttaaacgagagataaatgattgatgggacacatattattttaaaatctttacatttgtgaataaattttaattgattggaatgtttataatactgaatttttaaaaaaatatttggaatgcttatatttgtagatagagggggtcgtagtattatagttatctgattatgaataagaaataatccaagcatcgaatacatatcaggagcatggtcaaggcacttagtcatttttattcggtatacaataagtaatccgggctgataaaataaaattgaggtcaatgatctggattgaatataaatgagagatcaactgaaagtaggtttacatcagtatcatgctgggtcccatactcccttgcgccaatggtcaacttgcggcggcttacatccggagaaaagcattgaccataccagagcaagtgtaaatctacttaactccatccagagagctagcattgtcagctttacaacacggacgaaccaaggaagttcaacggttggaaatttggaatgagttgctgcacgatttagctcgctttggagtttgtacgaattctccacgcgaaacaatttaactccttcgtggagcccaaccattaaatggatgtaccaagatttttctttgaaaacaatacttaataaataattcatggaggccacatcttggatagtttatatatgaaaattgtctatcctgtctcatggtgccacatcaacttaattaattttttctagatttgggataatcgattgatcaaagttccaaaacatataaaatatatcaaatcaaaccatgttcgctaatcgctacaatgaaaatcaacacaccacacaactcattttaaccattgtgaattcggtagatgtaaccttctatcccacggtaacagcagcaacacacatgtaattttcatctagctggttaaatatagggtgaatagctaatttagtccctcaagtttcaccgaaggtttaatttggtctttcacgttttattttgtccatatagctcctctaaatatttgttttggcttgaaatcatccttgggtccacttaatatgccatatggctatttccagtcaatattcctattagaaaatatcctttttgcccttaatttgtatacaactatacactagaaaagagaaagccaatataaataaacaacattacatatgtacttcccattatttcaatatgtgcacatgaaacttaagcaattgctatcgtatacacttgctagtacataatttatttttattttacataatatactatgtattatctataaaaaattcaagcatgcaatttttctcttttatatatatatatatatgtgtgtgtgtgttatttatgaagaaaattgttggttcaaggataaatttgaactaaaaggaaaacttgaagtacttatatatatatagatagattgaaatagaactaaactaagcctctgatgaaactgatgaaacttggaggactactttgactattcacccttaaatatagatatttgatgtttgttgttccttaaacataagctaaggaattgaagcataaggaattgattaaccagttagtactattggtcgaccgttaattaataagcacatcaaggcagcaagcgtggaatttactaactagtgaattaagaagataatggatggtttaatcttgctataaatacatgaatgcaatgcagggatcgtgtgcggcctaggcggcgcgctgctggtggcgactgcaggactgttcgcttatcggcggcagcagcgcatccggctggccaaggagaagctggccaaggagcgcgaggagatcctcaacgcgaacaactcgagcggccgcaccgccaagaacttctccgggcgagagctgaggcgcgccaccgccaacttctcccgcgacaacctgctcggcgccggcggctacggcgaggtgtacaggggcgtcctcgcggacggcaccgtggtggccgtcaagtgcgccaagctcggcaacaccaagtccacggagcaggtcctgaacgaggtgcgcgtgctgtcgcaggtgaaccaccgcagcctcgtccgcctgctcggctgctgcgtcgacctggagcagcctctgatggtgtacgagttcatccccaacggcacgctggccgaccacctgtacggccccctcagccaccccccgctcccgtggcggcggcggctggccatcgcgcaccacacggcgcagggcatcgcgtacctgcacttctccgctgttccgcccatctaccaccgggacatcaagtcgagcaacatactcctcgacgagcggatggatggcaaggtatccgactttgggctgtcccggctggcggagcaggggttgagccacgtctcgacgtgcgcgcaggggacgctgggttacctcgacccggagtactaccggaactaccagctcaccgacaagagtgacgtgtatagcttcggtgtcgtgctgttggagcttctgacgtgcaagcgcgccattgactttggccgtggcgccgacgatgtcaacttggccgtgcacgtgcaacgggcagcagaggaggagcgccttatggatgtcgtggacccggtgttgaaggataacgccacacagctgcaatgcgacaccatcaaggctctcgggtttcttgcgttaggatgcctcgaggaacgccgccaaaaccggccatccatgaaggaggttgcagaggagatcgaatacattatgaatatcgaggccggcaacgctcatctcaaggagctgcacagcttatgatcagtggtcaattatattagttagtcaaacaacccatataatgcacgggttattatagtttttctttccgagttttctgttttgctagtgtctcctcacgtttcaaaagtaacgaatttactctgtggagttttccatttactcttaggcagggttgaaaatttcggatcgaaatttccgaaattttagaaatttcggttctatcggaccccaccatatgatattatttcggccaaaatttttatttttttatgatttagtaatattttgtttaaattagatcaaaatttattaaaaaaattcatataatttcggaccaaaatttccaaaatttcggtatttcggccacccccaagtacaaatgaccaaaccgaaagattaaaccctgctcgcagctttctacatctgcttattcaacagtaacaaatttacttgcatgaatgcgccccacatcagggttggaaattttggtcatttcggacccctccgatatgatattatttcggccgaaatttttcaaattttttaatttttcgtgaattttggtaatatttgttcaaattcaactaaattttgttcaaaatttcggaaattttggaccgaaatttccaaaatttcggtatttcggtgaggtccgatcaaatcggctaaactgaaaagtttaaccctgccccacatcatacgacaccattcctagatggccataaaataattactatcagcttacaacgctagtaattcttttaccagtgttataaatattggttagacttcgtggtctgcgagtaaaataattaccaccttcctctcgatatagcccatgatctcgtagccaccgtatagtaatatgtttattgatgtgttcaatatacagtataagagtaaaagttgatactaagaggattgttaatctgtatcacaaaatggccatatgaatgaaaaaaaattataggctcaatcacacacgagggatacaattactcacaggtgaatcaaactagaaaagaaaaaaaaatgatacagccaaaaattcatcgtgaagctaggatcctggtggctttgttggatcttgctataaggatagagaggctggtctgtgtcttgtgatggtagtggatagtggagagggaaaccgggtggtgagcggtagtcgacgttggaatcatgaaaggacatagtggcgtggtataaagatgagctcgacgttgcgcagtagcatccatccatcatctagcaagcacggaaaaaatgcaaaaacattctcgttcatgtcatagagacgacgagggaaaaaaatagcaaacaacttccatcaccggcgaactccaccctatcctctacggccaaccacatggagcacgatgtgcaaatgtaagacctgtgcagccgatcagatcaattcagataaggtaatattggagattacacgttaatttgatttgcaaacaggggcttcatgcgtgaaagtgaaggagagtatgtagatgtaaattgaagtgtcatttccttacttgcttgttctgtcaatgtcaccgacgtggagcagccgccggttattgctctcggcctaggtgaacacctccttgctggttaaggtactacctagcgtccggctgcgaggctcgaagcagcaccttcgcctcaaccgccaccggccaccaccgtcaaccgccacggtgtcgtcgtcctcctcctcctccatggtgcatcaccgatctgtgggctaggatggtggatcaattcagataacccccccgccccccaagaaaggaaataatgaagtgagggcgagagtggttggttgggtatggggaaaatataatatatactggaagcgaggaaattgcttttatcgaaataaattatttcctccaataatggtgggagcgggatgatgggacgtggggtgggatcggatgcagggaagttgtttttatctaagtaaatcgtttgctccgataacgatgggagcgggatgatgggacgtgggtgaggtgggcctgcgctgatacatgtttgacacttgctatattaggagcgcactgcgctcctagtagtatctctatttgtttggattgtttttaacgttgattatgtttttcttttaattacctttgcagcatataaattctaactaaaaaagttgatgttaaattaaagatataatgttgttctatcataaatgaacgctaattgttctcatttctgttaacaactattaaaaagctttcatattggttcatactattatttcacacgcgttgtgcaaaatgtatatgacaataaaattgatcaaaattgcctcagcattcactaccaaattaaggatggattaaaacttagataccattgcttccgtataatatataggcaaataaatcatccacataatttgtggctagctagcatatatatcatgattggtacggtgagagttagaattcttctcttccatctgttcacttattttcttcgaaaatgaatttaatttgaaatatgactgcaactatatagatcgagcacgttgatgtgctatagactaaagcctaggtttattgtttgaattacttttcctaactaacattcacgtatttagtcattaaaatatttaaatcaaaactatattgtatatgacgaccgggtcctttatgctaaaaggcaaccttttatgcaaattaattcttcaaacatctaattgatatatgaaagaatttgtatcccttttactcat

SEQ ID NO: 77118 - DNA, 1829 bp, Oryza sativa
aggattacaagatagagactttatccttacggtataaagctctacatatactttacaattgtaaccgattgggactaggggatattaccttgatacacaagttaacataatacccgcgtccttttatatacatattctatccacatgaactatcccctatagcagttagatagcatagccatgtgggtatatggtacccataatctccacagtagcccctaagaccttcatagttgacaaaataatcttctaccgagtcatctgtactaatataaaaagcaccagttcatcaaatccagatgttttctaacctttagatctaatcatccgacagctcatatcaagagttggatcaaccactgcgattaacgatctcccacgtctaaacagtggttagggatcgatcaaagcgaaaaagaaaacgaaaaaagcttctttgctcgccgcctcctcgtgcagtcgcgcgccctacctcgcacgcaccgggcgccgctgccgactccgggcgcgcgcccgccagagccgctcgcgggttcaccggcagaaaatcacgcacgcaatttgtcaccccgccgccgtcgcatgccatccttcgcacgtcgttgcacccccgtccccctccaccgctgacttcaccccgcggcgcggccgctacaagtcgctgcagccctgtcactccctctccgttccctcgcccatcgtcgcgcccctgtcccctccgccaccaacttcgccccgcagcatggccgctccaatccgccgtacccgtcccgcacatcgaccatatcccgccccgcgtcatttgccgcccacgctgcctccggatcacccatatccgacctccagcctcgtcagattggcgccgccgccgaccctaagcttgtcgtcgagcattcaccgtcgccccatctgccccccatgccgatccatccctagcgccgtcgccgattcaccaccaccaggtcacgtccatcgtcttcttgatttgctccttccgcttcttatttatcctttcttttgttgatttgatcagaaactttatcctttcttttgttgatttgatcagaaacggcaatgaattttattttaacagagagagggggggggcaggggagggggaattgattgaaaaaatgaaaactggagtttgtttgagtcaatcaaattcaaatatgaataaacatgggaattttctgtttctttagctaggccatgtgcatttcacatttgtaatgttgatggaaaagctacagataggggcagagagtaactggagaaaatagaaatagaaatagaaatgagtagcgatgttagtagcgtacatactttacgcaagtcaatgaggatcaagaggaggaggaggcggtatcctagctaactggtcgtctcgtggaggtaaaaaaaatttctttgattccggcgaacctatggctatgtttcgttgataacttctaaagttcttcctgttgttcatcctgctatacatggtgttcttttaagtctttcctccaatcgcctccttatgttctattataccagtggtgccgtaccaatggctatgatgtgcagtccatatatagaatcaatcactgaaaaaaaatgagtttagataagtcacagccattaggactatattaaatgagtaatgaatcattgtatttgcactttttgcagaatcatggcagtaattacatggtcaggttgtgaccaaaaaaaaaatcagagatacatatgctcaggttttgatcaatgaaccacttgtagacattctcagattttggcaaaaatgcacagatacactacaaactcaagacacgttctttgaattt

SEQ ID NO: 77119 - DNA, 24375 bp, Oryza sativa
accacaatacaggtctagcaaagagagctccatcttctctagcacaggagacttgtgcttcttattgacatctatcttcttcattttgtcattgattctactagtgtaacatgactgcattaaatcatctgtgtcttctgcttttcaagaaatttaatcagaataataggcacctaaaagaaattattacagatgaaagaacagaaaccatgcaaaatgtaatttacaagacagtacattacagaaaactatgatcaataaaaaaaaatgctaattcaaacaactgcaagatgtagatatcagcttacaaacagacatgattggctctgtgaagcattcgttgttgagaatactaacccatttctatggtagagaatgtactatagtcgatagagtatttcatgtcatagtaatagtcggacgaaggaactgactttgattttccatctacctgtaaataaaatcagaatcatacgtctcaatggaaaatgtttcagtagaacacagccatcacaagacaatatcaaaactgcaacatcaagccttacactaggaggaacttgcacgattgtcactttcgagacaatgcagtccagtaaattgtcatctgtcaggtctgagtaaaagagcctcctcgggtcatgtgattgtgcttgctctcctatgacctgagatcagtttagaggtttaaaccttaaagcattaaggaaaagtaacataaacttgtctgtccgcttctatttttacaagctgagaaatgatgttatggttacagtactccaggtttgatgcataggcaatataaaacttgtcaaaacaagcataatgttttagtcaaccagaactaaccgtgtcttcagctgtgaaaaaccattgcactctgaagtaacattcaccagtttttgtttcgaagaactctagcaacctgccaatataatttggttttccctctggaccctgcaaaagttaaatctattaaacttgtgcaacaaaaatattttttgatagcaagataaacattacttcaatataagaaagcagtaaactcacaaaaaacataccctgaaatcaagcatctgtagataaacatacataaagactacacaaaaagatacggtaactagtctgcacaattgtacagaaggacaaaatgaacataagaatcatttaagttatttttcctcagggaagtcaattttatacaattgaattgaaatgcaatgtgtcactgatgtatcatatctgaatcaaggacctaaatataggcctcacaacgagtgttgtattgcggatatggatgaaactcagtgacagagggtggatttatcctttttgtgaactagtctgtcacgttggtcagttaaaagaatatcaaccaatgaagacgcaagtccataaaagctacagaaacgaaaaataaacatatatatctcaacttgcctttacaaatgcgcattctccaatgcaaaatgtgtatctggagactttggcttgtagataatgacatttgacatccaagacagctttgccagcactgtaatataaggtagtgcatatagctgttaccatgaatagcttcaattatttatctgatataaatattgaaaataaaatagtgcatttgggctcacttggcaaatgtttggctgctggtcctcttatccttcaagaaaacaagcaaaaaaaatgttactcacttaaatttaattgttataggcagcatacgggcagactatataataccattagcaaattaaatgtaaacccaggtgtagaatagcaattcagcacctcgcagtagtgccacaaggagacatccagtaacaaaaccagtcgtacagtcagtaaatagtaacatcagaaggggagtgcagtaacacaccactggaaactcattaatgagtgcactatgtttgaaacggcacacccttcatgctgttactccacgaggagaataactattctacacctggacgcaaaatagagtctaagtgtacaatagtgttgtccataaattctttatatacaaatatccaaaataacaaacttcagatgaaaccctataagctgacaaaaaatgtacaagcatgtttatgttcatgtacaactatgagtatggctccacatgtcgaagatttttgagattcacttagccacatctatgtggggaaacttcttgcaagatatcggtgtaatataatagataaaagaaaaagaggcaacagctttttcacacaacttctgtatttatgcgttattttatccttttacaccaaaatttactgccattcaatcttcaaattaaacctttcatctaaccaagttgagtatcctatccagattctagatattccttatcttctcttatttatatgttcatattttaatcacggccaaatttgctcctggcagctaatcaaggcaatcatttgttggttcacactgcaaaagtcaatctttgcagaacactgctatttcatgaccatttgacagaggttactgcagctgatatagcaccacttcttgtcacgagagagaatgaggtgaaatgacaaatttccccttcaaccatattgcacaaatattggctgaaccttaaggtgctacaacttgcaaggtgggtgagattaggcactcatcttgcaaaatgctcaaaaagtcacacaacttgagtctaacgcatgccacacagagtgattgcgtaaaattggacacaagattggttgcctgaagcacaaagcaatcgaaaatggacaaattgaacacaccattgctgttgggctcccggcagcctatactaggacatcaagtttatctagagaatgtaactgtaccatatgctgccatatgttgctcttaggccgacttgggcatgctcggatctcatcaatgatcaaactttcactttccgctcatgtcatgagcataggaaaacctttccagtacaggctagattcccaggtgaagcctgctatcaaatagctatgaaggccaggcgtaggcttgttggggatcgaaacatacccagtgtccatgtcagcgcccacatggcatgagttggacttcatttggttagcatttggcaagatgactaatacgatcactgtattttattcttaatataaaacattgaaaatcagaattttcaaatttgaacttaagaaacacttttacaggatattgacttatccgcattcaagttttctgagcttgaatttaaataattcaaatttcagaatttttattctattaaattttggatcacatttactattcaaatagtataattatttatattttaaaaatcataatttttggctaaaaatcagaaattagatagtttagaaatttatattgcctaaaattcaagttttgcattctttctttgaaatttcatatttttaatatccttcttagccttgtcagcgtcaaagcttttgatgttaaaagggatcatctatggacattacactctccaacaatggaatgatgtttccactggcaccaaggtcctctgggttctaggtaatgatcacacaataacagtgtcctatggcaaagatcaaagatggtgatgtaaacaaataaatgattgactagattagcttctgtgggcaagtgttacctaaaatcaattttcatttatttgaaccgttgttcaaactatgggtaagaaaatagattgactacataggagatgcagccttccaaacctaaaaccaatgcacgagttataatttttttcttgttattctttctgtttccaactgatgcatagcttctcattcccataacatacattggatgtcagagcttgaatatcatctaaaaggttgaaaccataagacacactggaacatatataggttgatattgatcgatggaaacaagtttattaatatagtcatatacttgtatttatatccaccatacaatttttatgttctaacatgtactatagtaaaatgaatgtgcaaacaattacatgtttacccatttcacatctatgctttctgacacttccttccatgcttgaacattattgttaggaatacaaactactccctgaattgtatctgcacgaatcagcagttctcactattgtattgcatgtacttccgtgacaaagacatgaatagatatttcaaagagaactcctactcctagggaaatatgaagatgatctacttgtatatctatttaactaatctgcaatagtccacatcttattgttatattgctacagaaatatggcgatgaagtcatgcagagagcagcaaaccagccaaatcacgtgcatacctttttcatgatttgatcatttatttcgtaacggtgaggccactgcttcctagcctcatcatcaggaactgcatcccccacaaagaaacaggaaccatcgtccgtttccaacatcactgaatcaaccatgtgcttgtccaaaacaagttcgtgcttagtgctcagttctggtattattggaactcttggtgatttggacattgagccattattttctggtatcattggaactcttggtgatttggacattgagccattattattattgttttctgccctctttaatttttccaagtatttaaccgacaacgtcctggccctctgtgtctttggaggttgaggggatcttcttcctctcccttgaggcgtcttgctgaccactcgtgattttgcacttttcaactttgagttgcacaacacaataccaccaccatccactccatccagacttgtcaagcactcttcaacagcaagcttatgctttttagtaggtatacaaacatctgatttctgcacaggaggtccaccatttaccactggtgatatagctgacaccctgtctgaattcaccaatacctttgaggctaacctagtcttccttcgaggaagaacagaagctcctttgtctttcaacaaactattactcgctgctggtaaagccaccacaacctgattgtagagaccacctgctttctgattattgtcgtaagaggaacttacgttttccacggcaacaatttcttgcaatccttgaaccttcaccccgttaatcaaatcaactgtgtttactgaaattggccctgtgaacgcagggagtttgctcccttcactgcttctactcttccttgaatccgcaactcgtcgcttggaagctctagatgagtctccattctgattcaaaggcatggagctcgccgctgacttgattttcatgatcctccgtgatctccgcagagctgtaccatttgcacaagtagcatccacctcgggatccttcgcatccatggttgttccccaagcaaccgaaggggaagaatccttgataggatcctcagcccccaaaccgacctcatatggggaagcaagaggtggcgatggcacggagttgagcgtacaatcgagcattctcccgtctaaattggcttccgaggaagcgacagacggcggtagtggagactccatcgccggggcggagtcggcgacggggtcaaacccccgcgcatcaaaatccaccggaggagacgacgatggcggcgggtcaggcgaacaatcaacgccggaatcgagcgcactcacctcaggaacgtcgcccaacgaagccgccgccgcccccgccggatacgaatcgatcggcgccgcgggctcgaactccgcgaaccccgcggcggccgtggggggaacgagcgcggtggccgcgccctcgccggcgacgaccccggaggacctccagggcgcgccgtcccatgggccccccgcgacgtccatgatctcgggctccacctccgccgcggcgaactcggcccccacgccgaaccccctcggcggggaccacatgggctccagctcctccggggagccgaacagggccgtccacagcgaatccagcccggcgctgaacccccccgcgtcctccgccccgtcgtcgcctcccggcgagccctcgtcggcggcgggcggcggaggcgagacggggtcggggggcggggtctccatgggaggaggagcaaagcacgggggcaattcctccccaaccaccaccaccaccagcgaaaggtagttggaagtcaatcggcgtgtccagtggcattcacttgctgacttcgcgttccacacgggagggagggagtcgcagttgccacgagtcgggggggctttgcccgaaagagaattgtggtttttcttttttcttttttcgattcgaggaggagagcggcggatttgagaaactgaagcttccatttctgacaaattcatgtttgttttagggccaattttttttttcagcttgatccccgggaggggaaatctttggggaaaaaatttgaaattatactgtttatcgattgaccggatagcgaaggatttgcggaaataaaccatcggtggaagagcgataccgatgttcgctcctgaaaagtgcaatagcgtggcgaaatcgctatctgaaaaagcgatagcgaagttgagctggcgctctcgcgccaacgagacgcgagaccatagcggtatcgcttttccctcacgtgacagcgccacgtggagaaatccccgcgactacgttgggcggagccatcgctctcgcactttcgttgcgcgagaccgaggtcggtatcgtaatatgaaatcgcgagaccgattatgacgcgacgggagagacgtgggcacgcggtatcgcgctttgcgtgcgcgagactggtgacgcggcatgcgcgagagagagaaagcctgggggagggcagtgggaccgcggcgtcacgctttgggattgcgagaccgatcgcagtgtcgctatacgcgtgcgcgagagcgaggagcgcaatggggcagcgttgtcgcgctttgcacgcgcgagaccgtaggcggtctcgctctacgcgtgcgcgagagcgagggtatcgagagagcggcaatgggttcagtctcgcggtgtctcgcggtccgcatgcgcgagaccgtcctcggtatcgcgctccacatgtgcgagagcgacggcgctttccgcatccgacgccaccgacacctttatttcccatctctatttctttttgctttttgcacgggttctagccatctaccttagctttttagggaggggtggaagagctctgtgcactctcttatcagtttactgttgtagtcacatcatgccggccatttgtaaccgctgtagcgttcgaatccaatgcgctcacgggttaaattgagaggagaggagatggtcctcacagaggaagatagaagggactgaactaaggaggagaggaagagcaagagatgcaggcagtggagagaaggaaaaaaagacacgtaagttgattagttttctattagcacaaattcgtatgaggatttagaaaatattagttcacgtagttaatatttgtttttaattatgtcatagaaaaatttaggtatgtattagttactactacattatgggtgtgtttgaggagaaagagattggggagattgggaagatacgcaaaacaaggtgagtcattagcgcatgattaattgagtattaactattttaaatttcaaaaatggattaatatgattttttaaagcaacttccctatagaaaatatttgtaaaaaacgcaccgtttagtagtttgggaagcgtgcgcgcgaaaaacgaggtgctttctcatcctatcttacacaatcgaacgcaacctatattttgttaggttgcatataaaaatagaaatgtagaagttgatagagtcgattcgggttaaaaaataggtagacataattaatttataaggtacaaaagtataatataagttacaattaatttgtacctagtagtaattataagttataattaattagtagttcatgtgatgtttaattttatatatacggccaatattatatgtaacaaatgaaaaaaaaactgaaatattaatagttatatttgtagttattgatattgatattaatagtattgataattattaaatatggtacaaaaattaaattaaagttgtaattaattcgtagtaattttaagttacaattacttagtagttcatgcagttatttatttcgtaagaaatggaaaaggtataaatattcgttaagtagcgggaaatatatggtgtgcttaaacatatgcttatatagcatattgtaggtagttacgaacgaacaaagaaatgcgcggtactacgaagaactttgaaattggaacttttatatgagcaaattggttgaaaagaagaaggcaagacaaggtatggtactataatggaagatgtagtaaattttttaatagacagtttgtattttatttggtattgtaattaaagtccagttatataaatttatgtcgctgcaactagttttatactataataaattggtagttatgattaatttgattgattatgtaattaatcaagtgaagttgaacttagttctattaatttatcatgttatgattaatttatagataattttgtactaactgatagttacaaatattttgtatttaagtaaagttacggtccgttagataatttatagttaaagttgtaatatattaaaagtactaatccaaaattgcaatagtagtattgtttcagaggtcatatctaagtaggtacaaacaatccgtagcaaagaatatgatgcggctcaatgagtgtcattgtcctagataaagaatagaaagagctaaccaaaatgatttttaacttagcttccgtcaatgtttcttcggtgcacgtagtcatttgttgtattaaaattaattgatatgtataattaatttgttagttaaacatatggattatgcagtgaaataaactttgaggcagcaattgttatacgagcaagctggttaaaaaggagtaggcgggttctgataaacgcaggtaaatattttgtcatcatatttatgtacgatatgctatggttgtgttgttttaagtattacatactcttttacttaaattaattgccatagttatgtttaattacgtgttttaatcaattaatttgtattaaatttattgtcatgtgtctattttttatgtcaaagttgtagtaaaattataaataatgaattgcattgtcatgtattcgtaagtaaataatttatgtttacgtaattatttatttataattttcttattacaagtacatgaattttttataaataattagttattgataaagatttttttatcaaaaaaagtatgcgtgtaaactaattttagttgtgaataggacacgtttgttctgtaaatcttccttacggagtagtctgtgttgtctgcaatggcaggaatgtcggcatttagagtgtatttcggtgaaggtgaaattatggaaaatgaaagtgttaacgtgatctgagcaactttaggcaatgcacactataccatccaaatcctgacacccttaccatgcccgaagtttggtactggttaacatgcacattttctttagatctgggtatatatagtattaacgtgagggttatgtggagccgatcggccaacaaaataggcctggcaggattggctcgctggctataggagacggggatatgaatatgtcatgctggtgcaagcatgtcaaggaagagtccccacggagaacgcagcggggcaatccagcaaccgtgaggagttggggtctagttcacacgaagaagatgaagttgtagctccccatcgtggtggcgatgttggtcttgacattcaaaatctatccatacaaggagatgaagtggtcaaccgccatcctattggtgaaaccgatgaaggggaggacatacctgctatagctgaagaaattgagagggtggaccgacatgcagtcgaagatgaggaaaacctcgctgctgaagagaatgatgacgaagatgaacaagaagttgaggaactacctatgcctgcttcgtggaaccttgaagaccctggttatattgcagaaaactcttgtcatgattcaatatggttctacggggatggccaaatcaatctaggtgcaatgttccgtgacaaaactgggttgcaagacgcagtgaagtcatggtcattccagatgcaaaggcagttcagggttgtgaagtctaacaggactgagtacacgatcgtctgtgagacggaaggttgcaccttccgtcttcatagtcacgtgccaaagtacgagtgttattggattgtgtccaaactgcaggaacactcctgtctgattcggaacactagggagtcgcaccgcaacctgaccgcggcatacgtcgcgaacaagtactacgaggaaattattgaaggtgatgacactgcctgtgcggcacataataaaactggtggagaaaggtgaacaatacacaattagttaccacaaggcttggagggcgaagcagaaagccatggagaaaatatatgggacatttgaggaagcatatgacacactgccacatatgcttaacattctaaagagaaggaaccctgggacctatgttgcggtgcaggatcgggagtcaatttatcctccaaattatcttgtgatgcaacgggcattctttgcattcggagcatgcattcatgcgttccagtgctcgaggccggtgctgtgtgtcgacagtactttcctaactgggaagtaccgaggccagatattaacagccgttggtgcagatgcgaacaaccagataattccagtagcttttgcttttgttgaaagcgagaactacgaaagctggttgtggttcttgcaacatttaaagtggggagtggtgcaaaaacgcacatcgatatgcatcatccatgacgggaatgccggtctgttgaaggcaatcaaagagctccaggaggatggtgatggtgcatactactggcctgacatgcacagccgttggtgcatgcagcacatgggagacaattttttcaaacaattcaacagcccgcggctgatgaacatgttcaagcggttgtacaaggaaaatcagtctacaaagttcgatgagctttggaaacaacttgacgaggggacaaggacacatattcggtcaaagcagaccaataacaacccgcaggatgtacgtcccccaggccctggaaccaatggatgatcttattccatcaaatggaagaagcgtaggtcatcaaagaatatcaaatgttttacccattggattgagtgcgagccgaatgataagtgggcactcctgcatgacactaatgggctaggcatggcataatgaccactaatcttgcagaggcgtacaatgcgattcttcgcaaattaaggcctttacctctaactgctattgttgaaggcattatgtataggacaacgatgtggatgaggacgaggcgggccgtgacattgcaacaaatgtctaacgcacaaacacctttctgcaaaaagatggcagagtacctccaagagaaggctaacaaggcaagatttcacacggtcattaccactgggaacatcagacaaaggtgggaagtcacatgtcgcactaagggggggtttggatcttctactggggtcatcactcatgaagttactctagggcatgaatctgataacacatgttcgtgctcttgcaataagccgaagcttcttcataagccatgtagccatatcctggccgcgtgcgctaaaattaagtttgattcaacatcatacgtgtcgacattctacctaaaggatagagttctgaatgcatgaagtgctaagatcctcgggtggaggtccctccaacacctagtcgaaactgggggtgataaaaggatctatgtgccagatttggatttgttgaaggctggtaagggtagaagacaaacacgacgcttaagaaatgatatggatgcatccgaagcgggagggcctgtgaggcgatgtgaggactgtcttcaatacaggcaccgcactagagattgcaagaataacaaggagtgtacatcttcaagcatggaacctaggcaacaacgtgcgaggaggaatagaaggggctctcagggtgctcacgatagggaggaaggaaacctgcagtagttataacctacactgtccggttatttatgttcggtcatgatatgtttgctgcatgacgttgtatttcaataagtttgtaatatgttagtcaataagtatgtgtaatatttattttattatggtaatattgtaagattttattgtaaggtgttaccaagtttgtaacgtttgtaaacctattgttgtactatttatttcgtaaggtgtgctcgaatttgtacttgtactatgagaaaaatttattccttaatttaatgcattatgtactttttcgtatgtgcacttgatgaaatttctaatttacccttcatgatgtacatgcagatatggaagaggagtggccttacccgttgcttagcaaagagatcaatgcacgacatcgtgcaaataagatatctgatgaaaattcttgctctagtctagctgtcctgataccgcgtacagccggatggtggggtattgatccacgatggaagccgaggtgcataaatggttaaagtttgcaacatcatgatatcgtactataacattgcctaatgtgactaataaatttcctcataggttgtcagctacaggtcttcttacctttgttcagatgacgtaggcaaggaagcattacgatgctagagaacctaaacaaaaacaaatgggggcacaaagcaaacgacgacaaaatatcgacaagtccctacttatggcactggttgataggtggaggctagagacacatacattccatctaccgtgtggagaaatgaccataactttgcaggatgtgtccatgctcacggggctgcccctagccggccaggcaattgtacttccggaccctcagaagattggagagatgatattgtatcacgatatgcatgtattttgccacagtacgctaccggtgatacagacgatgatgaggacaaaatatttttctctgaaaaagaaactcatggccccacattgacgtggttgtcacagtttgaggtaattgaatatttttaattaaggcatattccgttcacattcacatatctcacaacacattgtttttttgttagctgagatatatgcccgacgatgtccaggagtaccaactgacgttgtaccttgaggcttatctactttggctgtttggttaggtcatgttcaccggctcgcacgggaacactgtggacgctagactaatcctccttgctcgccaaattgctgaaggtaatatagcgccttctgcacagtttagctggggatcagccgtccttgcagccacgtaccgtggattctgcaatgcttgtattaagaccggacaaagggaggcgattttcacggggtgtccacttttggtcatgttgtagtcgtacgagcacttctcgttcggacgttcatacatgagcatggccgtggcccaccaggacgattacaagggaagatattatagcatttcacccggaaatattccaaggtattgtatttatttaattccaagggaagatatgataagagagtactatgataataatttacatcacttgtatagatcaaagtctatacaggggttaagcaatatttatcggtagagatatgttgacacacagaagaagtaaccatatttttctcattaaaaataaagtctaagctaagtggagaaagaaaaagaaaagaatcatttctgtacttatagtatatagccattttaatatacacttgttagtatacaacaatgtagccaatacgccctaattatgccctcctggtgttttgagagaccacccctgattgtcgagtttcttacggcaatatgtcatggccatccaaccggtaatgaatacggaagaatacccacaccaggaatttgtcttagtactatatacccacgtggaggaataccctgccaccatcagcggcccacctctactgccccgtggcatataataccaattaatgatatctaataatctaagcaccacgcatacattactaaatactactccatatcgctgcagctgacatagagcaatcatcgaaagcaacattaaacccacaccaatgcatatctctaataagctagccaaatcattatatcgagacaagtaaaatataaagtcggtactcagatataaatgaagtaaatgaccgaagctatgtaaaaaagaatctttcattgataatggtatacgtcttacaaaagaaggaatagctactagagccatatccgaaatctcctgaagactcgaagaactaaggaaactattctattcctactctactagcactagaacaaataactaaacttgagagagctctttattcttcttcttgagtgtgtgttagagtggagtgaggcctcctccttaaataggttgccaatgacggttgtggcggttggaattgtctaaaatgcctcgcaaccgtcattggggagcaatcctggatgttcacgttgaaggccgagatgaagggcctcagctagggttcggcgaacctgggccgacccctctggcctccaattttggccgaggacttccttgttgggccttattctttgtggcatggtagttgggcttatttgcagatgttaaataagttttgtaagcccaaacatccataagtctgccactcggtggtcgtcgattgattgtttgattattttcgactgattctcatccgtatatgtagaaatctccgtgttcaaataaaattccaagtacaagtggaaatagattatttctaacaaaatatgcattgcaggtatagctagttctcctttattccgattatattgacggtcgaaattggtctataacgactgtcaatagattgcccccacaagcatgcctggttgaaaggttatagtagtaaagtatttagttaccaaggattagtttgtcctcccaaaactatgaattactttgttcttctgtgcatgatccaacgatctcacgatggtggaagggcaaccacactgggacacgtggatgtccaaatcgtctctagcacgagatcaaacatacgatagcggcgagaaccagtgcataattaacacgaagtgcgggggcttttttgcaaaaataactgatgacatggcacacgtaattctccagcaatcccacggaatttagagaagttaatatttgggatttgtctattcagagtattttaatttcaaatgaatgcttggcatccttgtagcgaagtgtaatcaatatatgttgtcatttctcagatattcttgagatgtatgtgttatatttcttgcactttatcattggaaaaaatgttattatctatgacgatgtctcaaggtggtggtaataattcagtgcatatggaaattagaactatatatggaaaataagcatatgaacatgaaaatatcgattatttttaatgcaaaactatacttatagaatatgcctctacatattatcttatcttatcttatatagtgaaagcagcaagcgttcttgcacgagaacacatgagaatacagcacatcatcaaaaacatatcaaccgttgaataaagagtttagataaataatggccattggatcacaaggttacatatgcattaaaaaacagcaatgggataaacgtatgggaatttctagaggtttctagtgccttctcttagacacatggtacaaagaaagcgggtgcaaagataatgaaggaaaaaaaacaaagaaggttctagtgatttatcatatagtacgactagctaaaccaacagatactttgtaaataaaataactcatcaaaaacctccagtaaactaatagatcctatacaacaaataattcttatacggaatcaaaagtcgcgcaacgcgcgactacgtggcttgttagtttgaatgtaccaataaagtatctctacagatacattagtttgaatgcaccaataatgtgtctctacatctgtagagacatgttaccagttcactgtaaaatgactccacctacagaaagtgccgctacatttgttttgacaaatgcagcgtctctatggcagccacatatctcatagaggcattttatagtgtcactatttgttataaaagttagtcgatatagtggaacgacgactaaccttcccgatcgcttcagtcattgatcatccaagacatgtcagatgacgacacaggaacacacgatatttgttaacgaggtttagccgaagcctacacccccggggctctgattatgggcgctcctcccgaaccaatatagctcctagccgctacaagtccatgcccacgccaccaccatctccctacgtgtctacgctacattgtagtcgccatggttacattgtggtgccccctctctacttaagagagatgccgggttacagagtccgactctaactccaccccgtaacacctattacaactccaagtccaactgtaaccaaataagactagtatattcgacacctattctaacaaacttcaccttggcgaatatatgccacctagaagttgtagaatcaccataccgatccaccggtcctccagacttgggttgtcttctttgcagcttcatcacaagccgcccgacgagtctgcaccaaacccgcgcctttaagagattctgctatccctgtaatttcttcctcttgactccacctgcaacagtgctccaccttctctcatatcaccacagtcgtcttgccaagcgaaattgaattcctttctagctgtcacatcatagacttcccgaaaaccatgttccactccatctaccatcttaaatttgacttgatctaatccatggctagataactgatgccatcaccaaatagataaatcaaactcaccagacatgaagaactgaaccctttcgtccttgtcgccctatgaaccgagctaataaatctaacatcctcgctttcccgcatccgcagactaaacccatgatactttgagaaaattcaccgttgccttgaatcacttgaagaattaccacgatagtgctcactcttcctcttcagtgacgtagattttcatatatccccatcatgtcgacccgcatatcctgaaccgccaaacagtatcgttgaccccatcaacgatatttgacccgctgttgtccggatcttttcttcagtcttggcttaactccatgtatctttaactcctcgccaagtcccagatatatcctgttttcgccagataattccatatgcaacctgactagcctgttgccgccagtctactcactctttacacttgcaaactatccatccgtagaaccttcttgtccttcttatgaatctgttaacaagttccagcaacgaaccacacgtccgttgaacccggtttaaccgtccaagctccatagtctaaccagtctgttggtctgaccaccctgccggcccaatttaaccgtcatacatgcacacctcacgcaccttctcctaagccatactcacacactgcaccaccttgatcacaacaaaaccgcaccatgcatgcctcactgtgcccagccacctgccgatgcaccgctgcgccaaattgactgcatggctcgcaactccactgcacaacatcctctcgtgcaccaccacgctgagtatacagcgtatctactggtgttggtttttcacgtgaccttggtctagtagtgtcattctcatgcatttaatggtccaccgtgtcacaatagcccatgcacttaattacactactaattacctcttgcatgcaacaagtaagctcagtaccaatccaaagtcagattgccacagaacctagccgagcctcctaagagattgattcagtttcgagcttgcactatcgaatccagattagactcctccatgcagtccaatcagaactatacgtgtcctgatccaagtcacgactccatcttcgacacgacgacacccctgcaatctccgtttgcgatcgttctctttgctcgctagttctgctcatggcttcctgctcagtcaccgcgccctcgtgtactgttagagtatatggtagttaggatcatattaggatatgattgatttgtgtggactccttccatatatgtaatccttccttatctcctcccccatgtactcctatatatatcgcccccctgaggctcaatacaattgtgatccacgttacacagtatctctctcatactatctaacatggtatcagagcgggcgatctagcgccgctcccacgcttccgccgccgccgcccccgggagtagcgatctcccaggggcggccacccgtttttttttctcttttcgtcgtcgccgttgtcctggagagatcaatctctgggcgttctgctcgtcgtcagatcgatctgaggccaatcttcagatcggtcatgcatcttcttctcgtcgtcgttcatcgtcacgtcaacatgaagcagctagcagaccaccatgccagcctcgccaggggaacccgttgccagtgccacgccggaagtcggcgctcctccggctcaccctccccctccatcgtcgtcagccggcccctgccttggcggcggcgatctggaggagtccgccgccctgacgacctccctgtcagccttccgcgaccaccgcccgtccgccggctcctccgcctaggctgccaccgcttgtcgtcgtctctccggctggggaccaccgccgcccggggggatctgtctctgccactgccagggggacagccgcctcttctcgacgcgtcaggccgccagccaccgatgctccgccgttgccgtcggggctacggggccgccgcctggccggcggtcggcgtcgccttcccggctcccgatctgaccgccgccgccggggggatggagctcgacccctccggccagccggccctgaggccccctgttggcgccggccagcctccgccgcacgacctcctcccgccgaggccatcggcttgtcggcgacccggacaacgcggcgtcctaccgctcctcggctcctgtcccctttgtctctctcgttgtggtaatgggagatgggagatgattggttggctggttgacttgcccgtgtggactgtggtgcattaatggacttggcccatgtgctgctagttgggctatctattaattgcaactgcattgctgctgctgcttgtatccgtgtatatctttcttttatcccgatcagtgaacgggtttgcgtcgcccgccgcctcgtcgacatcggcacgtctccgacattggcatcgactctgcttcgacttcatcgttccgcctcgcgcatcttcggcttgatcacccgttcaagcgtccggctacaacaacttctacaaccgatcatcatcgagcatgcatctacaccatcaagcttcgggctgccgctgcgtcgccctctcgggctgcagtgttgccgctcatggtccatctccactagttgttggaacgctgcaaggcgccctcctcagcgtggcctcaccaccggtgaacttctcgccgctgcatcgacatggagctgtagctgtgttgtgctctcgaaccgcagcttcgccgctttcatcgtcttcatcgccgttcgcgcatcgacaacctcgtcatccgcactggtcatcgtcagccgcttagggtcttcttcctctacttcgagcatcgccgccgcgtctccaagctgccactgtcgccgctctaggccggtgatccagctacctctacatggctaccgacgtcgccatctaggccgttggtcccgctacatcgccttatacttcatccaacatgattcatcgccagcgttgccgtatcttcctcgactacacttcgctcttctccgacaatcgtgtgctgctccggcaattctccctctacgccgttctcgcgccgcgaccgtcttggaggccttctctactagtctccttcgacattggcgtatgattcatggtggtcccctacctagcccgcgcggtattggcaacaccgttgcacgtgttcgtcccgagttgtccccgtgtctggcaaacccggcgtgacgtctcgtctttcacggttcgactacatcggctcttcggcgtcatctacctcaacgactgccgcgatcgtgtcaccgttatcgtcttccgtgtgtccttgcgcaccttcgtccacgacgccttcccgtgcgtccacgatcactctacgacgcctcatgcgctccctgcggctcggctacctcgacatcagcttcctaacttcggctacatcgaccacggctactctacgcacggcttcatcgatcacggctccctcgcatccatcgctttggctacgttgattatggcacaaagggctatcatccgtgttgagcactcttgccggtttcttctccagtccaagtgtccgcgctgctcacgcttgaactgcggggggatgttagagtatatggtaggtaggatcatattaggatatgattgatttgtgtggactccttccatatatgtaatccttccttatctcctcccccatgtactcctatatatatcggccccctgaggctcaacacaattgtgatccacgttacgcagtatctctctcatactatctaacatgtacgtgtatagcacatattctacatgcgctgtccgtgccttcgcacgcaccgcagtcgcagccctcgtgttcaccgttcacgaccccgtcgtcatcggccctacacgtccgccgcgccacaccacgctcgccggcttcgcccttccgtcactggcctccctgccgctgcggatccgcgatcgccgcgtgcgtcgggcacgccgtccattgcgttacccctccgatctctccggttgccttcagtcacggccggccccgtcttctagtcacgttccgccatcgccggtctaatcgcgagcgaggtcgtcgcctccgcaacgtcctcgttgtcgccatcgatctcatcgccacgactgacgatctcctgtagatgtgcgatccccacctcgtgtttcctcctccacatgtcttcttgatccaatgttgaaaccttcagctctgataccacttgttataaaagttagtcaatatagcggaataacgactaatcttcccgatcgcttcagtcattgatcatccaagacatgtcaaatgacgacacagtaacacacaatatttgttaacgaggttcagccgaagcctacatccccggggctctgattatggacgctccttcctaaccaatataactaatagctagctgctatgagtctatggccacgccgccaccatctccctgcgtgtctacgctacattgtagtcgccatggtgacattgtggttccccctctctacttaagagagatgttggattacagagtccgactctaactcaaccccctaacacatattataactccaagtccaactgtagctaaataggactagtatattcgacacctattctaacactattatctttaaggcagttcacagcaaggcacttacgggacgttttatatactgtctctacaactaactagcggcataacaaaagtgtctctactgtgcaaagaaaaaatctctacgaaccaattctgttgtagtggggattgttagcatgatcgaagctggaactaggatggccccgactcgacaatacaacaaaccatctctaataagatgtttggattaagccgttttattattcgtctctattttcagaatcacgattagaattaagacgtagtttgggacactttgaaattgaagcatgttgagacgttttggaacaaactgagacgtcttatggatgtttcatttctatggaagaatataatatatttttagttagaattaagacgtagtttgagacgctttgaaattgaatcgtgttgaagcttatgttgagacgtcttatggatgtctcatttctatggaagaatataatatattctttaaaaaataaaagcaacgtagtataaaaggaggaattataagatattttatagatggggtaaaagagaaaaaataacaatgcaaaaaaaacaggactcgagctctcaacctaacgcacacaacattaccagcttaaccaagtgatctagaagaggaacttgttggaaagttaagttactcaatatactgcaggtgtgtcgatttttttttgtttcctcctttttagagcaggggtctccgatcagatccgattaagagggaaccgtaggtccttttggtggcgggcaataccgcgacggcgacggaggccctgcccctcagccgccgtgcgccaacgcgcgtccgctgccattggcggcgtctccttgtctgtcgtccgcgacctctgatacttggcagttggcagcctctgcacttacgcatctggccatcgccgccggtggattcagcgtctccggccccccgcatctctactttggctcgaccctctcgtcgcgagacaccaacgcccctgccactgtgccagtctcaggccacagcacaaggcaaggattacttgtgaatgcctcaactattttctattattttatttttcgcgaacaccatcttttccattattttaattagatgataaattgttcactgttagggttagtgttagagtctttcttcgattaattatctgaagaataatctaagaaattggtttgagaaggcaccatatcggacgtcaattttcttgggaacatgccttggaggatttggctagttttccttatttctgaaggcacgttctcgtgcaagaaaacctgctgctttcactatataagatccctgcaggcaaacaacactaattcttaaaaaaaaattattaggtgaaattcagtagtttacacgtaatgttctagattaatatcatgtgtgttagtactgactgtaattcagatctgacaaacaagcgaatctcaatcatccaaatagagtaattttttaaacgaacatcacaaaaaagtgcgatgtttcaaatcgatatagcaggaaaaaattacaagactgcagtcttgaaaggctacaatcagggaaaataacagaaccactatcaaacaccagcaatacctgcacaaaccaaagacctagcaccgcatcgaccgccgctaagcaggatctgatgccgccaagcctagacatgaagccaccactgaaccgcccaccaatgcctccaactagctaaaacatgaggtcatctggaccaagcggaaaggtttgctgagagagaggaagagagataagaaggatccacttgtcccttaaacagacctgccaccgactaaaagcgtaattgaaattgtaaagttctggtatattgtaagcatgcccaatgggccaatgtgtacttcacaaatcaaaagaagattcagagcttgcctactcgatcagctcctcggctccgatagtccggactctagcttggcaaagcaggcaccgaggcatgccgcacgcagcgacctggtcgcttctatctacttggcacctccccaccggcctcctgctagtccccacccatgcgcctcctgaccgcttgtaggctccatgcaacaccactacgttgccctaggggtgataatgggatagggagcctgggccctttcataactaatctcagcccttaaaatagttttagctaaaatatctattaaatcttagaccaattgttttgggcctagccctcacattttgtaggctaaaatattggggcttattaccacccgtatgttgaccacgccgacattgctagttggagccacacttccgccggccactgccaagtctccctcgcccctcacttcgttgatgattcgtcaggcaggcaaccactttgcctcaccctcgacctcaactcctcaagctgactgatttgttgggagaaaagaaacaaaatgtgaacaagagagaggcgcttttgcaaaattactgagatggatgagtgacgtggaaaatattcctatgtggagccctttggatcaaagatgcaccgatcttgccattgaaccaatatatttaatttttaagttgttgcatcggaatgcgctcacagattaagttgttgtaccataagtgtaatttactctttaaaatatatgttatagcatgtccaaagaaaagaacctcctggggcctgggccaattactctggtggtgatgagaatataaaattcacatgagccaaaattctagcatagagaaagggccatagagcctatagaaagctcaaaaccattaccactatttatatctggttaagtagcaatgcaacaatgtttagcaccagtacatccatgcccagcatagaaatctacacttgactcaagattttgagcttgtttatttcgtggtcaaattctacgtaattttagcacattttgatattaccaatttttggaagcattgaattgtttggtttg

SEQ ID NO: 77120 - DNA, 8582 bp, Oryza sativa
ccctcctcccgggcagcttcttcggcttggcgagcccgggcggtctcctcccgagcagcttcctccgcttggcgaacccgggcggtctcccgggcggcctcttcagcttcccgaaggcgggctgcggcttcacgccggtcagactctcgcctccgctcctctgcggccgctggatcttcggcctcggactggccggatttggggtggcgggaggaatgcgacgggacatcgctgaagcagaagaaaaaaccaaaagacgaacaaaatgagtaagaaaaaacttctctttgggagaaaggtggttgcaatgagagtgagacgaacctgcgagggggtcggttgaatgaccaccttggaggagaaatcaggttcccccggcatggttccgtctcccccgtcttgcggagccgtttcttcttgcgctccccctcgggctgcgacgtcagcgcagccccctccgggcgccgactgctggcacgcgccgccccgccccctcggggaggagatgggggaggtgttcctcccagcttcctcttcccctgggcgtcggcagggcggctgctccccgagcccccggcgcggggcccagaagcacgaccccctcctggggcagattgttcccctcggcggcgctcgcccgcgccgtcgtggcccttaggggctctctcctctgaagccccgacccccatcataatggttagaatggaggcgcggtcgggatcgctgcagagggggaggatctcctgaggaatgcgagacgcctccgcggagctaagattcagcaccctttggaccacgatcttgaagtcctcgggagcccaatcccatctggctccctggtgggtccgcatgtagtctttaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggtgcccgccagctggagacctgcgccgggggctggcttggaagtcggaggcgcgcttcgttggcgaggggggtgtagaaccagtcgctcttccagtcgtcccacttcttgcgaaggacgcaggggatgtagcggttcaacaccggcccccgcggctggaagtagcagccgccaaccaccgacggcggtgacaccgactgcacggtgaagaaccaccggaacagctgaagagaggggcgcaccccgatgaacatctcgcacagatgcgcgaagatggccaatgtcatcaccgcattgggggtgaggtgcgccatctggaggtcatagaactccaggacatccatgaagaaatgagaaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggtagtacactgccgtcgagcagagcagagccccgtgccatggcggcggaggaagagatgattgagaacgagcgcgtgtggcgaaagtagggcgtagcagagaaagagttagagctcaggtggcgaaggcaagagaaacaatggcgaaaggaaggaagcaaatccttttctcgatgcttttatacccttgccatcgctgggcctgactcctcgtttctcgcgcccactacctcgctccctcgtatctcgctatctcgctccctcgtttcccgtgcccacgcttccactaatcccattcgcccgcttacggcgcattgagtggatatgcggttgtggcaatcgaaatggattgtatcgtgcgcgcgttaattacgctcgccgaccgaagcggcgttaccatatctccgggcgagacaaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcacagggtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgattacccccgagggggggtcgggttgcgcttgccccggccccgagggccgaggcaccccgacccccttaaggaagtctgcgccacatatatgggataagtgagcacagctgtgctcacctaacagcatttattgcagtctggtcaagcgtgtcacgctgcatacagcgcagtacggcgcgttcctttatccggtctgtgaccagtcacagaccggtcagatcacgggttaggtggcgactggcggtctgacgcacgccttaccccatcccgtcaaggtgtgagcttctaaacactcgtccccagctggagctagcgtgttacatcccagagatggcacgttaaccccgatcgatatataccaggcttcatcctaaccattacaggcaaggtgttacacaaggaagggcaaacatgcatgttgttaaactgacgcgtggtgaacaagaatgaccggtctggcactggtcgcgtcagcaacgggcagccacgatcccacgttgcgcctgtctccgccgggagtggaggtaggtgtgggctgtcccatcggagtgtcattcggacagcaaccataccaatctccgtccataaagagaagaaaagtccagtttggaaaggggagggtgcatgtggtatccccttgaagtataaaaggaggaccttgcccatagagagggggttcttcttttttcttttggattcttttccagatttagagctgagaacgggggagaagttggctgacacttggtagctcactcatacacaaatccacaaaaacacaggagtagggtattacgcttggcagcggcccgaacctgtatacatcgccgtgtctcgtgtgttttgcgggcagacgatctttccagatacagagggagagcgagagcttgagatttcaccctaagccccgggcggacccgaccaaggggggcgtgcccggtctcccggtaaagagccacgagctccgtcagctaccattaaatataatcatgaataataatgtagtatatatgattcatcccattaatgagctaatgtttctaagcatggctaagcaactgtaaataacatttagctgaaccaaaccaatatataagattcaagctaatcaatttattacccaaggtatcaaggaatagggcattcaatgcaaattggccataacaaaggaataggttcacaccacccggtgacatttgaaaataaatgcacagttgaaataaatagagaatttaaatataggatcaacatgctcaaaggattgtgtttaggatcagtgtgacttgccttgcaataatcggtcttcaattaatcttcgtgaatacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagagacttgaacggcctcattccgacttcatatgaattagttatgaattttacaagattaaactgattttaagatttatttttagaagggaaaagggctttatgacatcacgatgacgtcatcaccggcgggacatcacggacattacggtcaccggcgatctaggtcacggcggcgagaacagagggcaccaacgcgacgagcacgacgcggggaactcactgaggggcggcacgacgacgaacgacgacgggagacggccggcgacgagctccgaacggcggcgaagtcgggacgacgacggcggtggctttccggcgacgagcagcggcaacggaggggtggacgggcttcttctcggtgctgctatgccgagggaggtggcggcacaggtcggggacgaccgaggcgacggcacggcgcggatggaaactcgacgacgacggcggcgctagggtggaagcggctagggcgctacgggcgacggcgagctcgggcgagggtggaaaacgaaagaggagagggaggggactctatttataggcatgggagagagagatcgggcttggaacgcaaggaatcgcgccgggaaaacctagggtttggtttagagagataaacacgaatcgagctcgattccgcgttgatttcttcgggataaagtccgattcttgggggaaaagatagaggaggataagaggaatatttcccctcatctaattttgaaataacacgagagaggagaccggatttggaggggaaatcgagggcaatggcggcatcgggctctgtctccagccggctggaggttgaagatgccactgtagcgacagggacgagaagtagacttctggctgggcttctacttcttggcccgattgaaagagggacacaaagcagacttcagaaaagagagggagagggctgcagactgagaggagactgggccgagagtgagaggacttttccaaattcggcccgaaaaggaaaaggtgaatttaattacttttccaattaaattaatcactgaaatgatctttgaattgttaaaaatacttccaatgctcaaataatttcaagaaaaatcctgaaaatacttgaaaactataaatatttaaaacaattataatcagaccatttaatgattaatttaatatgtgaataattactgaaatgttgtttgtattattaaaattaaaaattgagctccgaaaaatccaagaaaattccagagagtataattaaccatggataatttaataaaaattaaatccatccatgctttatatttaggaaattttatttccaacatttaacttcacttgtaaattaatgaacatttaatataaattctaataataatttattaaataatttataaatcctgaaacgaaaatcaggatgtgacagtttgatcatctataatggctctaatcccaatatagatctgttatatatgtcaagaaatctataacggatctaaataattgacctactacaaatgacttgataacatctatatacaatttagaccttttaatgatgtcctcatctttccgcctacccatttaagtctcttgaagtctcgattcatctatctaataaacataataaagtccgtgaatccctcatcttcttcgcatcctcctctgcttccatcacattattgtcggacaccattgcctaccctacatgtaaatgacacctctcccacaactctaactagtagtggctaagccactcatcgacacgtatccaagcggttgagatggtggcaggttgcgatttgtagggcaacgatgacgatgacagtgaggcagccatattgacaaagctatggcctcaccatgttcacctggctaatcctctcctccacctcccaagctccgctcctattgcttcttccgctttccatggccaccgtgaccttggtgcacttgatccgggcaccagatccgaccgccctgatgttggggggcaccagatccagtttcccccaacattgggctggattgatttggtgatatccagtaactgttctaaggttggggccaggcaggctgggtcctggggcagggccagcagggcgaccgccctgagcccccaagagttaaggggccccatcgtcagtccatatacatatatgtagtataaactgcatgcttatttcttagtgaatttagctcaggaactcagctggtagttatcgtcaatgagctaggagaagcccacgagtcactaaattgttgtcgtttccacaactggtgttgatgccgcctcggtatacctcacattccaaaataaacacgggtgcaaatactgttgcttcactttcgcacaacagattccaatttcaagaattttaacccaattaactaaccttcaaatttgcaagataaacaccaaatatttcatccttgcatggttgaataaaacatcatggttcaattgataccaaatattagatcagtgctttcttgcttattttattttccggagttgactaatcttccttgtagctttacactaattttctaaaaaaggtaatctgccctttttctttgtttttttttattttcagtacttctcatagtacaagcaaagtcttctatatattctcctctgttctagagtttctatacaatcatcaaatctagttgttgttcctttcttagtcctaaaaatcctatattattattggcaaattatttaagtttttttcctgataatgtgttgtatttttcttgtacatccagataatattgataagcaattggattgtcatgattaatatgtaattggtgtttcatggtgattaaacattacttttggaagtgcaataaagaaactcatttaggtatataggccatccgattttatctcaccctaggcccgcgaaagttcaggaccggccctggggcgaggttcactggttcaattaacatctgagacccatacagcaggctatggcagagctgtgttcaaccaagacaccattttttttctagttattgttggaagatagattgaacagtagaaatttttgttaagaagaagacataattttgagtgacctgactaagctgtgttctcatgtactgcaagctatgaaactcttcagcatgatcatttttgcttgtccttttgctcaagacttgtggatctatatatagggacaattgcttatttgaccctattttgaagcctaactaccaatatgaccctactttttctagtttgtttatttgaccctacttttttaacacgaacgctccgtttggctctgttttttttagcactgttaagttttcattcaaaaaagaaaaaaatataattacttttcataatgactaaaataccctcgaccaaaccctatccatatatattcccttctctccctcgtatcccgtctctctctctcgccgagtgcttgcggcggcggcagcgacgggtggagggagggagcggccgtgagcggcggccgcgaggcggggagggagggatccgcgcggtgctggctcgctgagggagggagcagcgacgccggcttgtggagggagggagcgacggcggcggcctaagaggaacttcctcccgccgccctccttgtgcaacagctgccgcgcggtggtggctagatgaagaggacggtcggcggcggctcgacaaggcggaggagtggctgcggcggcggtggcatgggagggatggtggcggctcgacgaagaggaggagcggtggtggcttgacaaggaggagggtcggcggcggctcgacgaggcggaggagtggcggtggcggctcgacgatgaggaggggcgacgccgacagggtggatccggcggaggttcggcgatgaggtgacggatccggtcgcgccgaggcacgtgcacggtggatctagcggcaccgagacgcgcgcttcggtgggtcagcgaaggcggcgcggcggtagtggacttcggtggggaggcggcggttctgcagggagagagggagcaccggcggtggcggctgctccacacgaatgggcttgggagttcgtcgtcagtggtgaggtgtcgacatgttctttttttttttgtttttggtagacataaatctgtgtcacaagggtataaatggaatttttgttttgagttaacaccgtcacgttgacttcacgaaatagggccaagtctcatcttcgtttgtaaaaaagagggccaaatgatcaaactcaaaaaagcaaggctaaattagcagttagtcctcaaaatagggtccaaaacgcaattgccccatatatatatgcccaagtaggagatttgatctgtcggtgatggaagtgatggagggtctccaaacagttgtaatttttaacttatacatatatattcactataggaacttctcctacagtatttttttttctttaaaagaaggcattgttacgctacattctactactaacgagtagggtagtaaaatttaaatctaacaatagattttcttcagtataaaaaatattttattcaaaactccgctaagatatctaaattttccctttaccaaatcatctattgtaacatgctatatggcatgcaaagttatcatggcgttatatattttaacggtattgctaactttctgccgacagaaattgcatccccaaatattgcaaattttgggccaccggatgagcttcgcgattcgtgctccaggccttctccaactctatagcgacctcctcttcttctccgacgccagcaacaccctagacttcggcagagggctctactggttagggtcccggttggggtgggggctggaggggt

SEQ ID NO: 77121 - DNA, 18167 bp, Oryza sativa
gactccaggccgggccctgggggggggggggtcgacctgtcagtggcatagggccccaaagtgaagggaccaaaccccatcagttttgctatatatttgtcgacaattttcttcctaaaaatttaacagatgtaattccagtacaattgtagtgtaattacactaacttgcatgtaattacactgtaactatagtataacttgtatgtaacttttaaaaatctctccgtaatatgttatttcggtaaaatagaggtcgtgggaacaaatccttacacatatgtgtatgctgtgttttttttcttcctcaccaaaataaatcttgtaatagatctaacgattcaaaattacatgaaacttacatacaagttacactgtagttacatacaaattacagtgtaattacatacaaattacagtgtaattacattacgattgtactataattacatatatcaaatttttagaagaaaatttgtcgacaaatatataggtggtcccaaccccatatatgctgtacataatagcctatagaggaattagaaagcccacccgcccaagagaggaagagacacatccgtcgtccgtcgatttggcttccttccgcgatcgcttgttctgttcgcctcatcacctcgcctgttcgctgttctgctgccgcggtgcaccgcttccgcttccagtcgcgtcgtcttgttccgagggtttagggcgcgtcgacggggtcgtgccggcggctgcgtcgtcttgtgtttagggcgcgacggcgtcgtgctcggcagcagccggcaactggttgcaatctctccgttcagttccgggaggtacccactgctctcccatttgatgtatgctaagtttatatgtttaaattttgggatttaaattttactccccaattgctcctcttctaatttctgaaattctgattttggggtttagggatccttacgttgcagctgtgcaagtgtgcgtctagggcagtgaataccagcagtcattttaattataatgttgaattgaatttagtatgaaataatttccataattacttactaatttctaaatttacagtgaatgttagaagaaatttttaaggtaagatatataacttaaatgtttttttatgcattacatttatcagaaacatcgttatattattatagttgtattaaagggcccatttttctagctttgcttcaggccactaaattgaaaggaccgggcctggccgactcgagcaacccgtacacaatcatttcccatcccacgccgcgggcggcagcagcggctgcgacggcgacggcggcggcgggcggtggcggcagcagcgacgacggccacgaagatggagggatccggaagctcgagtggatctagccttcatcagtcccagcaagcttcctccatcccgaggttgagatgtgcttgccaaaaacgtgcggtgaatagggtttgcaaaatgtcagcacaatatagcccacacaggcagaatgtaaacacatttaatatttttttttttgcaaattgtaagcacaatgtagcctcacagtcatgatgcaatcacatttgggcacaacatatgaaaagatttgcatttaacaaacataatggttctggatagccatacagccagcttgttctgatagcaagcatatttatgaagtcatagcttcattacagccagcttgttctgataacaagagcctcaaaatgatataactaggcacaatgcagtcttcatcaacttcatcaacttaagatagcagcaaaatgagcattcatgtgccattacagccactacttgtactgtcacttccatctagctacacaaaatagacatcctgaaacacgtagtcgccgtggccgtggccgtggccctcgtcgtcgccgccgccgccgtcgccgtggctgtggccgtcgccgttgctgccgccgccacagctagggttagggtttcaacgaggaagagagaaatggactgctgcatcagctcacggttggtataccgtatatccactcacacaagggcatttaggtcaatatgagaaacggttgcatttctcgtcaccatattcaaattaagcccgccgatattgtagcgcgtggtctgcatgcacattaaagaaataatcaagttgtttaatgtaatttgttacacagccaatgcaagtaagttcaaaatacagagatcaaggccagcatattgttgcagagacaccaacattttcacgtagttgcagtgctcggctagtcgtcgtcgtcgtcgatggcgaggccgcacgccgtggtggtgccctaccctggctccggcaacatcaacccggcgctgcagctcgccaagctgctccacggccatggcatctacatcaccttcgtcaacaccgagcacaaccaccgccgcgcgctcgccgccgagggcgccgccgccgtgcgcggccgcgacgggttccagttcgagacgatcccggacggcctgctcgacgcggaccgcgacgccgccgactacgacctcggcctgtccgtggccaccagccaccggtgcgccgcgccgctgcgggacctcgtggcgcggctgaacggcgccgccgccggatcagcggacggcggcggcggcgctccgccggtgacgtgcatggtgctcacggcgctgatgagcttcgcgctggacgtggcgcgggggctgggcttgccgacgatggtgctgtggggcggcagcgcggcgtcgctgatggcgcacatgaggatccgggagctccgggagagaggctacatccccctcaaaggtgagtattaaccaagcatttgatcgataattaagctaattaatcgaggatatctaatacaccccgtttcatcagcgttgacaatttcgaaattggattttatgccggggaccaaaattacagaaatttcggaaatttctggccgaaattatttaaaattttgaatgaatttgaataaaattggatcaaattcacaaaaatttgcaaaaaaaaaccccggaaatttcatgtgagatttgagcatgccgatgggggagaaattaccgaaatttcaaaccctgcgttttatatagcctccacacgtgtgcctcaaataagtacatcgctgaccatgagagaggtagattaatattgctatagtaaaatgaactcttggtgcctctaaaatttgtttttccactggctttggaaatggaccactagttattaagctagaaatgcactcctcgtaataaaacttttaaatgctagtgtgcttattctggggcatacgaagagagtagttgttgtttcatgtttatttttccccattatatttatatgtctagatctaccactctaaacccacgggtgatatgggtttgtgctaaattaaacagttcattttgttttgtaccatttttagttaactatatttcactatgtgcttaatactttctttttgatcgatatttgcaaaaatgtgaggttaatcatgaatcaatttcctcccatatctaaatacctcaaactagctgaaaatcaccccctccccagcaattttgtgctggtgtggaccttggcgggaggcaacacgtcacccacgctgcattccggtgggattttgtgagctcgtgtttgttcgcatcaacgcaattacgagacgagagagtacattaattaatatgcagtgcacatctggaacagaaaaaaaaaatgtaacgcaataacccatgcactgcacatgatgattatcatatcgcggttgcctacataaactaagatttgcatctcttcctcgcagcttcgcttcttgagattggagacaatgccagttgttttttatttacaggacttacatttggtgctctacagtggtctctaatatacaattcctaaggcaataactaaaacaacggcctccagtatatataaactacgttgcaaatattgcaatggtaactaaaattaattctggatcgacataaaagaaaacattgatagcacatccaacaaaattattattaactagttttgtcaaaacattgatagctagtggaagtgatcaattcttcaggcttctgctgaagcctgaagaaaccatgtcagttgagaaatcagtacagtacaatcaagctagtgatcaatttattttcatgaataataatggcttaaaaaacgacaaataacggctagtagctgggctatgagccaggaaaaaaactcatcagctggacttggttgaggcagggtttggaatttcgttttcaacaaaaatttttgtagaaccgaattttcagaatttttggtatttttggaccgaatttttctgaaagtttgacaaaatttaactgaatttgacataattttgaccaaattcacaaaaattgagaaaaaccaaaaattttggcccagatattttgaggtggaattaatggacaaattaaatgggctgcaaataaaaaaaaaagaagtaaattagaaggaaaaaaaatcaagaatcccaattttgagtgggaaattgtagcttcaataacacgatttttattaatttgatcattgctctcagactagctataatccgggatcaaacatgatttttttttcctttttagtacaagccacgtaaatgccttaggggccttgttgccgaatgccgacaacttgcccattagatcacatcactacctgagcttctttcgtcaagatcaagtcctaaactactcctaatctccgagctctgtgtagcgtgtatcttcctcaccaaatcacttccccaacgcacgcaacacgcgaggtattttctatctattatcataatgtagcggatgatgaaaattaatggagtatttcttatctcaatacttatgttattattatcaattaaccccatatcattgggattgggaggcatatgcgccatggataccatcaccaatctatctataaaaccaaggtggtcgtcgtctccaaatgcagacgacgccattgcagaattgcacacacacgaacatcacgtagttgttgatggcgagaccgcacgccgtggtggtgccctaccctggctccggcaacatcaacccggcgctgcagctcgccaagctgctccacggccatggcgtctacatcaccttcgtcaacaccgagcacaaccaccgccggatcgtggccgccgagggcgccggcgccgtgcgcggccgcgacgggttccggttcgaggcgatcccggacggcatggctgacgccgaccacgacatcgggaactacgacctcgcgctgtccgcggcgacgagcaaccggtgcgcagcgccgctgcgggagctcttggcgcggctcgacgacggtggcgccggcgcgccaccggtgacgtgcgtggtggtcacggcgctgatgagcttcgcgctgtacgtggcgcgggagctcggcttgccaaccatggtgctctggggctctagcgcggccgcactagtgacacagatgagaacccgagagctacgggagagaggctacatcccactcaaaggtaacgaaattaaagatgatagggaccggactgtctaggtatcattttaaaaagaaaaaaaatagtttactctccaaactatttcgctatgatattactccctccgtcccataatataagggattttaagtttttacttatactgtttgaccactcgtcttattcaaaaaaatttgtgcaaatataaaaaacgaaaaattgtgcttaaagtactttggataataaagtaagtcacaaaataatataataattccaaaattttttgaataagacgagtggtcaaacagtgcaaacaaaaactcaaaatcccttatatcatgagacggagggagtacttacataacactaaactagcttggtccgcacattttacacggctagctgccaatgttccttattttctattccaaattttctttttttctaaattgtatttttattgaaactcttatttcaatatttcttattttttaattttataaaattcagttataaacggtatttctatatacactcaaacgtctacttctattttcttttttttaatttcgaattttaggtagttctaaattatatactgatatggattctattttttttcaatattctattttttaatttcgaattttagctatttaaaattgtatttctatatggagtttattatttctttttctctaattccatattttagttagttataaattgtataccagtatgaacgccttctcttccaatatttattatttctaattgcaaattcaactattttaatttttttctatatggacttcgattaatatgagaattcgtagctcatgagagcgaacgtgacttcgattaatatgagaatttgtagcacatgagaacgaatgagaacgaacgtggagtctaattttcctattacttaaataagttaatggattagttcttaatccaattacacttgctctgcattggttaaattagaaataaactttgtgcatgtggtttgtttggtcgtttccatctcaaacttttttacttcgattcctataccttactttaagcttccgtaaaaaataattctattagttatataactattatattaaatctaaactattataatctggatctactatgacgcaatgcttatttttttctctttttcttgattaacattggaatttctatttttcttgtatgttttcactttttttctatctttcttatctgtttccgtttttttttgtctgtttccaattttttttgtccgtttccattttttatcccgtttacactacacctaatctaataccattctctttttttttgtccatttacacaaaacctaatcctagtacccttctatttttattttttttcttattttctttcgattaacgtgggattttctagaccgtgagagtcaacgtggaggctttttttattactttattaagttaatagattggtgtcggttggaaactcgacataaacactggatttcccacttagcaccccaatgacaatggtgaggaaaatcaaatgttccagaaataataataaaaaaaccagcttgatgcataggttgatcgagccgatgcttggagccaagaattaggtacagaaattgaatcacaaaatcatcacaattccaactatacaatcaccttgaaaaactacacacatgacattcataaaaaaaactaaatcacaaaacaatgcatggctccattacctcatctcatcggagaccaaggcggccatcgccaccgttgctactcaacaaaggctaaggactccgctgtcgttcaccgctactgctcaaatccaaaagaccacgatcaaatctagggatggtaggagagatctggaaggatggggaatgaggaggagaggtaccttttagtcatgcagaccgcgcgcggcactgttgctcgtgcgcgtggaatctggcccccctaagctcgtggtggccagatctggtagccctacccccaagctcgtggggaggtagggccgaggggagggtgtcaccgcaatagggaggaatccgccgctgtgccaccattgggagggcttgccgccatgccgatgaagagggagctgttgccgaggggagggcatcatggccgatggaccacctgccgaggggatggtgtgctaccgaccgctgcttgactcaagaggagacatagaagtagaggaacaaggagaagagagaaaggttaggacagattggcacactaggaaatggatgagtgaggaaaaacaaggagatgggctggagaaaaaggataagtacgggtggaggaccgaggcggcttggatcagctggtctgatgtattatttgtgtcgtttttttttaaaaaaaactggcactagtaatattactacatgcgtcgatttttaatgaaaacaagcacaaattacgtggcgactttttatgtgcctatttcattaagaaccgacacttatatatgctgctttttatttttagcctttcctaagatttcgatttcgagtttcccttattaggggttctatacgcgtgctagatatcttaatctcgtaaagtattttttttactcatttcaccctctaagtgcttcactctatctcttaataacattttaccttttggttcctctttatataagttgtattctaagctaagacattttggaaccataaatgacaccattattagagttgacaaatattttcaaaaaaatttcatgaaagtttgcttgaactttcaatcctcgatattttccaaccatgcgaggtgtgattaaaaaaaatcaaaaaatatattggtatgtaaagtcgtatcacatatatcatcataccaaaattaaagtgtaaaatataactaatataaataatagaaaacataaatattgttagaaagtagagtgaaccgttttcaataattcacagtataaaatgagcagaaaagaagtgtgtggggggagtaaaatgggtttatatgggccaaaatccagccggtccacgtgtgccggttttttactggaataagtccactttgactttcttaaaagtgatccaagtctaatccgtaaccctcaaccgcatagccggataagacaactccccaaactattgaaaccagtgcaatttgactctctcagcagttttggagggtggttttgctgatgtggcgctgacatggtgatgttgacctagttttcgtcccacgtggcgcttacgtgacatgagaattaaaaaaaaaatatgtgggacccataagtaattcacactaaaaaatattgtggtccccactgacatgtggggcccacatgtcatcctccctctctcttcttctacttcctccctccctctctctcccttctctctttctctcacgtggcgcaatcggcaggcaggggcagcgacggcgacagcgggcgagagccggagcggcatcgggcaagcagagacgtcagcgagcggcggagacatggtcatggcgcggaagcccgcgagcggcggagatgcaggagtggcacgacgttgtggacgatgatggcggtgctcagcctctcgctggtgacagggcacgtgtggcaccccgcctcgatctccgccgtcacggccaccgctccggctcgccaccgaatcgcgccaccgctgcctccgtcgccccttgcgcgcccacctcgtccccttagcgctcgcccactacccagccctctcccgcctcggtctctccctctgcccacgccgtccatctccgccgtctacctctcccgctctcggggattcactgccgctgcacccgtcgccgcatgcctgaactcaatggcctcgacctcggggatgcggcggtggcggaggtggccaaggcacgccgcctgcagaggctctcgcggttgccgcacgccgccggagccgccgcttgacccgcctccgcactcctccacctcaccccttcccacccacgccaccggggtcgccgcacgccactggagctgccgctcaacccgctcgagttcctctcttgctcatggagcgcctccgccgtcgacgtccctcacctgccgctgccatcgcggggttccatgatgcccccgccctcggcctcggcgacgctcgctgccaaccggctccaaatcaacatgggaagagaaagggggtgagagaagggggagagggggagcaagaagagagaaagagagagaatgacatgtgggtcccacatgttagtggggccacaacatttttttatgtgaatgacaaatgggtcccaccgatatttattttaattgtaatgccacgtaagcgccacggtgggacggatacaggtcaacaccgtcacatcagcgccacgtcagcaaaaccgccctccaaaaccgttgaggaagtcaaattgcactggttttaatagtttagggagtctttctatctggttttgcggttgagggtcttttaagggagtcaaagtggacttattccttttttaccagtgaatgggccgacaccaaggcccaactgaatcacgcatttttttccatttcgcagatgagagcttgctgacaaatggccacctcgacacgaccatcatcgactggatccccggcatgccgccgatcagcctcggcgacatctccagcttcgtccgcaccaccgacgccgacgacttcggcctccgcttcaacgaggacgaggccaacaactgcaccatggccggcgcccttgtcctcaacaccttcgacggcctcgaggccgacgtcctcgccgccctccgcgccgagtacccgcgcatcttcaccgtcgggcccctcggaaatctcctcctcaacgccgccgccgacgatgtcgccgggctgagcctgtggaagcaggacaccgagtgcctcgcgtggctggacgcgcaggagatgggcgccgtcgtgtacgtcaacttcggcagcctcaccgtgctgacgccgcagcagctcgccgagttcgcgtggggcctcgccgcgacgggccgcccattcctgtgggtcatcagggagaacctcgtcgtccccggcgacggcggcggcgacgcgctgctgccgacggggttcgcggcggcgacggaggggcggcggtgcgtggcgacgtggtgcccgcaggatcgcgtgctgcgccaccgcgccgtggggtgcttcgtgacgcacagcgggtggaactcgacgtgcgagggcgtcgccgccggcgtgccgatggtgtgctggccggtgttcgccgaccagtacaccaactgcaagtacgcctgcgaggcgtggggcgtcggcgtgcggctcgacgccgaggtgaggcgggagcaggtcgccggccacgtcgagctggcgatggagtcggaggagatgcggcgcgccgcggcgaggtggaaggcccaggcggaggcggcggcgcgccgcggcgggtcgtcgtacgagaacctgcagagcatggtggaagtgatcaattctttcagctctaaagcctgaagcctgaagcctgaagaaaccatgtcagttgagaaatcagtagtacatcaagcaagtgatcaatttattttcatgaataataatggctagaagccgctgggttattagccaggaaaaagactcatcagctggacttggttgaggtggaaataatggacaaattaaatgggctgcaaacaagaaagaattaaattagaaaggaaaaaaaatcaagaatcccaattttgagtgggaaattgaagattcaatctgttaacatgatttttatttgatcattgctctgagactataatctgagatcaaacacgatttttttagtacgtcaaccacaagtacacctacgagtcgtgggacatcggccactcggcctccagcttggtgaggaggtgagaagagagcaggtcaccacacaagttgcaggtgatggagctccaactatagatggccaaatagaccgtctggcatggctctgctagggcacaaccaaggcacggcccgaccaactcgttgtgccctgccgtgtctgtccacaggctgtacctatggcctaggctcggactgtgccgtgccggcttgaaggcatgactagtccaccgtgcttgtccttcaataagtctaatttgtctccctcatctctttgggctgtacattatatggtggtaataagtctattttacctccctcatctctatggctaggtagatttagatgcagaatctctttggctaggtagatttagatgcagaaactagggattgcaatgtatctttcttatctttaaaaaaaaagaagcaggtaatggagtcggaggagatgcggtgggacgcggtgaggtggaaggctaattaaggcggaggaggcggcacgcgtacaccccggcggatcatcttacaagaaccttcagaccatggtggaacactggaagtcatccgttcttttcgcctccgattccaataagcctgaagcatgaagagtattgttcagaaacaaatgtattcaagcaagtgatcgcgcaacttctgtgtcatgaatataatggcatcaaatcctcacgaaaaaaaaatcatgttgctgaagaagttgttcgtaatgtacttactattaatgaataagagacgggaaaccgttttagaccccctcatttatctaaaaacgattcaaatagttataaaaaaagtaaagaaaaaaaataattggactgattttctcccctttcatgcgagtactactgttctggttcttttgagtgcaactagctagcattacttatttgcaacgtttttgccatggatgatggccagttaaagattgtacagttctcattacgtgagcaaatttcttgtgctgtttgcaaaacgtttgttatttatataaatgtgatttgaagaaaaatcatcagaatccattgtcgtctagtccggttaggatacctggctttcacccaggcgacccgggttcaaatcccggcaatggaacattttctttttctgttacaccgaactcttaccttctttttctgcaccaaatctgcgtgatgtgtttgttacagatttgcagatttccttgttctgttctttggcgtttgttacagacttgcagatttcctttttctgttcttttacaccgaactcttacttctgaaccaaatctgctttgatgtagacttcacggaacaatggcgtttgttgcagacttgcagtcaaatcgttgtagccttcatctcgaaagagggtgcacgtgactgtgttcccggtgaccatcgtcaccggcgcgccgctgccgatggaatattggaatggccacactgaaatctgtgtccaattctccgagagctgtggggttcagagaggaattctccgacatgccacaacctgcctcagactgcattcgagagcagcagacagagagagagagagagagaagagtcgtttttggcgcgtatcttttcttttttttttctttttttttagaattacacagtataacgcagacactcacaacgcacgcgcactcacccctataaacacacgcacgtaaaccctacctctatgagcatcttcaaagactgggccggcaaatcttggagagattaacgaaatcaccacaggtgcctcgctgtcgacgagtacgtcgcctaccactgaaagcacaacgtcgttaaatcctggaaaaattctgaattactaaaatgtgtgtttttaaaagattcatatgaaaagttaattgaaaaaatatagtgatatatttttttaagtgtaaaataattaatacttaattaattatacactaatacctcacattgttttatgtatgttctcaattctcttctctattggatatcgaggtcaagtcggtagatttcgaggtctatccatgtcaggttccctccgttgcaagatgcaacgatgatcgaaatcacacggctaaaatttgtttttttgtttaaattcgagttaaaatgggtgccgacaattaactcatttacttcatccttaatggttatcataagtttgtaagttagctagcgctcaacagatttatcctcttatatattttttttaacatgacaagagagacaatgcagatctagttagccaaaaagctcatacaaacaaaggcaccaagaaattcgagcaaagcagatagtaaattatagtttgggtcaccttttatcagcaatgtttaactttgaccatcctttcgtttggattgtataaccttaccattttttttttggttagaactactcaactctctttattattcatgtacttcaatttcgtgaaaatctgtcctgcatatagatggaaaagttcacatgcgtaccaaaaccgatttgattgagattattaatgagtgctgaagaagttgattgggtggtccaagccaaaaaaaaatttataaagttacctgatccaaaataaaaagattattttaaaggagatccaaagtgaaacttggataataaaatatgacctaaaatgaaattcatacacacactacactgccttgaaatcgtttcagagtttcaggattttcatggtcaggtcttctccagcgtcgtcacggcgtggctgccgaagcccagggcatacgacggcaatagtgtggagattatggataccccatatctacatgacagttataatttagtcagatatacggtaccaaatataaatagaatatctttatgaggactcgggttagttttgaacttgtatgtcaaggaaatacccgagatcttagtcggttacgattgtattttatctgtaattacatattccgttagggatatggactgtactttgtaaagcggaccctttcccctatataaggagggtccgtgtgcctctcggggcacgattcttttttccagtttatacgatcaataacacactcggcggaataatccccggacaggagtagggtattacttcttgaataagaaggcctgaacctgtataaaattcttcgtctccaaacccatccactttcctagcttgatagccacccccttttattattgccgaaatcttgtttcgacagttggcgcgccaggtaggggtagcgtcaagtttttgccgactaagtgcgatgggttctgtctccggcatcgacgacttcgccttccctcccgggcaggcgttccggttcggcagcctcaacttcatcaccaacgacttcggcaagatctctctccttaacttggattcgaaccagtcaggaagagatcaggtccccgtgccgttcggcattccgaactcggccgaggcctactccaagatcatctctcctgagtcggcttcaaaccactcggacgagatccaatctactcctccgcgaccagatcaagacgacgggtcctatccctcaatcctgatgaaacttcctgatgatttggccgctatcttcacagccaagacatctcccactcgaagatcttggcgagctccggcttcggccccgatccaatctagatccagggaggttggcgttatactccaacctcttgggacagtcttgacggaagagttggatggctacctcagctcccccggcgtcagttctcgaccaaccgagatcctcgactacgacgacttcggctaccactatgaccacggcgaccacgacaacttcgacgacagctatgaggataactacacgcccctcttcttcggcgtattcatggctgacaacgaaacggaggaacagcgccgagcccaagaagcggaccaagatcgcgcacggcaagaagctgaacgtcgccgactggaggaagagcgatagcgacaggagcaagaacgactacagcgtgagcaacaagatcgcgaacggattgcaaaggaggctgaagatcgatggcaacacgccttggaatctgggcggtgagcgagagagctcattgggcaacaagacgtcaatggaacagtggtctttcgcaccccctagcagaacgcggttgcagcaatcactctcctcgacaccctcctcaaggaagacgcactcaaccaagctgatcatgttgtcaacatcttgaaccagacgaagaccatgatcgctgcctcggttccagccaactccgcaagcacccgcaccccgactggtagccgagtccctcatcttcgatctcaagactatcaccagccaagcctcagcattgccggtgccggatctagtcgcaggagcaggggacatgatgaacggtctgttcgttcgcctcccgaacgatatagggagcgtcgagttgaacgaccacactccccacatcgaaggcgccccatcgatcttcgcgacaccatcaaccagcgccgcgcagcaagaggctatcattcaccggatcgctacgacgacgatgtggacggagttgctgccttcacaagcgatctgcgtcgagtggattgcccagccggctttaagccgactggaatcgagaaatatgacggcaccaccaaccctgagtcttggctcaccgtctatggtctcgcaatccgcgcagcaggaggagacagcaaagccatggcgaattatctacctgtggccctagcggattctgcccggtcatgactccacgggctaccccgcagcacgatcggatcatgggcagagctacgcgaccacttcatcgccaacttccaaggcacttttgaacggcctggtacacacttcgatctctacaacatcattcagaagtctggagagtctcttcgagattacattcgacgcttctctgagcaacgcaacaagatctccgacataaccaacgacgtcatcattgccgcctttactaaaggcattcgccacgaggacctagtcggtaagttcggacgcaaacctcccaagacggtcaagcagatgtttgaaaaagccaatgagtatgccaaagccgaagatgctatcacggcgtccaagcagtcaggcaccacttggaagtcaaagaaggatgcgccgacagcataccatgctatactaggacgaccggctctagccaaattcatggccgtcccacactacacctacatgatgatgaagatgcctggtcctcgaggggtcatatcactacggagcgacatcaagcaagccgtcacatgtgacaaagaaagttgcgagatggcccaaacccacgagatcactctcgctcgtgaagagatccgactggctgccaccacggcaagcgaaggagaggtgcctgcgaccaagctgtcaaagatcgaaaaaggcgacgacaaaactaagaagatttcactagatccctctgatcctaccaaaactgctgtaataggcaccgagttagattgtaaataggaaagcacgctcatcacctttcttcaaaataataaagatatctttgcatggaaaccattcgatatgccaggtattcctagagaggtgattgagcactctttacatgtcaaggaagacgccaaacccatcaagcaacgactccgccgttttgcacaggacaggaaggatgcgatcaaggaggaattaaccaagctattagcagcgggcttcatcaaggaggtccttcatcccgactggatggctaacccagtcctggttcggaaaaagacggggcaatggcacatgtgtgtcgattacaccgacctcaacaagtcttgccctaaagacccttttgggttacctcgcattgaccaggtggttgactcaactgccggctgcgagttactcagtttcttggactgttactcgggatatcatcagatctgactaagagaatccgactgcttgaagacctcgtttattacgccctttggggcctactgctacatcaccatgctctttggattgaagaacgcaggagcaacctatcaacgcatgattcaaagatgtttttcaactcagatcggttgcaatgttgaagcttatgttgatgatgtagtcgtcaagaccaagtagaaggatgacctgatcgcggatttagaagaaacttttgcaagcattcatgctttcaggatgaaactaaaccctgaaaagtgcatcttcggagtaccgtcagggaagttgctcggatttatggtatctcaaagaggcatacaggccaacccggagaaaatcaacgccatcctcaacatgaaaccgccaagctcctaaaaagacgtccaaaagctgactggttgcatggcggcgctcagccggttcgtctcacgacttggcgagctggggatgccctttttcaagctgctgaagaagactgacaatttctagtggggacccaaagcataaaaagcctttgaagacttcaagaaacttatcaccactccaccagttttggcctcaccacatccgcaagagccgctactgttatatgtgtcggcgacctcgcaggttgtgagcacggttctagttgtcaagcgtgaagaggaaggccatgttcaaaaagtccaacaaccaatttatttcgttagcgaggttttagccgactccaagacaagatagatatcctcaggttcaaaagttattatatggtgtcttaattaccgtcaggaaattatctcactactttcaaagtcactcggtcacggtggtcacatcgtttccactcggggatatacttcataaccgcgaagcaaacggacggattgcgaagtgggccttagaattgatgtctttggacatatcgttcaagccacgaacttcgatcaagtcacaagctttagctgatttccttgc

SEQ ID NO: 77122 - DNA, 696 bp, Oryza sativa
ttcagactttcaatacgggttccaaagaccttccgctcatcccaaatatctatctgtaattttaaaaataaagttttttttttactttttgggctatggccttgtgatagagaaaatgaagtaaatagacttttccaatgtaacggaattaagaataacttactaatcttccaactactttctttccatcttctcccccattgacataaaagtctttcaataatccaggaagaaccctccaaaattcattcacaaactcccctcccttgcgtttactattttgcaggatatcatttgacaggtacaggaatgatactttcttatccttatttgcactgttatactgcttctcccatgtatcaacaacctttctggctctctttcggtgaaaaatgcaccaatttgaaagtgctgcttaagaattaaggaataaaaaaggcatgctattgtaatctagatgctattgttaaaaatatgctgtgggaatttggtatcatgactgtgtaaatgatttttacggcattgacatcaaacacaggaaagcaagtggtaagactcgttcagaagatattacatagggattcgagttgctaatatgtaagcaaacggacatgacacaaccatcacataatcccccaccccctttgtagcgtgaatttatggatgcaaatggataaatgctatatatatccttct

SEQ ID NO: 77123 - DNA, 660 bp, Oryza sativa
tcgctgatatgttggtctcacttatcgcatcatctaaaattggacactatatatactatcctaagaccttaagtatattggttttgtaggttgagtgacgcgctatttctggtattgcgtatgaagggcgtaaattcaaactcggcgtcgagatgtgggccgagccgcacagttttgtgggccttgcgctaactaaattgtctgtgggctgctgggcctcttcttcgtgttgactgtgatccgagtatctgacgtgtgtccgttgcatgtgtcgtatgtgtacgtatggtgccacctggtgtagtagcggcgtttcggtgttttgcatcgtaactccatcgatcgtcgtgttgtggttgatcgatggcgatgagggatgaatcacgtcttcacgtgatcgttgtacgtatctgctggatatgtactacttttatattttaatatatgacaccgttaattttttattaacgttagactatttgtcttcttaaaaaaattatataactatcatttattttattatgacttgacttatcatcaaataatctttaagcatgatataaatatttttatatttacgtgaaaattttgaataaaaaaattatcaaatattatttaaaaattcaggcgtcatatatttagcgagtatattattcaatt

SEQ ID NO: 77124 - DNA, 6429 bp, Oryza sativa
ccattaaatccacctccgctcggaccagcattgagaccaaagccacccctccacccatgacctccagcagaattattccatctagtagtactttttgtaaaagacgtataatactccttcgtccttccctgtagaaatatgataatttttttggaagtaactttacaatttgcatatcattttgttatttacaaatatattacatcagtcctaaatatttactccctccgttttaggttataagacgttttgactttggtcaaagtcaaactgtttcaagtttgactaagtttataaacaaatatagtaatatttataatactaaattagtttcatcaaataaaaaattgaatatattttcataataaatttgtcttgggttgaaaatatttctacttttttctacaaacttagtcaagcttaaagcaatttgactttgaccaaaatcaaaacgtcttatgacctgaaacggagggagtacctgcttacctaaattgaggagttttattttccttcaatacgccttatgacacccaccaaagaaaatagcataaaaaatatatgcaaaatttaagacttaccatagataatactatatctaggggtggatagcgagccagctcggctcggtcaagctcgttaagataggagctggctcggctcggctcgttatcgtaacgagctagaaacccagcttggcttggctcatttgaaagctcgaggtagctcgttaggcttgcgaaccaaaccatccaggcggccaggcctctcctcttctcagcggggcgcggcgcaactaggggtaaggggtggatgcggcatgcgggcggcgcggcggcctccttcgtcagggactctagcacggtggcagcgagctcggcttcgacgtgccgccgcacgtcgccgacggggcacacgctccacccggccgccatctgtatgcgacgatgaggccgtgctggaggagctcgtcggcgggctggcgatcggcggcgaaggaggaggaggaggaggaggagctcgtccatgggctggcggctggcggctacagcacgcggcgctggcggcggcgcacgccggtgtgaaaggggattggcggcgcatgatgcgggcatgcggcgcaggaatggcaggatgcgggagacagggaaatcggggagagtgggagaccgagggtagtctctagggttttcctttcagttgggcttgggccgttgagtaacttgtgttgtctcattgtttgttgggcttgggccttagagtgctggctcgttaaggctcacgagctagctcgagctcattatctctaacgagctttaaagccagctcagctcgttacgaaatttaaacgagccaagacgagcgagctaacgagccacgagcttcctgcccacccctaactatatcatataaacataaaaatatgatgatacaagagagtgtaatttgtatatttattcatttctattcagtcttttgagtattgagcggataaatcataagcagtgataaaatcattcgagctaaaagtctacataaatagacaaataattagaaaaaaaaactaaatatagccaaaatgagcaacagattaaactgcaagtatcactaatattttagaaatttcaaatttaaattttagccacataatgatttgaacaatggacacgattattagaaaccttttcttctagataataagataatggatcattagatagcaagatattacactcctccatcccataatataaagtgcgcacatatttttagattcaacttttaaaacatttgtttagtaattagtataatatgaattgaattttatttgttgaaaataatatcattggatttgacatttgaatttactttcatataattataattttgtttctataaaattatatgagaaattataagtcaaatattatttttgaacatcatgccagtcttagccatctaatttatgtgtcttttatattgctacaatagcaagtcaaattggttaccaacatgtttattttatgaaaccaggttatgtctcatgtgtcaaaatggttatgttttttgcaagtcgaacaatattactatgttagtagatctgggttctatgaaatgtactcttttaattaagaagtatctaatataggttacatgcttaacccctcctttgcttataagggaatcctcaatgtagccaagattggtctaaatggtgagtcgaaagtttcaaaattgagttaaaagttctcatttgtttagaaattttactcaaaattttcagttttgaaatgacactttacgttaagaaattctctcacgaaattttactttttttttgcggggatacaaaagtttacttgaatttaagaattcaaaaaaaaactcggaattatctattgcgcgtcaggcgcagccgtgtcgcgtcggcggcgcacggcagacggccgggcagaagcggcgctaattagatctcgcgcttatagaaactacaagtctacaatcgaaccttggtatactctcctaccaatcaaaattaacctgatatcctgttttgccaaatctttactgctactcaagcttagattcactgcggttttgcttcaggcaagttgatgcacacagcattttctcagcctttcagatacgtacgcttcacccacaagctagcataccaaccgttcatgatttgacggcgccgccgtagcgacgcatgcatgcaggtccgttttgccctataaataggcagcctctgcactgatccagtgcactcaccaccactgcactgcaacacagcaagcaagctcacttcttgcattcttagctcatcgattcttagccccttttctactatggcttgcactagggaggttgctttcggcgtgaacctgatcggcaacaacggcgccgcaccggcggacgaggccagcagcctcgccggctgggcgccggtcggctcgcgcaccacgctgtccgctcacgtcgagaaggacgacccgccggcggccatgctcccggctgtggacgacggcgggcgcgagcaccggccgagcggctctcggtacgtcctcgcggcgcgccgtgacggcgaggaggacgggctgcggcacccggtcccggccggcgcgctcgtgccccgggtgacgtaccgtgtcgccgggtgggtcgccgtgcagagcggtggcggcgaacacgccggcggggagagccacgtggtgcgtgtcagcctccacgtggacgatggcggcgagtgccgcgttctcggctgcggcgcggtgtgcgccggagtggccggcggctgggtggagatcaacggcgcgttccgccttaaggcgaccccgcgcggcgcgacggcggtgcacgtccacggcgcgccagccggcgtcgacgtgaagctcatggacctccgtgtgttcgccgccgaccgcaaggcgcggttcaggcatctcaaggagaagaccgacaaggtaagacaacatctctcactctgaatgatcacattaactaacaatatagtaccatgcatgttgatcgggaccatgtcatattcacatcggatttggccatttcaggttcgcaagcgtgacgtcgtcctcaagttcagcggcggagccggagtggaggcgacggcgagcatccccggcgcggccgtccgcgtggtgcagatggacaacgtcttcccgctcggcacctgcatcaacggctcggtgatccaggaccccaacttcgtggacttcttcaccaacaacttcgactgggccgtcttcgagaacgagctcaagtggtactggacggaggcgcagcgcggcctgctcaactaccgcgacgccgacgcgctgctcgacttctgcgaccgccacggcaagccggcgcgcggccactgcatcttctgggcggtcgacggctccgtgcagcagtggatcaaggacctcggccgcgacgacctcgcgtcggcggtgcgcggccgcctcaccggcctcctgtcccgctacgccggccgcttcccgcactacgacgtcaacaacgagatgctgcacggccgcttctaccgcgaccgcctcggcgacgacgccgccgcgctcatgttccgcgaggccgcgcgcctggacccggccgcgcggctcttcgtcaacgactacaacgtcgagtgcgccaacgaccccaacgcgacgcccgagaagtacatcgagctgatcgacgcgctccgccgcggcggcgcggcggtgggcggcgtcggcatccagggccacgtctccaacccgtccggcgaggtcatctgcggcgcgctcgacaagctcgccgcgtcgacggggctccccatctggatcaccgagctggacgtgagcgagcccgacgtgtccctccgcgccgacgacctggaggtggtgctccgcgaggcgtacgcgcacccggccgtcgccggcgtcgtgctctggggtttcatgcagggccgcatgtggcgccaggacgcgtccctcgtcgacgccgacggcaccgtcaacgaggccggccagaggctggtcaatctccggcgggagtggacgtccgacgcgcgcgggaccatcgacggcgacggccatttcacgttcaggggctaccatggcacgtacgtcgtgcaggtgacgacggcgacggggaagatactcaagacgttcaccgtcgacaaaggggacacctcgctcgtgctggatatggaaatttaacgactacgccggtttatcttatatttgcattgattcatgcataatcatatatcgaatgagtggagggcacgtgggacaaaagaattctgctagagaacagagtatgttctgtccctaactccctatgttttacataatttggtaatgggtattgtatggttgtactattgtaagacaaatgtaaggtattgcatttgctaagatttaatgcatatgaataatgtaaacgagttatttccctaacaaaaaaaaaaggtaaacgagtaattcctcgttttatgcaacttatgtgccagccgtgcattgtaacggcttcttagtagggaggataattcatatcagcggtgatcccttataattgtagcacaacaatatctataactaagttattatataccgtgtattagaaaatttacaatataaatattggaacgtacaatgtagttaacatgtaagtgtaggtaatttacagtgttaaaatgatttgaagtgaatttcacaaaactatagatattttggccaaactattgtaaaactatatatttaaaacgttctatcacaaaactatagatttagggcctgttcggctgcatttctttttactatgctgtagcctacctaaacaataatatgtgtgtgtggctgcagtagaaagccagaaacaactgcattgtagtgcagccgaacaaagccttagtgggaaatttattataaaactatagatttaatattaagtatcacaaaattacagattttatattaaagttatcagaaaactacagattcaatatagattttatattaacattatgttggagctataaacgtcgtagttttgggataaatttactacttactcttcaattttataacattccatcctaaatatgtagttctgtgagaaattttgcgttaaatatatagttttacgatataagatcttaaatctatagctttatgatagtttgatcgaagtatttgtagctttgtgaaatttactataacatgataaataaatataactactcttttttcctgtgcattttgatggttattttgccaaaggcaagaaattgtagaatcttagattcgtattgaagttgcatgtgtgaagctgtgcaactcagaggccatgcacactgggaaacacagacagggatgacagttgacaccgctgttgtttctacagtactccggaaagaggagacgtgtgtttactatttatagtaaaaaaggaagggtcgctggttaagctcactgggtgactgtgcacggcatggaagagtgtagctgagccactgacatgtggggccatagcaaaagtgggacccacatgtcagtggctcaactgcatatgccgtaacggaatagcgctgatttgcttccgcgcggcttagtcgcctccacaaataatgaaataatactaatccgcatgcaaattcgtcagggaaattatatataggaccccctctcccgaaatgagtggaagtgttggaacgggttcagcgctgcagactgccactgtgctgcaacctccttatttcttgccgtctcctcgtcccacaaccactctttagctccactggatcgagaaaaccaagcacagatccaacaaacgcccaaagaaaaagtcttttgagatacacaccaatgagcctaactgactagctagcgatcgaaacaccctgctccagatcgatctggcctagctagggaccttgctgcg

SEQ ID NO: 77125 - DNA, 1398 bp, Oryza sativa
tggtgcgttcgttaggagatgtgataagatggaaaacttgctcgcttctctacgcgcatgattcccaaacggttaagcgatatgttttttattaaatgccgcacttatccagtcgtgttcacctctagatcttgtcgttgctgtttctctctctgtcggtactacattattgccagccacattcatgctattatgactttcttcattaccaacctccaccatctatggacgaagacactattcattcttggtctagcctaactatgctcctgaaccactcatataatattgagacaatagaatatgaatataacaggaaaattctaatttatgtcaataaaatggttacctattcagaaatgatggataggatttgtatttatgggctaaaataagtttttttttaatttctagctaattttagttgtttttccatttacaatattaattttagcactatttgatcgattaaaaattattgtattaaaattattaaataattttgtcagggttatggataccacctacctaatagtagttgactaaatctcggaaggacccaccacataccatgtcctatatggaaacaacctgtggatataggaggagttccggataaggaaagataatcagagttctacatggaaacgacaaggactactcggattatatccatattggtttccctagttcaacttggacaaggggacacctatgggtataaatacaagcccccttaggaggagagtggggacgaggcaatcaacacccaacacaatagacatagaagcctacatacgccaagacacgtcgccggatatcgacttcagggataggcatggctagtcccctacggtgtctctagatactgtcaggagagacgaaagcactatctctgatctcgccaggcacggatttgaggaggaaggctaccctgttgtcgactacgagttatatcatcataccgccatgtcgacaacagttagataggctaccccaaatattatactggtgtgattatcatgaataagagcaataccggcttcggccaacaggatgtagggttattacctgacaattcaggggcccgaacctgtataaaaatccctgtcttcatctcttttacctcggtctcgcgtatatcctagtaccaatgatccccataccatgcaaataccgtagtcgagacatcaaacgtcgacaaatttgaattatcgtttgggccaaagttatttatagtttcatgttgttatttttattattatatttccttcagtcgagttgtgatatatgatttaggattttaatttaagcatatttctttcagtccagttgtgatatgtggttcaaaattttaatttttgtcgatgaatgttatttagaaaaaccgggggatcc

SEQ ID NO: 77126 - DNA, 1151 bp, Oryza sativa
cctaaaattgtaaatatgtgatgcactctggataaatcataccaatttattcatagattttttaggcatatgttaatatagctataaattaaaatggagaagacgataagttttttttattatatgtttatttgggttttatcaaaaaaaataccaagttgatatatctcttagtttactttagccccaccttaattaatttatatcctggattcgccactgggctagtaacatactaacatggttcacataatttagcgcgcacacaagttgtactacatacatagtgccgatcagtcaaatggaagagtttaaacaaaacggaataagaatagcaaaatatataagttcttaggcatgcccatataccaaaccgtcacaagcaactgactaggaatcaccctagaaagaaccttcctcgaaacctccggtacctagtacaaagtactcctcactaaacatctcatttcttgtatcaatgcctaaaaactgattagtagaaactgatttctcacatgtttacatgtttatctcagcagagacccgtgctgataatatgttaggaaattggtctattctaccaatcagcacacaagaaagcaaatatagagctttggaacgcagaagtaggaacgagttcacactttatttcttcttggatctgagtacggaaggagacaggagatatccgagagggttgacctatccctggaccttctgggttctatttataggcagagaaggttgacggcttccgtcttaagcttgcttccgcggcaagcttgcttacaccctaagcttccttccatgctaagttatcttctcgtagtaagctttccactaattcctttaatttgtccacgtaaaacatgtttcgtaacaatcagagccaagtatgtgaattaagccatgtaagtatgcgaaccttgtatataggcaactctaagtagttgtgtgagttgcagagagtataactatatctcgtagattgggattattctgaaacgcgactacccaggctgccaggcacgaccttgacgatgatggtagaattattcatatccgttgtgcactccattgaacacacatataatagatttatactgtaaaaatatattcaatgaactaatatgttactacatatattatat

SEQ ID NO: 77127 - DNA, 4124 bp, Oryza sativa
tgggacgagctggacccagggtcgggttgccagttcggtctgaatcatcgtaggcctgggttaaggcaggttcgtgagggttcacggccttgtttaataatactgtgtagcgctaggatcgtctttataaaatggctttgggcaactaagtgacttttaaatgctgtttactgcaaaacttaaaccctatattattacccccttgtactcctttgcattaattgtgcatctccggtgtggcttgctgagtactgtggttgtactcattcttgctcaatcttttcccccttcagtaagagaagctttggagaagaagtcttaggtggagtcctggcttataccccagttgagcgcctgtgaagatggagccgtaggcccgctagtccgctgctgtttatttttgattgtcaggcctgatgcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaaatggataaaacctaaggacatattttataaataaaattatttgcgaaagttcctctttttctccttcccctaatgctatttgcaaaagggttactcttttctttcttcggatttcaactaagtactagatggtcagctttgcgaagaagaagatgtcgtcagttgtttgccgaagctccggaagactgcaggatccgccagcgaagcgaaggaagcagtgaagccagctgtgaagcaggagtgaagatcttggagaacccgtcgcagaacctaagccaccctctagggtagagtcgtttgtcgtgtgtttccttgcttgtgtgtgtagcgcgtggtttgcatcggtgggttgtgatgtaaccatgctaggttgtttgcttaatcaacttgcagaataagcaaaacaaacaacacatcaacaaaaagagttagttcctttaaggtcctgtccctagctctggtctattctttccttgtatgcttcccctctcaacctctaccttgtgacagatggataatactggtaacaaaggctatgggaatgatggatccgatgactcaagaacccaagccaatgggaatgagagaagcatcaacgaaacctcaccagagctaatccaagttgtggttaaccaaaccaacatgttggcaacagcctttcaactattacagaattggaacaacccagcagaggcaaccaacgttcaagtacctacagtccaacaacagtgcaagttatcagaatttctcaaaactgagcccccaacctttgccattgccgtcgatcctatggaagccagtgattggttgcgcacagtcgagaagaagctagggttgattcagtgtaccgaccaggagcgggttggcttcgcaactcatcagttggttggaccggcctcagagtggtgggatagctacgaagcatcccggccagaaggacataccatcacctgggacgagttttcatctgtattcaagagatcacatgttcccgcaggaatgatcacactaagaaaacgagagtttcgctacctgaagcaaggagatttgaccgtcacagagtacctgcatgagttctatcgtttggctcactatgcaccagaagatgtggaaacggatgaagacaaacaagagaagtttctccaggggttaaaagatgagctcgcagtgcaactacttctagaggattatgaagattttgagaaacttgtggacaaagccatgcaactcgaaagtgagcataatcggatgacgaactgcaagagaaggatggttaacaacccagtatttccaggtggtaaccaaagacagcgcactgagccacttcagatcaccggatcttctgttgtgtatcaagagttcctgccccaagaagatgaacgcaatgcaggcaacaacaatagcaatactaatgatgatgataccaccaacaaccatggttcttgccccattagtgaccactcgaataaagcgtgccatgtcagtagcattcaccaagatgtcaacaatagtatcaatgatggcacccaaaatgacaaccctagtaattgggactctgggaaagactccaatggtgatagcaataatggtaccactgatgccaatgttagcaaggattcccaaccaccacttccaactccaagtcaaaatgatcgtccccagatggacagctcagtaaagaagacgttgatttgttacaactgcaaagaaccaggtcatttctctagagattgtccacagccgaagcgtaacctgcgccatcactccggccattatgcaagaagaagacaagtcactcgccttgtggtcactggagcaaacgccgtacctgtgaggcctcatgttaattctaacccatagtagatacaatgtaccgatgttaagcaccttccctttttgtttaaagcagtgcctcgtattcatgtaatatgggagaaatttgtaataaaaacaagctctaagaggattcttttggaagatgcggatatgtgatcatgtgtataattgtttactgacaaaggagacctagggtctcgtgccagaggaactatattctaacctcgagctaataaccaacctgaggatggaaaagaaaatcaagtgattaaccaaagagacttttgtttggactaagagtttcagatgtgtcttctttggatcaaaggcaacaaccgtcagtatagcttttggcaaaacactttaaggtttcactgaaaggcagcagaccaaaggaccacatcgtcaccagaagcatccacaactctcggagtgaagagtacttggttgacaaagttccaaagatgactgatagaagataccagcaaaggtgtttattatcgggcaaagaggtaggtcgaaaggtgattgataagagaaatcgggaaagaacacatcaaggtcaaagggtaaaggaatacgttgaatgctaactgaggacaacatgaagtgaatagtggtaagttagaagtaaatgacaagcatgatattctcatgataacaagcatggtatcctagtgatgacaagctgatatcgacgcataacgtgaagtgggtaacttgtatgaggttgacgccaaagatatgaattatgagaagtctggaaccgaagtcccatcttcaagtgccacaatccagtcgaagtcagctagaggtgcaaccagggaaaagtcaggtgaagagaagattccatctgcaacaggagattgagccaagcagtccagagtggagaagttttgctaggcaagtttgttataaaagatgcgacggaagaagtcggacaagaagagaagaccgcccaacctatcttctagctagcctcctcgaatctcggggacgagattcttgtaaggggggtggatttgtcacgtcctgataaattcatcccgaaataaaattcattttctaaaaggaataatagaattaattaaaattcgaaaagaaattggcaaacactaaaaatacgtacaagaaaaattcaaatgtggcccggagaatttttgttaaattccccttggtctaaaaggagccctcaaaatttacttgaattttcagagcaccggaaataattattaagcaacaaaaacaattaacaaagtttattaaaaagaaaaacctaaaaataatctctcttccttctttgggccaagcccagcccaaaagtctccctttcctccctctttttctctccctctccttctctccctccttctcttgggcctcctcccctcccggcccactccctcctccctctctctcccgggctgccttttcccccccctcttccctcccggcctgctcggcccaggccgccttcccctcctctcctcctgggccggccgcccggcccaaccctagccgcgcccccgcccgtgcagcgcgcgtgcgcgcgctgatgccgccgcctgaccggtgggtcccacgcgccaggccgggcgtcgtccccttcctcccgcccggccgtcctctctccctctcccgtgaaccctagctcgtttcctcctctaaatccgctcgattcaagcacgg

SEQ ID NO: 77128 - DNA, 2895 bp, Oryza sativa
tgatacccagcgctttgctgcaggattcatcgattagtatatgttaaatattgtcaaaatgataaaagttgaaatgttaagaaaataatgtgaggaagatgatttgacacatacttgttgatatctataatataatattgtagatgatgtgttatgcttatatgagattttaataggctagaatagtaatttctactgagtgaagatgtggcatgcttgcatgagattttaaatggtctaaaatagtaattgctagtgggtgatgatgtggcatacttgtatgttgagctttcgtttttaataattgttagtgggtatcaactatatagaaagtatagattagcacagttatatagaaagtatagattagcacagttttcttttctttaggttccataatccatatattattaatttttccttggccgacaaacaaaacacaaccaaacgcaccgttgctcatagcaatggcccgaatacataattcaattccagcgcagttttcgccatcgattctgtcttgtctgaatatattacaagtcgttttcaattttgccgggggtgtacgtacgtagtaacgtactgtacggtctcattcccaggattcgaccaaatcgcggccaatcgatggaggtaactgcaaaatatatagagcgcacaaaaaaatcaaacctgcacggtcgattggagaatatatatgccaccatagccctttcctgatcgcactgcaacaacccgatttgattaattagctactagcaggatcgtacgattgatctgtccttttcacacgtgcgacccagccttgtttcctcactcagccgacacatccatccatcgatcagaagagaaaaattagtgccagtgcaatttatttgtatagaactagtctaattaatactgtagctagcctacgcgcttgtctgattgtgcattgtcttatccacttcggcagcagtggcagtataactaatgtgatgattagtactccctccctccgtttcaaaatgtttgacaccattaactttttagcacatatttgaccgttcgtcttattaaaaaaatttatgaaatatgtaaaactatatgtgtacatgaaagtatatttaacaatgaatcaaattatatgaaaaaaataaatgattacttaaattttttttcgaataagacgaatggtcaaacacgtactaaaaagtcaacggtgtcaaacattttgaaacggagggagtagtaagtagtataattatattgctgctgttagagaggcagctatagcttagtagctgctgttagagaggcagctatagcttagtagctctcgatggccatggccagtgccgggtcgccgttaatttcactgtgctggtggttgggaagtggttggagttggctggaattgaaacggtcgatcgatctcgacggcccccggccagcagctgacagctgcgttcctatgatcgaatcgatcgatcgaacgtgtggtctgatatgatcatggaagaagaatcgatcccagcaaataccttttcctgtcgtcgctgtcgcctgcgatattccttcccgtatcgtacgtcgctctcacctctctcacatatggccgtggttgttgcgaccctggaaattcatcagaacccccacgaggcaacgtaccttagctctagaaggagatcgatcagatgatgaggaggaagacgacgagcatgcgctgccactgatcgatcatcctatttgtttattgcgactgcctagcttgtcttcacgcacacatgtgcagtgtgcaaccggtatatataaaggtgtagcgggtgcctctgccatggacattagctagctcagctcagctcactgccactgccgctctgcctgccggcgatcgaggagaagaccggccggcggcgagctagcaggagagggctagtgatggaggaggggttgccgccggggttccggttccacccgacggacgaggagctggtgacgtactacctcgcccgcaaggtctccgacttcggcttcgccacccgcgccatcgccgacgtcgacctcaacaagtgcgagccatgggacctccccagtaagtctctagctaactcttcgatttcgatccccagtaagtgtgtttagctttaaaaacgagttttgaagggagaaattgtgagcatattgaggattgaacacggaacattcgcgggttgaaattgaagtgcatctctaaattgtgtttagctttgattcagcgagtaatataatatgcatgaatatgtcgtccattaatcattctttgatctgcaagttgattttaggggaaatgtaggctcttctgtgtccctttcggacttgttcaagaattcccttttgagaagaaatgccaaaggccctgcatgctttcatagaaagcagaagacttgttcaataattctctccttttaactctatacactttcttcgattaagctttttcttattctcagactcgttctttctgattggtgagaattgcattgccctctcgtacctttatagttgcacccgaaaattttaataaaatttctacacgtgcacttacattattatcgaattgtacgggtgtagtttagtggtcactggtgatcatatcactgcatgcatacactacaaatgcacacgtacaaatgaatgaattgatcaatcgttcttacacatgaacgcaatgttgatggatgtgatatgcaggcaaggcaagcatgggggagaaggagtggtacttcttcagcatgcgcgaccgcaagtacccgacggggatccgcaccaaccgcgccacggactccggctactggaagaccaccggcaaggacaaggagatcttccacggcggcgcgctcgccggcatgaagaagacgctggtgttctaccgcg

SEQ ID NO: 77129 - DNA, 15656 bp, Oryza sativa
agggatgtgcaatgcgtcaccggttgcatggccgccctaagtcggttcatatcgaggctgggagagaaggcgttacccttgtttaagctcctcaaatgctccgggccgtttacttggacggaggaggctgaacgtgccctcactcagttgaaggcgtatctcagctctcccccagtactggtcgccccggagccaaatgaacccttgctactctacttagcggcgaccccgcaagtggttagtgcggcgttggtcgtggagcgcgatgaggacaatcctcattccgcgcacccccaccttgtgcagacttggcccgggagagagaagggaggagaggcccccgagccgaacggtggcccaaggcccccgacgaccggagatggccctctgcccgcttgtcagacggtgctaggagcccccgacccccaggaaggccccgaggccactgcgggaaggccgcacctatcgccctctgaccccgaggctaaccctgtgccaatttggcccgggagagagcagggaggagaggcccccgagccgaacggaggcccaaggctcccgacgaccggagatggccctctgcccgcttgtccgacgacgctaggggcccccgacccccagggcggccccgaggccactgtgggaaggccgcccctgtcgtcctccgaccccgaggtcgtcggcacagaagacgagtgcgccccgcgaggccgctcgggtgaagagcgccccagggatgcggcccctagcgaagaggatcggccccaccgaaaggtgcagcggcccgtctactttgttagtgaggccctccgggatgccaagacccgataccctcaggcccagaaaatgctttacgctgttctgatggcctcgaggaaactgcgccattatttccaggcgcatcgggtcactgttgttacgtcttaccccctcggtcaaatcttgcataatcgagagggtactggacgggtggtgaaatgggcaatcgaactttctgagtttgatttgcactttgaaccacgccacgctatcaagagccaggccctcgccgactttgtggcagaatggaccccggctcccgagctcgtctcggtccccgaaaccggctcgggtccctcgcagctgcctcacaccgctcactgggtgatgcagttcgacggctccctgtctcttcagggcgccggtgcgggggtcacattgacctctccgagtggagccgtcctcaaatacttggtccgcctcgactttcgagcgaccaataatatggcagagtacgagggactccttgccggactcagagtggcagctggactggggatccgccgcctcttggtgttaggcgactcccagctggtcgttaaccaagtctgtaaggagtaccggtgctctgactcgcagatggacgcctacgtgcgccaagtacggcgtatggagcgccattttgacgggattgagcttcggcacgttcccagacgggataacatgatggccgacgagctctcacggctcgcgtcctcgcgagcccagaccccaccgggcgcctttgaagaaaggcttgtccagccatcggcgcgacccgaccccttaggggagacggatgcgcctgaccggcccccgaggcccgtcggagtccaggcctcgggacccgaggggagtgctcccagctcccttagattgattgcttggatcgccgagatccaagcatacctcacagataagactctacccgaggaccgcgaagggagtgagcgcgtccatcgcatctccaaacgctacgtactggtagaagggaccctctatcggcgcgcggctaatggaatcctcctgaagtgcattcctcgggaacaaggcgttgtgcttcttgccgatatccatgaaggcgaatgcggagcacactccgcctcgcgcaccttggttggtaaagcttttcgccaaggtttctattggccgacagctctcaatgatgcggtcgacctggtccgccgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcaacaagttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactgctgcgaagacatgggcatcaagctctgcttcgcctcacctgcccacctcagaagcaatggccaagtggagcgctccaatgcggaaatcctcaaaggtcttaaaaccaagaccttcaacttactcaagaagcacggcgtttcatggatcgaggagttgccagcggtgctctgggcaaaccgaactacaccaagccgagcaaccggggaaacgcctttcttcctcgtctacggcacggaagcggttctcccatccgagctcaccctgaggtctcctcgggccaccatgtactgcgaggctaatcaagatcagcttcgcagagatgacctcgactacttggaagagcgaaggcggcgcgaggccctccgagccgcgcgctaccagcagagcctgcggcgctaccatcagcgtcacgtccgggcccgatcactctgcgtcgacgacctcgtcctacgccgcgtccaaacgcgtgctggattgagcaggctctcaccaatgtgggagggtccgtatcgagtggtcggcgtcccccggccgggctccatacggctggccacgggcgacggcactgagctgcctaacccgtggaacatcgaacaccttcgtcgcttctacccctgaggggggagttgggtgtcaggtttcgggctcgggccaaccccgcaccccctcgggcgtgcagggttggccgggggctgccacacatgcactttcttatttctcttatttcagaatttcaataaaagcagtttcaatttcctaaaggttgtatctgtgctgttttttccttttgaagaatcttgacttgaaatagatcacttgcgctcaatcctgccctcgggggctcgggtcggctaaaaatcgccaaacggggcccagaaccgagccgtgcctcggggcgtggtgaactccgggggggaatcggcaaaaacccacaatcgggtcacccataaccctcggtcaccacgttcccggcctggccagtctcgacatgtggatctccctaggcactgtcacgtcctgataaattcatcccgaaataaaattcattttctaaaaggaataatagaattaattaaaattcgaaaagaaattggcaaacactaaaaatacgtacaagaaaaattcaaatgtggcccggagaatttttgttaaattccccttggtctaaaaggagccctcaaaatttacttgaattttcagagcaccggaaataattattaagcaacaaaaacaattaacaaagtttattaaaaagaaaaacctaaaaataatctctcttccttctttgggccaagcccagcccaaaagtctccctttcctccctctttttctctccctctccttctctccctccttctcttgggcctcctcccctcccggcccactccctcctccctctctctcccgggctgccttttcccccccctcttccctcccggcctgctcggcccaggccgccttcccctcctctcctcctgggccggcagcccggcccaaccctagccgcgcccccgcccgtgcagcgcgcgtgcgcgcgctgatgccgccgcctgaccggtgggtcccacgcgccaggccgggcgtcgtccccttcctcccgcccggccgtcctctctccctctcccgtgaaccctagctcgtttcctcctctaaatccgctcgattcaagcacgggattcccaaattaaataggggaaattaatccccattgactcctcttcatttccccctaatttcccccttgaatgccgcccccaatcgccgggaacgcccgcgttttctccggccaccaaccattgccgccggccgtggttctcgccgccgttccgacctcccccgtggccggttccctcccccatcctataaaatgggatcctcatcccccgttctctcgttttagccccatcccgagcctccccgtggtccctagctccctccccaccgtcgccctctctctcccacgttgccggccgcctccagccgcctgtgccgcctcgaccgtgcgccggccggccgcaccgtcgcctcctccagcatcgccgccacctcctcttcgccggcctgccctccgtttcgcgaggtgacccccggagctgccttctccccgtcgccctcctcttttctccgcgccggccgcctccagtcgcctccatctccctgcctgcacgccggtcgacgtcgccaccacctccctcggctccacgacgccgctctcatccccggcatcacctcctcctcgcccgaacatcgccggaacaccgtcgcccgcgccggcctcaccttcctcctcgtcgacatctcctccggctgcccctttcgccatgcccgtgcatcagccgacgctgccgtcccctccctcggcatggtgacgtagccctccacctcgtccactcctcggtttcgccggaacgccatcgccgcgagcctctccatccgcctcgccggagttgttcggccgcccgtccctccacgccgtgcaccggtcggccacacccccatcatcttcggcatcgcagctgcgacgtcgtcctcggcctcgcctcccctccgaccgaacaccgccggtgtccgtcgtcgtcttcaccgttccctctcgccggctcgtcgtctcgcggcgccgcctccgtcatcgtcatcatagcggcgtgttccacgtcatcctcgaccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagcaagccgctgcagccccgtcctcgtgttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccacgcctcgtcgcgtggtggtaaggttccctctccctcgctgccctgtcctcgtcctttcagtgtcgcccgtgcccgttgtgcggttgtcggccccggtacccgtgtatcggcgtcggcagtcgttcgcttgtgcgcgtggtgaccgtgttagtgtgtccgctcggtagccgcgtggtttccacgtgtgcagtccgtgtggtgtctagtggagtccgtttgtcggccactcgcctcggttgacacacgggatccgcttccatcgacccgtggaccgtctctgtgtactcggtctaccgtggtcctttttgttgacatgtggggtccgcatgtcaacggcgcagccttcctgtcttttcccaggctagcgcttacacatgttttataattgcaaagcttaattataataatccgcaaatctccatataacagcattaaacttcggatgatcatatcttggtcatacgaactccgaatcgacccgttcaagtctcttaatgtttgttataacctaaagaacccggtgctttctttttatgtactgttattgcttctttataggcttgtagctttgcttgtgtgcttcgcgtagcttctgtcgttccggaggttcccgaagcgtggttcgcggtcgtcgccgaaggttcggaagtccgttctctctgagcaaggcaagtcacatcatccttgagcatattgaatcccagtttataaaattatgttgatttaaattaatgcattaccgctttatttaaattcccgcgttatcactgttttatttagccatgcctatttacctttgttatgaccttattattgctattgttattattattcccttgttcaccctagattaaacaaaacctcaactagtgggtactctattcatggttccactagtatgaatttaggtagatgcttcgctgtttgaattagacaacattaggtggtttcacaactttagacttgggaaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctgcctgtcccgggtatcccggccgtaggtgggattgggtcggtactcttgtctaaggctaggatgggttggaaactatgtcacgtcttccgtccgtataccgtggtggtatgtggcgcgtggttacacgtgaggaagatgtgtcttgtgggtaaagatgtacacctctgatcagagtaaatctattcgaatagccgagccctcggttatgggcaagccgagcaatgtacccaagtcagtgttttaattcttaaaatttgctcagcaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagcgctaggatcgtctttataaaatggctttgggcaactaagtgacttttaaatgctgtttactgcaaaacttaaaccctatattattacccccttgtactcctttgcattaattgtgcatctccggtgtggcttgctgagtactgtggttgtactcattcttgctcaatcttttcccccttcagtaagagaagctttggagaagaagtcttaggtggagtcctggcttataccccagttgagcgcctgtgaagatggagccgtaggcccgctagtccgctgctgtttatttttgattgtcaggcctgatgcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaggcactagccccgacccgcgccttttgaggaccagaacctgggcacgagcccttattcaagctaagacacaaaagggccacggcacagatcatcctcatctcatacacatagcaagataaaattaacacaaaaatttcttcatttttgattacagattaagttgatctatacaaaaaagaggcccgaaggccttagaagaaagaaaagaagaaaagactgaagaatggcgggggtctgggggctcattccgatgcgcccggatcgccggcctcgacgtcactgtcgtctgcaccaccggcattgccctcctcgtcggagttgggggcaaacgcaagccgaggggccgagccctcgaagctgtcgacgatatagtcggcggcatcccggacttgcgcgcgcgcgcggtcctcggtcccaggagggaactcatccagcgccatccatggagagaagttggggtccctggcctggtaactcgccaggacgagctccaccgctccttgggcgaggtccctcgaggatgacttaattgtcttctcgagctcctcgggaagccgttggagagccccggccatcttcgagaggtgctgggcgaggcctccctggttgtcggcgtactttgcggtctgccctctccagaggcccacctgccgaccggcgcgatctaggcgggagacggcgtcccaaagcatgccgggcccgacctcgcctgccaaacggagggcttcgacctccccggcggatgagtccagcgcgctctgcagaccggcgatggtgtgttcagcatctgcgaggcgggcggctaagtcgctttcgcccgcggccgccccgccgctgcgcgccctcgcgtccagctccttcgcccgcgcctcgagctcagcggcccgctggttcagtgcggccctctcggcgcgggcaccttccagattgcggcgcgcctgctcctcctgcgctgcctcgcggagggacaggctgtccgccagctgttgcgccgcggcctcggccccctcgagagctcgctcccgctcggtgagcgcgtcctcgcggaggcggagcgcgagctcttcttcggcgcaggcagcctcgtgcgccgccagtgtcgcttcccggatggtgacagcggcctcgcggtccgccagatccctctccacgacgcaggcgcgctcttccagcgccatggcgcgcgcctcgagggtctcttgacgccgccgggacaccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcattacggtggtggcaatgagggcagccccccgctcctcctccacttccttggcgatctccgccaacaccttcttacgggtttcaagctccgagacatgccggcggtgagccttacggcccacctccaccatggcctccaccgagcgtcgcccctcttcgacgcgcgcccacgcggtgtcgagctccgcccgctctgcctgcagggcctccacctgggcacttaacccgtccaacaccgtggtgtttgcggcggccaaggcttgcagaaggggctctgcgctcagtagggcagcagaaggcgtggggaaaagtcgcctcggagaagatgccgcgcggctcggcccgccgatggacgtgccagacgcagggatgtcctccggacctggttgagcctgagcgtcgcccgagggagtgggcccaagcgacgtgcccgctgccacgtcgccagctgccccggaagttgtcgcctgagcgtcgcccgagggagtgggcccaagcgacgcacccgcggcctcgtcgcgagctgcctcggaagtcgccatcgcctcgtcctggcgaaatccagcctcctcccgagcggcttcctcggcatggtgggctcgggcggcctcctcccgagcagcttcctcggcctggcaggctcgggcagcctcctcccgagcagtttcctcggcctggcgagcccgggcggcctcctgggcggcctcctcggcttcccgtaggcgatccgcggcctctcgccggtcagcttcccgcctgcgggcctctgcggccgccggatcctcggcctcaggctggccggacttggaatgatgggagggacgcgacgggatctcgctgaaacaaaagaaaagaccagaagacgaacaagatgggcgagtgaaaactcatgttgagagaatgaatacagccacgatgggtgagagacgaacctgcgagggggtcggttaaacgaccactttggaggggaaatgaggtttccccgagatggttctgtctcctccatcttgcggggccgcttcttcttgcgctccccctcgagctgcgatgctggcgcggccccctccgggcgcttgctgctggcacgcgccgccccgccccctcggggaggagatgggggaggtgttcctccctgcttcctcttcccccgggcgtcggcagggcggctgctccccgggcccctgacacgggacccagaagcacgaccccctctcggggtagattgctccccccggcggctccctcctgcgccgtcatggccctttggagctcgctcctcagaggccccgacccccatcataatggtcaggatcgaggcgcggtctggatcgctgcagagggggaggattccttggggaatgagggccgcctccacggagttgagattcagcacccgttggaccaatatcttgaagtcctcaggagcccagtcccatctcactccctggtgggtcctcatgtagtcttcggacccggtgtactcccaggcgccccgagcgcgccgctggagcggcgcaatccgacgacggaggtagtcaccatacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgagggcagtgtagaaccaatcgctcttccagtcgtcccacttcttgcggagggcgcaggggatgtagcggttcagcgccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggcggaaccagccctgccattgcaaaagggagaaagaagacggaccgccccgggtagtctggcgccgggcgtccctcgcccagcgtgactatctcccggccggcggcagattccggcatgaagcggcgcggcagcccagcctgcctctcactcacgatgcgggagggcggcagcacgctaccatcgagcagagcggagccccgtgccatggcgccggaggaagagaagattaagagcgagcgcgtgtggctagggtagggcgcaggaaagaaggagttagggcgcaagcggcaaagacaaggggaataatggcgaaaggaaggaagcaaatcccttcctcagtgcctttatacccttgccaacgctgtgcccggctcctcgtttctcgcgcccactatttcgccccctcgtttctcgcgcccacgcttccactaatcccattcgcccgcttgcggcgcatgaggtggatatgcggttgtggcggtcgaggtagatcatatcatgcgcgcgttaattacgctcgccaaccgaagcgacgttaccatatcttcagatgaaacgaatcgccatgtccagattcgtgtgctactcgagtaatgtggcagtcttgaagagaccgctcattattgacaaccgagttaccattgccgatgtgcgtgatttttgaccgttggttttctgcccaattgtggagaccgatcccacctgtcaccgggccttaggagtggcgtcacgcccgaccatttcccttgaggagggcgatcgccctggcataacgccgggggctactgttggtgacatgggatcgggagtatcatgactagaggtttgaggcagacacaatcgcccacgtggcctggcaccctcgggggacgtcaggcccgaaggtggtgtgttcgccctcctcttagtccccccgagggggtcgggctgcacccccctcggccccgagggccgaggcgccccgacccctcgtgggatttcgctccgcgtgtatggggtaggtgagcacagtggggctcacctaaccacatttattgcggcttggctgagcgtgtcacgacgcatgtaatgtagtgcattgcactcatttatccggtctgtgaccagtcacagaccggtcagatcgcgggattaggtggcgacaggcggtctgacgcacgcctcgccccatcccgtcaggacgagggcttctaggcgctcgtccccagctggagctagcgtgttacctcccagagatggcacgttagtcctgatcagatatatgccaggcttcatcctaaccattacaggcaaaatgtagtgtgaaggagggccaacatgcagattgctaagctgacacgaggtggacaagaatgaccgatttgtgaccattctgacaccggtcatgtcgccagcagacagccatgattctacgtcgcgcctgctcccggcgaaagtggaggtaggtgcaggccgtcccatcagaaggtgactcgaacggcaaccatgcagatctccgtccatttatgaaaaggtagggtaagtccccataaaaaagggggggatggtgcatgtggtatccccttaagatataaaaggaggaccttgcccacggagagagggggatagattttagagagagctttttcttggactggacctttccagattaggggcccagaacaagggagaggcgggctgatactttgtagctctttgatacacagatctcccaaaaacacaggagtagggtattacgcttctcagcggcccgaacctgtatacatcgccggtgtcttctgtgcttccggtctcgcgaaccttccacatacagattgggagtttagagtctcacccagggtccccggccgaaccggcaaaggggggccagcgcggtctcccggtgaggagccccacgctccgtcagcgtgggatgcattacatatgaaacacttagcaagttcgtacgggaatgaaaattggtatgtaggaagacagtaaaattaaactaactctgtgttgtacggtaacagtatgaacgtcttgtaatgctgcgccttcaggagatggacgagattgtcctctgtttcctgcggatattggtcgagcattgcaacgtttactctccgagggtcgatgaatccagtatcgaaaaccctccgccgtcgggccctttgaatctccattctacaacgataaaagggagtattttattttatatagtctacttatatacaaggacctaattaattaaaggagacgtagtaattaagaattataattgaacgatatacttacaaagtccagcaactcataatagagacgtcgagggcgtccagctggtatacttcgtagattcccttgaaattgatccagagaatatcatctccttgcaagaagtccgggtccctgatcctcgctccgatcatctctctaccggtggcgctcatctccacgtacagctgatggaacttgtacatttgtgtgggtagggactgcaccagctcggacttgacaagcggtttaccgagttcgtacatgtatttcaattccgccttttctattggttcaactcctagcaattgatccgtagatagaccggtgtcaataataaattcttctatcgtcatgtctttcccggttaccaacggctcgatctcctggtttggttgctctccaagctgagggactggtttggactttccagaagatgctttcttcagcgttcgctcagagtccgatagcttgatggcctccttgacaggtgcagacatacccctgaagaagttcatgacactggggtctataggaatattcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggtaggcggtggagctgggggggcccttgactttgaaggtgccggaagaggagcttgcggaggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgtttgtcgcccagggaggatgatgtaccgcctgcgccatagaataatggcatggcttgtgtctcgtaaatgcgtctcaccgtctcctccagggtaatccagctcgaggtcctcgtacgcgccttcgaccaactcaactttgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatactctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttcccttgtattcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgagaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgttcaacggagggttgactaccactagcctcctcctcctggttcccctccacatccctttccacgtgcccctgctggttcctcctccgcatccctctccacgttcccttcctccttcaagtactggtttggatcctcgttcctttcttcttcattccagtactggc

SEQ ID NO: 77130 - DNA, 1291 bp, Oryza sativa
aaattcagtggaggtataaagcgaagaacatgtataatgcaacccttagccaaaagcctgaaacataaactcacctttctctccagttgcttgtcagaagaaagccatgccttcgctgtgagaaggccaatctgctgtgccgccaaaacctagaaatcataaataaaaaaaatgcatatattattagtatactcgagaaatctatggccccaagtatgatattgtgcaagtttctcaatggaaagaagagaaaccaaatgtacacaatagtgagcatcttactttgtcaaggggtatatcctttatatgctgcaccttaagttcaatcgagatctctctcatgtcagccaagtaacctttagctgtaaccatatctgggaacttgccttggtatttcccagatatacataaaggactttttgctgaaatgtctggaatgtattcagaatcgatctgaattggaggaaaggaacagtcagaagacaataaaactactgtttttttctagctactactagttacacctgcaaaaagcatacccacaaaccacccttccatacagcaaataattatttctatatacaggacaggctctttgtaggaagagcagtataagatggtatggcagcaatgaacacagcacacatacactaccagaaaaatgagttgggaaatcacaaatcaaatactgaaaaagagtcaatttcattatgaaacatgatcgcaatgcagccagaaccaccttgatggcattactcgtcttacatatccatctctacataaccaaatttacaatattgagtagttagtgatgaattaactcacttcaaattcatcaagatgtgctgtagcatcaatggagatgtttgcaactattgtactcgatgctttcctgaaccacctaagtacctgactctcaattgatcctgcaaaaacaattcaccaaaaaaaaaaggtttatgaagatgttacatggacttcataaaagtcatatttgtccaattaatgcatataatagaacagtattgcttagatatgaacttcaggaataaatccagatcaataacaataatgtattggtagaatgcccatgaaacttgagcagaggttgcaagatggagtgtcaacttaaacagcatgcagggatcataaagaaacagtgttacgtggaaaattgcaaaccaagagtacaactagctcttagattgcagagcaagaggatcccttcatagaaaacattattgccacctctaacaatatgaactgattgcagtttggtttttctattata

SEQ ID NO: 77131 - DNA, 696 bp, Oryza sativa
aattcctgcagcccagcacgtcaacatagttcagtttgcagagcaatgcatcagtaaaaggatgctgctagttcagttgcttttgattttagatattgatgccatatgcataatatcactcctagtttattttcgttcgaatttagttttgtagtactacctaaatgccttctgatatactaacttctgaaagtgaagtgcagctccgaatctctgacgagaactataaaccattcaccctcttgtggtgtttacacactaaaattcactcgttctaccaaacgcttctcccaagtgacccttgtgagctcttgagttttacttaccacatagatatatcacataaaacacatgtgtccattagaaaactagcatggtcagtcaccagcttcataaatcaaaaaaaaaaaaaaaactgacaagagaacaggcagtaccgtgtactgttaccttctccttcccagcaactccatagcccagaatactagaggttatggtggtgttcttgcaatagaaaacacagaaaatggcgtggacatgtctgaatattgatcacagatggcggccgtctaccttccctgccaacagcacacatgatgtgaaggaacctgacctgaaccttcctgcatttcatttgctacgtacaaaacattagtttgtttgtttctttggtagaacaacacccaaattaatcct

SEQ ID NO: 77132 - DNA, 661 bp, Oryza sativa
aggggacacctatgggtataaatacaaggccccttaggaggagaggggccacggacaatcgacgaccaccttaatcaacatccaccacaatctacggaacaacagaagccaatatacgccaagacaagacgccggatattgacttcagagataggcatggctagtcccctacggtgtctccagatactatcaggagaggcgaaagcgctatctctgatctcgctgggcacggattcaaggaggaagactaccctgttgtcgactacgagtcagatcgtcagaccgccatgtcgataacagttagataggctaccccaaatattgtactggtgtgattatcatgaataagagcaataccggcttcggccaacaggatgtagggttattacctgacaatcaggagcccgaacctgtataaaaatcctcgtctccgtctcttttacctcagtctcgcataatcctagcaccgacgatccccatactatgcaaataccagaattgcgacatcatatgtcgacagtggcgtgctaggtatggggactttggtgcttcaggatttcgacgagatgggttcaagagatggattctccaacaacaagctactcaacgacttcggctgtgaggagatctaacccaactgaagtgcatcttccgaccaaat

SEQ ID NO: 77133 - DNA, 639 bp, Oryza sativa
aaattatatcaacagctgtaatggaagtctttcctcaaagtcaatttgattatttctaatacactcatatatatacataaacaacaaagcaatcataacaccatgcgtctaccatgtaataatgtatagtatataatacctgtatttgtcattatttagtggactctgcttagttctcctaaaataatatcaaccagtgccgtactctgaacaggcacaaagtatacacacttaatcaacccaataaaaaaaacaaatatattaccgtggttttctcaatcaagcaaacgaaaatactttaccgaccaaacaaccgcagcaagttagcaacagcaagcaagccagccgcccacttggagacagctggcaacgcccgttgccacccgtccgacgtggcgtccccatcccacttacttgtgggcccccacacctccatgattccctcgcgcgtgggccccaccctcctcctccttccgtttataaagcccaaggcccaaaacgatcacgcgcgcacgaagaggagacgagagagagaagacgcgacggccacaaggtgttcgacgccgtctccccggagcagcagacgccggcgaggaggaagagactagtagcttggagtctgaaggttccagccatgga

SEQ ID NO: 77134 - DNA, 1965 bp, Oryza sativa
cggcgtcatctattaaaaaacggaggtaggatttagcagctgatgaagtaccgagacacgcagatgctaatgaccactagaggaagacagaactagcatattttacccacttcatccatctcttcagaaactttcgctgcgtcagatcgaatgatacgagacggaaaaaagaagaagaatggcacgagaattggatattcttttacatagatggtagatataaggtcagaaacaaatccatcaggcaactcctccttaacatgttcgtgtactgtctcacagaaaggacgggttcagatcctcttatccatcatatatagttgactgtagaatgtgtaggttggatttctttcgtgtgatcgctctgtaactgtgattgcgtcaaacatactatctgttttcttcttccccaaagtacaaactgtcgtcctaccgttaggacagcttttacccattttgaaatacaaacagtaccgtaaaagttatcgattgttagaaaactacaagaagatgcacacggcaatatggacttccatgatagttaagtaggtatagtttttttttttaaatcgaagccaggcaaagttggagttatattaaggaaaatagaaagtatttacaatatcaccaggaaaggtgaaagagacagaacaggggaaataaagaagaaaagcaacaaggaaaacctaaaagggagacctaagtggatattctcgtgatgttttttttgccccacacatactccaaagtttgatttcgtcttgtattttggcgagtagttgcggcatggttttctcttgattttgaaaaaccctcctgttccgttcacaccatacttcccataccaccaacatgtggattgatttgagtgctttggccttgcttttgcctccttctgatccaccattccaacagtacttcgttttcatcgtattggtgttctatatcgttgcagttcagtatactcaggaccctctcccagatatggcacacaaaagcgcaatctttaaaaagatgttgggcggtttcaaggttcctatagcatagttggcagaaatagttgtttggccattgtctgatttgtagcctatctattgtccaaactctattttgcaatagaagccatgtaaagtgtttgcatttggaaggtgcccattgcttccaaatcagttttacagctgcagagcttattctaccattaaactgcgctatgtagaatgactttgcgctgtacttttcatttgccgtccaccgccaagttatggtgtcctcgacaccttctgtgagtgccacgccattattccacgcatggtagaataataatacatgaagtgtgtaatccgtggccaattatgcaggacaattaggatatgatgatgttgttcacaccaaaattagtccatatctttattttctccgcataaataattagctgcataaattagctacggactttggaacttaatttgggaaaaagcaaactctttttattcagtacattgtgatatgatgtcaaaacaaaaattcttaaaactagaggcggcagctgatctggagttgtgtcccgtgactcgtgtcttcgccgccgatgccttcctcaccggcgccgccgccattgtcatcgtcctccggaggcaaggatgcaaatagcgccgcgaggctggcgtcgatctggtccagcgagtcagcggccaaggtttctccggcgtcccggatgtcgcggatcatctccaagaagtcgtcggagtggagcgggatgaagccggcgtcgacgaactcctcgagcgtatcgtagatggctctcaacgaggcgatcagctgcctggtcgtcgcgaggtggagcaggttgcagcgcagcagcagcgagccgctcggcgaatcggacagcttcgcctgcagctacttggcgaacgactccctcgcatccatgtatttgttggcgaacgacgacgtactgctactatg

SEQ ID NO: 77135 - DNA, 6302 bp, Oryza sativa
  unsure (1)..(6302): unsure at all n locations
ttatatctcgaaaaaataataaaaaacatgggacccacatgtcagctaaaaataataattttaaaatggtggccccacatgtcagctactcctcccttcttccccctcccttctctctcatattcatcgtcctctcttcttcatgtgcgcagggggaaggaggcgaggcgaggcgacgggaccatcccccacaccgacaccacccccagcgcgccgccaccgccggcatcttcgtcttcctcctccgccgtcaccgcctgcatcttcgtcttcctcctcgccgccgccgccgccgcggcaaccgcggcaagcaggccggcgacgacgacgtggagatggccgaggggaggaacaacaaggtcgccgacggcggcagcgccgatgactcgacgaccagcggcaaggcggacaccaaggtgtagctctggcgtctcaatcgatccatgagcgatcgagtagctcagtagcatgcaatcggctaagatttgctgcatgtgttctagtactagaagtaataatactccctccatctacttttgatagtgatatttccaaatctgaaaattttatttttgatagacatatttcaatccaacaacctatcatcttaataactttctcggatttaatgcacgactctccattcttccacacatgattggctacatgagcattgaaaaatgtaaatattaatgaatcgtttatttacgaggaatgactagtagcatgtttaaatagatgataagtagaattacttatccttggtctatgtgcaaagatgaaatatgactatcaaaagtagatagaggaagtattagctatcctaaaaggctaaaacacataacgtgtatgaaaggaaagtactatcctaactgaataaaacagcttttacaggcacaagtttaacataatatgtctgctttgatctttatttggaagttgtaattaaccatgtttgtaataacgcgataattaaacgagagtatccatgtgtcaagaggtcaagcgtgacctctcccacaccgtccatggcttccccgccgatgagcaccacgtccgggaggtgattgcgctcacgctccactcccacgcctgcgtcgcgtcgctgtcgcgctgcctgggcgtcacgctcaagatgctggtgctcgtccaccgcctcctcgccgacgcgggcccggcgttcgagcaggaggtgttttacgccatgcgccggggcacccggtccgtccacccccaccccccagcgccgccacgccgtggcccgctccagccggcctccttcgtcgctcgggccgcccgtgcgccgttccagccgcgcctcctcgtcgctccgccgcccatgagcgggagagagacaagagggagagagaggggacagagagaagaggttgtgaggataacgtgtgggtccacatgggcccaccttttttttattaatttgtgtgtgcaactgacatgtgggcctcacaagttttattatttttttcggatctaattgccacatcagcgccatgtcaataacacgttggacaaaaatctagtcaaaagaagccacgtcggcgccacctcagccaaaaccggagtcaaatactgccgagggaccttatttaaacggtttcgtaagttgggggatccgtcgtatcctgttttgtgactaagggacgaaaatcggactgggcaacaaataaagggacccaaagtgaacttattccgaattctttctaccacggattctgttgggccgtttctagaagaaaaaggaaaagggacggcctgtaggctgcattgggccgagcccagccaggctgagccagcacgtggaacgggccgaattcacggaccagtgcagtgcggttggtggggaataagttcaccttacgtccctcactttacacgagtctgtctaagttccctaatccccaatattagaaatcttcacccataaactatacaaaaccgtgtaaaagtatggatatgtggtttcactgatgtggcaacctagtcagcaagataaaaaaataaaaacgttatggggcccacatgtaagtgagaaggaaaaaaaatatggctattcaaatagattcgatgtaaagttaagggacgtcaggtgaacttgatggacacgaagttgctattcagttgaagatttattcaacatttattgtgatataaaattattctctctcattttttttccaagccgaacaagaccttagtttgatgttggtacggaaaagcctactccataatccacagtttggtgacaccttaatctgagagagtagttatctaggttatgcgtgcttcaggtccttacgctctcagggcaaataataatgaaattcacattacccacataactgtcttttagtgtgagcgtcttcatggcttaataagcccttgtgcaggcgaactatattttcgctttccacaatttataaaatttttaataaacaactaaacaaaatcattttagtattgattaaactacatgcggctcataactaatcatttaactatttgtcacttttaagatgtaatgataataaatttaccactcattttctatggcatatggtgcctatgacatgtgagtccagtgataaatatgttatcatcacttgtaatagtggcaaatataattattcctttatttttagccttccacaatttatagaatttttaataaacaactaaacaaaattattttagtattgattaaactacatgcggctagtaatctagagttgtgtcccgcccggcgccgcctatatgacttcctcatctggagttgcctctcgtcgccgcagctcgtcgccgtcgctgccgccactgtaatgatcatgagctggccttgaggtgtcacaccctgaagttttccccattttgcttgctttaaaaattggttaaataaattgcccgaagaaattatcttaattaacctagagctgaattccttaattaataaatacaattaataatcggaaatagcgtggtggaatttttcttgagttccccatgctccaatgcattaacaagatttttagtggaattttcagagccttggaaataattttaaccaattaaaaatcaccaaagtgcaatttttaatcccaggaaaaatcctttcttccttttctttttcttttccttcttttttctctattgggccgtcggcccactccctcccgcgctcgggctcctttctttgggccggcccgttccccttcccctctctccgggacgctgacaggtggggcccacctgtcaggtcgtcccctttcttcagcccgccgccccacgacggcaaccgccgncgaaaccgcccgcgccgncgccttcttcacgtngngccttcactccgcgcccgcaccttgcgcccacgtncccgccctcttccccgcatctnccggcccgcacgcgcgcccgcaaatgggcgggaatcgatttgaatcccccccactttctctctcttttcccccacgtcgccggccaaatcggggggtttcccggccatgtccgcccctttcgagcccctataaagcttccccgcatctccctcttccttttccccttttcgccgcgctctcccgtgccttctaccggtcgcgcgccgctcgccactagcgccgccgccgcctgccgtctcctgccgcgtgccgtcgccactagggccgccgtcgcgccaagccgccaccgcctcgcgtcgccggaaccccaccggaaccctatctccctcgcgagccggtgagctatccattcccctccgtctccggccagccattttggtcgtcgcggtcgctttctccatccctaactcctctcctcccctcctctaggtgtctccaccgctcgtccgcccctcctctcgtcgggtcgtcgtcgccgccttcgtcttccgctccggccgccgtgtcgccggtgagtcctccctccccccctcctttcctcaccttcccgcgagcgccggccacgtcgctgctccggccatgcgccgccgcctttcggccgtcgccgccgcttcccgcaccgccggtcaccgccgtcggtggccgtgcctcgccgccgcctcgccttggtcagccggtcggccttgaggccgagccgagccggccggcgcctccctcgcctcccctttgagccaccgcctggtggggcccacctgccaggcgccacctccctccctttggagccgctgactcatgggccccacctgtcggcgccgccccccccttcgctgacgtcagccctgggctttattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcgtaggtttcggccgtttcgtcgatccgcagtttctcgaagacgttgctgaggtctcatcagttcgagagcaaggcaagtcatgcaatacgtttgatcatattgtacccaatttacaaatatcccgcatttctattaaatgttgcattcttttacaatgtaatgtgggatgggtcctattcctcagccacatattggttaccctatgccattgataacttgggtatcaaaatgactagatgttggcttagaaaatgcttagccatgcttagttcaactaatacacaaatggggatcactttattacatagactttgtctattggcatagctttagattggtgccaccgcaatggtgttagttaattaaaatacactgaatggtgggctgtgggtgcatggttttgctggtcgcacccatggcagttaaggaccggttcacgggaaaccctgggagacttaccgtgcttaccacaagcgggagtgggtaactgcttgatctgaagtatagctcgacccttctaggcaccggtggtgagggtgggcgtgatggaattgggtcggcaggggtgtccggttgtccagatgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtttggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgattggttaatattgattaattactacagctgttttactgctttcaactactgctttgaaatgcctgctttatgcaaaagaacccctagcttcctttggttatatcctgcatcatacctcctcttccggtatgacttgctgagtacagtgggtagtacttagtcttgctctcttttcccccacaccagagttgaagttcttctcagttggagatgtcttgaagaggtgggtttcgtcgctgccgtcaagggttgcctgtggaatggaatcgcccgctgcaggagtcaagtcttcaggcttagctcgcttttaccttttccgctgcatttgtaatcctttatgtttttgtaagacgtggatttgtatgtcaacaattgtcgtttgtgtaccctggctggtcctggacaggggtttaatacacattcagcttagaaattatggttcgtgaatttctgggcgtgacatgaggcatgggtggcactagtacagaagagcttttttcatacgggcgaaatggatctttccatgcggctagcctgcccgcatggaacaaaaggtctgtaaaaatcgctatttctccatgcgggcaacacaaccgcatgcaaaaaggggattttcgcatgcggtccacatagccaaccgcatgcaaagatattttttagccaaaaaaaaaaaatccaaaaaccccccgaaacactaacccgccgcccgccgccggacgccgcgtgaccggcgccagatccacgctgctgcggccgccggccgtcgcggcgcagagccgtgcccgccgccctcgccggctgccactgctcgccgtcgccgtcgccaagcgtcgtgctcctccgtagggcggcggatccggccctcccgaggacgatgccgccgccgctctccgccg

SEQ ID NO: 77136 - DNA, 8119 bp, Oryza sativa
ttcggtctgaatcatcgtaggccttgggttaaggcaggttcgtgtgggttcacggccttgattaataatactgtgtagctctaggattgtctttataaaatggctttgggcaactaagtgacttttaaatgctgtttactgcaaaacttaacccctatattattatccccttgtactcccttgcattaattatgcatctgccggtgtggcttgctgagtactgtggttgtactcattcttgctcaatctttcccctcttcagtaagagaagcgttggagaagatgtcttaggtggagtcctggcttataccccagttgagcgcctgtgaagatggagccgtaggcccgctagtccgctgctgtttatttttgattgccaggcctgaagcgcctttgtaataatgtaaatattatcgatataataaaaatatgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaatgaaactatttgcgaaagttccttttcctcctttcccgtgtgctatttgcaaaatgtttactctttcttccgtcttcaaatttcaactagtactagatggttagttttgcgagagaagaagatgtcgccaattgtctgccgaagctccggaaggctgcaggattcgctagcgaagtggaggaagcagtgaagccagctgtgaagccgaagctaagatcttggagaacctgtcgctgaacctaagccaccctctagggtagagtcgttagtcgtgtgttccttgcttgtgtgtgtagtgcgtggtttgcatcggtgggttgtgatgtgaccatgctaggttgtttgtttaatcaacttgcagaataagcaaaacaaacaacacatcaacaaaaagagttagttcctttaaggtcttgtccctagctctggtctattctttccttgtatgcttcctctctcaacccctaccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaacagcctttcaactattacagaattggaacaacccagcaggggcaaccaacgttcaagtacctacagtccagcaacagtgcaagttatcagaatttctcaaaactgagcctccaacctttgccattgccgtcgatcctatggaagccagtgattggttgcgcacaatcgagaagaagctagggttgattcagtgcaccgaccaggagcgggttggcttcgcaactcatcagctggttggaccggcttcagaatagtgggaagtgaaccaaatgtaaagaaagtgaatccgagttgcttgttcatgagagctattcccagttatgaaccaagtgatatgttcgaagatagtctatggaggtcagattaaaatcgcatctaacaacgaagcttcagatttggcaggataacgatcagaccataacaagtccagcagcaaagtcatttggggagacgtcaaagcatgtcaagtgggataagttggttctttttagaaacataattcaaaggcaaagttaccgacccttgcatcgaatagcagaagtagctagcacctggagagcaggaaagctaatatgaggcagttggtggcaagttagaagtaaatgacaagcatggtatcctagtaatgacgagctgatctcgacgcatgacatgaagtgggtaacttgtatgaggttgactccaaagatatgaactatgcgaagttctggaactgaagccccatcttcaagcgccgcaacccagtcgaagtcagctaaaggttcaaccagggacaagtcaggcgaagagaagattccatctgcaacaagggatcgagccaagcagcctagagtggcgaagttttgctaggcaagtttgttataaaagacgcgacggaagaagtcagacaagaagagaagaccgcccaacctatcttcttgctagcctcctcgaatctcggggacgagattcttgtaaggggggtggatttgtcacgtcctcataaattcatcccgaaataaaaatcattttctaaaaggaataatagaattaattaaaattcggaaagaaattggcaaacactaaaatacgtacaagaaaaattcgaatgtggcccggagaatttttgttaaattctccttggtctaaaaagagcccttaaattttacttgaattttcagagcaccggaaataattattaagcaacaaaaacaattatcaaagtttattaaaaagaaaaacctaaaaaataatcctcttcctcctttgggccaagcccagcccaaagtctccctctcctccctctctttctctccctctccttctctccctcctcctcttgggcctcctcccctcccggcccactccctcctccctctctctcccgggctgcctctccctcctctcctcctgggccggccgctcggcccaagccgcgccccctgcccgagccgcccctccctcccgcgcacgtgcgttgcacgcgcgctgagcgcgcgccccgcgtgggacccgcctgccaggcgtttcttcctcctcccgcacagcttctctctcccccgtgcgaaccctagctcgctccctcctccaaatccgcttgattcacttggttaattccaaaattgattagggggttttaatccccattgattcctcttcaatttcccccaatttcccccttgaatggcgcccccaatcgtcgggaacgcccgcgttttctccggccaccaaccatggccgccggccgcctttaccgccgccgttccgacctcccccgtggccgtctccctcttctctcctataaaatgcaaccccctcgctccgttctatcgctttagccccctcccgcggtctcccatggtccctagccacctccccaccgtcgccctctctctcccgtgccgctggacgcctccagccgcccctaccgccttgcccgtgcgccggccggccgcgccgtcgcctcctccagcgtcgccgccacctcctccaccccggcctgccctccgtttcccgcggagacccccggagctgccttcccgccgtcgcccttctctttcctccgtgctggccacctccagccgcacctcccgcctcgcccgtgcaccctccggctgcgccgccacctctcccggcgtcgcagctgcctcctctttcccggcttcgcctccgtttcgcggggaaatcaccggagacgcgtcctcaccgacgactagtggtgtcgccaccactccaccatctccagccatccctgccgcctcgcctgagcgtcggccgacgtcgccgtctcctccctcggcgtcgccgcatcgccctccaccccggctgctcctcggtttcgccggaacgccgtcgccgcgccggcctctccatcctcttcgtcgccggcgtcctttcggccgccccttcctcctccccggctcgtcggcttgctgcaccactaccacctccggcatcgcagccgcaaggtcgtcctcggcatcgtttcccctccatccaaacccctccgcggtccatcatcgtcgtctccgatcgttctcgtcgtcgacgtcccgtcggtcgcccggctcgtcgtctcgcggcgccgcctccgtcatcgtcatcgcagcggcgtgttccacgtcgtcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagtgagccgccgcagccccgtcatcgtcttcgtcctcggctccgcatcgtcaagcctcgtgccggccgcgtctcgccttcgtccaaggatcgccgccgaagtcgttccctcgcctcgccgcgtagtggtaaggacctctccctcgctgccccgtcctcgtcctttcggtgtcgccccgtacccgttgtgcggtcgtcgaccccggtacccgtgtaccggtgtcggtagtcgttcacgtgtgcgggtggtgaccgtgtagtgtccgtgttagtgtgttcgctcggtagccgcgtggtttccacgtgtgcagcccgcgtggtgtctagtggagtccgtttgtcggctactcgcctcggttgacacacggggtccgcttccgttgacccgtggaccgtctctgtgtacccggtctaccgcggtcctttaggttgacatgtggggtccgcatgtcaacagcgcagccttcctgtctcttccaggctagcgcttacacctgttttataattgcaaagcttaattataataatccgcaaatctccatataacagcattaaacctcggatgatcatatcttggtcatacgaactctgaatcgacccgttcaagtctcctaatgtttgttataacctaaagaaccctgtgctttctttttatgtattgttattgcttctttataggcttgtagctttgcttgtgtgcttcgcgtagctttcgtcgttccggaggttcccgaagcgtggttcgtggtcgtcgccgaaggttcggaaggccgttctctctgagtaaggcaagtcacgtcatccttgaacatattgaatcccagtttataaaattatgttgctttaaattattgcattatcgctttatttaaattcccgcgttatcactgttttatctagccatgcctatttacctttgttatgaccttattattgttgttgttattatttccttgttcaccctagaataaacaaaaccccaactagtgggtactctatttatggttccactagtatgaacttaggtagatgcttcgctggttaattaggcaacattaggtggttttataactttagactttgggaagtctcatatcattcggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtcttgtgggtaaggcttagtttgtggctcagtctggttataaacaaaagtacacggatggaggtggatgaagtcgggggtcgatggacattctccagggcaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgattagagtataatctattcgaatagccgcgccctcggttatgggcaagccgagcaatgtacccaagtcagtgttctaattcttaaaatttgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggattgtctttataaaatggctttgggcaactaagtgacttttaaatgctgtttactgcaaaacttaacccctatattattatccccttgtactcccttgcattaattatgcatctgccggtgtggcttgctgagtactgtggttgtactcattcttgctcaatctttcccctcttcagtaagagaagcgttggagaagatgtcttaggtggagtcctggcttataccccagttgagcgcctgtgaagatggagccgtaggcccgctagtccgctgctgtttatttttgattgccaggcctgaagcgcctttgtaataatgtaaatattatcgatataataaaaatgtgtcttttatatcatgtttgtgtggtgtaccccggcttttcctgggacggggattaatacactagcgttcgggaaaaggcaattttcccggtcgcgacacgtactcaaaccaaaccgtatgtttcatgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttcctgtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacatcgttaccatcagcagctatttcctccttgcccgtttgatttgcttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgtttcacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcataacctcccctcttttttgaagaaattttgaagcttgctcgggcagctggaggaggaagaagacatatatataggggtgggactttagtcccggttggtagcaccaaccggggctaaagatcaccgggatctttagccccggttggtgctaccaaccgggactaaagtcccacccctatatatatgtcttcttcctcctccagctgcccgagcaagcttcaaaatttcttcaaaaaagaggggaggttatgccaaaatttctattgaatttattttggtgattacatacaaatcggtaggtgcctaaaaggtttgcaacttcat

SEQ ID NO: 77137 - DNA, 1992 bp, Oryza sativa
gctcgctttctcgcaaagaacaccatactttgtggagtctcagttgctctatattagcagaaggcaaagcctttttcccgcgctttattaaccaggccagatcgagttcgtgtcacatggtcttaaactcttcaatcttagtacatcaaaccagacacactgtttaaccatcagctcatcatcaccttactcatgagaagaactaatccagagatacggggtaaatcaaacgcccaatgtttcggaagctgcagaggagaagaagtagagagtactatcgctcagattctttggtgctggttcgtcactgcgtcttcttcctggcgtccttggccatgcccctcttgcggatgccgacggacatgttgaggaggagcctgtccacgatgggctccgggaacgcggagatgaggaaccacagcaccgcgtgcggccagtagggcgtgcacctcggctcgtacccgatgtagcgcacggcggcgcgggcgtacgtctccggcgacggcgcgaagaaggacgccttcttgatggacgccatcttcgtcgccgcgtacaggggtacctgattatgagttgcgcataaaaaaaaaaaccatccaagtcagtcggtgctcgtttctatgaaaattaacttagggcacccaaaaaaaaccattaacgcgtaattaattgaattgaagatggatttatatgatattttaaatcaacttatacatatagaaagttttcataaaatgcacaatagtttaaaaaacgttctaacaaaaactaagataaaatatgtatcttaattagaaaagaaagagacaaagattctgatgcggcagctaagacaatcttgataaacgccgaacagctgacacacataaatggtgccagataacgacgttcccaacagcgacagcgaggatgtaagtaatggaaaatgaaaaacaggtagaggtcggccaacagatttgttttaaatagggctatatggaattctcctatcctcctaatgcttcgctgcatgttatgcccattaattttccacatgcactgtttgcctgccttaggagcagttggaagaattgaaagcacggtagaagtgcatttagctttcagccatgaaggtttcagtttcttgttggggcgttatgtcatcatcgccatggccatccagcagatcgcggaagtacccaatgtagtacaagttttttttttttaggacagcatggcaaaaccatgttcatgttgaaaggacatttcttggattactgtataattcaggtgatcactgaccatataaaaacttctactccatagcccataaacaaaaatgtaatgattgcaataacggcttcgtgcaacatatgaaaaaaaaaatggatagcagacaaccgggaacaattagagaaattcatgcatcgtcaggaatggctatttcgtacctggcattgcacatcgatgcctttgttcttgtactcaacatagaggcatctcgagaattgatcaacatacctgaaaagattgaaaacagagttgcatgaatcacttaagcccacatatgaccctatgttgagttgaattcagttatatccagttgtagctggatgtcacacaattgtgctgcggaaaatatctatgcaaagattaaccaatgaccacatcacaaagcatgaattccacattccactagtgaaacatataaaaagcgtgcaagaaagagaaccttgtggatagctaaatatatgtgttgcttgccaaagtaaaacattaaacaacataaacatgctgtcgtatacattatcaaacacagagcaaatgatcaagcaactacgttttgagttcaattttcacaaaactgctggaatacttgaatatggccctgtttagttcccagaaactttttcccaaaaacatcacatcaaatctttggacacatgcatggagtattaaatataaataaattaaaaaactaattgcacacttaggggagaaatcgcgagacga

SEQ ID NO: 77138 - DNA, 2376 bp, Oryza sativa
cccctagggtggcggatccggccttcccgaagacggcgccgcctgatccgccgccgctcccgccgtctcgtcgtagggcgtcgccaccgcggctccttgctgccgtcgcccgctccctcctcgcggccgccgctacgcctccttgcttccgccgctactcccgccatctcgccatcgcccgctgcctccttgatgtcgccgcccgctcctcctagctgccgccgccgccgctcccaccgtcgcccaccgcctcctgccgccgcccaagtgtgagagagagagagagaggacttcacggcggtgaggagggggagcggcagtgaggagggatggcagtggtgccgccgcccgagggagtcaccgacgacggagggatggcgggggagtgagaaagtgagagagatagagagagacgagagatgagagatctacagagagagaggagataataagtgaggggagaggaagagaagataaggtttggtgtgaaatttttgaactggtagagagggaaggaagagggaccatttttacatgcgggccacttaaccacccgtatgcaaaaattgattttttgcatgtggctttttagatttcaaatcgatttttatgtcactatattaactcatatgaaaaagttaccaaaaacaaagttgtagaactcatcaagatctacaacttttattttgaccatttttctatatgactttgtttgaatagtttcaaattgaatttcaaaatatgacaacttcaaacaaaattttcaaataataaatgatttcaaatagaaatgtcatcaacaacaaagtggtataacttatcaagatctacaacttttgtattggtcatttttctatatgactttgtttcgacagtttgaatttgaatttaaaattatgacaatttcaaacaatattttcaaatactaaatgatttcaactgaaaaagtcatcaatcacaaagtggtataactcatcaatatctataacttttattttggtcgtttcttcatacgataaagttatgtgtaacattgttcacaaaatgtacatctgttatatagttttataaactatagagagagatatgtaaattttgtgaaaatgttacgatcactttgtcggatgaaaaaatgaccaaaatagaagttatagatcttgatgagttatacaactttgttgttgatgactttttcaactgaaatcgtttattgcttcaaaatcggcgaccagcggaacagggagcggaggtctatgcgtttggcggcgagggccctcgttggtgggcttggcaacggcataccaattccatcccctttggcatcgagtcattgtatgtcagccatggtgccttgtaacaatgaccatgataacgacggtggtggcaacaacaattgtagtaacaccaccagtaccgaggaaggcttgtggcggcgacagtgaagttcatatattaacctcatgtctaggaatcgagaaaatgatcttatatattcttggaataagtttgtttagagatttatttgtaaaataagttttttaaaatggtcaaagtacttttaaaaaataaaaaaggtatatgctacagtgctacatgtcggctgcgcacggcagggcatgtccaacgccgtgacagcaggcaggcatttgccatccgcactgcatttttttgagcgaaaaccgcattgcacatagtccgtggattcagctcatgccgctcattccatgtgccagatcatcctaaccggacataatacaatatttaggtgacatgcaagaaacgataagatacctccttaaaaattcatctctacttttcccttctcttatagaaacggcccaacacaattcgggagaatttactttttgccatcctctaaaaataccagttctcaaatgccactctccccaaatttcatttccaaataccacctgcgtccacatgtcagccggtgattattttgaaactcgatgacaacatgaggggcctcatgtgaactttttcctacagaatcgaatgacaagggccggcccaattgggcggaatccgagctagtgcggcgcctccgccacctcctccacaaaccccgagccggcgagacgagcacctgccgccgctgccgccctcaaccggcactagcagagcgcagatgggcatcgccacattgccgctcgctgccttcgcgacagggacgagttcggctccgacctgaggcctctgcatgcgcatgcgctgctttggctcgcgccatggctgctcttctacttgcgcacacgaggtgttcgttgaaatgcttgggaagtcatcgcttgctaattactccaatctgatacccttgtattatatgtcccaggggagcacgtaaccaaaacatgg

SEQ ID NO: 77139 - DNA, 1681 bp, Oryza sativa
aaaagtgtgaatatgggaattagtgatatatggttttaattgttaactgtgtgtaacaaattatcagccaagagttcctctgagtaaacaaagtatatgtactttgtcggaacaacttcaaacaaatttagaacaaaaaaaatgttgattacaacatcaccattggagtcctttgagaatcagaaagaccgagcataacccgaatttgctctatccgagcacgcttctcttttcttcgcaagttcttacgttcaccctttattagcgatacagcagtggacatatcgacattcttctcggcatcttcatcagactatgaaaacagttttaggattacagattaataaccacacagtatgattgagaggaaatgaaagatacacaatagctataaatctcagaaggatgccatgagaaccatggacttcatattaacgtatacagtatccgtaatagaagatgaaccatcatgcagtattttggtcaaacaccaagattcaactagaaacaaacaggccagagacaggatgtttggtttgtggcagaattgtgggacacatcaagtcaacattatcttccccattttcttaaaaaacattttttgaaaatctgttctaatttgtagagaaaatgtaaacgtgcctaaatcagatataaagtcctcgcccacgcgaacttagaaagattctatctagtacagccattaatcatgaacttagcaagatataaatcccaaaaatgtgtgaccaaacctaaaataattttgcatacctcttcatcatcttcatcggtctgattagcgtcatcctcgctatcattctcattatcatcatcatcatcatcttcatcatcctcatcttcagaaatttctagccattcagattcagatgcctgcataagaaaggtgagtaaggcaagttcagaaaccaatgtgaatagtaaaaaatgataacagataattttctgttatctctgattgaaataaacaacactatcagttaaacaacaaaatggcaaaaagaaggggccaatctgcaactgaccggtatgatacacttccactcatctagtttgctaaggttaagtgaatacatatcatcaagagtaatttctctatctttcaattccatcattcctccatataaatagagtgtatctttccctacagccaagcatgcattgatccgaccaccgggtttcactgcctgtaagcagcaaatgctaatgagaaacaaaagatcattagaatgtaaatgtcaacatctaaaagaacagctgcaatacctctgggagtacttcttgtgttgtcgaatcagagagaatatcagagctattgcctgagccagctttatttaaggttagactcttggtcaagtgattcgaaaccccatggacttcggattgccctccagtagtttctgagtcctccatgatctcatcctcctcattaccaagattatcttccacattgttcgatggttcttttcttttgatgtcctttgtctacacatggcacccaaaaaaaaaaaaagaagcacaaactgcttttaagcaatgatccaaatattactatataatagtcaatgtgaatatgtcgacagatcgcatatgcttattaagaaaataacagtataatagtatatgagaatatgtacatatcgtatatgcttattaaaaagaa

SEQ ID NO: 77140 - DNA, 4060 bp, Oryza sativa
accgggatctttagccccggttggtataccaaccgggactaaagttacggttggtataccaaccgggactaaagatcccggtggggcctgacatgacctgacagcattcgaaccgggactaaagatgatctttagtcccggttggtaacacaaaccgggactaaagatcaaatatgcccgttacccttttgaaccgggactaaagatcatctttagccccagtttttattgcatccgggattattgtggaaatcggccgaccgacgaaagatggtttctccaccagtgttgcctacttcaatccctacgagcagaacaccatctccgattatatcgacgacaacgagacgaagttgggtcggaacgagctgtacctgggcagcaaatgcatggaaggggcccacaagctcaatgccaagctcggcgacaacggcgacacccagttcagtttggacgagaagcaggaggtcgtcgacagcttccgcggcacccgcatgtggtggaaactgtccaaggcttccgatgactattccttgtatggacgtaagatccaacggcgcaactacatgctggtatttcacaagcgccaccgtcagctcgtgcaagactcatatctccctgaaatcctccagcaagggcgcgcgctcaccgccaagaacaggcagaggcgactgtacacccaccacgagaaccatatgagcacgtggacccacgtcccgtggaagcacccggcgacgttcgacacgctcgccatggaccccggcaagaaggatgagctcatagaagatctcaagatgttccagaagggaaaggagtaccactccaaggtcggcaaggcgtggaagcgaggatacctgctatacggtccgtccggaacaggcaagtccagcacgatctcagcaatggccaactttctcaaatatgacgtctatgacctcgacctaacgaccgtcacgaacaacaccgacctgcggaacctcttcctccagacaacagagcaatccatcatcgtcattgaggacattcatgcgatggaattggaggataaacgcatgagcacagacttccagtggtactatgaaagaaagaaaataacgctgtcggggctgctcaactttattgatgggctgtggtcagcatgtggcggtgagcggatcatcgtgctcacaaccaaccacgttgataagctcgatccgggactgatccgccgggggaggatggacaagcacatcgagatgtcctactgccggtttgaggccttcaaggtgctcgccaacaactacctagacatcaccgagcacccattgttcaccaaaatccaacgactgctcgacgagactgatatgacgccggcggatgttgcccataacctcatgcctcagggcaagaggaagaggaacacgaacaaatgcttgacaggattaatacaaaagctgaagaaggccaaactggaatctggaacgcgcctctcccgaggccgagtcctaccgacaggccatcaaggtataatctaaggcagaagagagctacaccggggaatatatgttgagtgggatcgatgctggctcttgtgtggtggggaattgcctagcaagctagctagctgcatctttctgtgtttttctgttacaatgcattttcgtgtttgtttagtcggttaaactctgcagagtcatagcctaaataaacccactttaattaccacttaccagtaatatgtactgcaggtctccatcctttttaatttgcgtgtgttaggagacgcacaagtgtggtgtgtgataaataaactggcgagtcatacataactactcagtgtaaaactacttatgtaccttatacttcacgttctagaatttgtgttctcaaccttattttgtaaaaaaactgcattgacggacgcttttgtaatattgttattttattgtaacacctaattaacaaaatgtagttggagtttaatcttacttaattacttaagatcttagcctaaacatgatcacctttgtttaatgcgaaaattgatctaactgaccttatttgtgaagccattgaagccggtatttggtttgttgttcgtccttttgctttttctccttcttcttcttcttcttctctgtactgattttctattgatgaaaaggaaacaaagagaaacctcatgaacccctttcagtgtcaaatcgatccggcgattgatttagggcttagggttagagagagagttcaaactcgatcagttgcctcttctcatctttcttatacaacgacactggtggggcttgattagttttgaattatgttttgcaccgatcacacaaaaacaagatcttatctctttttttttctttcttgattgggaaggaaactggtggttgttgattgataaatttaacaaccctttatccatgatcttatttaatactttaattacacatgtattgtccagaacattatcttaattaaactcaatttatgagcctttcgagtatggatccatgagtagatgctcagcttaataattcgattatgggacatatcttttacaaccatatcaatgagttaggtagaagacacacaacatgttgttaccataattgaaaattgtgttttattggtgcacatctgtagacccccgtttttataacaggaatcaatcgtgtaaacagtaccatttccctggatcaagtagtctggtacacacgagttcatagccggaataccaaatgctcatacacgagagtctaataccaaatgctcatacacgagagtctagtacgaattattacaacatgagcccgcaggcattgtcttaaatcatcggaccgagcggtccggaatacaaccaaaagcagagtttagataaggcagcggaatttaggcagcggcatgccattgccacaggcaacgaccgtactaagacctattgggcaccgtcgtcttcatctctctcctggtagtaggcatagggatcctccatagcttcatctcccgtttctgattaattttatatttgcaagggtgagtaccaaccgtactccgcaagccaccacagcaacaatacatatgaaaggggtatttcaaaggatggctatggttcttttgcgcaaagccaattttgtaattcttttcacaagcctaagacctagcatcaactgatcaaattttagtaccagtgtttgtatttaaacaatgacggttatgtccaccatccattgtgatcccaaggatagcttcccgccattgagtcgttatggttttctgaggacgtccactttcccccatctcaggaagtgactccaacagcataaaaattcatcatgcgataacccatcccacacaagttaagaattcagagtctagccaagtgtaatacatgtcccggtgctcaataaccgcgagcacggctattcgaatagatttggtttactcactgtcacgaccggaaataacccaacgggcattccttacgtgcgtgcattaatccttgtcccaggaggcaaggtacaccaaaagttgatacaattcagagtttaacaagcggaagcgtatataaaattattacacgggcagcgaaggcccaacacacgaagacaaacgaggaacagcggaagactagggcgacgaccacaggcgcttgacggcaggcacgagctagacaccgaagccttcatcttccaggaactcctcatctgggcttgggaaaaattgagcaagactgagtacaaccaccgtactcaacaagacacacccacaaatgcagaataaatgcaagggagtacaagggaattataacataaagggttagggttgcagtaaacagcatttaaagacatttagttgctcagggctattttgtaaacacgatcttagaactatgcaaagttgttaatcaaggccgtgaacccacacgaacctgccttaacccaaggcctacgatgattcagaccgaactggcaacccgaccctgggtcccagctcgtcctaagccaacccaggccaaccattccacattttagttgttaagcaagttttaagaattaaaacactaacttgggta

SEQ ID NO: 77141 - DNA, 674 bp, Oryza sativa
attcctgcagcccaccatgtagtggaaagaaaaatgcacttggctgattctcatgttaccacacggcttttctgctccttgaactaaatgttttgccagttactaccgtggctatttttgataaccgagtgcagtgtgcaacagctcgggttttgtgtaacttacaaaccccagttaccaccaccatatagtagtaatttatccttcaggtatcgtaacaatttctgcacagaaatttcacaaacttttagagtctgatctgacctgactccatggaacatggatttaacggactggttgtatttgcaaaaccaggcgttgcattgtcatgacgcgtcaaaacctgcatcaaatcaagtgacaagcaaagaatgtcccatcctgacgaggtaggttagcgagcgagtttgccttatcatgacgagcgatgttgcattgcaattgcattcacatagtgttcaaaacatgcaaaattaggtaaagaagaatggttagggttagctcatatagctgcagaatctactaatttgtacaatgtagctggtaattacagggaaaggttcctcttcactagcatgtccggtacaaagtgaaaaaacagcactgtcaaacattatatcacggagtgcgatcatggcttgtcatttgcgcttctggatcttcatctctgacgt

SEQ ID NO: 77142 - DNA, 1119 bp, Oryza sativa
tgtaaaacaaaatctatacacatccacaccaaacactgtacctaaccaatcatcttcacatcctcaagttttcatctactcctcgtcgtctctaacgaacatgtatctcacatgggtctgtgaatcggtgagagtctgaacaccgcaccgcacgtacgcctcgcatgggatcggtcgaccagatgagcaggcaagatcgtcgccgcgcacatgcgacggggaatctcaatccaaggcgagggttttgcatgtgggttccgaggctgcgtggcaccgggagaggcaggcttaattagcttcagaaaaatggagagattcccaggcgatcaggacaagaggttaagcattctcccttagttatatcctgcacacgttcgtctagcatctgggtgaagttctccggagctaatcagggatcaggagatggtaacttcatgattagatgactcagcatctaatgtcggctagctaacttcataattaggacttgtcatcaatttgatgactcagcatggagtcttaattatctttaggatacagattggttatagttttatccttctctataaactgtttttctttttagatcggagtttggcacattaaccaaattaatccaaaaattttgctcatacattcaaatcagtaaatgtttcacatgtagtgaactaaattttttttttattagaaccaataattttgacaagttcggaattatttaatccataatcatgggcaaacatataaaatgtacttctgaaagagtagtaggtagatgaaatgttgtattggaaatttaagtttttctgaatgccccttgatttttttttccatttatatttctacttgaataagagcgagaaatattttctgtttatcaaatggtgatacatagtgcaatatggtcaaaacatggtgttgtattttttaatacaaatccctaggaaagaaaaggagtctaatccaccaatcattttacgctttttttatccaattagtttatatttgttctagaaaagaaaagtatggatagagatgattttctattgtgtgaaacactttgattaagcatattttcgtctcttttttggtgtcaatgactaattatggggtgcagga

SEQ ID NO: 77143 - DNA, 3455 bp, Oryza sativa
  unsure (1)..(3455): unsure at all n locations
ggtgcacgtgctccaccacttcgacggccgcatgctcatgctccacagcgccgccaacgggcggtacctggcggccacgacctcgccgtgggcggcgaccgcggcgcggttcggcctcggcggtggcaaccgcgtcaccctgcgcgacctcgaccggctgccgatgttcgccgccggctggtttcccatcgtgtcggcatccggggacgtcctgctgggtcacgctagcgaccgattcctccgagctatcgacagaggggatggcaatggcgtcaccgtcgaggtgtccgacagccgcagaccgaacacgccctgggtggtggaggccatccccccgatagaatccatacctcgccttccacatcttgtggtgagcgcgtcatgccctgttttttcgatcctttcttaactgattgcatgagttgggttctttggggatcaattgctgatgctttcttgaaccagagcttgcagattgtggcaagttgagttagttttgctcttctgggcgctattatttggttctgatgttgcgttgtttctgcctctgttgctaatcgtgcgtcctgagttgttcatgggaaagtaattcttagtagcattagtagcatttgggggtcatggtgtcaattctatttctgtatgatacattcgtagtggggagcagttcttggttccatcaggttgccatcttggttcttcagttcttgcttgtccgcatttgcttccttccagggtgcagttcttgggtcacaaattccattttcggttccgtttacttaaattttctgtccgctctatgaattttccttttccaagattatttcagtacggttcttgaaaatggcaacactacctgatcaccattgccgttctttcttaatgtgttcttggtcctcggtcacacagtgtgtgatgaattcttgcaaattgtaatgaattcctttgtgccatcttctttgctgcagggcataggacacattgcacgggcaatccggttcgtgcgagcagagcgggcatctactgatgggacctttccccatgtcgcctgggcttgtttcgagttcaccgggaggtcattgttcaatctgaggacggagctggcgcgtaggttgaactttgcagtggtctccgatgtcattatgtgtgttcgagcgggcttgtttggacggctgactcctctgatcaccgatctgcctcccaacaatgtgaccatggagatcatcgttgtcacggctgggacgattggtgagatttcgtttttatgtacctgtgtattactggttatcgccttctcttttcatgacagttctatagattacatgctcggtattccatagtcttggttagtcatactgttgctgcattttccctgacaacttttgtattgacatcatctagttaaggagaaactactgactactgtactgcttttaataaagttctatcacttgtcatcaaggaaactgtgcacatgtatagtaaggagaaacttatctgaatgttcttgtagataaggaaagaaagaagttgagtgaaaataagtagttattaagagtttgtcttgtggattttcagtctgtgtacagatgctaaatatggactgaaactagtcatgtgatcaggaacagccattttttagttgcatgcatagtacatactcatgctcaatcttgatatggataagactggttttatgcatcctcagtttgaataactcggttgctttttttttctttattttgccctggtattagtgttgaggggtttaatcccagatcatctcagtcagctcttgtcattatgagaaatggggccttcgatttaagacattcttacatgccttgtgcctactctaaccgtaaaagagttcacttgtacattagtaccatatcaagatacaatgcaaacactgtttccattaagagcaattttacggtccttaatgaggtaccatgaagtaccattttttctattgtaaatttggtacctcatggtacctaggtactatgaggtactaaaatttacactaaaattttagtacctcatggtacctcctcaaggaccgtagaattactcttccattaaatcatgcttccggtttctgctcactatgctggtttctatgagtttttcattttcttctttaacaaaagggtgacccagatgtttacatgatgtctgaattgagcggcttgcgagttacaatatctgtacctaactgccttattattttgtctggtccttttgcaaattcagatgccaatgagttgagattccccaatgttggtgcagtctagaggaagacagaagtgcaggagcagaacatctgacagtcactcccccattcatcgtttcagaatttttttgctggctcagaccgaatgacaggagaaatcaatggaataggcttcagaaaggaaaccaccatctgttctgtttcccggttgttagctatgggatgctctgatgtcttgaatgcctgaacatcgcgttctgacatttgctgtactttccattgtcatctgtatgatatgactgatgatccatacatttgcagatgtgaaatgttgtgctcaagtctgaatacacagagctcatctgtatgatatatagtactacatcttttgacattttttgctgtgattcctgtgttatcattgtgtttgatttcccttatgtctacaccaaaaagcagtcaacatcttatccagataaatagtggtggttggttataaagatttgctgcaatgtttctgactttggcaaattattttaattccattcacttatatgtattgtgcataagagtaaatataagatcaaacctaagcaaagtcagtttagtacttaaagtcttaaactgcatgcggccgatctggagtttgtgttctgttgctgccgatgcctttcctcacaaggcgatgggcggattgcgcgcgccngccggcgnccggcattcgncgccccgtcggcggggttggacanaaaacccgatcccgccgttggggcgtcggcaccgtcgcaagagcgccgcttgntgggggcctccactgctttntcttgctgccngcggcgacaaggatgaagctctgttcttaacttcgcacacgaggtgttcgttgaaaatgcttcggagtcggttcgcttgctaatcaggttgcttcttgatgtcacagggaaagcacacatatcgagcatggcattcacgggcgcggtggtcgtggacgacgacgccggccgcgccgtggtgagcgcgtgcgtggcgtgtggtgcaagtgcagcagctagctctcgttgcttccggcgaaacgggcatgacgtcatccagcatgtgggaccagcgggcccacctgtcagaggagccggaactgcggccccacctgtcagcgaagggggacaactcctttaaattgcggccggcttggcgctgacgctgagagccccgagccgta

SEQ ID NO: 77144 - DNA, 1709 bp, Oryza sativa
atactcctccgtttcaaaattagtacaattttacaccgtttgtctaatttaattttttttataattagtattttatttattattattattattagataataaaacatgattagtattttatatgattaatttttttatatataaatttttaaataagacggacgacacgtgtaaccacggctaggatggagatagtacttattaacacatggttcccacagatacatttttttcaagtgctacattaacgccatgtggtataaaaactcagtcaaacaaaacacttaggctgtgtttagtttagtgcaaagtttggattttggttgaaattaaagataatgtgactgaaaagttatgtgtgtatgacaagttgatgtgatggaaaaggactgaagtttggatccaaattttggatctaaacacagccttagacgtgttgttagcaacatctaaatcaatccgggttgcaccagtttaaagagatggacttgaatgtggcatttcggttcaagttcaaaagtcagactctgggtaaaatcgagggacgtaaaataaactgcattatctcatcatgtaggttgttaagctctactgaattgattattttgttggtgaaacgaaaatgtgatgttggtcaaagaaagtagagaatctgatgcagatcgacggagcatacgttgcaatgatacaaacaaatatgaagttaacgatggtcgaggttaaaatgtacaatgaaagagtgtagattctaagtacgaactatcttcgatggctgtgaagctatgtatctgtggagctttatatcgaaaacaactccaatcggcaatagcactatagcagaaaaggtgatttcgatggctagaaaaggtaggtttctagtccaatgtggcatgtgctgttcttgctatggacttctccttgccgcaaatgacctcactttctatttcaggccctgcaaaaacagttaatcagacatgaatatttaaggaagacattaaaatttctctattttgctatattcttgcttctaaagttttgtatggactagaatggatcgaaaaaggtagattaagcccaattactttgttttgtcatttacttcaagacccttcactgtacatagaaaacacataataccagggaccaccactgtacataattatggaccagcaagttcgtcactttcaggataatgtaggacaaatataacacagtaggaaaaacagaacaagaaaaaccttgaacagaactaagaaaacagtgacaaatgtgaagattaacggcacagtttttttgaaaaccagagctaattagagctaaaatgtgacatacaggtaaagcaacaatcatagaacatcaaaacagaagattcagcatgatataatcactagacactttaacagacctgtagtaggctgtaccaagttttccaccttccagtcctaccaggcctcccgccttgagagttctcttactgaccctataataccttgcatcaacttcttcatattgaaaatcctcatcagaaaagtcatcacacaacacatcaaaaacactatcaaccagcactccagaactgtactcaaactcatcatcggagctaaaattggtaaaatcatctaccattgctgcaaaagcggtaaaatgtggttaattttcatgcaaccgataataatgtgtaataaaaacagtgaccacattagatagcc

SEQ ID NO: 77145 - DNA, 3776 bp, Oryza sativa
ccacgtgggtaaaaagtggcaaatagttataccacctctttatctttataaagaaaacccagaaatatatttaagatgggtatttgaataattgctaaatctaaaagtgacaaatggttaaattccccggacaaaaaccctcccttctcccccaaatcacacctgattcgggggcgccgcgccgcgaatcgctcctcctcctcctctccggctctctctctctttcctccatccgaaacctccaaaggcaggcgagggcgagggcgagggcgagggctatcaatggagtcgcgaggcgagggcgatggcgaaggagcctcaatccggcgagggcgagggcgagtaatggggtcggagggcgagggcgagggcgaaggcgaaggcgaggaggtgaagtgggcgatgctcttcaccctcccgatcccggtcaccgacgaggagcttcctccgaccagagacctggccatgagcaagcagccgccgccgctcatctcctttctctgccttccgcagcggagcctcggcgaggccgcccactgcttcgttgagatagtctgcgcggattctgctggtcggcttctcttgagcgccaagccgcggccagcaccggccgcaaccacctctgctgctctgcctcctcgtcaaggcgtcatcatcatctgcgacgccacaaacctcaaggtcatgcgcctcccgctgccagtcggcgcgacttgtgatgacaacgagcgcgggttcccatgcctggcggtactcagcgatccgcgcgacgaggaggatggcgatgcctacatcgttgttctactccatgcggacgcgagcggagccttccaggaggttctctgctatgaatccaagaccggaggagtactcgacacacagacccatgaccaggactggagcgacacggagacccacgaccaagactggagtgagaagttgctgtcctgcaattcgcagcagccaccgaggggttggcacagacacagccacagccaccgtgcgatacctctcgatggcgaggtctgttggattgatgctgcttatggtttggtgctatgtgaagttctgttggaggatcccaggcttcggtacgtccagctcccagaaggctgcacgatggatgaagacgatgacatggggtcgcctgctgttgtagagaagcttaggagacgttgtattggtgttagtgatggcaaacttagataccttcagatagacagttcaggacagtcgattgccgtgtggaccttgatgactcttaaggatgtcacattttgggagcatacattctcagtcgatttagtatctcttcgtgctgataagagtttccaggaagcaggactgaacccacacatattcccctcagtggcaggcattcatcctatcgacactagtaccattttcttagtgcagaactcaatcatattttctgtcagctcagatacaacaacttcttctatcaaagttggtgatcaccacaagttcctgctcaacgagaatgagatcactccgagtctgtttctccttccgtggctggttcatgacccagcagacctgcttccccaagagacaccaccgagatcaagtaagcacttctagtttcccttgtgattactacagtgtcatttgatacccccatcatatattgttagtttgctctctatattctgaaatgccaaattgtttttgctcctgccagcatgtttttatcttgtctgaaatgttagaatggctaatgtgggttaagtcatgttgcttgctgtttaggttattcaaagaagtgcctccccgaatatacactgtgaattgataccatgatactatattgttagtttgttctctatattctgaaatgccaaattatccctgccaacatgcttttgtcttctctcaaatgttagaattgttaatgggggttaagccatgttgcttgttgtttaggttatttaaagaagtggctcctcggatataaactgtgatttgataccatgagccatggtatattgttggtttgttctctatattctgaaatgctaaattgttcttgtacctgccatcatgcttttgtcttctctgaactgttacaattgtaatggggattaagccatgtttcttgctgtttagattgttcaaagagatggcttcgtgcccttaaactaaagcaagcactcaagagggggatcgtgtggctgagtgataaccatgaagttgtaactcacgttggagatgtaatagattttcttaccattcctgctggcggttcctttagatctgcagctatttgtgtcaagaaggttggttcctattgttcgaaaacagggaagatattgaaatttcacaattcgaggttacatgcaaatgatccggtcaaggcattgccaatggaagatttccaaatcatcaatgacgtggatgaagatgtcgagtcattgtcaatggaaggtatccacatcgtcaaaaacgtcaatgaagctagaaggtttatcaatcagtggattagctgccagcaaccacatagttgtataatggatgtggctaagtctgtgggtgtggaagagtgcattaatatcttgacgtaccttgggggtgaaaatgccacgttcatgctgatgaattccccgacattccttgagaaaaccggcaacaacttacgcaagtcttctgatttgaaggagtgggtctacctaaaagagtagcagccatttactggagacttatctgactgtataagaggaagacagatacaggagcagaacctctcatggtaaggtttccattttaccccatgtatggctggtcatctttttttttccctgacacagtttctatgcattaatagtcattcacttgtgataatcctttagtcttcagtttgtattttgtcctgcatcttttgtgacaaacttctgcatcgatttctttctaacagagcttggtactgttcttaataaagttatatccatttgtcctctaggaaactgtatagcatgtctggtttggagagacttacctgaaaactgttggaaataatggtttgttggttgccatacatactcatgccccgtccttgtggattttcaatctgtgtacatgtgctaaaatatggcctgaaggtagtttagtaattgggaataatggtttgccctggtatcgaaaatactgggtttatatcccaatccttggttgagaatgtttatgtcctggtagtagtgttgaaggatttaagcccaggtaatctcagtaatatcttttcagtctaagaaacaggttatttgttttaagataatcttgcatgctggttttcatctacaaatgtataatacacaacgctgctgacgttaaatcaagacccagcttatgatgtttttatatgagttatccattttatatttctatatatttattttcttctataacaagatgttttgttagatgatttctgatattgaacggcttacaggttgcgatatatgtacctaacttccttattgttttgtttggtcctctgcaaattcagctgcaatgtagatgcggtctagaggaagacagaactacaggagcctccacttgttcattcgtctcttcagaaatttttgttgcttctgatcgaatgacgcagaattggttgccttctttttgtaaagatagtagataggcacatgctcagaagccaaaaagaaagccgtcaacttttttgttttcctgttactatgtgttggccattatgccgtgaagtttacaaactgctgaaatttccaactacgtagaatgtg

SEQ ID NO: 77146 - DNA, 7042 bp, Oryza sativa
gacccgacaggtgggccccacctgtcggcgacccgagagaggaggcgggcggcggctgccaggctgggccctcggcctgcggccggcccagcaaggaggagggggaggaaggaggggaatgggccggcggcccatccgaaaagagaaaggaggaaaaagggagggaaaagaaaaagaaaaaggaaaaggattttccctggaattaaaaattgcactttagtgatttttaattggttaaaattatttctagagctctgaaaattccactaaaaatcctgttaatgaatttcgacatgtagaattcaagaaaaattccacatgtcaaacccgattattgtttgcattgttttcttagggttttatcctgatttcctctgcattttcttggggtcatttgtaatttacaatttggcttgggaggaaaacttcggggtgtgacaaacctaccccccttaaacggaatctcggccccgagattcggaggagctggtgaagaggtacggatgggcggctttcaactcctcttccctttcccaggtcgcttcctcttccgaatgatgactccactgaactcggcaaaaccgggtgaccttgtttctggttctcctttcactggtatcaagtatgcgaaccggcttctccacatatgtcaggtcctcctggatatcgatgtgttccgaatcagcctgctcttcaggtacccttaagcacttctttaactgggaaacgtggaacacgtcatggatgccgatcatattggatggaagttctagctgataagcaacttctccccttcgttccaaaattttgtatggtcccacgaagcgtggtgccaacttgcctttcgtctggaaacggtgtactccccggagcggagtgacacgaagatacacgtagtctccgacctcaaaagttagctcccttcgacggttatccgcgtagctcttctgtcgagactgagcaaccctcaatctctccctgatgattctgactttctcttctgcttccgctaatacttctgttccgaacagttgacgttcgcctgtctgatcccagaaaagaggtgtgcggcacttccggccgtatagagcttcaaacggtgccatctgtagactggcctggtagctgttgttgtacgagaattccgcatatggtaagcttttgtcccaggctccaccaaaatcaagagcgcaagctctcaacatatcctccaagatttgattgacacgctcggtctgaccatcagtttgcgggtgataggccgtgctgaagtttaaacgggtccccaattcttcctgcagcttctgccagaactttgaggtgaactgactacctcggtcggatactatcttcttgggtaccccatgcaaacacatgatccttgcgaggtacaattctgccaatctctttcccgtataggtggtatgtactggtataaagtgagccaccttggtgagtcgatccacgactacccagattgaatcatgtcccgatgatgtccggggcagtcctgttataaagtccattccaatctcctcccatttccattccgggatttggagaggttggagtaaacctgctggtctttggtgctctgctttcactcgttggcaaacatcgcagagtgcgacgaattcagctatttctctcctcatgctgacccaccaaaatttctctttgaggtcttgatacattttagtgctgcctggatgaatggagtactgggtctgatgagcttcggtgagtatcagatccttcaattccttgtcgtccggtacacacaatctttctcccatccagattgtgccatgctcatcctcaaggaaatcccgagcctttccgactctcatgttctttttcagttctgctatttccggatcatttacttgagcggctctaacttgatccacgagcgtaggccgtgcctccagagcggctacgaacccgtgttcaacaattcccatgttgagatgttcaagctcctgtcgcaattcctcacacatgccctcgatgcatagagcagtgcagtaacttttccggcttaatgcgtctgccaccacattggctttacccgggtggtagtgaatactcatgtcatagtctttgattagttccaaccatcttcgttgtcgaaggtttaggtctggttgggtgaagatgtatttcagacttttatggtccgtatatacttcgcagcggttgccgatcagatagtgcctccagatcttcaaagcatggaccactgctgccaattccaagtcatgagttggataatttccttcgtgtggacgcaactgccgcgaggcatatgcaaccactctgccctcttgcattaggacacatccaagtccgtgacgggatgcatcgcaatagacttggaagtctttcgtctggtcgggcaggatcaaaaccggtgcggatactaatttccttttgagctcctcaaagctcttgtcgcactcagctgtccatttaaacttctcgtctttcttaagcaactgagtcatgggtcgggcgattcttgagaagttttcgatgaaacgacggtaataaccagccagtcctagaaaacttcgaatctgcgacactgtcttcggtggggtccacttggtaactgactccacgttcgatggatcaactgctacaccctgagctgtaatgacatggcccagaaatttaacttccgtcaaccagaagtcacacttgctgaacttggcgtatagctggtgctccttcaacttctcgagtactagacggagatgttgttcatgttcttcctcggactttgaatagataagaatgtcgtcgatgaataccacaacaaacttgtccagaaattccatgaacactttgttcatcagattcataaagaatgcgggtgcgttagtaagtccgaaggacataaccgtgcactcatatagcccgtaccgagtggtgaaggccgtcttcggaatatcctcttcccggattctcaactggtggtagcctgatcgcaggtctatcttagagaacactttagctcctttcagttgatcaaataaatcgtcgattcgcggcaaaggatatttattcttgattgtgacctcgttaagtgcgcgataatcgacgcacatcctctttgtcttatcctttttctccacaaaaatgaccggagcgccccaaggtgaagtgcttggtcgtatgtaccctttctgcagctgttcatcaacttgcttcttgacctccgctaattcgttggccgccattctgtacggtctcttatagattggagcggttcctggtgccaaatcaatccggaattcaatctccctcttgggtggcatggtggtgaggtcttcggggaacacctctggatactcgcagactatgggtatgtcctccaattttctcaagttcttctcttcggcgtccattgggatttccgtctcaatctgattcaacgaggctcctttctttggcgagactagagatttgtacaccacggtttctcctttctcattggtcagggtgactgtgcgattcgcacaatcaatgacccccttaaacttggtcagccaatccatcccaagaatgacatctaggtctttggattcgagaagaatgaggttggctagaaacggtgacctttgaatttctattgttatagaagggctgaattgaaccgaagtggagctattccctggggtatgaacccgcatcggtgtgctaagttcctctcttattaacccatgcatcccgacaaatttcttggagatgaaagaatgcgttgcaccagaatcaaaaagtactgttgcagggattgagttaacaggaaacgtacccagtacgacctctggtgctgcttgtgcctcctccgcagatgcgtggttgacacgagcctggataaaccttggtccggcacgcctgggcttcgggcatttgtcagcgaagtggccaagctcgccacagttgaagcaggaccctggttttgctcccgtctccttcttggcttgtgcgggctggcctgactgtgccggtgccatcggtgggcgtggagctgtaccgcggttgggctgacttccatggtggttctgactgccactagtgccctggtggaagttgctggggttgaatgggcggtgttgacgaacaatcatggtggtaggtccaccctgctgtccgggagtgaggcgcggtcggtgctgactaccttggttggaccggaactgcgccgcctttcttttcctgtccattttgttgcgctgatcctcctgacggattgccttgtcaaccagcctctcaaagtcggcgtagtccccagatatcagttggttggtcagctcgtcatccagacccgccatgaacttctcctgcttctcggcgtcggtgcggacatcctctggtgcatatcgcgcgaggcgattgaactcatggaggtactctgtcacagtcctgttgccctgatggagcgcccggaattccctcttcttttgtgccacgaccccgtctggcacctgtgccttcctgaagctacggcagaactctgcccatgtaacttcagtacccggtgggcgggtggccatgtggttgtcccaccaagctgacgcaggaccctgaagctggtgtgtggcgaaagcgaccttctcctgttcattgcactgcaggagattcagcttcttctctatcgcatggatccagtcatttgcctccatggggttggtggtgctggagaaggtgggtggcctgacacgtagaaactccggcaacttggactgagggggagggggaccaaactgctggtgctgctgttcggcgtgctgcatcatcctctggtgcatctgctggtgctgctgttgcatctgctgcatcatggctgccatcatctgagtctggtgtgccataacttgggcaagcgtcggattctcgggaagtggtggcggaccattgccagaatcactgttggggtgcacaccatccacgcgttcttcgccgttgctgccctcgcctgtcgtgcggttgccagtcctggtgtagaccatctggagggaaaagcagacggggggaaaaggagaaaaacagatgctcaagaactaagctttattatataggaattaaaactgcaattgttctgatctgaattaaaacacttaaaaagagcaaacaaaaatccttattaagacagccatatcataggcacatgatatcgaccgtcgactgaccccaaacaagcaacctaaacacacaaactaacaagcagaaactagacaatcgataaactaatgggaaaacgagcctaatgctcggaacggctcctgcggtcggtggagtcgaaagcgtcctcctgctcgtcacctggtccctctgaacgactcctggagcctgacagatcagtctcgccgctgccactgggagtagcggacaaccaacctccggtaccactggctggacctctggcggctgatgctggagcgaaggagagagtgaacgcgggagctggagctggagctggaggaactgcgggaactgccggagctgcgggcggaactggaggtgctgcgggagctgctggtggaggtgggttcctgggcgcaagctggatgcgcacgggtgcagtcgtcctcttacggggcgtagtgcggatccggactcctcctggtgctggaagacccttcaactgagcattctccttcttcaggcgcgctatctcgtccttcagagcgacgatcctcatgagcttcccatcattcaaggccttggtcgccttgtgcaggtccgagtgcatccggtccaatcccctcatcacagcacacatgtgaccgaaggtggtgtcgttctcgccagctgtcggacggaaggagctgacgccatcaccatgggctcgacgggggtggtagcggtacgccgtgtcgtggaagatgtagtcgtggcgctcccgtagtctggccatcatcaagtaggctgcctcctgacaggcgtgatctgctgtgcctccagatgcctcgaccgccatgttagcgaggcaagtccccacgtaaccatggacctccaagcggacacggtgaggaagctcgccactgagcggcggaatcgtcgtgtactccggcgcgtcggggtagcccaccaccagggtcatgcgtgccaactctgccacgaaatcaatcatgccttctccgcggtggttgggtgggtgaccggccatctagagaagacaaaggagtaggatcaatgcatgctcaaatccaaatttaaataaagcaataaagactcaaataaaggaatcaaataagagcaaaattttatgcatagatcattttacatgagcgcgaataaataagacagactcacataacgataaaataatgagaaattagatacatattaataataacgaacaaagcataaataccttgcaacccatgataccgagctaggaccgagtgcatttcacccatcaaatcccaactgactgacgaataaatcccaataattttactaaaaccctagactgactcgttttgaaaaactcactttaaacgagcgaccaagatttttcccttgaaccataagaacagatccccattttcccggaacaaaatccaattgcaaagaacatatgcaatgaaaaggattcagagggctcttaggtctttccatttggcttgtcctacggtcaaggtcggctctgataccaacttgtcacgcccagaaattcccgaatagaattccaagcagaatgtgtattaaaacccccgtccaggaccagccggggtacacaaacgacaatgttgacatacagatccacgtcttacaaacattataaaggtcttacagaaatgcagcggaaaacaaaagataactggagctaagccttgacttgaactgcagcgggaacaccactccacaggcatcctcgacggcacggacgaagcctactcctcggagaacccgccatcggacacatactcgagctctgaggttgggggggaaaagtagagcaagactgagtactacccactgtactcagcaagtcataccggaatagaggtatgatgcagggatttaa

SEQ ID NO: 77147 - DNA, 3055 bp, Oryza sativa
caataagggattcaaatagttatggcttgagaccagggcaagatcatatcaatctcttgaaaaaaaaaggagaaacagcacaacgaatcaactatacgtcacatccacctaacaatacaagattcccccaattgtgtggcaggggatcagatccgaatagacaatcacatgatcaatagctgcacaacgaattaacaagtatacgccaaatccacctaacaacaagatacaccaatcatagcaggggatcagatccgcataggtaatcacttgatcaatagcagcacaacgaattaacaagtgaacgtcaaaacaacctaacaagaagaatcaccaggggatcagatccgaatagacgaagaaatggcaaaaatataacatacgaagggcgtgccgctggcgcaacaggtgagggcgcctctggagaaggagccgcaggtgagggcgccttggaagaaggagccgccgttgcggtcgccttgggagcgggaccagccggtgcagtcgccttgggagcgggacccgccgctgcgggcgccttgcgagcgggaccagccggtgcggtcgccttgggagcgggacccgccgcagcgggcgccttgggagcgggagccgccggcgactgagacatcacgccgatcggggaggtggccgtggcctaggcggtggcggtggcggcgcaagtgctcggcgaaatcgtgattttggcggagaagaagagatcggagaggctgtatcgctcatttataccagcgtgtcgaggataatgtgctgcggctaaatgttcgtgtttcgcaaggaaatccggcaccagcacgttgaggctaatggtctgtgtccaattgttcgtgttttggaacatccagtaatttttatggttctgatcgggctagtgggccagaaatgtgagaggtagaaataatcgaatttcatcaaaaaaaaggccatccgaatcacagaagtgagaaaaccaggagtactttttagctaaaacacagaggggaaatgcgccgtgagggatgtgtcgaaacaatactgctgctactaaatggtacggaagaatcgtaagagtaaaaagaattgaagaaaacgttcgaaaaaactaataggctggaagacattaaaacacaaatggaattaaccaaaggataaaacatcgacaaagaaaaacaaacataaacaaaaaaaaggtaagacaatgatgaaaatattttaccggttgttagatcccagatctgaagaaacgacccgtcacgaacccacggatccgacgggaccggacggatccaacggctggcggaccggatcaaatcaaacagcttgacaagaataccggggcgccgccagtggctggattggtagactcgggccttcgccgcacaagccaacccagccaggagaacgattgctgctacggccggcggcgtgggacacggccaccgttgatgcaggccacagatagcatgtcgccaagacacaccatgggaggtggccgccgtcgtaaatcaaccggtcacacatgcgcctgcctcagtcgtcgcagtcagaggccaggctcaagctggcaccatggaacggctgtagagaccaacaccgtccctcgactgtacaggccggccaaagagactcctccggcgaggccaggtacgaggccatatgtcagagacctcgccaagggctaaagccggcaacttgccggccggctgcagagaccaaggccagacgtccctccactatagaggacgggcacagagacatccctgccgagaccaaggccgtcctctgcagtcacagatacatcaccgccggcgaggcagggtgaggaggccataggtcggcagcaggcgccgaaaccaggccgccggcgaccggcgagagaagttcctgtatgagattgggtgggagacaaatgaatgagatggaaagaggcggccaggggtggagaggaaaccccccctcttgttatatagcggtgagatcccacgcgggcggagaaacctaggttcacacgaaaagcctgccactacctttacgcgtcaacaggaccctacctgtcatcctgcgtcagagtaaaaaacgggtggccattcaaacctttccaattttgcgccgtcgaaagaggtgcgatgctaaccgcaccgcccggtgacgggacgcctccgcaaccaccagtcgacacgcaattaactaccccaccacataacgcctcccccacacagggtcaccgtgcagtggggccacgagcgctaaagataaacgtggtggggcccgcttgggagggtggtggggaaagcgaaaacgagagatctgggaactctacaccacccacccgacacgggaatcccacctgcgtttatcttttcagttttttattagtagatttttatttatgtagtagtacttctctctgacgctctggtcctagctgtcaattgagagcaagtttaattcggaccactagcttcaaattatctatagtcaatttaataactaatttatacaatagttacatattacactattgataattagtctcaccagtcctacacacattacgtcttgaagtccatgctacagctgactataaatctgtagcctgatatttttctctctcctcttttatctctttaaaatatgtttattgctggtttatagcttgctactcttgctatggtagatgctgtgaaacatagtacttctacagtaataaaaaaaaaggagccccccgagactggctcacacagccagctgcagatggaccaatcagctgtagtagtaaaaaaaatttaactcgccgcggtgaaacggacgggtcggttgggttgtcacttgtcgcgccttttgaacctttgaaatggcctagcgcgacgtctcgtgtgctttgctggaaaagacggcaagggcggcagctttgccgggcacgcccgtcaccttcccctggatttttcacattttggtccttttaaaaaacttatttcgtaaatagatccctagaaaaacttatcccaaaaatggtcatttttggggcgccagagtggctggtgtcgtcggacgg

SEQ ID NO: 77148 - DNA, 15984 bp, Oryza sativa
gaaaaagaacttcttttaggattttctttttataaacctttttaactttgttcatttcttttcaattattatttgtgctctgaaaattccactaaaatttgtttaagcattttaggcttttaggaaatatacaaaaatcctccaagcctcatttgacttttatctttgcacattttaattgttggaggctttcacattgaattttaattattctttgcacaatttcgaggatagatttttgtcacgcccagaaattcccgaatagaattccaagcagaatgtgtattaaaacccccgtccaggaccagccggggtacacaaacgacaatgttgacatacagatccacgtcttacaaacattataaaggtcttacagaaatgcagcggaaaacaaaagataactggagctaagccttgacttgaactgcagcgggaacaccactccacaggcatcctcgacggcacggacgaagcctactcctcggagaacccgccatcggacacatactcgagctctgaggttgggggggaaaagtagagcaagactgagtactacccactgtactcagcaagtcataccggaatagaggtatgatgcagggatttaacaagggatagctaagcaggttcatttgcataaatactggcatttataaacaggaattgaatgcgaaaacagttgtaataattaagcagtattaaacatccgctgtccaacgctaacccacgttgcgacaggcccaaccatccacctaaactatccaaattcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcactcccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacaccagagcggtggtattaaaccaacattatcatataaacctatagtctaggttttaaatgagatccccaatgtgtgctagttgaactaagcatggctaagcaattcctagtccaaagtctaatcatgttataacccaagctaacaaaggagcatgatatccaaaagcatggctgtaacaataggtatccatcccatagtgatattataaaacaatgcaatatttgaaagaaaacagtagagcatttgcaatataggatcaacatgttcaagtgacaggcatgacttgccttgctctgctgctggagggacctcggcgactatctcgaagtacaccggagcgtcggagggatcggaatctagcgacatacaaagcaaacattgcaaacaggctataagactactgaaacagagaacaaaaccatttttaatggattctacacatttttcttgatttactgagacttgaatgggattaaacggagctcggatgaattagatatgaattttagaagattcactgtgtttattactataaaagaaatccttaaataatttattgcgcaatattaaccagggctgacgtcagcgagggggcgcggcgccgacatgcggggcccaccggtcagcggcacggggaggagagaggaggtggcggcgcgcgggcccacgggtcagcggcacgggggaaaggaggggcggcggcgccacgtggcggccgaaccgacggccccgatctacccaagggtagatcggacggcggcgggacctcgcggccggggcgcgcgggcgcggcgcgagacggcggcgaccatggcgccggcggcgcggcgctcacacggcggcggcgcgcatgcggcagcggcgcaaggcggcgaccgaaggcgaccgaccggcggcggggagcggcggctagaggaggagcggcggctacgcggctaagcggcgcgcacgcggctacacggtacggggaaaaggagaaagaggagggggaagcctcaccgacaacggtcgacgacggcggccgacggaggacgacgacgacggcgggacgagctccggaacctcctaacgaacaaaaggagagggattagagagagaggaaagagcgtgggagggcgagagcgccggccgaaggcggcggccatggtgccacttgccggcacacgacggggatgggtctccggcggcgaacctcgacggggaaggggcggccgaggtagatctcgaccccgcgaagctaacggcggcgacggcgcgagacggcgacgagcctagcggcggctagcggcggccggagtagcaaaagcggcggcggcgggtggttgcacggcgtggaggcgatggggagctcgggagagatcggcgaaatggggaaaaagcgagagagggggacggcgatgcttaaaaagggggagagggagccggacgtggccgggagcggcgggattcgacggccgacgtgggggagtggggaggagagagaggcgggattcggttttcgaatcccggccatctcgggcgcgggcgcgaacgggagggagaggggaaagggcgcgggagacgcggcgcacgcgcgggcgtggccgacgtggcccgggagagacggaggcgtgggcgcggcggcggtttcggcgcggcggcgcgccggggatcggcgggaggtgggggaaggacccgacaggtgggccccacctgtcggcgaccccgagagaggaggcgggcggcggctgccaggctgggccctcggcctgcggccggcccagcaaggaggagggggaggaaggaggggaatgggccggcggcccatccgaaaagagaaaggaggaaaaagggagggaaaagaaaaagaaaaaggaaaaggattttccctggaattaaaaattgcactttagtgatttttaattggttaaaattatttctagagctctgaaaattccactaaaaatcctgttaatgaatttcgacatgtagaattcaagaaaaattccacatgtcaaacccgattattgtttgcattgttttcttagggttttatcctgatttcctctgcattttcttggggtcatttgtaatttacaatttggcttgggaggaaaacttcggggtgtgacaattttagagtcgttttgggacgcgacaaacctaccccccttaaacggaatctcgaccccgagattcggaagaactggcgaagagatcgggatgggctgccttcagttcgtcttcgcgctcccaagtagcttcttcttcggcgtggttgctccactggaccttgcaaaaacggattactcggttcctggtcctgcgctccatggtgtccaggattttcactggcctctccacataggtcaggtcttcgcgaacttcaatttgctctgagttggcctgctcggatggcactcggagacttttcttgagttgcgacacatggaacacatcatgcacgttacccaaggaggcgggcaactccagctggtaggcgacttctccgcgtcgagcagtgatacgaaagggacccacataccgaggtgcgagcttccctttcgtctgaaacctgtgtacacctcgcaatggcgtgacccgaagatacacaaagtcatccactgcgaattccaggtcacggcgacggttatccgcataacttttctgccgggactgtgccacctttagattatcccgaatgattctgactttagcttcagcttctctcaggatatcagtcccgaacacttgactttctccaacttggtcccacaatagcggtgtccggcatttgcgcccgtacaacgcttcatatggtgccatttgtatgctggcttgatagctgttattgtaggagaactcggcataggggagactcttatcccaagtcttcccgaaatctaggacacatgcgcggagcatatcttctaggatctgatttagacgctcggtctgtccatctgtctgcgggtgataggcggtgctgaaattcaatcgggtacccagctcttcttggagcttcttccaaaagcgagaggtgaattggcttcccctatcagatacgattttcttgggaataccatggagactcacgatcctagcgaagtagagttccgctagtttattccctccataggtggtcttcacaggaatgaatcgagctaccttggttaatcgatccactattacccatatagagtcatatccaccttgggtttttggaagaccggtgatgaaatccatcccaatttcatcccatttccattccggcacttggagaggttggagaagtccggccggtcgttggtgttctgccttgacacgctggcacacatcacatagagccacaaattctgcaatttcccgcttcatgctaacccaccagtatttctccttcaagtctaagtacatcttggtactgcccgggtgaatggaataaggactttcgtgagcttcctgaagtatcagctgtttaagttctcggttatctggaacgcatacccgctttccgttccatagggttccgtgttcatcctctgtgaaaccagcggctttaccctgtttcatattcttgaggagtccatgcatgtccggatcattcttctgagcctcgcggatttgatcgagcaaggtaggcttggcttccaacgcagccaagaatccgcgaccaactatgcttaggttcagggcttccatctgttgattaagctcgggcggaatgctacggacgttaagagtattgcaatggctcttccgacttagagcgtcggcaaccacgttagccttaccaggatgatagtgaattcccacatcataatccttgatgagttctaaccatctcctttgccgaaggttcagatctgactgagtgaagatgtatttcaaactcttatgatcagtatatatttcacagcggttcccaatgagatagtgccgccagatttttagagcatgaaccaccgctgctaactccaagtcatgtgtagggtagttgccttcatgaggacgtagctgacgtgaagcataggctaccacatgaccgtcctgcatgagtacgcaccccaatccttggcgcgaagcatcacaatacaccatgaaatccttgcgagtatccggcaagattaacactggcgaggaaaccagcttttccttgagagtttggaacgccttctcgcactgcgggctccacacaaatttctcttctttcttcaacaactgtgtcatgggtcgagcgattttggagaagttctcgatgaatctccggtaatatcctgccaaacccaagaaactgcgaatctgagtgactgtcttgggttgcttccaatcggtgacggcggtcactgtttcggggtccacagcaactcctttagcagatatcacgtgccccaagaatttgacttcggacaaccagaactcacacttgctaagcttggcatacaattgatgttcccgcaactttcccaacaccagacggagatggtgctgatggtcttcctctgattgtgagtatatcagaatgtcatcgatgaaaaccacaacgaacttatccaagtattccatgaacactttgttcatcaagttcatgaagaaggcaggagcattggttaagccgaacgacatcaccgtgaattcatataacccgtatcgcgtggtgaatgcggtcttcggaatatcttcttcacgaatacgtaactggtgatatccggaacgaagatcaatcttggagaatacagtggcacctttaagctgatcgaacagatcatctatccggggaagagggtacttgttttttatggtgacttcattgagagctctgtagtcgacgcacatcctcttcgtcttgtctttcttctctacaaaaatcacaggagcaccctatggggaagtactcggacgtatgtaccccttttctttcaactcttccaactgtttcttaacttcggccagctcatttgctgccatacggtagggtcgcttgtacagaggagtggttcctggagcaagatctattcggaactcaatctctcgcttgggcggcataccaggtagttcttccggaaacacgtctccgaactctctgactatggggatttctgacagttctatctgatgaagttccgaacttctgacagaggttgagggtgcaaagaaaacaaccggttgttccggtcctcggtacagagtgacagtgcgcctcgcgcaatccactaccccttggaattgggccaaccaattcatcccaaggatcacatccaagttctttgtgtctagaagaatcagatccgagggaaaaggaatcccctgaatttctataggaacggcagggctataatactttgctgtcataacccctccaggggtggtgatgagcagagggtttctaagcctttctacccccaactgatttctccccacgaatggcacagatataaacgagtgggaagctccagagtcgaacaaaattgtagcagggatggaatgaacgaggaacgtaccaacgatgacgtctggagttgtcagcacgtcctcggccgtcacgtgattcacacgaccccgaatgacatccttcccgccgttgttggagcggggaggtgcttggccttgctgacgccttggcttcgggcatttatccgcaaagtgcccgggctcgaagcagttgaagcacagacgctgctgaccttgagcgtccctgcggccttgaacgggctgcacagctggcgtaggaggacggggtgcacgagtcccttgctgattctgctgctgctgtggctgtgggacgcgcaccacgaattgaggtcggggcgctgggcgaggttgctgctgctgctgctgctgcgaggaggatccccctgggtagggattggtgtagcggaccctctggttagcaccctgttgattgcggaaattcgccaagcggcgcttgtgcgattccagctccttgtgcttggcttccaagcggatgctcttgtccaccagtcgttgaaaatcaggatagtccccagagactagacgaacggacagctcagggtccattcctgccaagaacttctcctgcttctcctcgtcttcccgcacatcctccggggcataacgggctagattgttgaactcatgcaaatactccatcacggagcggttgccttgcttcaactcccggaattccctcttcttgagagccacgactccggcgggcacatgggttctccggaaagcggcggtgaagcgagcccaagtaatcggttgcccctctggctgcgtagcctggaaatggtcccaccatagagatgcgggtccctgcagctgatgggcggcgaagacgactttctcctcatcgctgcactgcaccgtgtctaacttcttccccacggcatgcaaccaatccaaagcatccacggggttgttggagctggagaaggtaggtgggcggatgcggaggaactcggcgagtttagagtgttgtgggggtggtggtggagcattctgttgtggcgggttttggaggtggtggaggaaagcggtcatcatgttggcttgctgggcgaggatttgggtgagaatggcgttggtgtctggcggtggtggcggaggtggattgccttggtggttggggttgctgccttcgggttggttgccttcaccggtgttaacatttctcctggtcgtcaccatctgaaaaccccacacggaaccagcaaacagagaaggagctgacgattaaaactaaccacccacgactaccattattcttaaatttatcactgctattaaattggttcattaatgttcaagttgcttaggcaaataaaataagacaggctccgacatagatacaccacacaccggtgtaaccatgccccacacaactcaaaaagacaaacgaggaaaaacacacgcgcaagcctactaactgctcgtctaccgctgcgacgggccaggacggaaggtgagcaacagcgcaccctccgagctaccaacgccggaggcttccccctcctggggaaccacgggcgcaggctcggcacgaggggtctcgacgaagcaagtccacgccagggactgacgaacaagctcgggcctggaggtgctcttgcgggcggtgatcttctggctgcggcagacgcggcgacgcttgggacggctgatctctccctgggcgatcttgagctggtgcagctgcgcctccaacgcgtcgaggtccttcttgagctgcaggttctcctgacgcagctccaggatcttcaggttgttctccaccatgccacggcgcaccatctgatggaagtcgatacgagccgcgtcgtacgcctccaccatgcgtgccagatgcacgacggtagcgtcatcctccgagctggcgtctcggaaggtggcgtagtcgcgggctcctccgcgacgagggtggtagcggtagggcgagtgctgcaactcgtccgggtagcgctggtgaagagtgccgatggcgaggagagcggcgttctggcaagcggcggggaaggagtctccacccgcggtgactgccagcgaagtccgctcgggagagccggagaggatcactgcagtgacctcccaaccagcgtgaggctctgcatcctcaccctcctgctccgggagcggcctggcctggtaatccactccatgtggataccccaagaccacgcacatgcctcgcagctccaagacgaagccagtcatgtccaaaccacgacgggtaacgctgccggccatctacaaacaaaaacaaaaagagaaacaacattttaaaggccagattttgatgataagtgaagcagcaagacagagagagactagacagttttcacaaataacaaaggatttttatttttgaaaatattgctaaggcttgggatctacggctcgtcctagggtcaaggaaggctctgataccaacttgtcacgaccggaaataacccaacgggcattccttacgtgcgtgcattaatccttgtcccaggaggcaaggtacaccaaaagttgatacaattcagagtttaacaagcggaagcgtatataaaattattacacgggcagcgaaggcccaacacacgaagacaaacgaggaacagcggaagactagggcgacgaccacaggcgcttgacggcaggcacgagctagacaccgaagccttcatcttccaggaactcctcatctgggcttgggaaaaattgagcaagactgagtacaaccaccgtactcaacaagacacacccacaaatgcagaataaatgcaagggagtacaagggaattataacataaagggttagggttgcagtaaacagcatttaaagacatttagttgctcagggctattttgtaaacacgatcttagaactatgcaaagttgttaatcaaggccgtgaacccacacgaacctgccttaacccaaggcctacgatgattcagaccgaactggcaacccgaccctgggtcccagctcgtcctaagccaacccaggccaaccattccacattttagttgttaagcaagttttaagaattaaaacactaacttgggtacattgctcggcttgcccataaccgagggctcggctattcgaatagattatactctgatcagaggtgtacaactttacccacaagacacatctttctcacgtgcaaccacgtgccacataccaccacggtatacagacgaaagacatgacatagtttccaacccatcctagccttagacaagagtaccgacccaatcctgcctacggccggaacccccgggacaggcaggcaagactgagcccctagcagcagggcaccaaccctctgccgtatgacatctcgactaccgggccgcagctcgtgtagccttcatttgccctggagaatgtccatcgacccccgacttcatccatctccaatccgtgtacttttgtttatgactagactgagccacaaactaagccttacccattagacatgtggaagtacggtagtgctttgcaacagaggcccgaagaccggtccttaaacggccgaggtgctactatcaaaaccatgcaccccgagcccagcctaaaaccattttaggggattttgaatagagggggcggtgtgaagccaattccacaataatccaacaattccagagtatccaggtgatatgaaataattcccaagtctaaagttgtaaaaccacctaaggttacctaattaaattgcgaagcatctacctaaaattatactagggataccatgagtagagtgtccactagttgaggttttgtttgtctagggtgaacaaggtagtaataataacaataacaataataatatggtcataacaaaggtaaataggcatggctaaataaaacagtgataacgcgggaatttaaataaagcgataatgccataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaattttcaattaaaaaaaacccatttattgcgtcggccgagggaaggggcgcgcggaccgggtccacgggaagtggggcccacgcgtcagccgctcggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaccggcgcggcggagcggcgcccgagagagcggagagaagggggaaagcgaacggcggtcttcggctcaccccgggacaacgacgacgacgagaacggcggccggagtggaggaaagcggcggcgcggctcgggatgacgatggcgacggcgctccgacggtcggcggacggagcggagcggcggacggggtcggcggcaacacggcgaagcggacggaggtgtcgccgagtaaggaggaagtccggagcggcggcggcggcggaacggagctcggcggcgatggcggagagagcggagcacggcgcgagcacgaatccgacggcgagagcgagcggcgagcggcggaaacggaagagcggagctcgggcaacggttttatagcgtcgggagggagagaaggcggccggggaggaaggaaaccgaccgcggagatttcggccgccatagatgcgccggcgatgaatgcgggaaggaaatcggacgaatccgagggagagagagaggggaaaacgggggaaacgggagagggaatcacggggagtgattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagtggcgggcgggcccgcctgtcagcggcgcgcgcgcgcggggaggccgatgggccgcgggggaggagagagagagagagagggagaagtgggccgagccggcccaagagggaagggggggaaaaagaacttcttttaggattttctttttataaacctttttaactttgttcatttcttttcaattattatttgtgctctgaaaattccactaaaatttgtttaagcattttaggcttttaggaaatatacaaaaatcctccaagcctcatttgacttttatctttgcacattttaattgttggaggctttcacattgaattttaattattctttgcacaatttcgaggatagattttagagtcgttttgggacgcgacactcacactgcagtggatgtacactttacccacattctgcgactgcccaacacatgagccttgtctcaacacatgagacgcgtcacggcaaagcctttcgataacctcgcattggcagtacccgctccatgaacttttcatcctcatgcactctaggcgtacacggtttctagcagtgagaggagttctggcgcacccaggaagggaagttttacacccatgcaattaagttataactaagttcaactcaacacacgacagtcctaacaatggcgacaccattgtagagcccctgccttacacatgagaaaccactatgcatggatactgcttccgctcggctattaactccgctaggtctatccccattcgagaaatccggggtcgtttcatgcttaacttcatggctcggtccttaattgaccagggacggtactagcctttcccggataccacccaaatccaccatccgccccggtctaaaacataggtttttaattcctttcatgtcaccattatcatggcaatgtggtgctcatgcctccacatgccgcatctcaattaccttcccaaaggtaattgcccaagcatatagcatttgataaatatgaacatgcaagattctagaatagcattttctaagcaagtgtcataattgactagggactcatacgtaattatggttacaaggatttgaaggaaaacaataacaaggcatggcataaccacaagtgggatgttgatcattgcatgcaatcttgtttgtaaacaaaattaatttcgcaattgggatcaacgtgatcaaggaatagtgatgacttgccttgctcgaggtcttgtgggtcttgaccttcgcccggatccgcggctccctcggtctctgtagttacgtgcgtaagaacaatttgaattcgattagaattcaaataaaaatccaagtaaatccaaatggaagtcgaatgcgaaaatcaattctcttatattatctttactattcgcgaattagggcgaaccccattttgatttaaactattttgcgtgtataaatattttgttgtcataagtttttaatttaatcaacccgatcaatataccaatataataggctagaaatttctattgcgagctaaacatcggacgaaatcctagaaatattatacgacttaatttagtctatgattaaatataatacacggctaaaatccctagtaattaaatacgaattgctaccgttaatcgattacttatagagattacccaaaaataatccataataatttacgagaattcatacatttgtttagttattaattacatctaaattactaccgcgaattgatttcttatagagattactaagaataatctataattaaattttgcaattctacgactataactaatctataatcatactctaattattttaaattttctaaacttcccaatctccctctaattccctatttacttctttttttcctttttcttttcttccctttctttttcttttctttttctctttttctctcttctctcttttctttcttttctttttctctctcctttcctttctcctcccggcttccttctctcttcctctcttcttttctctctctctctcggcttcttcctcccgggcggcgatgacgatggacgcagggggggggggggcggcggcttaccgacagcgacggtcggcggcgacgacagcgacggcggcgcacggcgcggcggctccgaggcgacggcgcggcggcttcgaaggcggcggcgcgatggcatggcaacagcggcgcggcggcacaacgacggcggcgcgtggagaagagaaagaaggaggggaaagatggggatgggtgtggagaggcttggggatggaggggaggggtttttgtagggcgtggagaggaagaaagggaggggaaggaagagaggggaagggggagacgagacggcggtgcggggctcggggtgagggcgcactgcatggggctcggggcgggacgcgacgggcggcgacgcgacgggcgacgcaacgggcgacggtgacgagacggccgacagtgacggcgcgcggcgcgacagcggcgacgcgacgggcaggcggcagcggcgtcgcgcggcgcgaggtgcggacgcgatgggcgagcggcgcacgggcgagcggcgcgcggggcgcggggcgcgaggcggcgacgcgacgctggcgcggcgcggcagcagcgatggcgacggtgcgcggcgacaggtgacgatggcgcggcggcgcggggcgcgaggaggggggacgcacggcgcgaggcgcggcagcggcgcggcaggcggcgagggtgacggcgcacggcgacaggcgacggcgtgcggcacggcgcgggctcggcgcggctagggcagcggtggggagaggggaggaaggctaggggacatcgtcgaacacgtgtggcggccgatgaacagtggttttttctattaaaccgatttttgtgtatttcccatataaatttaattccacaattcctaatttttgcatatatgcattttactcaataattgtgttatctcaactaatgaactcaccctagattaatatcacacatttattattattattattattatttatataatttatttgaagttttttaattagggttaattattattccatcgtatttaaatttaattgatccaaatatggtcgcgacaatattttatttacttctatccacacctaatctttattttaatttatatttattttaccaatttatttttaaggtttatttctaattaactattctttactcacgattaataaacttcgagatcaaatccaaaaataggcgaataagatcagcatgatgcaattgatttaaaaagtttttgaaaatccgtatttttagagttttggttttatcggtcgaattttcagggtgttacaacatcttataagggaacctgtatggctcgggcgcccgatcatttcgagaaattcggtgacgtcagcgcccgatttacgtgcaaaaactcctttcaactgttttttctcttaaattacttatccaaattatgatccaattgcaccattaaattcattgcaattaaatcttcaaaacaagaccacacatggatatattccgacgaaaaatttttttagcttatttttgaattatttttaaatgttacacgatgttccacctggtatatcgaaattatttcactaagtagatcgaaaatgtttcactcgtttaaatcgagtgttgtttcaccttatataaaaacaatgtttcagcaaatagcgaaagattgtttcagttcactgcaacatttaatctatatatagtgaaacattataagtacaataggtgaaatatttttcggtggaacaaaaaataaaacgaattcccttaataggggtttccaaaatatgtaggtttttttgttgcaatgaaagatttcagttcactgcaacattagatctatacatagtgaaacattgtgagtacactcggtgaaacattttttgtggatcaaaaaataaaccaaatttctttaatagatggtttccaaaatatgtggttgatttgttgcaggtgggggcagatattatggtggggcctaacgacatcaccgcgcactgag

SEQ ID NO: 77149 - DNA, 2807 bp, Oryza sativa
attcctgcagcccccgtttgagtttattttttatacggttggttcctatgttctcctaagtgtgaaaaaaatatcaaaaaaataaaataaaaataaaaaaattgcatctctatgtactgtttaacttatatatgtcatttcatgtggttatattttgaattagattaagtaatttcatatagtggtagagtgcattatgtttaacatgctgatcaaagggttttactaaagaaattatggtctaattttagtgaaggtgcaaagtagactaagtggtatgctagctattttcagacttagctaagtggtagttcgagtttaaattttttttgtggttggttgtatcgtgatcctgagtgtgaaaaaaatccgaaaaaataaaataaaaatgacaccgttgcaactccatacagaaaaacagaaatggaggcggcagcgcagccatgctggcgccctcctcccttgggcggcgccagcatggctggcgccctcctcctgccacatcggttcgcgtgcgccacggtggcagaaggacggcgcctctcgttggatgacggcgccagccactctagcaccccaaaaagaaccatttctgggataagttttttcaggagtctatttgcgaaataaatttttcaaaatgaccaaaatgtgaaaaatccagtcaccttccccactttgaaaaaagaggagtagtagcttgctgattggtgttttacatttaggtaaaaaaaataaaaatcgttgattatgccgatcttctactgctgcctaatttgggtacattgttttaagaaaaaaattaaggcgcctgcttggctgtgttttgacacgtcgttgttgcctagctagcctgtctcccatgtgtgtcgccgacgtgttggacccacccgcatttacggacccacatgggtaacgtgaggccgtgataaactgggcaccacaaaggcacaaaccgaccggaccaaacaaatgtgactcgcacggtcgcaccacaaaccgaccggaccacaaaatgtggcccgcacggtcgcaccacaaaccgacggattcgcctcctcctcccccgtccgagagttgtggttggattggaccgaaggaccaaacacgatcaagcacggtatacatttttttttgtgcgaatttattccctcacgacttttttagtgaatgaccaccctgtcatatatgtttccatgagacactgtacgctcgtggacaacgctgcgaccgatagaagttcttcagctcgatgcctcgatacctctctaacacgtgaatgctatattttcatagtatattggtagtgttatttattttcatacaccaaatgtttccatgcttaattgctgatattaaaagttgccaggttctgaaaatcacgtcacacccaattatcgatttccatatgtgctaactccatacgagtaaatcccaattactcgtatcgatttccttatgtgctccagctgtagtatatacttccaaagttccaaattgaggctaggctggacccaaatactagtataaggaaaaagaaagcagtatttatatttttccttatttttctattttttttcctttctagggagatccagccaattcttctggcaccgtttctcttagctgtagctgtaggattgtcttgacacgtccttgtttcctagcccgcgcccatttgttccaccgacgagtgggacccacccgccattagttggaacaatatgggtaaggcaccacacccacaaacgggacccacacgtaacccggtgaagtgtgttcacgctttttgacacttcaagatgatacttcttcggtctcaaaataaacaactcctacaccttcttactattagagcaagtttataatagtgcagtcaattatttgttttaaatcatttataatcaattttcatataatcgtttcatataaacatatactccctcctttcaaaagtctaaatcatattcgtagttagtcactatgtgctatattattttttttatcggaaccaaaaaattattttagtacttattggttacatgtttattggttttggattaataagttaattacacattagtcttggtgaaaaagaaacaggactaaacttttggaaggagggagtactacacaatcaaactacgtgtcatacacacatgcatgttagagtccgtgctgcagttggatacaaatctgtagcacattgatcttctctctcatctcttatctcctcgaaatgtgtttatggctggtttatagtctgctattgcacctgctcttacctacccccaatatgcaaattgagaaattttattactccactaccctcacttagccatcaaccaatataattttcacattaattaaggatgcagtggtctatccttaccggtaattgtgcacggcacaatgcacgtttcccacgttagctatcgtaatcacataaaaacacttaaattttgttgcattttcctgtataatatgtcacgcgaaatatacaaatatactaaaattttaagaactatatgtactatgggagaatttactatttgccactttaccaaaataccagtgctcaaatgattgcttaaattaataaatgaacaagatgtgtggcaagacttattggaaaggaaaaatcttaatagtaaatcaataactcatgtagagagaaaacaaggggattcccatttttatctggcctgatgaaggtaaatagttacttctaaatatgggttctattccgcttaatgtttctttcaggagagctttagttggtcagaatttggtcaattggcataatt

SEQ ID NO: 77150 - DNA, 25066 bp, Oryza sativa
  unsure (1)..(25066): unsure at all n locations
cattgctcccttctgccctctaaataattggattttagagaggtgaggtgaggtgagagtacgtcatataatcaggaaacacatattggtggcagcccagagaatccaacagatagcgaggtgggtctagtgataggaaaagcacatattggtcccaggcgcccatgtgattgtctaggtacacatggaccgtccacagaaaatggcgccatcgaccacaattcagtgcaacgaaaattacgaaatgctactgtcactctacagaaaattcagttgacggctgagaattgaactcccaacttgagtatcgcatatactccgtacttgcctaaggaaaagacaaagtcgtcaatttactcagtttccaacgcttcctacaccaaacctcaccattcctcttcccactaaattacgatatcaaatactactacatcaatggcgtgtctgctcaaacccagccacgtgcacaggcctcgaaacctcccaggtgcccaccccatcgccacccccatcatatcgcgatccaataaatatatatattgtgtatatgtgcagtataaaaattgttagtgatgtgctcgaattggggttccaatttctcgcgtggtaattaatccgcagggtttgttcgattaatcaagtgatcaaaggcgcgcatggaactgcacggatcgggcattgatacgggaggagagggaggatcagcacgagacaagccacgtaccttctagatcgggctcgatctcccccacgccggagtccggcaacggcggcggggtcggcgccggcgccggcgactgcgtgggcgcgggtggcgtcaacgtcggcacgaggaaggtcggcaggaccggctgcttcaccagcggcgccggtgccagcgggcgctgcgccgacccaccgtccctgctcagttccggcacgcaccgccttcgcacccgctggagccgcaacctcctccccggcctcacctgcggcgccaccaggcacgccgccccgatccccatccccgccgccgtcgccatgatcccccctcctctccgccgatcctgctgctgctgtgtcgggcgggccgcgcttggcgggcggtggtggtggtggtggtggtggtggaaaaaaaggagtgggctgagtcgcggagacgatgagagagagagaagaggtgggtgtgtgggtttggttttaagcgagggagaggcgctgaggcggtggggcacagcaaaaacggatcgcggggtggatgagctggttcgctctcgctacgcgcgtggcgtgcgcgcgcgtcccaccgcttccgttccttctctccgttgcttcacgctaaacgaagaaatgtcatttcgccatttgcatttcacttcacaaattcaatttttataaatcacaatggaaaaataaattaaactacaactaatccttttttaaaaaagggtattatttatccgatatgtacatctaaccggatatatataattgtttaaattgaaaatttagctctcaaataactcaatctaaaattcgttcaaatggagatttgaacgtacgatcttgaggcgctaatcaggttaatacatgttctttcgcaaactataactaattaacgtatattcaaaattatttttttttattttttttgtaaaatgtagaaagttaaatttgatcatgcaatgttatgggtttgtgaagtgatatattacatcataaactatattattgaatttttttaaaaaagtttataatgacatctatacctaataaaaaaattcgtaaggtttccgtatggttttttcgtccgtcatccgaatcagaatcatgttgctaaaattgttttaatccgctcaatagtcgggatggatccttttggatctacctcaaaactaggttaatataggatatgtattaattgatgtaacatgtgatcacaagtagcagcttgcctacttggttagtgaagaaaatcttcattgtggccaccagggttcgttcccgccaccctcacctttttactcttattattacaggctttggcccatttaagtttctctcctacctattgattcatttttctttatttgtttttttttcgcttttttcttgggaaaaaaattcctcccgacgctttatctttttttttccttttttatgcggtaagttaggataataacaggtagggaattcactaaaaacaaagttcaatagaaaaaacacataaataatttagttaaaacttttaaaagaatagttgaaaatttcaaatatgtagttgaaagttttcgaaattcgagttgaagtttcgaaatcttaagtgaaagtattcaattttggtatagcttatttttttataactttttaattattaaagtaatttttaatttttagtaaaaaagagaagaagtaaagtagatggtaatactggaaactaattacgtaaaaggaaaaaaagaggtgcgaaaacagaaaagaggagacacggtagcaaccaactgtgcgaatttttttttcaatttttatccgactccttgcgcaagaggtgcgaaaaaatagagaagacaatgtggcaaccaactgcgtgaaaaagaagtctcgaaacaaaagataatataaaaaaaggaaaataggtcgcacgcgactgtgcgatggatgggctcaaaacgcgcaccacttaaattcgcgacgcgtatgcactaattaggagttttgtattattactcgcactgtctatgggcctctcctaggccagattgacctaccctacctaaaacttttacacttattattactcggaataagtctactttgtctccatatctcaaatcctatttgcgtgcaatttttttctctccgccactagcacggaccatgcacatcctttttttttctctccaccattagcacagaccatgcacattcgatggctgaaaagtcaaaagttttatacctctttcttcaacagatatttagtgattctgaaatcttataatgaaccagtttttaatttgaaaattaaacataatttttttttcttttcgtcatctgcaaaacacgacatattagagtccgcaccatctatcgtccacgcatgagctgttaagcgattcgtctccacgcgaatccgtgttggattttagaagtaatatcatgcgcgtgccatgcaagagttgagagagagcttgtgttatgacaatatgagtactatatcaatatgcaatggtgtttcttattagtcttgattatcattaacccaatgaacaatttatctatcttgaaatattattacatacatgttaaccgtgtatttatagcatttaaccttccattatacccgtagcgaagcacgggcattttgctagtgtaaatttacatatggaggcaggtgatgtccacttgatcgctttggcccgttggtttcacggtttttcaccgagtcaccggggactcgtgactcgtgtcgtgtcgtgaccccgctttacgtggcgcgttgccggatcgcgagggcgtcctctgcgtttctctctctctctctttcttttttgtttgggcttggttgtgttgggacgtgtacggtgtgtcctgtgttctgtgtgtgggctgtgtggcctttttgtcagcttgttgagataggttgtcaaaaactgagatagactttgcttgattgccttgtttttgcttttgccagcttgtttcagctgggttaacgtgattgttctagctagattttttgcagggggtgaagtgctgtgttgcactaatgatacagtggttacaaaagctgtgcacagattacaggtagtaccattggccatgagtgagagtttggttcatttgtatttttcttggaagccagcatgcagaggcctaaactatctgttgtttggctttaattagactacttaggaaatattacaatcgcatattcgcatatcaaccagctgtgaaggtgtttgttgctaatccttcattcattcatattcccagtttaatacgtgagatagaagaaccgaagtctcacgcattactctaaccggagtttaaattaattaagctttacttattttagtattcaaataagtgccaaatacttatccgcatgtaaagtttatttcattcacattagtaaatgtcgtcattgtcaagtgcttgtgacaatcatcttgtaactcaatcacgcaagtaattttactattagatcatgaactattgagttgcatgcaccgtacgtctccctcacgcgaggccccctcaagtctctagcgtggaataaaagtatgctgaaatttttatttaattgcacgccagccagaattcgaactcgagacatttagctctgatactatattaagttgcatgcatcgaccagtttaacccaaaagcttaagctgatgagtaaagacgggcaatttactttatattccaacatggaccgtacgtttaattgatatatcgagcacgatcaataatcaacaatgccacatttcggtcttgtttagttccaaactttttcttcaaacttccaactttcccatcacatcaaaactttcttacacacgtaaactttcagctttccatcacatcatttcaatttcaaccaaaatttcgatattggtgtgaactaaacacacccttcattgcatggtagagtatgtaattgaaaaaagaaactactcctggctaaattaaatcgacagcgatgggttacatatatcctaattacatactctaccggctgatcgtccgcgactggtgagttgggccacagccaatggcaccggagttgtcgtcggcgccacgacgacgagtaccaccatcgccgccggcggcgggcgtagctgctcgcaccgagtcgatcatcgtcttgatgacagcctgcgcggggaggatgacggtcaccctgtcctcccggagctcgcggatcttgtcggagagctcggcggcggtgtacgggcaccggtcgttgtcgatggcgtcgatcagggccaggatgtaggccttgttgccggcgatcgacttcttgttgctggcgacgagctcagagatccaggtgagccgcatcgccatcgcctgcctctcgtccatcgtggccagcttctctctcatcctcatctcgtcctcttccatggctggctaagctctggctgctcgtggcttctgcctgctaggctgctagagtacgtgcgtgcgtacgcgtggacgatgagtacgttgaggactcttgctgctgctgatgccgccgcgatgagaaaagtagacagccaggggtctggttatataggcagcaaggcacgcggtgagcngacgagccagtcgacgattcggagcgcggagtccgtgtcgnaaccgaaaagagctcggcacggattatgttgggctcgatctgtttagaatgtactgggctaaggcccgacgcccgtatccgggccgccgtcaggggttagaattttgaaaaagtatatactccctccatattttaatatataacgccgttgactttttaaacaacgtttgaccacatgtcttattcaaattttttatgcaaatataaaaatacgtatgtcatgcttaaagaatatttgatgataaatcaagtcacaataaaataaattataattacataaattttttgaataagacgaaaggtcaaacgtttgttaaaaagtcaacggcgtcatacattaaaatacggaaggagtacgaggttccttatcttgtcatccctcgactaacaaatccgggttagtctgtgttcctttgaaggggttgggaatccctcccctccgcacgtaaaacggagcgatagattaaaacatgattaattatgtgttagctgtaaaaaaaaacttttaaaatagattaatatgattttttaaagcaacttttatatataaactttttgaaaaacacgcaccttaaggttgtcagtatcccgattcgtattcgaatatcttacgatactacgatcctatcaagccgaaacgataccgatcacacatagaatcctaattttcataatatctcgatcctactattcattactacacgatccaacgaaatcttaggtagtatcccgatgttagggttacagataaggcataccttctatcctacgacttatggaatatacgaatatggtataccttcacgtatacggatcgttcccgtgtacgtggtagaaatccgttccaaattatggaaattatctctacgagtcaagcgatgtccaaagtcctactcggaaatgtatagagtttctgttataccgtaccagatcaaatatcctcgaatctttcttaggggtcaatacgatccacggtataaaagggaccctcaaggaggggtgtgaggacatccaattccatcgccaacacacccaccatagtttacgaagccggagtgcgcggagccaagtcgccgggagatctcgtcgaactcatcgactacgatcttatcggtatcatccgtttcgtctattctctttgtaatctgttctcaccatcatcaatctcatataaactggactatggctattacctgataaggggcttgagccagtataatccttgtcttttgtctgcttgatgttgtactacgtagacccctgctccaacgtaccccaatactcaactcatctggtccgcgagtatcactcgtcgacacccgattctacgatccctacgacactacaaaatattatttaaaataacatggtttgaaaataatgtaaataaatatgctcaaatttatataaaaatcagttaaatatatcaaaaccaacgtggtttttctttgataaatgtctctatttgcatgacatatatcattactacatttattttatatagaatggctatatataattaatataaatattaattaaacttaaaaaagaaaatctcatattattccgatactacgatacgatattactttaaacaaaacgatactacctagtatctcgatcctgacaaccttggataagttaggaactaggaggattcttagacggttttaactcggttttatctgatatagcagctgagtcagcgtggaacccacatatcaggaagaccacatcatcaccctctttctcctcttctctcccttcctcctctctctcactctcctctgggcaagtgaagtctgccgcccggcggggcgaggcggaactcctccatggtggtgcgcggaggtggaggcagggcggagcgctgcggcggcgaatgcagggctccggctgcactccgccgatttctcgccggagccgggccggagcatggcggtgggcacggacagtggcggatccagaaaatcgattcgttggtgtcataacgtgtctatcggtgtcatagtatgctaattatgtttagatcatagtgttataacatatggataaacagttttgctataggttttgccgaaagtcgtcggtgtcgcctgacaccgggtctagtactgtagatccgcccctgggcacggaggcggaggcggaggcggggtcaggctccgtggtggttggcgcggaggccggcgccacggaggtgaagacgggcgagagcatacaggcgggcgccacggcgacggaggcggggctccggcggaactccgccgtcgagacggtggctttccaccgtgctcacggcctctgcaaccgccgcctccgcttctcgcgcgttgttgtcgttgccgccgccgcctcctctctccttcctctgttctccttcctcctctctccttcctctgttctcgatttctatgtgggctcgaagggaaggctccttatgcatatacggtgttcgatgaaatgtttatcaggtatgatttgctgttttcatcgcattttcgccgcccttttgaggatcaatggatcatcagatgataatgacatgatctacactacatcgcagagaaatgatcggcgccctcgacgtcggccggttgatggatcgatgggctcgggcagcccgtggcgtttgtggccggcgcagttgcagacgaacaggaggacgcctgacagacacagcctctctggagtgatgacctcattgagcagaacgaggccccacctggtcagtgggacgaccaggacgcctctgccgtcgggcggtgacgtcattgcgcaggatgaggccccacctgtcagcgagcaggaggctcgtgcaccttttaaagtgctcgccttggcgctcgcccagagccccaagccgtaaccgactaaccgtcgagctcctcctacctgcgtctcgcgccgccaagaaacccaagatcatcccaccgcgcccccgtttccgcctccgcctccaccttcggcgttgctcgccggagcccggaagcgatggagcagttccacgacagggaccacgtgcggctgcggagccgcgtgcacggcacgtacctccacgccgatgaggacgggaggggcgtctccctgcagccgaccggggcatcgctcaccgcggtttggacggtgcacctggagggcggtagcccccagcgccgcctcctgctccacagcgccgcctacggccgataccttgcggccacaggcaagccggggccgagcggcctccgtggccaccgtgtcgcgcttatcaacctcgaccggctggacgacgagtccgtgtcgtgggaggcggttcggacggcgaaaggagatgacgtgctgctccggcacgccacggggcgcaacctacgcgccaaccatggcgctggcgccaccgttgacgatagatacagcaggatgctgctctgggtggaccaggtggttgaggccatcccctcggcagattccgtacccaggcctccaccgatctcaagggtgagcacgctacaccctcttccatggtacatcccgaattggttgggggcaggggagcgattctttagcccattactgcgttacctaggttcttgcagccaagctccatttctggttgtattcttgcgtcagagttagcgcattagcagagtttcatcaattgcattgttcttgatgaaatccttgttgtgttcttgctagatttcgtcctttgttgttaatcatttgcaatgagtttgtggcggtgagattttttgtgcaattttggcttagggggtagattgagttcatgaaagtggttgttggttccatctgtagttcttttggtcgaggtgctgaaaatgtgtaacattcttgttcttttaggaacttcttgaaaacactttcattttctgttcttgtgttatccaaatcctactaattttcagagttcataggcaggttggcatcacataaccgttgctgttcgtgttgtcttgcattggattcttcaacgtatatcctgttctctctatctcaactaatttgcggcgaatctgtttcagcgccaggacgggcctgagataagaaccatccggtttgtgccagcagctcctaatgggaccattgccgaggattggagaacctttcaatttactggaagatcagttcagcggttaaaggaagagattacaagccgtgctggggaggcaacccagtactgtgttcaagcaggccggtacggacgtcttatccctttgacacatgagcttcctcacaacactgagaccattgatatcatcattatgatgactggtactacaggtgaggagtttcccttttttattttcatgttctcctcgtatttttggtgaaagaggctcgcttgaatttgttgcactgagctaggtcaatagatattattgctgctcttactttttagttgtgcatgatgtcttaagtttgattctagtcagcaaagtgttataatcttctgcttgaacagatagtccttgtctggttagaaaaatatataaaaatctcattctatagattatatgctcaaggtagtttatacagtattgaattttgttgcgcacttgcgcacattgcactgagctaggcaagtagatacagttgctctaccatccatgcatatttgttcataatattattttagttaagtgtaatcatgtgcaaacgtatgcttataaatacaggcatttctatataccagataataacaatcagtattacattgcagatccccacatggataatagcccaagaacacaactttctgctcctgagtccttgggagaacatcgtgttgctgacattcagacatcatactcgcaccgtctgcatacaaacaatgtacttgagagtcagcaacggaaaacaggtataacacgagctgaacttgaattgaaaactaggaatatccactggggagatttgaatttggaggaaaagaagaggacaagaaaggagttgaaagcagaatacaatgaactcttagctgcagaaaattgcatcagtaaatcgcaggaagatgatgtaattacaaacgaaaattatgaaagagcgtcactccgggatccatgagtccgaggtaaggagacaggagtagaacctgaaatcttcagaattttttcgctccctcaggttccaaaaataagtagctattcagagtttggcttgttgattttcaatctgcgtaaagttgctaaaatatggcctgaagctaattttatgattgggaacaatgacttgttagttgcatgcacactcatgctaaatcctaacatgaaaaatactagttttatattccagtcttcagttaagaaaattgagttgcttcttttattttcatgtccagaccatctgtcagctccttttcagtctaagaaatagtgttagattaaggcagtcttacatgcattgcacatactttaaatataaatagttcacttgtactgctgtattgtatcatacaaataaacaatagacaactccattgccattaaatcatgacaacggcttcagtatgctggtttctagatgagttatccctgttgattttagataatttatgaatattgaacggcttgtgagttgtagtgcctgtaattaacttgtctttaatttcttgtttgatcattgcaaattcagctgctgatggtctgacgagatagaagtcacagaactacaatagcagaacctctgacatcatctcttcagtaattttcgtatcttcagatcaaatgacagagattggatgtcttcttgttgttcttttttgttgatataggcttagaaagggaaaccataaactcttctttgctctgaagtttacagaactgttgtaaacaccaagtactagaatgtatgcatgaacaactgtgcgttctggcatttgctgtagtttcctactttccttggatatctgtatataatatgattgatcataaatttgcggtgtggaatgttatgctctatttttgacaactgaaatgttatgatcaagtctgaatacaaggcaactctttcataacctgttcctgtatttttatacagatgggcggttttgatttccccccttcttgtctgtggcaatatatccatgtaacgaagaacaaagtggcaaatcctttgccacctcacctctccggagtggcaaaaagttaaatatgccatttgctgtagtgctctgaacttcaacttctgaagcaagtaagcagaatgcctgaacaattttgtgctgtgacaatcttttgtcgggaatacacaaaagatatgcgtattattgaattacatttttgtgatgtgctgtgacatttgctatagtctccattttatctgtatgataggaccgaccatccatacatctgctgaagtgaatttttaatgccaattgtaaatgcatgaggtaactctttcataacctggtcctgtgttgtcattcagaaatcaggtctgttgtgttaacatgcacagagaaaagaagggttagtaatctcggactgtccgacattagcttttcggtacaaaattgtctccccagaactacttttttttaaaaaaaaaaactctaacattatacatcaaaccttacagaacaattcgatactacctggaaatgaggcattccatgcttcttttttttaaaaaaaagaaataaaacaaaacagaacaactcctaaatcctaattacatgatcgcgagcaccatgggacgaagcgcgggtgaggatggctcgcacgtcgtcgagcatctccttgatcccgtccagcgcggcgtcgacggcccttgactcgcggaggtcgcggatctcgtcttggagctcggcgaaggtgaaggggcatgtgccgtcgtcgatggattcgagcaggtcacgcacgtagcctctgttcctggctatcaaccgctcggtgtccgcgaggaggtccgagatccaccccagctggatcgccaccgcctctctctcagcctcgttcatcatggccctatcttgaaatgaactagcagacgatgatgacgacgatgacaacgacgacgactcgcgctgagatggaacgaacgatgagacgcagcagctgagaccgggagttcggttatataataggcgccgtgcgcacaagcgacgaatcggaatggggagtccgcgtcggaatccgaaagagccgttgaatccgacacggattgtgttgggccgctttctgtaggatgtaacgggccgagtccggcgagactgggccggcacggcggataggaatgcagatgggttcaaccggctccgatcatccgatggacttttggtccgccgacctcggtggctcgatcagaatgtttttttctttctgacatctagtgagaattcgttatttagttatcttctttacggttgctagctgttacttcattttttttcctagctgttgactaagagatagtctgatatgagctcttagttaataaatacttcatccatcccataatataaggcgcccatgcatttcaagatttcatcttcataatattttgactaacatttagtacaatatgaattgaattttacttactaaaaaattatatcattgaattgacatttaaatttattttcatatggttataattttgttactacaaactttattatatatgagaaattataagataaaaattagttttgtagaccgtgtcaagtttgactataccttgtattataggatatagggagtactcacttagtgactattctcctataataatagttgagacaacaattaaattttttaaaaatgttgagacaacaaaactttttaatcattaattccccccaaaaatatattactcttctttccttttctctatcccgtgcaacaaaatatcatttaataaatgctaagattccccccaaaaaaatatattactcttctttccttttctctatcccgtgcaacaaaatatcatttaataaatgttaagagtcgcctatgagcttttgtaggtcatatttaaatgtagagcccatatagactcttagataatgcatgtttattaaagactatatccttacaatggtagagacaccaaagactctaaaccattaatccacaaatattatctttttattatggttcacacactcatgcaacaaagttttcattttatagaggctaagagtcgttaagcagttgttaaccgtagcaacaatgtctgtctcttcttgcttctctctcttccatctaaccaaattcaattgcatgttaacgtaaagagctcgttaataagaatcttgtacatgcccttgctgtgaagtttacaaactgctgaaatttcaaactactaagtagaatgtgcgcctgaacaattttatgttctgacatgcgctgttagtttcaatggttagttttttagttcgaatggttattgtgcatgataattgatgcaaaccgatcatccacccattccagaagcgaaatatacatatcgttcaaaaaagaagcgaaatatacatatgctcaattctccaattgtaaattaattcatcaggcattgcctgtgtacctttttcactcaaaactcaatttgtcccaacataagtacataggacttgaacccagaaagaaaaaagaaaatcaatccctggcattgaggtgggcccgcccctggacggctggatcagatcgacgggcagacatccaacggccttgattaaactggtcttttttttttgaaaggaaggcaagaaatttgccttatatattgatagagaaggaggattaaactggtcttgcccctgttctgccttacggacgactacggtgaagaccgtcccggactcccctgtccgttatccactccgattcgacgatgatggttcatcgtgtcgtacgccgcggcccaataaaaacagcatgtaaaaatgtaccatcaaaacgtgaaaagctgcagcagcagcaggaagaagaaaaaaagacgccggccgaatcgtcgacttggcgcgtgttccgccgattcgcaaaccccgctcacctgcaggctgcagcatcatccgcagttcccgtgtcgatgtcgacggcaggttcgtttactatcaccccaatccttcggtttttaaccagtacaattttgttttttctatataagatgtactccctccatataaaaagtctaagacatatttcattctttgtttttttaaaagtctaagtcttatttgtagtcactatgtggtaattaaattgttgattggaaccgaagtcattttatattagtacttattggtttcatgctcattggttttatcacatggtgaataaattaattggtcattggtcttgataaaaaagaaatatgccttagacttttcaatgatggagtatttggtcaaaaattttcctaaatgggttattatatctttttaaaagatttgtttcccataatgggacataatttgatttaatttgtgcgggcccatctattttatgtgcatttagctgaatatcttcgaattcgtacgagatatgttacatcgtgtatgtcttctcagactcatgacgttttccgccctacttctacaattactcgtgcttgtctatttgtccactcgtgacggacctatgtttttttttcttttgtcctgggtgtgctcacatagtcccaatcagagttattcatatacacaaacacactaaaagatcttaatttatcaaaagtacattaattacaaatagtgcaaataaagtcttacacacataacgtataaacaatgaaaacaaaatatatttgtgtatgctttttatagcaaatatggcttgattacatcatgattagtgattcatttctaatcttaggaaaagctatatgaaggtgctaatctttacacacttgatcctcctcatatttaccttactaaaaagaaaaatgctaagatttccatacaaaattcttggctacccatgtacttgaagtctagaatttacgtccccgaaatgtttatattgagtaccaaatttgaatcatataaatacttatatttagcaataattggagtaattgaataaataatgtaggtcaaaatttaggaaaaactcagtagtgtcatatacgctccccccccccggccattaccaaatagcatttgtagtattcaatttttttaatataaaataagcattttttttgggacaacgattcgccaagcattttcagccaataagatagaatttgtagcatccaatcttttatacaaaataagcattttgagaacaatgattttccaaacatttttcagctaataatatacttagaagggaaccaagaaattcaaattcaacccatgaagtgactaaaaggatatattttctcgtatatgcgtgcaacaatctaaaaagttgagaaaattttctacatacccctgaaaagttttgtaatctcttctacgccccttgaattttgcatcatcccctacatgcccttgagtatttattttgatctcttatatccctactttgttaattggctgttagatttttctaaaatgaccatatcgcccatttcccatacttacatggggtctacttcataatttacaatgtgaaaaattgttattcctgataaaatcaaacgggggcataattatttattgtaaaattcgaaaaagaaaatttaaattgttgaacaaattattttttgacaattttagctagaagttataaacaaaaattatatatttgttgggctcaaattttgatgaaaacagtgaacgaattacataaaagttaattcaaaatttatttaaaaattctagatttttttataaaatttattgtcatccattgttttaagaattgtgtttttatcactaaactagcacataagtataagagaggggtaatataatcaatttaaaaaatatttaacggtcaactcatgatcaactaacagaatgagcatagagaaaatcaaattaaaaactcagggtatataatttatgaggcaaaattcaggggcacgcaaaagattgaatgaattctcaagggtatatagaggattttctctaaaatgttaggaacaaatagaagtatttaacatcggaggaactgaaattgcgcactgcatagccttgtaatcttgggcttagcaatatgtattccttccttaaaaaaagattaattctgggtatgaacctcgacatgcatgcatcaagattcgcagttaggatataatatttttatagcacagaggtgtaaatttaatgtgactataagtttctaggcgtatacaaatcaaccaaataccagtagggtctttgattcgtgcaggcaaaccattagtcgtcttcttccttcctcgcgtcgcggcatccgccatcgaagctttgctcgcggctttctggccttcctcctgccaccggagacgccaccgccatcgccgcctcctactcactcctctaggaacctacgccgcagaaccctctcacctccctcctccaaccccgcggctccgtccaccgccgcctcgccgcccccgaacccaaatctaggtttttgttttggttcgggaaatctatggctgtcgtcaccggcgccaaagaggagggagagttcgccggcggtggaataataagtcgacgtccctccggtgagctaccctctctcccttccccctcatcccgaggttgaagatgcttcccctaatcctgaggttgaagatgatgccctggcaattggatcataacaggggcgggcccactattgattcaagggtattcagacgtatacccaagatttttagacaaaaaaaataagtatatgtactctatacctcgtatatgtattcaagaaattaaagaaaaaggctaaaactactcattttgggccctgtttcatcgtttcttctctattgggcctaaatttcccacttccctcccctttcatctcagcccacaatcagtttgggccacaactagttcatttcccctcctcgcctaggcacagcaaaccaaagccctaattcccaaatcggccaaaccctaaccagaggaccgaggacgtgcgcggtgtggcggcgaggacgtgcggcagtgcggcggcggcgacttccggctgcgtcggcggaaggcggcgccaaggcgggtaggagcctaggcagcgcgtcgggcggcggcgactgcagtctagtctgcagcgtgctcgtcggcggctgcggcagaggcttccggctgcggcgtgcgcggctgcgtcggcggcaggaggcgccgaggcgtgcaggcggcgcgtcgacggctgcggccgtgcggcgttggggctcggccaggcgtgcaggccgccagtccaccaggccaccacacaggtacgcgatgcggcagccgaacgaccacggcttgccggcctggcatggattgcgtgaggggcttgattcattgattcattgcattgatttgttctaggtagttcaatagtagttatgttttccggtggcgacggcttgtttcattgatttgttctatagtagttcaatagttcactagcaccgaaggattcaacttcctcagttcctgtcttctttatttttcagagtgttaactgttaagtgtatatttattgacagattgatagtataaagctgtaaatattaggaatttagataacttagaaccataatatttaattttcagtgtgttaaatttatatatatgatgatagtatgaggctatatatgagctgttgttaggaatttagagaatttagagagggtgttttcttcgatgaactatataaaaacaagaagcaagatgagcaacaatctacatttattggaagagaattttttgtacaagttaaaggatgaggacatcatcactcatttttaaaatatcaagcattgaaaagttctcctctaaattgtaagttttttttatcattttaccattttctatcctttacatgttatatatgttgccactttcatatgtcgaacaattagtacttatatatgttaaagaatttggacttatgatcaattctatcaatttataaagttatggccatatgctataatattatacaattagtaatgtgtaatattataccaattaattattggacttctagaagtaaaaagaattttgttttacccctacctatttcgaatacccaacctctaaatcctgggcccgccactggatcataatccaacggccaggtccaggtgactgaaatgtgcctagcgaatcctaacatattcgttctttggccccggcgatgagtagcaagtttattactctctccgtttcaggttataaaacattttgactttggtcaaagacaaactgtttcaagtttaactaagttagtttcatcaaatcaataattgaatatatttttataataaatttatcttgggttgaaaatgttactacctttttctacaaacttgatcgaacttaaaacaatttgactttaaccaaagtcaccaaagtcaaaacgtcttataacctaaaacggagggagggagtacatgccaagttgttgtgaattccttgcggataataaaagtcatcatcagtaaattctatatatttttcatatatatccaaacattatttcttttatcagttctacacatacttattgtggtatcagtgctttgatgagacggataccatcctatggtcgtgtatcagaataattaggaaagcctagtgctaaaagctcgaatacctatcctaaaatttctgggaccctgcttgaaaaccaagattttgtctcaattcagactgaaaatattttacacagtgaagaaaaattgtgcagaaaccaaacgtaaactagatggatcatgcattgtttcagcaccttctaattagctagttgtcttgaacagtacactccttgattcttctgtatttccacttattgttccaattccatggataacagaggaaagtaaccttgttgcattcggcatagaaatgggtaacaatttaatacaccaaagaaaactacaagatcgtggccatggtaaacaaatcgatgagaatgcaagaccaggtgtaaggcttgaagaccttccatgggtatgttcatcttaacttcttttctgtttgagtgttgggtagaaatgggatttatttataatctccaaatgtatgtgatgcatttgctgcaggaccttgtagtatacaaaattttatctaaattaccactgaaagaggctgcaaaaactagtgttttgtctaccaagtggaggtgcatctggttgacgtgccccagattgtgttttgatggtcttgcgatgttcaaatgcgaaaggggtgaactgttcttacacgctcggcaattcattgctcaggttaatgctgttttgcaaaaataccagggagaagtggttgaggaatttcatatcagatttgattttcacagcataccagctcattatcttgataattgggttatcttttccttgtcatctaagatgaagaatctagctttagatctgcaaaccaatgatattgaacgatatcctgcacgctacaaattcccctttgaacttttggacagtggaagcttgtccggtctacaacatgtgcagttcagttttgtatctatcaaaccaccttccaagttcagaggtttccctaacctgagaaagcttgatctgcaacttctagatgcctcttcaaaggattttgaaactatgctgtcaaattgcaaacttcttgaatggctaagcatggacagatgccgcctgaatggtgaacttagggtaggtagtccattgccccgtctggtatacctacaagttgtgtactgccaagtaaccaagatacaattccatgctgtggagctagctaattttgtatataaaggagactttgtgcccatagccctcaagcattcgttgaagctggaaaatgcaaacatcaggttatatagtttgaatgatcggcatgctatcagtgacctggtaaaatgttttccgaacttgcaaaatctgaattttcacctttcttggaacgatgcagaggtttgttctcagaaactaaccctccatgctacagttttagcttgtttaacataatctagtgaatgatctttgtccttttgttttccagactaagttgttatcagatacaccttggaagttttctcatctcaggtacttgcggttgaaaaactttgcagattctgggatcgtggagacgaatttttttgtctcttttctcagggctgctccttttattgagaagttagagatccatgtaagtgctcttatcagtaactactactattctccaaactatttcttcacttgtatgttgacatgtcatgtaatactgatctccttttagtatcctgggtataccatgcagtaaaattaggtcagtctgctcacactggtcgttcatgtcttggttttagcatgttataattgactgcatatctgtgtattgtttctgagaatctgtctctgcacaatatatttttgtacttctattcagaaaacaatttcgccgttgtttacccaggagcgtttgcttaggccgtgtttagttcgtgtgccaaatcttttttgaagtatacggacacacatttgaagtattaaacgtagactaataacaaaacaaattatagattccgcctgtaaactgcgagacgaatttattaagcctaattaatctgttattagcaaatgtttactgtagcatcacattgtcaaatcatggtgtaattaggctcaaaagattcgtctcgcaatttacatgcaaactgtgcaattggttttttaatgctccatacatgtgtccaaacatttgatgtgacagaatttttggaagtttgaagggaactaaacactgccttagcaaggttttctttcaatagagtcaagtgagagtatacaattattactttgcagagtgggtatattatcgtatttttgcaaaatttcccaaacagcttcactgcttatgttacatctggatacacacaaacatacagttacattttcttttttttaaaaaataatgatgatgataacaatcactagatgcagtatgtatcatatcctaggtacacatatattaaaggatgtggatctaaacccagctgatcacatattgttatgttttaaccatgcagttttccatgaatttattaatactggatgaatcgcatgaggaccatcctnnnnnnnnnnnnnnnnnnnnnnnnnnatacaataacctgaagaacatgcgtatcataggatataaaggttcaagagatcaggtcgaatttcttctacatgttgtggagaatgcccctgcacttgaggttttaactctagaggcagctggaatagagtaccaggaggtttcatttgtgttgaatgaagcgtggatcgacagaattactcagagtgccgatagatctgctctgattgctcaacagtatctgagggagaaacttagctcaaagacacagctttgtattaagactactagttccagatagagctagcgctctatgcaagccatgtgaaaatagccattagtgtaagattaattaaataatattattataaacttgaaaataattgagtttatttgatttttctaaaggaatttgaaagttttttttaaataaaaaacacattgtttagcagtttggaaaacatattcacggtaatgaaggaattgcaaaagtaaaaggaggaaaaaacacacccttaacatttgttactctatccatcttaaattgatcatcatacacccttagcatgtacacattctctcttgctacattaattgtattcggatgaaatctgtgtccatgcagttatatgatgatcaatttgagaaattttggattttattatatgataatcaatttgaacagatggagtattggttagttttaaaacaaacaggtcctattgtttagtagtatatctcttctctacaacttaaaaagtataagaaatttccgtcgtccgtaaaaaaaatatagagaaaagaaaaactaaaaaaagaagtccgattccccttaaaaaggaaaaaaaagttcgagaaaaaatagcgaaaaaaaggtagatccgattcccctaaaaaggggaaaaaaaagtccggttcaaaaaacagaaaaagtggcgaaaaaaaatagatctgatcccttaaaaaggggaaaattttcctattcccacgcacggtttttctttttttcttcctttttttcgtttcttttcagttttttctttcccttttttctttttctgtttttttatttcttaatactatgtatgtatacaaactttatatatacacatatacaacctttgtatacgtgtattttttatatgtttgtatataaactttgtatacatctctatctctactctctagtctctatctctactacttaaaaaattcaaaatgtttccttcgtccgtccctacttaaaaaattcagatagtgggaaaaaagggtttgtaaacgagaaaaaaaagtaaaaagggtgggaagcgcagcaaaaaaaaagtccaatttcttcgttttaatagtccgtatatatctcttctctatgcctaatctaatctaatctatttaaaaagagatgttttcatcgtataactaaaaagagaagttttcatcgtacaacttaaaaagaaaaaaatgcgcgagaaaataaaaacggtaaaaatgaaaaaatgcgcaagaaaataaaaatggttaaagaaacacgtgaggaaaaaatgtcagagaaaagcgctaaaaaaaggtttccgtagtcctaaaaaataaaaaaatgtacgagaaaaaaaaatatttccatcatccgtaaaaataataaaaaaacatgcgaggaaaaaacttttagaaaaaacgcacatttctaaaaaatggtttaaaaaaacctcgcatgaaaaatggtttgaaaaacgctaaattgatggacgccttgggtcagataggatccatcgatttttccatctcctacacaacttttgtttggtcatctattctcctgtattagagaccctgcacgtctctatatgcaattatcagactatttttgttaagtatagctactattgttgataacatatgatatggatataatattaaaaaataaacatatttttaattgttatttagagaagagttcacagtgactctattttgtgtagatttgaccatgcgaggtaatgtaggatttgattgatcgtattattggttgcaagaataagattcaaagagtattttagattatatgcatgttgtcacatgaataatctaattattttaggtaaagcaagcatcagtgaggttgtcatcgttgaggttgggccatttcatttaagatgttacaatttttttgattgtcttagctacaaacgatccatacaaacattgtcattgacatcgttatgtatgaaaatcctattttattattagaagtttttcacccgttgcaacgcacgggcatttttgctagtattataaaaatgagacatgcatgaaaaaaggagaatgcaccgcgtggccgtaactaggggtgaaaacggtacagaaattttcgagatttccggctaccgtttccagcttgcaccgaccgtttcagtcggtatcggtaaccgattgtggtggaaatggaaacgggtgatatcttctggaaatggtagtggaaatgggatggaggtttttccgaccgttttgtcggtaaccatatttgtacggtaatttctgtcaaaatttcgaaagttccccagcggctcagctagctcaacccattggaagcccatgaacagaaaaaaattctggtaggcttgcagcccataaaaaaaggggaagtgaccagggaaaatgctgttaaacctatgacatggcgtgtggattttgctgaactttggtctcctcaacttatcgatgtataagtattgttgaactttgtttatattgtttgtcaaacttattatcatatcattaatcatcatataacggtgttatgtggagtgtgatgatgcaagaataaagttaaaaagtcatctacgtgcatagttaaatgtgtgttatgccacactctggtgattccgacatgaattttcgacttccgaccaatatcggtatattccgttccgatggtcccgtttccgatataccgatatcggcgatattgccgatatcgttaccgtttcaagtaccgttccgattccctttttgagaaaaaaaatatgaaaatgaaaatggtatatggttttttctggcactattttcatccctagacgtaacaaacttgtgtctcacgatgtgtgtggtgtgggccccacccccagccgtaacagccggataaggggaatttaactatttagcacttttaggtttgacaattatctaaatgccctttttagttagatttgcagttaattttttgcccctctaaagaggtggtctcttagggcctgttcactttaatgccaaaaaaaaatcttaccaaatgctaaaatttggtaaagttgccaaaattttggcaacttgccaaaattttggtaggatttcttatatagttaccaaaatttaacagcaaactaaatatagccacttttttggtaactttatcaaaatttggtaagattgaaaatggcatcaaagtgaacagtcccttaactatttgccacttttgcccacgccgtggcgcgccagggtggcaaactttggtgaaaaactccgtgggacccacccgtcagtctctccctcccttttgtctcttcccctgtgttcgttgccccatc

SEQ ID NO: 77151 - DNA, 6696 bp, Oryza sativa
gttgctgtcacgccgtgccgtcgtgtcgccgcccatcgcatcccgccccgagccgcgcgccaccggtgtcgccgtcgccatcgacgtcccgtcgccgcgcgcgtcccatcgccgctgccgcgccgcgcgccgtctcgtcgcctcgcgccgcgagcccgccgcctcgcgccccgcgccgccgcgccgccgtcgtttcacccctccccctccttcccctctctttcttcccctctcccctataaagaccccggcccaatcccccccttctccaccccactccattccctcctcttctccctcttccccttctccacgcgccgccgtcgtcgcgccgccgcgccgccgttgtcgtgccgccgcgccgccaccttcgaagccgccgcgccgtcgccccggagccgccgcgccgtgcgtcgtcgccttgcgctgccgtcgccgtcgtcgccgccaccgccgccgccggtgagccgtcttccccccctcacctcgcgcccaccgccgtcgccgcccggggaagcaaagagccgagagagagagagatatagaaagaagccgggagggagcagagaaaaagaaaagagaggaaaggaggaaggagccgggaggagagaaagaaaagaaaagagaaaagagagaaaaagaaagagaggagagaaaaagagggaaaatagaaaagaagaaaaggagaaaatagaagggaaatttggggagaaattagaggatttaggaaataaaaatggtcggggttaatcgtagattatttttggaaattcctcgagcgtaatagtatttcggtcgaaattccgagttaattataaaaatatgtttcttgatcagattagattaaaattagtagtaatttagatataattaataactaaacaattagatgaattcttatagattattatagattatttttggtaatctctaaaagtcatcggttcacggtagaaattcggatttaattactagggattttagccgtgtattatatttaatcatttagtcatagactaaattaaatcatataatatttctaggatttcgtccgatatttagctcgcgatagaaatctctaacctattatatggatataatgctcgggtagattaaattaaaaacttatgacaacaaaatatttatacccgcaaaatagtttaagtcgaaattgggtttgccgtagttcgcagatagtaaagtttataaaaaggaatcgactttcacattcgactttcatttggatttatttggatttttatttgaattctaaccgaattcaaatcaatttttgcacgtaactatagagcccgagggagttgcggatccaagcgaaggcaagacccgcaagactctgagcaaggcaagtcatcactattccttgaacatgttgatcccaattgcgaaattgttttgtttacaaataaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaataactgttttcgactggggcggacggaggatttgggtggtatctggaaaaggctagtaccgtccccggtcaattaaggaccgagccatgaagttaagcatgaaacaacccccgtacaaccgcacttctcgtatgggtatagacctagcggattagatagccgagcggaggcagtatccctgcatagatggttcacccctgagtgaggcaggtgcgctacgatgggacagccgttgaggtagggccgagaagcgtgccctacatcggtgtcgccattggtaggactgccatgagtgtgtgagagagagaacttaacttgaaccataatttaatatgcgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattctttaacttgtgtgggatgggatattgcatgatgatttttatgctgatggagccacttcctgagaggcgggaacgtggacgtcctcagaaaaccataacgactcaatggcgggaagctatccttgggatcacaatggatggtggacagaaccgtcattgtttaatatgaacactggtattaaaacttgatcagtctatgctaggtcttaggcttgtgaaaagaattacaaaacttgctttgcgcaaaagaaccatagccatcctttgaattcctctgtcatgtgcatcattgctgtggtggcttgctgagtacggttggtactcacccttgcaaatataaaattaatcagaagcgggagatgaagcctcggaggatccctatgcctactaccaggagggagatgaagacgatggcgctcagtaggtcttagtacggtcgttgcctgtggcaatggcatgccgctgcctgaattccgctgccttatctatttctgcttttggatgtattccggaccgctcggtccgatgatttaagactacgcctgcggggttatgatgtaataattcgtattagacactcgtgtatgtgcacttggtatttcagctatgaattcgtgtgtaccagactacttgatctagggaaattgtactgtttacacaattgattcctgttataaaaacgggggtccacaggggacgacggggatgggcgacaaacttgttaccgtagcctgccgcctccaatgtcctcggtgccgcccgtctcaccctcttcaccgcgcgcgcctcgccttccccgtggaggactcgtcgaccaccgcctgcctgagctgagaagagatagagagagagggggggggggaaaagggaggcctcactgccgtctccagggaagggagcatcagcggcgccgactagtgacgtcgacaatgaaccactcgtctcctcttgtgcttgttgctccgagtcctcgtctttgcatggatacaggaaagaggagtcgggagagagagagaaagagggaggcgacgcgtgccgacggcgctcacccgtgaccccgagatacctcagcctttccgctaaccacgccgccctcacctccgtggtcactggcctctacagccaccccgccgcatcacccctctcccccacccccgccatggctaccttctcgtgtaagtctggcgtcatccgccgctcccccgaccacaggaggacaaggcatatggtgagctcgacatgccagccatagcccgcgcgcgtgccgctcgttcttagcggcgagcgagcaacgggcgagagagatagaggtgagaggggatagagaggagagcgactatgacaggtaggcccaacattttttaaaataaaaaaatactaactggattgccacgtagggccaaaaccactccgatgttgagttagggggtgttttttcctgtattgaaagtttagggtgagcgatatctgcttttcaagttaaaggggtaattcggttcactgcgatagttcaaccagtaattcatactttttccaaaagaaaaaaaaaacaaacaactttcaggcgtttcccttccttcctgacgagtttttggtgttcgtcttccctcccgcgcccgcgccttctcgctcgcgcgcccgcggggacgcggcggctagggcgatgcagctggtggacgacgccgacggggccctcgactcgtgggcccgcttctgcgacctctccgacgagctcttcggcggcgccggcgacctctcggcgggcccgcgcctggcccccgtcgtcgcggacctctgcgcccgcggcctcgccgagctgcttcgggaccaattcatccgctccctagaggtgacgcaacccccacgcttctctacccacactcacctgctgcgtgttgctcccgccgcgcggagtattggggggctttctgcattgcacggttttggggactcggatcgcgctgcgcgctgagtgtttgtgagaatgcctgccccgaatttgagacggtgtagcagtagcagagggggtatggacttgggctcaaagaccctttcgtgtgtgcttggccatagacagtcaaggttgaactaggccacactatggaaacatggggtagacgggtagtaggactagtttgctttcgctgaaacaattgtcaggacatcacttctttcatcccttcaggtttgtggtgaacccttttatttatctgtgacgtagttaaaaaggagggaagagatggccacaatgcacagggtggctgtttcctgtttgtcagacaggcagagccccctgcaatttaggggagagtatctatgtgctagagtgtctacaatacttgttttagttttatttgagcattgaaaattgacagaatgcctcaggttttcaggttggtttgaaattgtaatggcttaggatttgcacttaacttttttcactccttacattttagttgaattagctcttatgcaaacatataagaggatcctagtctaaaagatgccatattatctgttgcaagtctgctggctgtttaaaattctatacccttgctcgtatttatggaatgctatgcaaagctttttattcttactctttctctattcaacctgtccttattaatgcagggaatatttagaagcaacgcggttaagaagttctggcagcagtttcatccttattgcaattcctctgcagtggaaagaattaaattctgtgtgagttacagaatagttaattatttgttcatccatacgtttgtttcagggtagaaaatttatgttgcagaaatgacatcttgcctgcttcatattctgattgtctttcttgcatacccaggatgtgatatctttcatatgttgtatcaagaaatgaaatggcattctttgtattgaaagatgaaaccataaaaccatcccagccatgcaaatattttaaagatactttcaccagtttgtcaatactgctgtatcataatttgaaactagtgaataaagtgtatattagtaatcatcttacctaatttcggtcttttaacattttacaacagcataatttctctaaccatgaatttcaggttcaagaaaactggcctgaggatatcttaagtaaagcattggaagacatatgtttggaaaagaattaccaggaaaagtgtgttctggctctagttcattctttacaatcttatgaggataggtcaccacacagaaaatctaaagcactggattgtagttccagcttaatgcctaggtaccagttaatggtatcttcagtacttctgacaacactaccattgagttttcctggttagtatctgtttcaccactgttttactgtatgaaaaggcttgagtttgacactgggccaattctgaaatgtttaccatgacttccatttctgaaccttgcggagtggtttgtgtttctctagattattctttagaatcatgaaggatacggtgcatggcaacacaaacaatgttatattttcagtttgttttctaggcatcagttttctaggcctcacaatgatctttagaccagttatgactaaactggagtgttgtgttatctcctatgcgttaattcttccaagactcatgtggccttttcataaagagggaaagatttattactagtattaaatcttatagagccgcagattgatgcaaattacccaactgcctttacttttttggcacttttggatgggatatttatggtttccaaactttgttctctgtatctttgctcctttggtcctgccatctgggggccatatgaataatcactcattgttaggacaataagttagaatatggatgaaactgcaaattggatctgtattggcaatttggattgattttattagcctctgcagaaaaggtcataaccattggaaagcattcaacaatccaaaattttttctattcatgtagcatgcatacccatcttccacattatagttgggttgcggccgtccttttttttgttttttgtttaaggttactttacagggtttcttggattgatggaatcatggacagatctcctattctcctccctctgataaaatcagttacaatatcctcttttagctgccagagcacagcatgcttgttgcacacccactgacacagttagttcaggaatattgcacatgaaacattctacagttactaattaatccaaatagaagctattgtttttaacaaatacattttcctgaaattataatattggtgacttgtttttttttctacttgatctgtagagatattaaatgtatacttcaagaagaaactggaagagttaaatatcatgatggctggattggatgggagcgatccatt

SEQ ID NO: 77152 - DNA, 4714 bp, Oryza sativa
tctgctaaaaattagaaaaaatgagcttggttggaggtttggagcttgtgctttaggcagctttaaaatgaatattaagcccctctgaacagatacacataaatactgaccaatcatggcctcgtatcatactatatcgaaagcgacaaatgcatgttaattgcatggattaaaagcgtggtaggacctaacttttctgagcccataaggatttggattccaggcaactgaaattattagaaacggtcaccaacggccggttttggcagctttaaactcaagcatagcccttccaataacgtaactacaataccaaccaaacatgaggtgcaaggacagtatttgcgtcacctagatcgaaaccagtaaatggctaaatgcgtgcgcaaacaaacataggaaagcaggaactagcttccaataaaaaccggtaaacgtcttttttggacatttcacaactttgtcggaatttgattttccaccttattgaaattagggtttcagcggttacagacaagaacagtacaacctagaactgctagaaacagtcacggatataccgacaaacaaacagagttcaaatgaacgccttttgctcttcccgccattcctacgcctcttgttcttcccgccattctaaactgcactacagagcctacaatactaaatagcataagaaataccagtgtactacttcttgttggcatgactccatgcctgatgtctccatggacatcaaacccatcaacagttagacactcttatttactaaacgctgtgcttcaagcagccaagcctatccattagcatgtatagcatctaacaaccctaaagacgaatcacatccctcacctcttgctacgcaccatatcaccctctagaggccataacctcaagtaaccctaagaacagtgaaaccaaacctgcccggtccgaattctccaacgaaaatctcacaccatgacataattcagtggtacagaaaatggataagacatgcacaggcgcgcacacagggatcgagcccagtcacctctcttagatgcgtggtggtgtgggaggtggcggacggcgatcccgccgtcggccggcgcgcccccgccggtggccacccgcaggtgcccctccgccagcatcctcgtcggcgacctcgccccctcctccgccgccatctcccccccacctatgcggtctcctccgcccgccctgcaacaccaccacgcacgcccacaccctcaatcaatcagatcaccacagccacaaaaacaaaaaacaaaaaattaagcaaaaccaaaaacgaagcatacgatgacgaatcggacgggatgagcagacgaacacacctgtggagatcggaggcggagacggcgagcgccgacgcggatctcaggcgagcggtgcggccgcgcgggggcgaggcgaagagagaggggggccaacgcaacgggggacgcgagcggagacgagaagggagagtttttattttatctttttttttttgcctcccgtctctctcacttattactatctgcctctaattacttttaccgcgctgtattaagctaatcttttccacccattttttttctctattttcttatttctcatcaagcagtagcactgtgtgaactgagagatcgctacgcgcacttaaatactcgcgggattagagacacctcttgtccctcgcgggcccacctgtcagtggtggtacgtcggtgccgtgtagcgagcggggggtcggtcggggagttggttttgagtagaccgggtgcatggaccggtgagtggatgggcgcgtggaacggacggcccgcgcgaggtggggcggcgtatggacgcggttcacgtaatccaggtggagagagcaacggggatggacgggcgtgagggggctgacgcggccacgtcgtcgtgttcggcccacgtggcacccctcccagatggggcgcacgtagcgtaaaggcgtccgtcaccgcgacggacgcatccgggccgtccgttggtgggcaaagccgctttctgctgattttgtccgtgagcaaaaccgccccaggtttcactggtcataaatctcacagtcttgcatgttgtcacttgtcatatgctaactactgtgctggctgatcagtcattcacatggaatctgcttaaggttgcctattagtaagatactaatccttcacgctttgttaagtgtttatctcgacccatacggcttggcaagctatagctagctaccttacctacctcgtcatgatcaacacaacacacaagagcgtcgacgtgtcatcggaagtacagggatatgaatgaggcgaagcacgcgtgccattaacatcgtcacaactctggcaccatgcgtgcaatcgatcgatcgattcactcctcgttgcagaacagcagagcagtgaacaaactaatttagtctctttctgttgctccgcctctgaatccatccagagcacgccatccttggtccatcacacaggtgttggcgattacagtgccagtgcttacttacagatacatatatacacatctctcatgacaaaaaaaagaagttgatcgatgtttaattaattgtactggtatgctcatgtaaatactggagtagtagtagattagatgcataatctaatcagatcaggacttgtcgaggaggccgtcgaggtagaggttgaggaggtatctgccgggtggagaggacgtcgaggcgcttctcgctgggctcgtagcgccccttgcgcagctggtaccggtgcgtcaccgcagacaccgtgtacgcctgcccttcgatcgtcacgctctccccgcagtggatgttctgcaccgtcatcacgcaccaacgtaaacaccgcttcatcacacgagatagcattaaaattcacagcaacaatacataatctgccaacaaccaccggccatatactctttttttttcttccttttttctttttttttctggtttttgttttgaagaaccatgtcagcatgacaatgtatcagttcaacggtgatagctggcacgcaaggaggaggaaaagcagcataattttttgtttccccgttggaaagtcgggtcttggtatctagaacaatgggaggcactcggcttggctttgacaatctttttattctcgagggaattactttgacaatctgacagcgctttcgtgcatgtatgatggctatctggcagagattcttgatggtagtagtaccaaattacgttgcttcgactttccagcaggaaaagagttcgttgtcttgcaaggttaaaactgctaaaacaggcttcacagacatcatcaggaccttggcgaggttaaacttgtctacttcctccgtttcacaatgtagaactttctagcattacttatatttatttagatgttaatgaatctagatatatatatatatagtatgtgtttagattcattaacatctataagtatatgggtaatgctagaaagtcttacactgtgaaacagagggaatactaccctaccggctgctcatctacacagcttcttcctgctatgcttatgtgcctttggaaccataggcatgaggtgacttttaagaatgaacaaccctgcctacgccgtttgcttcgccgctgcatcgatcatgctagcctctgggctgaacgaatgaacaacgttggtagatatgttatatctgcttgaaaaacaagctttctcccgtttcttatatctttaaaataggtaatggcgcgaccttatcgctacggcgccctacgtaacctcaaactcgttactttctccgtttcacaatgtaagtcattctagcatttcccatattcatattgatattaatgaatctagataaatatatatgtttagattcattaacattaatatgaatgtgggaaatgttaaaatgacttacattgtgaaacggagggagtattatcaatggaaaattcaagtgagggagctctttcctccggtgatttctaaaaaaaaactactaaaacaaggtttacaaacaaaaacacaactagagtaggatatatcactattatctaaaaagaaaaggatagcatggaggctagttgttgatggtcctagctgcgcacgggtgctgaattgttttttttttcgaaaaaacgggtgctaaattgttgttcttgaagttacaacaatagcataaccagtcagtgatcacttcagaaaacactgtaagggttcattcggtttaaagaatttacaaatgattattttatgaattgaaaccttaggttttttctatatgcattattagttgtttaggaataaatcctaccaaattcctaaggattatattcttacaatcctgttttatatgtttttttagtatgagatgagagctcttcgagaattttataaggatttgtggcattctaatcctttactctttatctttttttttcctatgatttaaaaatcctgtgaaccaaataaaccctaaattatttttttgttctcgcagtgctggaaacacttcagtaagttgtcaaagaacgtgtcctttttttccccttaatgaaaaaccactgcattactacgtgctacaatttaactagtagactgacgcaatctgtatttctccaaaagctgcgaagaatatttaggatcgaatttatacactgggagcagaccgtgactctgcaaccgaaattgtggtgcactgaattctggaacaatgc

SEQ ID NO: 77153 - DNA, 2143 bp, Oryza sativa
ccctcaaccaccacttcagccccccaaaaaagctgaaattaaaccaaacatttagtactacaccttcgattaattaacaatgctaattagtactaacaatcaacgcacgtacagaacacatcaagaacaactaatcatcaggctatgaccccatgattatcatcatcttttttctcctgtgtatgagcagacgcgagacatgagccggaaaacttgcgatcagccgcggcgatttagaatagccaaagtaggttcatggcctaacccgcccgaccgccctaattatcgtgcttggaaaaggagattaccttagctagctaggctaggctagccggacatgcgttttgccaactcccatgtgattgcgttttgcatgcgagattctttgttcctgtccatgctttgcccgtgtggtctatgcaactcccaggccttttcacccactttacccagcaatgccccaaccaaaaatgccaaactcctttccaagttgtatggacagtggtaaaattgacacgaattttgataaatgtccttcaatcagactgagataatgtttggcgctctacccttttaatctactgaaaagtgatggagctatatatgtatatcatttttctttcactcgtttacttactactgctagtgtcatgcccatatattgcaacgggacatgataaagggtgtgctcgacacgttttcccaactctcctctctcgtttttcgcatgcacgtttttcaaactgctaaacggtgtgttttttttaaaaaagtttatatatgaaagttgcttaaaaaacatattgattcaatttttttaaaaaaaattagctaatacttaattaatcatatgctaatggaccgctccatttttcgtgatcactgttactgttaggaaccgctccaccgaacacaaccaaagatagcctcactagggtgctctctaactagtagtagaaatcaatctgaaccgttagatctcattttattgaaggatacagatctatttataccatcccccagttaacggtagtagaaacgtggtgggacattattattagaaaaaaaaaggtatggagggtataatcgttatttagaagtgattaaactttttttcttttttttgctttttttgatgaaatatgagtgatgcaagcgcaatggatgatcgcagatcgatttagctaggggaaaaaaataaataacaaagtaactcatcattattatattagtaaattattaatttatctctaataatattgatagtataatattatgagtagagagcaccaaagcatcgtttaaagaaagatggtcaaatggttttacggggtttagttttttcatctttttttgatcaatttcgtgtgggaacgtctcgtttttttgtgagttttcctacaggcaggtttccttttcttttgagtgagagaagtgcaatggttgggaagaaaaataatggctccatttttaaggtaatagagaaatactagtacagctgataagtctgaaacatgaaatggcgtcgggccctcatgtcagccccgtggttccatactttcatggaagctgtcgagcgagctgtatggctctgtgtagcagcacaacctgttccatctttggactttgcgaggatcggctgtcccagtgtccccctcattggcgcctttgacaaacagccgcacgcttctaaagctttgtcctttcccacgcccatggctctcccttcgccttcgcttcctgtatatacaccccccacccaccgagctctccttccacggccacaccgatcaccagctgcgcccgccaattgttgcaagaaccgagccctttcagctgagcgaattgagtctctctgaccgggctgtgtgacaatgatcaagctgaggtactccaagaggctgttcaggaggagctcctccaagggcagcactgacagcagtagcagtagcagcagcagcagcgacggcgatgtcggtggccggagcggcggcggcggcagcggggagatagagtgggaggtgaggccgggagggatgctggtgcagaagagggacgggagaggcggcgtggaggtgatcaccgtcagggtggccaccgggttctcctggcacgatgtctccattggggctacctgcacttt

SEQ ID NO: 77154 - DNA, 1305 bp, Oryza sativa
attcctgcagcccggtggactactcgagaaaaggttgttaacggataattctcgcgaacgtcgtcggcttgatcacccgacatgattgcgagcggacatccggatatgctataagttgggtatgtgagcaggggcggatctacagtagtatgagcggtgtcaggcgacaccgacgactttcggcaaaacctatagcgaaattgtttatctatatattataacactatgaattaagtataattaacatactatgacaccgatagacatgttatgacaccaacgaatcgattttctgggtcctccactgtatgtgagtcatgctggccacatgatatgcacatgtaatgaaccaactttagcgcccctataggtgattaagaaactcctactcctggttcttgaaccagtaagacgtagtgatctctctcacctcactttaagtggtcgagttacgactactgcctgttcctcgaccagcgatgtagcgtttctcccactacttccacttcaagtggtcgagttacgactactgcctggtcctcgatcagcgatgtagcgtttctcccactacttccacttcaagtggtcgagttacgactactgcctggtcctcgaccagcggtgtagcgattctcccactatttccacttcaagtggtcgagttacgactactacctggtcctcgaccagaggtgtagcgattctcccattacccctgcttcaacaaagttgatatcaggtacacaagatcgccaagtgttttacccagagatcccttaccacgacaacacttagcgttgaaacctatcctactgtccctttacgccgtcttgacaaggcctccgaggaacctaagggaacttcggctggggacgcccagagccgataaggccttgtcggatctttcagagacgaaagaccatgtaagatctggtcgtgtaagagttctcgctatgcgtattaaccaagctgtgtaatcggaaatggattttccaacttcacggctgggggttaggatcaatgcttgttcaaccgaggcaggtcaaaggtccaagagccttatcttccgagaacgattctctgatgacaaggctgggggctagggagagtgtataactcaacaaactgactgatcgaagtcggtaaaagagtagacgctcatacacaaaacattggtctgtaagtctaattcattttcggttttccatacatattataacatgttaccctttgagtgttcgctcgggggctatttctatctaatattcttttctgagtattgatttcaggaagggctgcaggaat

SEQ ID NO: 77155 - DNA, 1220 bp, Oryza sativa
atcgtcagaccgccatgtcgacaacagttagataggctaccccaaatattatactggtgtgattatcatgaataagagcaataccggcttcggccaacaggatgtagggttattaactgataattcaggggcccgaacctgtataaaaatcctcgtctccatctcttttacctcagtctcgcatatatcctagcaccgacgatccccatactatgcaaataccagaattgcgacatcaaacgtcgacactccctcagtccaacaaaaaaactcaacttctagagtttgaattttgtctcacaaaaatcaatttctaccgtcctacctaccctcaacacgtgaaacggaaagttttatcccttcaataccttttactacgtatcactcttactattttttcagtgattaaaggcattttagtcattctctatctccactaattctcctttggaatgctaggaatgttttttttggacggagggagtataaggcccactttagttttcaaaaagttttttccaaaaacatcacatcgaatctttggacacatgcaaggagcattaaatatagataaaaacaaaaactaattgcacagtttgcatggaaatcacgagacgaatcttttgagcctaattagtcgatgattagccataagtgctacagtaacccacatgtgctaatgacagattaattaggctcaaaagatttgtctcgcggtttttaggcgagttatgaaattagttttttttattcgtgtccgaaaactccttccaacatccggtcaaacgatcgatgtgacactcgaaaattttcttttcgcaaactaaaccgggcctaagagagtaaaagtgcaccctgcaggacagtagaactactactcaaccctgtgaagaagattggtgctgttcgtttcaaagaaaaaccctgtgaagcagtgaaggagagtgaacaggaataactgtaatctgcatccagtaatggcaaatccgcctgctgctggcactgaccggccccgtcgcggccctccccgaagtcgttgcgccatcacgctgtctccacgcaggggttgacgcaatgcaaccacctgctcccgcaccagaaaggccggcccattaggtcactctccactcagccaaaaaaaagggggagagagagagaagcgatgatcaggtagggcgtgtggagtggtcgtgtcatttcgatcggtttggctttgccaa

SEQ ID NO: 77156 - DNA, 24439 bp, Oryza sativa
ggggggggggggggtggaacagttcttcgtttcatctgtcaggttgccacctatgttcggttcttgaaaatggcgacatccccactgctgttctttcttactaagttcttggtcctcagttacttcgtgtttgtaacgatcttctttgctgcagccctcattcggtttctttgcgcgtcgcatcattttccggcgattaacacataatgatttacaatgggtttggatctggttcactgggaggtctgcgctccatctatggaaccagctgtcgagacgaatgggcttcgaaccagaccccaactccactatgtgtgttagagcaggaacctacggacggctgactcctctggtgaccgatctgcctcgcaacaatgcgacaatggtgatattcgttctcccacctgagtcattaggtgagatatgtacctgtgcaagacttgctgtcgccttcttgttttatggctattggctaatgttctatagattacatgctcatggtattcatttagtcttgaatctctcgtgcgcattgcagtgctctagatcagtcgtactgttgctgcatgtttcatgaaaatttctgtgctgatttctttctaatgaaatgctatcaataaagtccaatccacttgtcctcagggaaaattcctatagataagaaaatggactcaagtaagaataagtaggtattcagagtttggcatgtggattttcaatctgtgtacagatgctaaaatatggcctgaagttaattttatggctgggaaggtagtagtgttgaggggtttaagcccagaccatcccaaatcccaatgagatcttttcagtctaagaaatagttgtttttttttaatttaaggcaatcttgcatgtgttgtgcatactctcactgtaaaaaagacaataagttaatcttgcatgcgttttgtatcatacaaatatacgatagacagcactgctgccgttaaatcattacaccagcttctgctcattatgctggtttctagatgagttatccgttttattttgctgttcattttcttatttcacaaaaaggtgacctcagatgtttttagatggtttctgaatattgaatggcttgtgagctgtaatatctgtaattaacttgtctcatcgttttgtttgtccctttgcaaattcagctggtttggggttgacgtgccccaatgttcatgccgcttagaggaagacagaagaactacaggagcagaacccctgacagtcacttgttcattcgtcccttcagaaaattacgctgcttcagatcgaatgacagagaactgaatgtcttctctctctctctctctttggtatcaactcttctgtttcccggtcattagatattactggccattgtgctctgaagttcacgaactgcattaagcaactaaggagaatgtgtacctggcaattgtgtgttctgacatttgctgtagtttctccatcgttatctgtgattctgtatgacacgagtgatgatcatccatacatttgcagaagtgaaatgttatgctcaagtctgaaatatagatcaggcaactctgcaaaagctgatcctgtatttttcatgcagaagggttgttttatgttttcccttttgtctgttgcaatgcatccatccacgtactgaaacttttatctgttaatgatatcggatttgcaccttgtttggtagaaaattgagccctcccagactcgagttatagagtcatctgggtgcaggttccaaattaattactaattaccgctgcagtgtatttcagacttgggagctgcagtatttgtgcttcccttcatgtccccagttttcagataggagtatgaatttactgttctgatcagttttcgcagtcttctttgcgatcatagaggatcacagcatgaaacattttctgtatcccagtcagaagtgaaatgttattctcaaatctgaatacatcaggcaactctttcagatatattgctctgtagttcctgtgtgtttgtatagaaagattgttttgaacttctgattttccccttttttttctacaccaaaaacgcagtcagatgaacaattggtggttggttatggatatcagcagctgcagtgtttcagactttggatctttgagcaaaaacaatttattttaattccattcacttagatacagtgcattgtacataagagtataacatcagaactaaaaaaaaaaaatcaaatcagtactgtactaagtgatacttaaccacatataacgcggctcatctggtgttgtgtcccgtcgccgccgaatcaccgatgccccttcctcaccggcggtgccactccaatcaccggcagaagcgtagtcgtcgacggcgcgtggaatgggccgaacccaccgactagtgcagtgcggcagcgctcgccgcgccggcggcggccgtcgtggcggcgttggacacacctgagcaatggcaactgccgccgccgccgcgctcatcggcctgtggccgcttgcgccgtcggcttgggttccacactggtgttctctgcccgcgcggccggcgacaggacgggttcggttccgaacgcctcagcacggctgctactcgcacaccaggtgttcgttgaaatgcttcggaatcgttcgctgctaatctggttggtttttgtcacagggaagcatgacagcacgacgcgtggcattcctagtcttcaccgacgaccgtggcaacaggcagcagcagctagctctcgttctcctctgctcgacgcctccggcgtcgcgagcatgacgccatcggcattgtgggccccatggcccacctgtcagagaagggggaggggaggtgcaggtgtgggcccacctgtcagcgaagggagagaactccttcaaattgcggccgccttggcgctgtgagccgtaactgtcgcaacgaactcctcccctccctccgctctcccctcgccggaaaaccaagaaatcaagaaagcaagagaaccctcgccgcctccgccgctcgccggaggcaatggagaagttccacgacgggcaccacgtgtggctgcggagccgcgtccacggcacgtacctccgcgccggcgaggacgggagcggcgtctccctgcacgagggccgcgcgtccgtgcacgcggcgtgggcggtgcacattctccacctcgacggcggcgacatcctcatgctccacagcgccgcgaacgggcggtacctcgcggcccccaggaccgggtggtcgtggaacagcgtcgacctgcgcgacctcaaccagctcccgtcgttcaccgtcgggtggttcgccgtcacggcgggttccggggactacgtcatgctgcgtcacagtagtagcgggctcttcctccgagctgatggcgggaacctcctgtgcaatagcgtcggcgtcgtcgtcgacatgttcgacttccgccgcagagagatcaggcagtgggtggtggaggccattcccccgagagattccatgcctatcctccccaatccttcggtgagcttgtcatgccctgtttcctttcctgatgcttgcagaattgattgcattactgggttctccggggatcaattcttgttcttgatcttttcttgtgtctgattgctgcgaattgtgttaattcctttctcctggatgcgattctttgctctgtttttgccatagttcaaggtgtccattctctatggtgcgcattcgtaggtggagcagttctctatgttcttcagttcttggttgctctgcatttgcttcgctccgtggtgcagttcctaggacggttcttgagaatggcgacatcattattgctgttctttcttactactcgtatgttcttagtccttagtcacttgtgcttgcaatgacttcttgtatacttttgttttgaaacttgacttcttatatgccatctaattctttgctgcagcccacagctttcagctggtgccgcatctggtacgtgcgagcatctcctcaagggaatttccgccgagaagactggcgttcgttattgttccatgggaggtcagtgttccatctaaggaacaggctggcgagtcagttgcgcatcagagagtcctctgacgccatattgtgtgttcgagcgggctccactggacgggtgactcctctggttactgatctgcctcgcaacactttggtgatagacattgtcgttatcacagccgggacgaatggtgagatttccttttatagtgatagattacatatttacatgttcatggtacttcttaagtcttgaatctctcgtgcacattgcactgagttaggccagtcataatgctgttgcatgtttcatgacaacttttgtattgatttctttctaatgaactgcttttaacatagttctatccacttgtcgtcaaggaaaatgtatacatggtttgttgagagaaacttatctgaaaattcttgtagataagaaaggagaaacaagtgaaacttcagagtttggattgtgaattttcagtctgtgtacatatgctaagattcagagttcagtgccttcgggcatccatctgtaaataacataaaaaataaaatgacttgttagttcagtgatctttgtaaagcttctttgttaatgaattagacaatcctgaagctagttcagtgattcagaacatgacttgttagttgcatacatattcatgctccttttgttattttgtcttgttagtagtgttgatggatttaaaacccagatcatctcagtcagctctttcatgtctaagaaaaagggtttttgactttcagacaaccttacatgcattgtgtatattcactgtaaaaaggttcaattgtacagttgtttcatacaaatatacaatagacaacactgttgctgacttacagttaaatcatgacaacagtttatgctcattgtcctggtttctagatgagttaccccttttattttgctgttcattctcttctttctcaaaacggtgaccccagattttttttcaactgatctctgaatattgaatggcttgtgagttgtagtatctgtaattaacttgtcttttttttttttttgctcctttgcaaaattcagctgccctctggttgaggtaccccaatgttcatgccgcctagaggaaggcagaactacaggagcagaacctctgacaatcacttcttcattaatctcttcagagttattcgctgattcagatcgaatgacagagaagtggatgtcttcaatttttttttggttgattcaggttcagaaagggaaactgtcaaaaaccttctgtttcccggtggttaattagctataggccattatgccctgaaagtttacgaactgctgtaagcaactaagtagaatgtgtgcctgacgaattatgcgttctcacatttgctgtagttttccatggttttctctatgattcgattgatcatctttttgtagagtgcaatgttatattcaagtctgaatacatcagccaactcgttttcataacctgtgaaaaaaaaaaggtgatgggctagacgtcctgagttcgaagcctcacccattctaattatttgatattaggtcattctctgatattcgtgtttttttttcataacctgtgagtgattctttgcttccatttgctagctgttggcctaacgctctgaagtttacaaactactgaaatttctaactactaaatagaatgtgcgcctcaacaattttgcgttctgatatttgctgtagttaatttccatggttactgtgtatgataattgatgcaactgatcatccacaaatttcagaagtgagatactgagatatatgctcgattcttcaattttacattaactcgcatcaggcattgcctgtcatctaacctggagtagtaaatttgacatcaaaactaaaaagaaaaaaaaatcaattccttcagtaattggttacatgcgcgattgaggtttcttcggcggtgggtgttcccaactccttaccttcgttttccacgtgcacgtttttaaaactgctaaactgtacgcgttttaaaaaaaaaatagaagaaagttgctttaaaaaattatattaatccattttcaagttttttaagctaatatttaattaatgagaacttttacggtacaatatactactagtatatactgccaatataaatgatctaacggtgtagattgaattacttaccacttacagtataaaattaaaaagggcatatttgtctttctattttattgcgctggggcaattccgttaattccagcagacaagcacactactgggtgttccttgcaagatccaatagtgattccccatgcccgtcattcaccccaggctaaggccgtcgttcacccaggcaaaggtgcaccggtgtgaggctgtcagatattgattaatttcctagtttgcattgttgatatgatgttcattggatgtttggaagatgtagattaagcgtattaattaaaggaattaatggtgattaagtactacatgcggctaccctgcttaagattgctgtatgttggtagacggtacagcccgagcaccggcctcgggttgccggacctagctccgccactccctataccattgccatcttcagattaaaatggcatagagtatttgtaagaacatgacccctcttgcagattgcatgaacgaagaagagggtaaagagtaaataacatacatctgtagactgcacatgtatgcatttttatgcacagatcagggcgtatgcttgtagagtgcgcatggtgtttaattctactccggctcggcagagggcactgcgttgccggctggcttgccgccagtatgcgggactgcatgtggccatgccaccacagggagatggcggctgttcgctttggcgggaagagggacaccgaggaattccgccgccgacgaggacgaattgcgccgccggtagggctcatctctccctctcactcgcacgacggcatcaacagatagggattgatctgaaaagcgaattactaaattgcccttacatttttttagcatattcctataatacccttgaaaatacttgcagtatatactaacagtatattgtactgtaaaagttctcttaattaattacttgttaatctatcgctccgttttctatatggaggggaacacaagtagtgttcggttgctgccgaacgctgccgacgtcttcctcatcgccggtggcactgcaattctcgccgccaccgacgtcgtcgtcggcgtcgaggtccctgcgtatctgatccaacgagcggcggaccgcggcgcatccctcctcccggatgtcgcggataatctcgtggatctcctcgacggggtacggcgagtagccggagtcgacgatcttgagcagcgagtcgacgatggtgttcatgtagccgatcagctgcttggtctcctctaggctcatgcatctgggctccggatcatctgccaactcggacacctgcaccgccgacgactccctctcagtctcagtctcatccatggcgattcttggctcgttcggcgacaacgacgatggctgatacggtggttcgattgagtcgatgagatcgagaatttgagacggagcgttggtctggttatattggcacgcacgcaggccatgcacgattcgtacatggactccaagtcccaaaggaaaaggatttgtattggccggttctaaaaagaaaaggactcacgtgttcgacaaccgaaccacgatcatgcagtgggtggtgttcatggtccaccgtacagtacatatatgtatgagaatcagggtttaatctggcggaaaaccgacaaatcccgaaaaaatttcgcggaccaaaatttgaatacaaatccctaagcttactgatatgttcacaaaagccggtcagcttcggcaaaattccaatagaaaccatcaaaatttcaataggaaaccaaaaggtaaaacgtgctgaaaactgtccggttttatcgaaaagccgataggtatcttcgaaaaaccgataagaaaaccaagtttgttttttgttagaaaaatatagaaaaaaatgtgataattgggaaaaaaaatcgtgaaaacgttatttcctataaatttgataacctcccatcgacatacccacgatatgtaatatatattcataaaagacagttcatatcactcaccaaccatcggccaaatagaatgcccatcaccaaatacataactctgtgaccgatatattgcaagaattaatatatttccagttgtttttcttccctgaagaagcatgtcatacaagctgctccttcagaagttcactattcgccgggcttcagaagttcactatggggtgcattactgacaattcaaatttgccgcagttaattttgaaatttggatttgggttatgaaatttggatcgtagttacatcatgtattttcttggacctactgaaagttgctctactgccaaagtgccaatgctggtttgggcctctctcagcgaagccttcatttgggcgcaattttgcaaatcccccaaccaagccatttctaccgccggccgtcgcggcgttggacacaccgaacccccgagccgccgccaccgtcaccgccgccgccacgcgaggtcggcacgtcgcagaatgtatctgggacgtcgacctgcggccgctgcctctgttgaggcctctactacagctgttcgccgtcgccgcgacaggacgaattctcatcttcttccgctccgttctactcgcgcatgaggtgttcgttgaaatgcttgggaatcgttcgcttgctaatctggttgttttttttttctgtcacagggaagcagacaatcgagtatgtgtatggctttccttctcctctacttaccagtagtcgtggacgacgaaactggctttttcgccgtggcgccatggaccttggtgagcgcgccatggtcgggtgcagccggcagctagctatcgttgcttccggcgcaacgagcacatgacgtcatcgagcatgtgggcccggaggcccacctgccagcgaacgcggggactgcggccccacctgtcagcgaagggggacaactcctttaaattgcggccgcgcttggcgcctagaatcccgagccgttaccgtcgcaacgacctcctctcctcccttcgctctcccctcgccggagctccaagaaaccaagagcgccgcgccgcgccggctctgccgctcgccgatcggagctccaagaaaccagagccccgcgcctcctccgccgctcgcccgagtggagcggcaagaagccaagaaccgcgcgtcgcctccgccgctcgccggaggcaatggagcagttccacgacgggcaccacgtgtggctgcggagccgcgccaacggcctgtacctctgcgccgacgacgacaggagcggcgtctccctgcagcaggaccgcgcgtccgtgcacgcggcgtgggcggtgcacatactccacttcaacggcggcgacgtcctcatgctccacagcgccgcgaacgggcggtacctcgcggcctacagggccgagggatcgtggaacgtcgagcggctcaacctcaaccggctgccgtcgctcaccttcagctggtacgctctggggtcgagatacggggacgacgtcctgctgcgtcacttcaagagcatgttcttcctccgagctcttttcaggagggatcgtatcagcaatagcggcgccgtcggcctttgcgcgatggaccggggcaccacgaccatgcagtgggtggtggaggccatacccccaagagagtccatacctacccttccagatcctttggtgagcacgtcatgccctgtttcctttgctgatgcttgcagaattgattcttgatcttttcttgatccttcggtgagagtcgattgcattactgggtccttcggggaccaattcatgatctgttcttgcgtcagatttctgcaaatagtgttagctccgttcttatctgcaattcttggctccattcttgccatatttcctcctctgttgctgatttgctaatcgtacatcctgcgttcatgggaaagtaattgttagtagcattttagctcaaggtatccattctgtatgttgggagcagttcttggttccatgtgtcatttcttcagttcttgccccctctgcatttgctctgctccagttcatgaaattggcgagatcacaattcctgttttttttccttactactcatatgttcttagtccttagccagtgcttgcaatgactggtgtgttctttgcagccgcccagttctttatccggtgtgtaccgcatctggtatgtgcgagcaaatcctgatgggattatctccccaaacgactggaggctgttcttattctacggtaggtcagtgcgcaatctaagtgcattgctgtcgattgagttgggcatcagaaggccctccgacgccattttgtgtgttcgagcgggcttctttggacggctgactcctctggttactaatctgcctcacaacaatatgttgttgaacttggacattgtcgttatcacagccgggacgagtggtgagatatccttttatagtgatagatttacatatttacatgttcattccttttgtcttgaatctctcgtgcacattgcactgcgctacatcagtcgtaatgctgttgcatgtttcatgacaaattctgtactgattcctttctaatgaactgcactagatcagtcataatctggaaattcttgtacataagaaaaagaaatcagctgaaaataagtagctattcagatttggattgtggattttcagtctttgtacatatgctaaaatacctgaagctagttcagtgccttcaggcatccctgtaaaactcctcttttattaatgaattaggcatcctgaagctaggtcattgattcagaacaatgacttgttagttgcatacatattcgtgctccttttgttattttgtcttggtagtagtgttaagggatttaagcccagaccatctcagtcagctcttttcagtctaagaataatggtttttgatttaagacaaccttagatgcattgtgtgtactcttttttgtttttgctgggccggcggaagagaagtcgtctgattttttgttaaaggatgaccccagatgtttttagatgatatctgaataagtgaatattgaacggtttgtgagttgtagtatcagtattaacttatgttattgtttcgtttggtcctttgcaaattcagctgctgatcggttgagataccccaatgttgatgctgcctagaggaagacagaacaacaggagcaaaacctctgacaaagtgacaatcacttcttcattaatctcttcagagcttttcgctgcttcagatcgaatgacagagaactggatgtcttcttttttatggttgatataggttcagaaagggaaagcgtcaaaccttctgtttcactgttgttctgaaggttatgaactgctgtaagcaactaagtagaacgtgtgcctgaacaattgtgcgttctgacatttgctatagtttccatggaagtgcatgattcgattggtcatcgttttgcagagtgaaatgttatgctcaagtatgaatgcatatttctcatgaccttttccctgtattttcgtacatatgtactgctttgtgtatggcaatgtattcatgtgccaaaagaacaaggcttaattttcttggctttgcattttggtagagaattgagcctcaaatttcagagccatttgggtgcaggttttcaatttcagatttagagtaggcttactgaataccttacttttgcgtaggtatatgttctgaaaaaacggagcaactcttgtgtttcctggttgttagcttcaatgcagacatcaaatcatctgtttgttatccctggtgctgtttctccctgacaagaagctgtgtatgttttggcctttatgttatgaaactttcagactgctgagtgctgacagcattaggtactagaacatatgcctgaacaattgtgtagtggtattggttataattttcaccttcgtctctgtgactgatagcaagaacatatggctgcttgacaaataaattccgcagtcaatttttcgaagttggatttgaattgtagaatgtggatcgtagttaacatcatgtataccaaaagctcagcacagagatatcatcctgtgtatttgttgtcgttctagctacagtagtaacaatgagtattttgtccttcaacctgttgaagttgttttcagttgttcacaaataggccatatacatttgttgagaaaaaatatcatccgagggcgtttggtctagtggtatgattctcgctttgggtgcgagaggtcgcgagttcgattctcgcaacgcccctattttactttctttttcataatttcatttagtgctgactttgttgcaactttgaactttcatcatgtagaattttcctgaatcctgatgtctactcacaaattatcttacgagccagtctttgaaattcatttggatttgaattttacgcaattttatactgaatcacttcctactttcatttagtgctgacttgttgcaactttgaactactttcatcgtatagcattttcctgatgtctactcacaaattatcttattaccgtattacgagtcagtctttgaaattcatctggatttgaattttacgcaattttatactgaaccacggaatcagttcatctttttttagcattgaaaaagttcaggcctctcaagcttggactgccacttgctccacccaacgcgcgagtctgtgtgccgccgccgccgccgccgctccgatggaaaccgccgcggcggcgccgccgcgcgtgcaggccctagccgacgccggcgtctccttcctcccggcgcagtacgtccagccgccggaactccgcccggaccccaccaccaccacccaccgccgcgccccgaccgccgcctccctctccgtccccgtcgtcgacctctcatcgcccggtgcgggcgacgccgtccgccgcgcgtgcgccgagtggggcgccttccacgtggtcggccacggcgtccggccggggctgctcgacgcgatgcgtggggcggggctcgccttcttccgctcccccatggaggagaagctccggttcgcctgcgaccaggccaggggcgccgccgccgaggggtacggcagccggatgctcgccaacgacgactccgtgcttgactggcgcgactacttcgaccaccacaccctcccggattcccgccgcgatcccacccggtggcccgatttcgtccccggctacaggtgattgcttgatcagttcatgccttgaataattgcaactggtacagatttttgcatgcttgaaatcattgagaaaaatgagagtcaatgttcagatatgataacaaatagaaagtgggcaaggaaaatttggtatcctacattttgggttgcctacttgcctctgttgttgattcggggttcatgttcaccgtggaggaatattatgtcatgcagatgatatgattatgagacttaattttgtactttcatttgaagcctgatagttctgcgcgtgtttgaaggatttttcggaatgctgtttgctgttgcattggcatcattgcatcatttctgtgtgtagtcattgcattgagaaaagaatgactcaaaaacatctagtgtcattgactcattgtacagtggacatatccatggaccatcacatattcgcatgagctgcggctttaacagataagctaataacttaatgttcgcagggacactgttgtgaaatacagcgacagcatgaaagatctcgctcaaaaattgctgcgcattgtctctgaaagtctgaacttgccaccttcgtatatagaagaagcagtgggggaagtttatcagaatattactgttagctactattctccttgcccacaacctgatcttgctcttggattgcaatctcattctgatatgggtgcaataacacttctaatacaagatgatgtgggtgggcttgaagtactgaaggacgggctgtggatacctgttccttctttgcctgatggaatccttgtaattttggctgaccagacagaggtaatattccttcacatgctttaatatatgctataccttctaatgctatctaatgtgtaatcaatatgctccaaactaccaaaatacattttgctactccagatgattttattcaagtattatttttatggtacaaattatctgttaggtaatttttgactctttaagtagtattaatctggcatttgcaattcattttagtttcattgcgaacttaagataagaatatggtcctgtgatacttgttcttgctactcatcctgcttgtattgtttcgaatagcttgtttactgttgtattccgagtagctgctaccaatgcgttctttccatataatttggctcctgcaatccaaatgctactaatgtttgcctttctctagatcataaccaatggaagatacaagagtgctgtgcatcgagctattgtcaatgctgatcgtgcccgcttgtcagtagcaacattctacgatccatccaaatctcgaaaaatttgtactgctccacagctcgtttgcaaggagcatccacagaagtaccgggatgtgatatatggtgactatgtctcatcttggtatagcaaaggcccagagggcaagcgcaacattgatgccctcctgatcgagcaatagaaccagaggcagcattatatagacagaatagagacattcatgcgtgttgtgatgctgtccaagattgccgatcttgattaataaagagaataacattgtaccatatgaatggttcctggtttttgaagtttctatgattcttatcaatacttcccttgaagcaaagctcacaattgtgatttctgaccaactgaccatcatattacaacatgacatgaacataggaaagaggaaaagatactgattcttaacatctatttcttgctaatatgatcatgctgtggagtaattcccagcttcctggagcctcacctccagtagctaagtttgtggtagtgggagtattgcactggtagctggtcagctggcggtagtatgtttcttcttgggatcagtgccattatgctgcagcctctcaggactctggaatcaccagtcaccaacagcatcaagctcctaagttcatcgctgaggtagtactgcactcatgcttatttctaataatgtaaatacttcttacacttcattgatgtgttgttataagttctatagcatatacgatcacttgtagaaaaaatttccatgaaacccatatggaactctttgaggtaaagtgattttcaataccggttcttctgcaaatctctttgcatcaataatgtaaacctacaaaaatgatgttcaataattaaggatatgcatggaaaacagggtgaagtcatgtcatgtgcttcctttaccagtaaatcatctaatgaggtttaaatacctgagacacattagttaattcatcatggacatatgttattatccatccatcatcttcatctattccattttcctttgcaacaaactgaactccagagcagaaggttttctcttttaaaacgtggtactccactgatttcagttgtttgttttcctgcggttgttctgaaacttcagtccaagtaaagtcatagacaaaaaacagttgatacttgtgcagtattttctgaccttatcttgcctgtcgaagtgtacctttgctatcctattatacttgaataaacctgcagcattacacacaatcgtacatattcagtatatgaagattgcatgagtaacttaaaatgaacaagcacatactgtaacaagacatgacataagcaattaaactgtcgagaacaattatatatataagtctcttttagtctttctgcaacttcactggtaggcaattacctatttcactggttgctactgagtcaacaacctgtgcatatccgtagttgtttttgaccccaacaaagtcttcattgataacaggaaaatccattgcaactttctcatctgtaagataaccttcttttgtagttccgcttttcaagtttagcctccattcatatggacgagaaaagagagtgccatctactgatggatcaaaaccttctgaattcttatctggctggagaaatgctcttccagaacattttgacttgtcgtcatcatgacttgcactagagagtaccgaatcaagtgttcgacaacctctgataacaacctgtttacaggcttttgccaatgagtataaatagacggaaaaaagcatcgctaatctatattttctatgagattatcctcatgtatgtgacataaacccttttatgttgggaaaattagaatgtttgaaccacaagaattacacggaaaaattgttctattagattgattttctgattttgtttctgtactctaaatgcatctatggtaaattaatgattacataactaggtccatctgaagtttctataagcgtaatatcgataggatttttggatctcgtgtgataatttaatacatgaatactgattttgtaaaggttctagcgaaaatactggaaaaatagccaaataggcagtccatagctaagtaaagctaggtagttagcatgttgcacactacaattttgattcataaggcaaaactacagcagaatataaagctttttctggataacagctaatcatatctatatatttctctggacaaaaataataagaccatcaattgaaatagcagaaagattaatccagaatgtgtattatagttgcctacagatttttttaaaaaacgatttcagtatggtgaacatatatacaagtgcagctacatgcctcatgcaccagatccactcatcccacctctagtatgaaattatcagtagtgttataaaaaaaaagaagcaatgtctgttctgaacctccaatgaccattaaagctgtttcatgatccttaattttatcttttgttaaaattgaacaatcacctcatttccatcctcaaagcaattaaataaatggtaactgcaatgattctccacatcaaaccagatgatggaatcagcatcaccaaacctaggcatcactccaatgcgtgatatcccgcccatatcattttggatgaatctgaagagaaacataaccacattattatggattattaagtcagtatgcatatttcccacagaagtggttgtcatagtaaagatggtgtatatgtatgggacccacggtttgcgtaaaattgtccttattaagccgaagtggagaggatagtccattataatattgtacctacaatataataattagtagttacaagaaaacgtattgttgacagcaatataagatctcataaataaaagctagcatactgtgcagttactccgatgtcatgaatgagttttccttcctcgaatttgagatcgaccttgtgaagaagcctctcaccatcagctagttcatgtgaaagaacatcacttaataatattgtaataaaatctaaaagatcatttttgcccacaataatagcaagcaagacacgtgtgtggttgagaaatttatattggttcttttgatacaatgtttgttgatatttctaatcttatctagctgtctttttttttcatgtaactattgccagttactatagtaatattgtgttccgtttacactttatttttattacttatatgccactcgataatttgcaaaaccccagcctggacaggcgctatcaaacaaggttcaacatggtggatctgagtgcatgtgctagttaaaaatacgagttgcatataacaaatgctacaaaaggttggtgtaatatactctccctgacccaaaatgtaagggatgttgggatagagggggtagcccattttcatgtattgttttacacttgtctagtgattgcatttatgttccaccaaatcacaacttacaggaaattactccaagcacatagtggggtttttcaatattagttcccatcgtcacgagttctccacttccacaaatcttctgtaaataaaatcatatgcatgtaagcccttgctatagatgaatgatgctgctcacaacagaacattatgaacaatttgagtaactttagttggcattaaaaatattccaagaacattatgtgtttgaactttgagttgatgatccatgcttcagtaatcattcaccatgtgaatttgtgaagttaagaaatggtggctgatggattaattgatgaaagatctctactgaaaattattgaataataatattaatatatcactggccttgcctactgttcatactaaaacatcaaacacacatttaaagaaataatgagcaagctgtaattgcataatagaatacctttgggtggctagtgaaaggttggtcccaagctccattaatgttgtaaggtcctagggtgcggagattattgatgtcaatttcgtaaggtagatgattttctgtggcagcaaaagctcgtccagcatgctgaaatatggaagtatttgcactgtccttcacaggctttccaaatctcacctataaatatcaccgaagatgatatgtagtgttaaccatcctcaagaccaagtttaaacaaaaaaatcatgtgcatctgacaattatatagctactcaaattccatgagaaaatgattcaacagcggcattcagctttttccactggagaaacaactaatttgttgagtttcagatattatgtaaatctattccactggagaacagtggaatttttacatctttctcatgtcgattcttcttgtattgaaataagaatatttttttactatgcagaaaaagactgtttcttatttatttgggtatgtatattggactgccttttcttatgcaatgcttatgtcacatccagtagttaatctgttctagatattgatttaacctgcacatcatattttcgccgtgcatctgcacatcatattagagctcaattatcctatccacctagtgtttacacttgatctaatactaaactatttaaaattaggaagacttacggtattaagaagaaaagcaaccagtgttgcacatggctcgccttcagcagatggaaggaaagctattttgttcttctttctctctaattcaaaagtgtctgtgtccacatatttgttcttgtacgaaatcctccattctcctaaattgctcttgctaaggtagatagcatgcaacattccatgtccttcataatacatgtatgatgttgggccaaagatggactctgcagctgtctgtgatgcattaagagggtttggacctgttcaaatagatcaatgttacacgtgcatagaagtttagcataaatctgattcattattaactttttttggttggaaagatgtatataagcttgtgagcctggaagtatcagaactcaccatttcttatatagacaccctcaggaaaatcttttggaacctctccattgagatcgtcaatgaaaacctcatcaccaatttcgtttacaggtccaaaattcccctgtagaagactcagatgaaaattatgccaaattgatgagtcagataaattggatactacaaaggagatggaaaaaaaaagttgctcgtcgacttcacaaatttgatgctgaacaatgtcatgtttgcaaattatatagtagcacatgcatacattaacaatctttatatttacctcattcagataaggctgctcagaaaacttgtacacggagtcgatgaatcggtccagcagatctgaagagactgatttcagagcttttgtcaattcctgcatcagtggctgcttattccacccagtaactgaagattgcacctgaaggatggtacattttgaggtaacctatcccttcttatattgcacaaaatattgacttaagaaaaacaaacgcagagatctgaaggtcctattgaggtagatgtagctttatctcaactgaagaacacaaatttgttacaacacattgaaaagtttctttgttttttttcttgggagaacttacaacacgtttcaaagttagtacttgaactgcttgctggatacatgtaggcaggcatgttccatccattggtttgtctggagacatcaagttaataaatcattattatttccagattagttaccttgacggcattaggtggagacaatgaggaagcttgatcagctgggctcttccctagatgaatgcatctagtgacctgggagctgcaccctccagctctgaacatggcttgctcaggttattcgatcctctcttgtcagttgtaaactgttactggatgttatgcctgctagttcgagcttgttgcattataaagtggaggagcagtaagccagtaaggcatgcaagaacacagacaaatatggtttatcccttgctatgcatcggccatggggaggaataaaatggtctgattggttcagactagcttaagagcaaacactacagtagataaggagcatattcttgatggtctgtgggtgcaataagacagggttaattaatcaagaacaagttgattaatatatggtcgcagaaatcagtctggaatcagctcaacaagggatgcaagtgcaactaggactgatttagtcatgtagtgatgtagatcgtgatttgtgacctgcgacctttgtgattgatttgctgctgggttggcagctctgtccgtgctatgagctcgtgaatggaaggaacaccagtggcgaatcacaatgacgctcatcaggtcaatgtctttttttgatgtaaaatcaggacatgttaatcacgatgatgctcatcaggtccatttcttttttaaaaagtaaaatctggacaagttaatcaccacaccgctcattaggtcaatttctttttttaaagtaaaatcaggacaagttgtaccacatggaatttcattacggaagtagttcaaattaggctggcttttttgttgtctaatcactcttgttgatatgtactccttccgtatttaaacatgtcattgttgattttattagtttgtggaaatataaaaatcgtatgggtccatttttccttataattttgttagatactatcgttatatttaaatacgaaggtagtggcataattgcagtgtaaaccccccaaaaaactgaagagatgcaggttttttgtacttagcattcgcaaatacagtaagagtttggttttgttcgtacatacatgcacgtatatacaagttcacaagaacagcagtcaaatgtggaccatgcgcaatggacgatgggttccaacttccaaatcttagtcgggccgttgcttcaccatgtgggctaaagatgccacgcgaccaaagcccaccaccacaagtggaccaaaagcccacataaaccgagggtaattggaccgacccaacctgggcttcccacatgggcttaaacttattcgcgccttctccttaccaggcagcccatcagaataggccagccgcgtacattcccaatgctcagagagatggactattattacgcatcatcaaaatgttaaacgaccactttcaaaagaaaaaaaaaagagcattgtacttgtacgaacacatataccttcgttgcaatcacaaattcgcaatcaaaagatccaagttcatcacatggccaactgcgcgagagatgacacaacacggctgaaccgctaaaaaaccgctacgaaaatgttttaggatcatctgtgcattcttctctgtttaaggttggtaacagagcatgcagtgctaccttcgtctcgggctcgtggcacgaaccgccaaaaatcgacggcgatatcaacctcgttttgtttgtgaaacttgtatgtccgtggtaggttgtagcggagctggaacagagggaaatacagattatcatagcaggaacaaaactggaaacagaaaacatatgttttgacccgtaaagccttaaatgtagaataaactcatctagaaaccaatcaactttttgccggatttcaagcaaaactagaattgctagtcaagtgttatatcccggtatttcaaataatataaagaaaacaggtgcaaaaatggtttaaaaaatcataggtagctcaatatcgcatttcaccattctatttgcccagatttcctacagctagcaggcactgaatacatttggtcctccaaactttactcatacccaaatgtctgattcagtctaaatggaagcaagaaaacaaaaaaaaaattaacaggataatttatttactacttccccattgaaatactgaacaacatttttagggggtagatgcacaatacaaaatgataagcgcctagcatctatttagttacctcacatagaacctcggcacttatggcattgcagttgcgcaaggctaccttcttgatgtgctaaagatcagacacaaaaaaggtggacaaaaaatcaattaataaaacttccatgctaactacaagatggaacattgataaatatggttacttcttgttggaaatacactgttgcaaatagagaagggaataatcaaacatttatcatcagaatctaataaaataaaagagagattgtttctgacatttgtaatccccttgaggaacacttacttctctggtagaagtcttgtgtagcgaatagacagctcgagtggcaacctgcaaatagcaatagatattaaaaattttaaacatcatgcaataatctcagtcatgtgtatgatggcaactgctgcccagtgccctcaccttcatgcccatagaaatgaattccatgtcagctccttttctgcttgtcccaaagggaggattcatgacaacagtgtcaacaagaaggcctacttcaacaggtagctaaaagatcagggaagcttttcaatgttgaaagcatctacgcttatgtgtataaatatatgattttgtttcaataaccattcacattttttttgtgacactatattatctttcttgacctgaacaatggtgcacaggctattgaagtactggagagaaagtaaatagctgactcgtatagtagcatcagctaggatactactctggatatcttctctaggtgctatctacttatgtatgaaataacaaataaataacatgcaacagaaaaaaacagtgtgaaaaaaaaactatgagaagatcagaagcaataggttatatagaaaaataattaaaaaaaaaactgaactaaaggtgcacttaaactaggtagagtatgtcatcatttaaggacaatacctctcaaatttaaattctttatatcacactgaattaagtcgatatccagctgcacatcaaacatttaacaaaagaaacatgtcattcacatagtcaagtattgttactgatcctagaaataactatccctgtgtccaaaaatatagctgtttatggctactatattttgggacagagggagtgatacattaaatctgagtctctgctttcagccctactttgccaacatttgcttagccatgcaaatttgaccactaatactaaagaacatgaatagagacagagacagtaaaacctatatttaaaaggataatctagacagattagtagatcaattgaacagaacaaaattattgcatctttacaaaagaagggaagcatactaagccatttatgaaatttctatgatgcattgataaaaataatccatggcagtagtacatataaagaaatgcaaactgcaatatttgaatataaaaaacatctcagatgtggagaactgaaaacaaaaatcaacacctgtagtgcatttcagtagttgcagaaagctgatttaagcatacaactttccacaatgctatttggcaggaagacgccattaacaatttgcactacatacagatgagaactatcagaaaattatgactacaataacatgcatagtttggtggtgatgcaaggaggatgctggaaaaaggtgaaaacgagagggtacatagacaatgtgaagatttttcaacttcaggctaaaccaatggttatattcggaaccaaaaaaatgctatacctctagatctgcagcattttcttgagcaagttcaagggattgcgggtcaatatcaattccaacaacatgcctgtgatttcacaaccaaagggacataagattagaaattgtaactgaacaaataacaacaaaaggcataaagatactgagtgatgaacctcattttcttgtttctaatactaatcgacgagcacttaagttctgtaactaatgtggtgagcaagtggctaggtgaactaatgtggtgatttactgtccactaagttctgtaactgatggtatatcaacacacaagcatcatggacagatatacttattaggt

SEQ ID NO: 77157 - DNA, 700 bp, Oryza sativa
gtaggataagaaagaaacgttactagagataaaagggaaacataaagttcttatgggacactaaacacacttttcaaaagataaaaaagactttccaaaagataaaaggaaacaaatagactcttcttaattaatatataacttgccatgccgcatcctccttgaactcagtctcttctggataaactttcttgaataaattaatttccttaaccaaatcctctaagaacccaactggtagcgacttgataactcccattggccgattccagaactctgaaaccgatattgtttttagaccgatgacgtcttcgaggcttactaaatttcactgttaacacccttatgaagaggtgtctcttcataaccaggcacaattaatatgtgctaattgttcactaagccatgcctaatcttcggttgccaatcttttccagcagctagtgcccccctctgaaaaccccaccaccacttcgattgtacactacggcagtgttcgtttggaggacattgagggagaaagcacctcgttgtccgcacgaacgcttcccaaactactaaacggtgcgtttttttcaaaaattttctataggaaagttgctttaaaaaatcatattaatcaatttttaaaatttaaaataattaatactcaattaatcatgagctaatggctcacctcgttttgcggggctgcaggaat

SEQ ID NO: 77158 - DNA, 4701 bp, Oryza sativa
ccggatctcctcttcgatcctgccgcgcatctccgcgagcagcgcagcgtctgtctccagcacgccgccggcccccagcgactcgtacagagacgccatatctgacgccaagcacatcgatcagatcaaatcaaatcaaatcaactcaagcgccaaattcccacacacacacacacacacacacacacacacacacacacacacacacacacacacacacacacacagagtcagaagcacgcggcaagcggaagctgccacggccattgattcgagtggagggggggggttgaggttttctaccatcggatttgactgcggcgaggacatcggcgcggaggtcgaccttggcgaggtcgtccacgtccgggtgcgagagcaggaacagcttgtgcgccagcaccaggtgcggctgctgcttcccttcctcgcctacgccgccgtccatctcgccgccgcttccgccgccgccgccgccggagaagagtcgcctcgcttctcgctttgcttccgccgcaagaagagattgggagagaacacgagagagaaggagagaaggctagtttcgtcctccaaagtttttaattcgggagagtatttccaggctactacgacgttgcagagcgacgtggtcttatctgagacgtccgtaccacgatccgacggctgtgcggggggccgagatctagtacggcacgtgtacaagggcaaagcgcaacaccgacccgagtccaaactccaaaccccattccgtttccgagttccgacccgcgccgccacgccacgctacatcccgagctctcaccgagagacccaaaaccctttccaccgatggccaccgccgtagccgccgccggcggtggcggcggcggcgagcagccgcgcaggaggaagccggcgccggggagagggggagtggtgctccccgcggggctgtcggaggaggaggcgcgggtgcgggccatcgcggagatcgtgtcggcgatgggggagctctcgcggcgaggggaggacgtggacctgaacgcgctcaagtcggccgcgtgccggaggtacgggctggcgcgggcgccgaagctggtggagatgatcgcggcggtgccggaggccgaccgcgccgcgctgctcccaaggctgcgcgccaagcccgtgcgcacggcgtcgggcattgccgtggtcgccgtgatgtcgaagccgcaccggtgcccccacatcgccaccacggggaacatctgcgtgtactgccccggaggccccgactccgacttcgagtacagcacccagtcctacaccggctcgagcccaccagcatgcgcgccattcgagcaaggtgatttacctcactggctactgatgtcacttggaaatactataccacctgtgagatgagctgcacggcgatgctttctctagtgttgttttgaagtatgctgaactgcaagtgaaggcagagttctgttatttattgaaaattagtcgattgtcagcaagccacggggtagttattttgtcgaaattgaagacttgcattagaggagtacaaatgatgcacaactcattaattactgtgatcaaagttcactagctaatgaaacaagaaagtacaccaatgcccactagtgatcttttggtctggcagttctatagcaacagattgtgttgggcgatatagccatgaagttgtcgccattattttgactgcttcatccctttgggtttcagaactttctgatctgtctacttgtaggtacaatccatatgtgcaggccagaagcaggatagatcagctcaaaaggctaggccatagtgtagacaaggtttgcccttacccttgagagtgttgtgtcttggtttgagtaattcgattcactttctagttacatttgattaatgctatcataagtttaaaataatttgaatacattatgcaggtcgaattcatattgatgggtggaactttcatgtcattaccagctgattatcgggattatttcattagaaatcttcatgatgccttatcgggacacacttctgctaatgttgaagaggctgtttgttattcagaacatggtgcagtcaaatgtattggcatgacaattgagacgtaagatcatttgacaatctaaactacccatatgcttaggttccttgatggttctgtatgatttccccatgaaacatctttattaacttcagttctataaactattgttgtctttcctcaaaattacaggagacctgattattgcttggggcctcatttgcgccagatgctatcttatggttgtacccgcttagaaattggtgttcagagcacatacgaggatgttgcacgtgacacaaacagaggtcacactgtagctgctgttgctgattgcttttgtttggctaaagatgctggttttaaggtagtctccttaaatcattaatcatctcgtttagtcaacttgttgctggcagcatttgttaaaataaagtatcatctcatatggttgaactgttttaatcctccattgattaccttttgataggtggtcgcccacatgatgccagatttacctaatgttggagtgaaagagatctggaaagtttccgagaattttttgaaaatccagcattccgagctgatggtctaaagatttatccaactcttgtgattcgtggaactggcctttatgagctctggaaaactggcaggtacttattttatctagcacttgatattctagattgctagtcttgtgttcactgttgtgtttgttctctagaactttttagtgagaacttaggccctgccaatgtttgttgtgtttcagataccgaaactatccacctgaacttctggtggatattgttgcaagaattctatccatggtaccaccttggacacgagtttaccgtgtacaaagagatatccctatgcctcttgttacttctggtgttgaaaaaggtaatcttcgtgagcttgctttggctcgaatggaagatttaggcttgaagtgccgagatgttagaactcgtgaggcgggaattcaggtctggaacactgcatctcctctcactctcacatgcttgtaatttaacttagctctttgtccttattattttcgttgtttgtctttatgtaggatatccatcacaaaattagacctgacgaagtagagcttgttaggcgtgactatgctgcaaatgagggctgggagacctttctctcatacgaggatacacagcaggtacatatattttgccagcatttcatgtgattttggggaacttgaaaatatgcagaatgtctgagcaggcctgtttgaaattatatgaccaacacctatcttcttggtccgggaatttttactgttatgtgtttcagactttcagcagtccattgaagtatttatttgttatttttaaaattattagatcgatactattctgcagagttcaacgcttggccttatgttctctcaatcttttggagcactcacattttgccatcttacaaattatacaggatatccttattggtctgctgcgattgcgaaaatgtggccgcaatgttacatgccctgagctagtagggaggtgttcaattgtccgtgaacttcattatatggaactgcagtccctgtacatggtcgtgatgcagacaaactacaacaccaggtgaccatagtacatgtgatattattagcataccatgtttgggaaatggatcggtgccatgacagtattagtagcagttagcaccaacgactttgctatgcttgcaaattagatatcctggcacgcttgataaattgtagtcactgttttaaatcaagcttagtgtctaaacttctcaatagtatggcattctggtatggtatattgtcacatattatccaatttcttatcattagaggaaatgtagtgttgctctataaatggtgattatttctcctgttttgacttgcaattggtacatgcctatagatatacttcctaacttgattgtccagaaatataaattacatttctgatttttttttgactcaacatcgacagggttatggtactcttttgatggaagaagcagaaagaattgctcgcaaggagcatcgttcaaagaaaatcgctgttatatcaggagttgggactcgccactactaccgtaaactgggttatgaacttgaggggccttacatggtcaaatgtctggtctaataacttctatttatggatgcttgtactccagcagcattgtcactgtagtatgggttttgtacaccagtgtaactttttttttatatgaatgagtaaacacacctcctttcaaaaaatgagtaaacataacatttgattacatacatctcactacatgttttgaagctgcatttataatagagaaatagaatagccatctcatccaaactcctcgccggacatgccaaattcatgttcagttttcactgcaacatcacattagatcattgaacatcataattttttttcagagatgactgtttttaacatgtcaacttgtcaagtgtaagcacggccacacttgaataatgcacgcacgtgttgacgaacccacggccacgagtgataagtaagctgacaccgaagggtgccagtagccaaaaggcattccggccattgcccctgccatttaatgccaagaagtctggttgaatttctttctgtcatttacagaccgaa

SEQ ID NO: 77159 - DNA, 1209 bp, Oryza sativa
cttgaggaagataggattgtactctggggcagaaagctcttgaaggcttataatgagttctgggacatcatctgagagaaaatactcttggattatgtgtccagattcttctttgaaatgcttgatcttttcaccacttgcatttcgcatatcttcattaggggcagaagatgtagtgaatgaagcatcaagccatccttcagatgtagcagtcagaaccagcttgtcaaagagaatcttggcagaaggaatatcaaggctcagatcatcaatactctctgctagccgacaaaaacccttagacatttgattagaactgatcaggcaacctgcagttgattccttcaacagcttcaggattaatggctgtgatgacagattctccatgctcaaggtgagagcgcgtttaacaacctcatgatggaaaaatggaaggcccagctcccttatacacctaaaagcttcatcaatatctccactctcaatatactccttcagaatatcctggattctccttttcgcctcttccacagtaaagtgagtgctcccaccccacttgcgctcaactagctcagcatgatggggggctgacaagtagcttttctcagaaacttgcagaacttcaatacctttagaaaattcaggaagcagtgctctggctcgagtgaggaaaacaggaggcagtatttcatccacaacagcacgagcaacaaaaacagacaagacatcaatagcatccggtatgtcgacagatagatcttctgttgactcaagaagcatcataaaaccttcactcatcttggaagagcctagtagatccgcatacaacgcagacaacagaattgacgccatttctttttctttgtcatgacgatccattgccatggatatgagcttcttgataaagtaactgtggaactgatcagatccaagactccttaactcagaagctgccagttccacatctcctgtactaaagtactcctcaattacaggaactaaaagccttttatagtcatctaatgtagcaggaacctacaataccagtgagttattgataaattagtgtcaaaccaacaaaataaattagtgccaaaccaacaaagaaaaaaaaaagcaaaattataggagcagcgagatcaaaccttattgttcccattaactagtttgttcgacatcttagatggtacagaatctacatcctcaagg

SEQ ID NO: 77160 - DNA, 594 bp, Oryza sativa
ctgcacccctacagcgtctacgccgccaccaaggcgtgagtgcttctcacttcttcacctttcaactcttcatcagtaacgatttttctctgcgtgttcttgcttactactactacatagacgaggcagaaaattattttatgctttcagtgagatttttggtacaagctttttagtttttgtgctctctcagatcagttgttctggcatggaccacggaaatggggactggcacagttagagtcaattaaattcatacttgattatatactactagtataaaattatgcttccatattgtgatttgggtttattgatcgagagttagtggtcatgtggatacaaatgtccaccaacattttcaggggttttcagctagaagcctagaatagagcactgaggtttctcctgggggtttatatgtagatggagaacttgttggagggtgtaggattatgtatatagggcctgtgtagttcgcgaaaagaaaatttttgggtgtcacatcgcacgtttgaccggatgtcggaaagggttttcggacacaaatgaaaaaactaatttcataactcgtctggaaaccgcgagacgagt

SEQ ID NO: 77161 - DNA, 2383 bp, Oryza sativa
acctttctgctatctttcctccaatttttatgcattatattcttgcgcatggaagctataaacgtccctgcaaaaatagatatgatttactctattttttgtcgtcatgtgcctctatggtcaggtcaggagtaccgagatttttccttgattttattacagcatagctatgcactctcctagaatgctcaggggatgtgtgggcttgggggggggggggggttcttcatgtgaatggcccttcacatacttcagaaaaatggctacgatcttgtgttgaaaaacttgactgaaatcttattagtattttgcaagtttgtagtcatttgccaattttatgttcatcaattcaacaagatgagtggtatgatactaccatctgaaattaaaagctgaatttgctgctactttcagatgcaagagcaacattcgaggtgtttcattcaaggaacagaagcaacagaggtgacaccgttgatggagtcatgcatgccataagttgttattatgcgggtcatagattatggcggtacttcaaataagttgttatttgcataatcagggtgaacaatctagtggcaatcttgattaacacatttggttatctggcatgagtgtataatgacagactgctccaaagaatacgagtacttgtttggctgccattttaagtgtacatatccgcctataattttggtgtttgccatacaatctgattatattctaattgcatactttctataattcgctccctaaagacagtctattattaatctttagatcgattgtatatgctttgtaatttagattgtccaattcatagtgttatagttgattgacaacatttgaaggtttttggagtaactattattgtattcacaaatatatttacagaacaataatgctcaagtttattgtgtttcacgttatttaagacttgttgcaacgcacgagcaccagactagttaagaaagaacataagaaacttgaatagtacaaggagtggcacaacgggcattcacaatatgctaaaaaaaagataacaagaggattactaccgggtagtaactatctggttcagcgttgtggttgtggacgtaggtagtaaaatgggtagtagcaagatctttccggttcaacgttgtggatgtaggtagtaaaatgggtagtagtaagatctttccgccgtgggtttgtaatacccattaagctaacaagaaaacaacacacttatctgaatgaaactgtattaatcaattacatggccttacatggccaaaacaaaatttaatcggcaaagatctccccttttcactgtcatatctcccctcacaaatctgtttcactgtcataaccttttcctcaattggtgtatggatatctcgtcgagggacaaaattgacagcctttgcaagaaacactttcaaagaataatactattaatcaattacatggccaccgaaacgaaatttaatcggcaaagatctcccctcacaaatctgtttcaccgtcataaccttttcctcaccggtgtatggatatctcgtcgaggggcgaaattgacagcctttgcaagaaacactttcaaagagtaatactgtttctaaattaattgctatttcagttacccgtcttatgtacgtcataaacttctcgtcaacttgaaagcccacaattctgagaacattcaaattttgatgcttaaaatcacgagatgattcccacttcaataatttatcaccttccttttggtatagttcctcatcctcactcgttttgcattcatggtcccacatctgcgtataggagaaaccaagttaacaaaaaaaatagacaatattttaagaaatcaaataaactatatttgctgccaatgtatgtcaacaagagtattgaagaacacaattgaggttgcagtttagtttcaaaaaaaaattgaggttgcagttgttatgaatcaatatcttttgaatggtgacatatttatgtcattctgatataaggaaaacacgttatagtttatgccattatattatttacatagctaccgatgtattcctaagaacacatacctttatgtgcatggtttccaatagaggcgcagcttctaaaagaaaaaatatccaagtaaggttgcactcttcatgaatgcaagtaagactagcaatctgcagattccgcaacacaggagccaatagtttcggatgttccggttgaatccaaatctgcaacatacagctaatgatcaaaccatgatattctaacctaaaacaatttcctttttaacaaaaaaaaaagtttcaaactcacccttccacattcaaaatccagatgcagtgcgcctatagccgcattaccaagaaactcacttagcttgatattc

SEQ ID NO: 77162 - DNA, 775 bp, Oryza sativa
atacttttttcactctatttgtccaatcgtaaatcaattcatcaggcactgcctgtatacttttttccctctatttgtcccaacataagtacataggactaagctagtaaattttacatcaaaactgaacccaaaaaaaaatcaatcccttcagtagttggttacaagcgtggctgaggttgagcagcgttctgctgctgccggaggccgatgccttcatcaccgccgccgccgccattatcatggtcgaggctcgagggccgccgccgccgctagtagcgcctcagtgtccctgcgtatctgatcgagcgagcggcggaccaaggggcatccaacctccctcatgtggcggatcatctcgtggatctcgtcgacggggacgggagagcagccggcgtcgacgaacaccagcagcgcctcgatgatgctttgcatatcggcgaccagctgcttggtctcctccacgcggatgcggctggtctccgggtctggcaactccgacagctgcactgacgaccgcgccgccgacgcctccctctcatccatggcgaccttgtagctgctcgtcagctcgtgcgtgtgcgtgtgtccatgagaccgtgactacgacgatggcgatggctgatacggtggttggttcgaggggtcgatcgatgagattgagacgtagcgtggtgtggtgatatattcggacgaatcggacccggactccggagtccgaaaggaattctaaaagaaaaggaaagggaaaaaaaaaaaaaagagagagagagag

SEQ ID NO: 77163 - DNA, 528 bp, Oryza sativa
acccgacgcgcaaatagatccacggggtgtccatagcacgttttgggcaatcacgccagtcaccacgcttggcatatgctggtaaatattccacgaaactctgctcttatatcacgagcactcaccacgcacaaatccaccaaacacagatttagctaaccaatgctgttcttgctacaagattaatcagttatctgtaggtattgatcagtgatcagttgcagagatgaagtttgggaagctgctcaagaggcagatcgagcagagcctcccggagtggagggacaagttcgtgagctacaaggagctgaagcgcatcgtcgcctccatctccggctcgccggccgacgaggccgccttcgtcgccgccctcgccgccgacatcgacaagatcgactccttcttcctcgagcaggaggaggagttcgtcatccgccatagggcacgtacaccaattcgcttcaattcgttgtgaatttagataagttttctgatggcgaaatgggttcttgccttcttggttgcagg

SEQ ID NO: 77164 - DNA, 2651 bp, Oryza sativa
gttcaggggcaaggagagggaggacagtgaccacctcaaggacatggtgctgctccttgaggaccctgccctcaaggacatgaagcttcgggccaccctcgtggcccgggctaccatctagagcccgtatcaatcttttatccaagtctaggactagcccagcctggtccggcccatcttatcacgctaactgctagattgatcgcaccatcatccttcaatgaaacttgcctcaccggggaacgaaggaattaagtcagtggttgcgacggcggtgttgtgccatattggcgttgcatgcgcctggtcaaggaggcggtgaatacacccagacgcggatctgcattcggtctttgaaggcccgacatgcagcgatggcgccggcggcgctgcgttcagcgtttggcggcggtgctgagttcggccttcggcgtggtgggcggcggcgctgacggtgggaaagtgccgcgagcccgcgacggtcgtgcctcgggcgagaaaagtggaggcagcgcattcatcgttgctagggatgaagcatacggacgtatcgagaacgtatccagatttgtttttgctagtattttagtacaatatccatgtataagtcggtttttaagttcgcttgcttttgaaaatacatattcgtatttgagtcagtttttaagatcgttcacttttagtaatacagaataaatcatataagaaatctatttaaaaaactcgcatgctaacttgagacgattgaactcctaactgtagataaaccatatacccgtgacgggcatagtctattttaatcttattattgttatatggtttagttaagttaaaattcattgtaggagttcgcttggatatatatatatatttttagaaaatcataagctgcagttaggagtctgatcgtcttaagttagcatgcgagtttttttaaacagatttcttatatgattgtcttaagttagtattttggtacgtcattcgtgcatgattcggtttttaagttcgtttgcttatggaattacatatatgtatttgagtcggtttttaagatcgttcacttttggtaatacagatagaatcatataaaaaatctgtttaaaaaaactcgcatgctaacttgagacaaccggactcctaattgcagctcatgattttctaaaaatatatatatgcaaacgaactcccacagtgaatttcaacttaactaaactatataacaataataataagattaaaaaagactttatccgttgcaacacacatacatttttttagttattcaaaaattgtaaaaatcgccaatacgtatgggatacttatccgtatccctttgtgtatctgatacggatacgtcgttttctaatgtatgtaggaggcgtttcggtttataaatcagaacacaccgcgcccttcgcccgttccttgtcgccgaacgtatatacgtgcccgggttctccagcgaatcatcgaatcaagcgacgacacgacacgaacacgatggacctgagcaatctgcccgacaatgtcttgctcgacatcctcgacaagctggacacgcgggaggccgtgagatgcagcgtcctctcgaggcggtggaggcgcgtccccggcatgctccccaacatcaagctggacgtcgactcctccttcgagcacgacgacgacggcttcacctccacgctatccgacgccgcgaggaacaactacgcgatggtgggcgcggtgcagagcctcctgtcgcgcgagagccggcacgacatccgccgcctggacctgagcttctcgagggaagagtccgtcggcatcatccacgccatcgacgacacggttcgtagtcttgtcggagaagtcgttcttggaacgcccgcacaaggacagggtcaagcaagggaggcgccttctgcactgcttcgacgcctacccgcgcgtgttcgtcggcctcacccgactgcacctggagtttgtcacggtgcacgggcctcgcttctccgacttgatcgccgcctgtgagcagctcatcaagctctgcctcgtctactgcgacttcggcaaggaaacgacgctgacgatccgacacgagcagctttagcacgatagatctcgagttctgcgcctgttacaccatcgagctggagtggctcccgaagctggcagagctatcgatagccgtctggccatggacgtcgcatgagtacccgctggtggttggccacgccccacgacttcggctgctagacctatctcacgccggtatggttaattcaaaaattctccggttgagcaagctacttgacaatactacgagccttcaagaactgtggttgaactttgaaaccgaaaaggtaagtcgatcatggcactgttaatatcggtagcgaaccattgaaggaaacatcacttgaatgtgtattcattgttcgtcacttcgtccttggtttccttctatcttatgcaggtatggattcaactggagaccccaaaacatttggctccttttatgaggaatttgacgttggtggatgtccaccgcattcatccaaactgtggcatcaattggacgctgtttcttttggaagcagcacctcttttgaagatacttagtatttcggtactgccttcgttcttcgttctcacttactagacaa

SEQ ID NO: 77165 - DNA, 1645 bp, Oryza sativa
ttcctgcacccccagttgcacgatatccacaaacaaaaatagagagggatttggtaaagaaagccataaatgagggaataacatcacctatcaaaagcatccagttttttcacacatccgaagctggaactatcaacatcattgactgaccggtcttaaattgttttgtattatgttgcgagtttagtatggctgcaattgcaagttgtgcaatggttaccaaagaaacggcttcagtcaacagtagatttgatactcatgttcctgatatagtaatgtatatcattaatatataaaattcagtcttcttttcaaccttttcactatagttatatttgaaagtttttcacttaaaaaactatcgaatgtactcccaaaagaaaagctgtgaggctgttatgcatgtatatgtatagtgcaaagtaacgctgatggcctgaaatagtttgtgtgaatgcaaaatgtaaattgacaaaacatgagccagtagcccagaacatacatcctcgatgaatggcatggcatggtatgccaacctctcagattatatatgtcttatatgatatccttttgattcagaaaagaattagattaggatggattcttgtcatggttgattttatgagttaatttttgttccctgagtaaaaaactgttccttctccttttggtcactaaaaaaaaactcgaatattagggaaggacataatatcaaataattagaaggggtgaggctttgaacccaggtcgtctagcccaccaccttgtggagctagccggaagacccctgagcatttctcactccttttggtcactaactgttccctctcggcctctcctgtcatggttggtgttatttgttttggaatttgtatctatgggagaagcatttgtcttctgtattgagatttcatttgtatccagctgatttggtcacctcatgagtaggatcagcaccctttgaaggctctgcgagctgatacagtgttcaccctttgcacctgtcgaaaatcacgtacaccactttaggggcttgcattgtcctttgcatgctttttaatcacaggaaaacaaaacagtttgtttttcaaagctttaggcttgcttggaagcctgggtttagcttaaaaccagtgtaaaagtatctgccagtttttatttttagttggaaaagtgataggatgggctgtttatggaaaataaaaaatccctagcccacaaaaaaaatcgaacaaaagtcaggctttctcgcaccgaggtttgtcgagctggtatgagcccagcctcttgctccgctctgtcttcgttcctgtctcaatcgatttatttggagtaattttacggtccttgagaggtatcggaaggtaccaatatttttagtataaattttgatacctcctaacaaaagatgtcaaattttagacttaaaaaaatatggtaccttgtgataccttttcaaggacagtaaatttactcatctatctgatgccgccagcggccagggcatgatcgacccacacttccgccgccttggatggcatgtctgaaatgaaatttgtattatgaaaattaaatcttgagctctgaaaattccaagaaatttccaaagaatactttatgccatcaagaatatatttaaaaaaat

SEQ ID NO: 77166 - DNA, 9022 bp, Oryza sativa
cctccagctcgacggtgtcacaggtgcagaactcgagcttcaccacgcggaggtgctcgtggtggatcgtcagcggtgtctcctcaccgaagtcgcagtagacgagtgagaggtagctgagcttctcgcacgcggtgatcacgttggagaagcatggtccttgcaccgtgatgcactccagatgtaggctggtgaggccggcgaacacgtgcgggtaggcgtcgaagcagtacagaaggcgcttcccttgcttgaccctgtccctgtccgggcactccaggtaacacttctccgacacgacgtcaaaacacattttgaggatcctgcggccacgggccatggcgtcgtcgatggcgtggatgatgccgacggactcgtccctcgagaagaagctcaggtccagacggcggatgtcgtgccggctctcgtgcgacaggaggctctgcaccgcgctcaccatcgcgtagctgttcctcgcgtcgtcggatagcgtggacgtgaagccgtcgtcgtggtcgggcgtgaacgagtcgacgtccagctcgatgttggggagcatgccggggacgcgcctccaccgcctcgagaggacgctgcatctcaaggcctcccgtgtgtccagcttgttcaggatgacgagcagggcctcatccggcaaatcgctcaggctcatcgtgccttgtcctctgaaggcctgaactgcagcaggggtacttatgttctttgggagcaagagggaacggacgacctacggcgcgataatgtgtttctgaacaggaaaacctgcccgtacctcctatttgtctgtgacgctgccgctgcgtagtcgtttgactcgtttccgattccaactccaacatccgactccgacgctggctgcttaggcctgccacggtaaggcccatgtccttcgaaaataaaaataggaaaaattgaaaccatgccattataattttataaaatttgagatataccatcctgacccacatgtcattgactcatgtggatgctacatgtcattgagataccgatgacatatctcaaactttgcaaaattataatggcatggttccaaattaccctcgaaaatatgcccgaatactgtttgtcgtcgactgtcgccagctatggccggttctccatgggcatatccatggctgctgcctcgcgttggcggagcgagacgcaaatctgagcttgtcatgttatgcttgcggattggaagttttgaacctcctctggccatttccgttgacgttgagcacgcacactcgatgttcctctctatcctctccttggtcgtttcggctcccatatttctctccaatcgctatccaccatagccttcggagttagtgtctgcagcgtggggtagggagtacatcagtggcggcagtggaatcggttcctgttcctctctgatcctctccttggtcgtttcggctccgatattcctctccgatcgctatccaccatagccttcggagctagtgtctgcagcatggggtagggagtatatcggtggtagcagtggaaccagatcctcttctaagtcagagacgttcgaccacgtatcgtcgttccttgcacatccgatggcaatgaaaaggaaaccgacgcttctagcctagtgttggatgaatgtcacgactttgaatgtaatgaggtgaaaaccctctaatttttaagcaaccatagaacatataggtttgaatgtaatgacacatctttgatgctaaatcattaagttatttaaaatatattgttggtcaaaagacatggtaactcaaagtcaaaaccgaagtttttttaaatgaaaacaatagtttactatataattaaaagtagtttattatgtaattggtgacgatgtagaattaatcataagctgaacgtcatataaacaactccagaagaaaaacatacatatctactactgtactgttgagtgcagtcctttcttttgcaacatagtacaaaattgtttatgaccaatcaatcaatgattttgatagttctagcttctgatgtgtgaaaaaattgaatacttttgataggggacgttcttccctcattgatagctctctttaccaaatccctctcttttttagtatgtggatatcgtgtaattggataataagattcgcaaatctcacacctatcatcgtgcaatgatatttcatccaaattcactgctgccttcatgacccttcttatgtagctcatgaatctattttcaggtcgaaagccataaatgatgagcttcgtcaaattgttgtgcttgaaattagatggttcccaatttatattgtttttctcgcaaatgaacattctctctagcagctcttcctcaaggggcacacagtgatggtccgttacctacataaagatagcacattttagtgtttaacataaaaaaagaaggaccaaagtgaatatatacactccctccaattataaatacttgatgtcaatcataagattattttttttgaaactttgtctattgattttatgttagcataagtttatggtagtatgataatacttctatgccaaatctacacaccatttttctcccttttaaactaagcatttgagaagatattggtgacaaattatttgaatgttctttttgaaaagttgtattttcaattacgtgataatgaataatgaaaatagtaccataatactaagaatcttcaagagaggtgccgcttccaaaagaaaaagtgtccaaatgatgccactatttggatgaatgcggttgacatccataaacgtcaaaattccttaaaataggagctaaatgtgtcggggtctctggctgaatccatatctgcaaaagataaaaagaaacaagaaccaaggataaatacgaattgttgtgacctcccttcaaagattcgataccagtattagctatgcttgtattgacttactttttcgcattcgaagtccaaccacagttcgcgaaggcttgtacaattgtcaagtagcttgctcaaccggagcactttggaatgaactaaaccggcatgagttagctctagccgctggagccgaggagcatggccaaacaccagcggatactgacgcggcgaccaaaaccagacggacatcgacagctccgataacttcgggagccactcaagctcgacggtgtcacatgtgcagaactcgaggtttatcatgctgagctgctcgtgttggatcgttagcgccgtctcctttccaaagttgcagcggacaagggagaggtcgatgagcttctcgcaggcggtgatcacgtcggagaagcggggtccttgcacggtgacgcactccaggtgcaggctggtgaggccagcaaacacgcgtggatagcggtcgaagcagtgaagaaggcgcctcccttgcttgaccctgtcactgtccgggcattccatatatgacttctctgacaagacgtcgaaccgcaggtcgaggattctgcggccgcgggccatggcgtcgtcgatggcgtggatgatcccgacggactcgtccctcgagaagaagctcaggtccagacggcggatgtcgtgccggctctcgtgcgacaggaggctctgcaccgcgctcaccatcgcgtagttgttcctcgcggcgtcggatagcgtggacgtgaagccgtcgtcgtggtcgggcgtgaacgagtcgacgtccagctcgatgttggggagcatgccggggacgcgtctccaccgcctcgagaggacgctgcatctcacggcctcccgtgtgtccagcttgttcaggatgacgagcagggcctcgtccggcagatcgctcaggctcatcgtgttgtcttgtcgtcgctggcgttggttacttgcttttgcaccgtgaatgcccacaggccacagcccaccgtctcaaggcctgaacagcagcaggaaacctgcttgtctgtagttctgatttctgaaccgaaaccaaacctgcggcgagccggcgagagcaagtgcccttgtcacactgtatttatctgcgacgctaccgctggccgcggcgtactcgtttccgactacagtcctactgacctactccctctatttcaggttacaacacgttttgactttagtcaaaatcaaactactataaattcgattaattttgtagaaaaaatagcaatatttttaacacaagacaaatatataatgaaaaatttatttaattatagatttaacaaaatgttgtaaatattactattttttttctacagagttagttaaattttaagtagtttgactttgactaaagttaaagcgtcgtttaacctttaaacggaatttaaacggaggggaaaaagtacacccaaggtccctcaacttgtcatcgggataaaaaacgtcctcaaaccacaaaaccagatatacggggtcccttaattatataaaaccggtcaccggaggtccttcggtggttttgaacctggttttatccgacgtggcggctaaattagcgcaggaccccgtgggccccacatgtcagctggccacgtcatcaaactcctctctcttttcccctcttctctctcttcctcatctctctcccttctctgccgccggcagtgcctcggcggcgggcatcggcggtgatggcggcggcggtggggggagcggcgtacgggctccccgccggtcgccgtccacgcatagctcctccccccgcagcttgcgcccaccgcctgcggtgcgccgccgcctccccgtcggcgaggacgcggtgcttgaggttggatatgtcgaagcagcagaggaagcatgtaggcttggtgcagctggggatgtagtcgcggagcatgtcagcgacgccgcggtagcggcggaacgcgaggagagagcacgcccggagctcgagagcggcctccatgcgcggcgacaactctagcactgcttccactagtccaagcgccgtcgtggccgctgagtggtcgccacattccccattgagcggcgcggcggcagcgaaagcagcccgtgcctcaatgaggtagtcgccgatgatctgctgcacaatgcagagcaccaacaaatcagttgctgaagccaaaggcaaaggcaaatctaaattgggagcaaaaccgcccaaattgccatcattttttgtggcacattagatgaagaattaaagagggagcaagaaacaacctttcggtgtccgcggagccaaatccttctcttgtcaggaggggaagaagacggcgaggacaccgtcgccgaccaccgccgttcgtccgcaagccggctgtcgacgagatgtccccgcgcagcctcgcacacctgcagtgcctcctcacgctcgggctccatcgccgacgagtggcggctgggacgggctactcgacccgctcgaccagaacctccgccgcgaggtcctccgctacggcgacttcgtgcaggccgcatacacagcgttccattccatgctgtcggcggcggcggcgtcgcagcacatctcgggtgggcgcaccggacgctcgtgctccccgacctgcggcggcgtcgcagcacagccagaagggagagagagatgaggaagagagagaagaggggaaaagagagaggagtttgatgacgtggccagctgacatgtggggcccacgtgggtcccgcgccgactcagccgccacgtcggataaaaccggattcagaaccaccgaaggacctcggtgaccggttttgtataattaagggaccccgtatatctggttttgtggttcgaggatgtttttttatccccatgacaagttgagggaccttcggtgtactttttccaatggagggagtagtatccaaccccagcgtccgactccgactcccgcttgcacgcgttcgtcacggcccgttgaggcccaactaagtccaagatgggccgtcggcccacggtgcgaacgccggcgccaccgttgtccctgctgctccccacgagggttttaggcacgcctccgcctccgcctccgcctccggcagcaagtgagcgcggggagagagacagaagccggcggcggcggggcgagatggggaagaagcagaagaagcccaggaaggggaaggagaagacggagcggaagacggccaagggcgaggagaagcgcgcccgccgcgaggcccggaaggtcggcgaggaggacgacatcgacgccatcctcgtacgtgtgctccctccctcccgcccccctcctctgcgtcagctcttcacgctcgctcagtgcgctctagctcgatcggcgtctccatgtgcggttttgtttgctcaccaccaccttctgcgtctcgtgatgcactccggtggctgaaaaattggaagcgattttcgcactggctcacctttttcccttcacatttcgttgcgtagcagctatggattttagatgagtttggtgttgctatgtgtgctgtttgaactttttttttttgctgatttatctatttgctctggttatttttcattgcagaggagcatacaaaaggaggaggctaagaagaaggaggtacatatagatgagaatgtccctgcaccatctccccggtccaattgctcggtaagacattttagagcaagtgccagctaaagaagttaatctttcggtattcttgtgattatgtacttgaagtggactaggtatcatttttatgcttgtggtggtcatgtttgcatgcttagaatttatatactccagtaggattaataaatttcttcaggcaagatggatttttttatgaagtaatttgatcaaatatgatgatcttttggtgatactgaaccgattggtttttcagttccggataggtgatgtcaaattacaattcaggggcaaaatgtgttaaaagatagatgttcgttttgtttttttttttgttaactgttggaaaaagtttttgatgttgtacagagatcctccctctaaatgttaactataacaaataaacctgcatatgatcttccagctgaccaagttaattccttcttaaatgcagcttacaataaatcccctgaaagatacagaattggttctgtatggaggagagttctacaatggcagcaaggtgggagacatatccttcacgatttcactgctggttgaatgagatatgttcatctagtgttctttttgcctctattctgcttctagaggtttttgagtactgaaatagtatttcttttcctcgccacaatctatttctgcagacctttgtttatggtgatctttatcgctacgatgtagagaaaaatgagtggaagttggtatctagtcctaacagtcctcctccacgaagtgctcaccaaacagttgcctggaagaataatatatacatgtttggtaacataacttaactttgggaaggcattctatgagttaaaatgctttttcagtatgtatgatttagttttttattctgtgttgatgtttcaggtggggaattcacttcgccaaaccaagaacgttttcatcattacaaggtagaagactaattttgtcagtctatttcttgtgactgttttgagtatcttctcttggcacaaggcatttgcacaattcgtatataagcagtagcttcataagcaatacatatctggcatgattttttttcaattttaaaccaagagataggtactgattcccatgttcctacataattataagttgaaatatgactaatggagactaatatgtgcagttcttctgctatttattgatttaagattaagatgtagaggatgcggggttcacctgcccttttatttggatttgcacatataacatcactttttattcgctgattgcctttttttttcctttctgttgtgatattaatggggttatttcgagattagctatcttagatggaaaactcattattatggttctattcaaatttctggtctgattttgtactgtaggacttttggtcattggatctaaaaacaaatcaatgggagcaaattcttgcgaagggttgtccaagtgcacgttcagggcacaggatggttagtggttttacattaaaatcagtcatcaactattctgctcccctcttttcaccttaatatttctgtattatgagcagtagtaaattgtgttctttttcctacaggtcctctataagcacaagatcgtgctatttggtggtttttatgacactcttagggaagtgaggttagtacagttacattttatatgactctaccctggtaatcttgttattagagtaacatttatatttggaccatgtctagaagtagtggagtcattatgtccaaactacaaattatgcactacctgaataacagtgtagcactcttacagctgatcatccgcaaagaatgaaatggtgtggcgtagagtacgttctgaataaatagtgtgacatgacatgatctgatctgcattttttttataatatccttctgcagatactacaatgacttacatgtttttgatttagataatttcaaggtgagtacaccatgttaatattttgtttaatactgttagtagtaacacatgaagtcatttattttaatactcttactgggaatatttgtatttcagtgggaggagatcaagcctcgccctgggtgcttgtggccaagtccaagaagtggctttcagctaatggtataccaagatcaggtaggtctttttggatttaaagctaggacattgatacttcataaaaagagtttaaattaactataaaccaaccttgtcttcgactacttttgtttacaagagtattaatggcccttatttctgtagatatatctgtatggcggatattttaaagaagtagtttcttctgacaaatctgcatcagaaaaaggaacagttcatgcagatatgtggactcttgatcctcgtacttgggagtggaataaggtgatctcttgcaattttttagaacattgtatcaacttccatcatgatagtgtatcgagttttactttaagccatatatccactgagtgatttgcatattagggctgcaggaat

SEQ ID NO: 77167 - DNA, 2282 bp, Oryza sativa
  unsure (1)..(2282): unsure at all n locations
tatagggcgaattcgagctcggtacccggactagtctaagaaccacgtggatcggatgcgttgacaggtggatgggatggattcgatcgctatcgagtttttcgtcacgacttggctcattgctgattgggagttgtgaacacgtggcaaccaaaaacgtaggtgttgttgagattttagataaaataaacctttaccttaacaatgctatcaaaattttgacagaaatgtttatatgtagaccaaaatttggcaaaactaaactaaatgtgtacataactagataactttattaaaaaattgtatagtttaaaatgacatccatatgaacagcctcatagttgtctcgtcacgcgtttatcccccatcgtgtcacaacataaaccggagagcgtaagagcatgtctaataggccaaccaagatcggcgatagcgtgatcacgtcagtctcactgatatgctggaggagggaatggtagagcgagaacacgagtcgacgaaagaattatcaccggctgcaacacgcagtacaataaagaaaaagaaataagcctgatggagattggttcatgcttaaaaatatattatctgttactacaaatgatatgatagtaataaagaccattgctatatgagcagcctatactaacaggctatagatgatgtggttgtcttatagtcagcaagttgacgatattattaaatctgctttaacaagcgaaaacgttccccagcctcgcggccgccggctgcaaggacgcaggcggaggggctttctctcccgcgttcacggtcaatacggtcgggacgtcggccccggtaagagctcagggccatggcgtcgaccgcggactggcggcagtccagattcgggtgctggggtgcccggatccggtcccccacggacggacggcggcgtcctggtagctcggcgccgagttttggcggtgggtttggccggtgacgacctggcgggagacgctgctggagctagctccggtagccgagcacgaaggcgtggccggacgacgggtgtggtggtggaggtccgccgagagccggtggtgacgtcggcgatgcgggaggaggcaatgacgtttctagccagatctagctggcggcggcggcggctgccgacggcagcagtgacggtggcgacggctgtggcggcatcgactgcgacggttggctggcgagccaacggccgtggtggttgaggcgtcgtggaggcggtcgtgcggccctcgtgggtggcgaggcctgctgtgcaggcgtcgtggaggccggcggcgtgtggttgtcgtggaggccagcgtcgtgcggcagcggncagggcgtcatggaggccggcgacggtgtggagtcgcgaccggcgacatcgggtgctggtggctgcaggctgcgatggcggacggcttgtggcattggccgtggcgaccgtggacgtggctgcagtggaggaggtgaggatggcgacggcgaggtggctgggcattcggcatcagcggctgcggtggcggtgacctcggtctccggaggcatggcggcttcggacggctagtcgagggtgtggcagacggctgcatctggccagcgtggcatcgtttggaggaagtagtcgtaggccatgcttggcgcagataaggcgcagctgatggcagcggaggccgactcagcgcgagaggcgcgggcggcggagaccgaggtcggcttggcgtgagaggcgcagccgatggagggaggccggattggcgcgagaggcgtgtccggtggaggaggccgacttggcgcgagaggctcggccggtggtggaggaggcgacctcggtgtgaggaggagctgccggcgggtgtggcgcggtcttcggcacacgaaagctggccggctggggacgccggtgcaggggtctcacatgtcggcagagcttgagtggtggtggagcatcggtgcgtcagccgtggattcgcagatggtgagcggcgggtgaaaacctagcccggccttagccggaccgacaacgacggttcattccccctcctgagggcgttgtcatgctgtctcacccctcaagagtggttgccgggtgaaagccatgtcttggctcctctgagccccgacggacggcagcaacggtttttctgtcacttctcttcttgaagacgttgttttggcatccctagggggcgatcttgtatgtgttcatttgttggtctaacggcggtcggtcacgcttagcggcggccggttcggtgctagccttcttccggattgtgtgttggcgc

SEQ ID NO: 77168 - DNA, 2715 bp, Oryza sativa
  unsure (1)..(2715): unsure at all n locations
gtagagagagtgagatgcctctccaccaacagcaaatttatgcatctccttggttcgtatctgtatctccatcagtggcctcatcttcccaggttcacttacatcgatggccacatgcaagctctggtaaccattttcttttggccgtgtgacataattttttgtccttcctggaacttctttccacatagcttgaatgatttcatgtgtcctgtgacaagccctagggccccagtctaacgagctgccatcacaccgaggttctaagattacccttaaagctagtatgtcatttacttcttctggttttctgccatcttttactagctttttcatagtactgaaacggcttttataccgcccttgaattgagatgtcnnnnnnnnnnnnnnnnnnnncatcatcatctttcagtgcctgaagcaactgctccttgtacgaatctattaagagcttgttctcagtctcttggctcctcaaccattgatcaatatggtcatatgaatgcggaaacaaatagcgaaatgaaagatcctctagctccagtgatagattaccagctccaacagcatgggcaagtggggcatatatcttcaggacttcaagagactttatccgctgaagatatctcgggaggcagtcaaggtgtctcatcatatcgagctttagagcaagttccaagataactgctcggatgtcatagtaagaaagacaaaactttctcaatgcacttgcactttcatcatcaagtacatcaagctttgaaggggcatgcttaagccgtaaactctcgtgcagcaaatgagctgtgctgatcccaatctcagatttgacatccctcatgcttattgctcctgcatcaagtgcttccctcagtattccggctgaaataacttcggcgtccatctgccaccatgtgccaaaaaaaactggttagatcttacagtttaaagtggataaataaaccagagatgcttaactgttctatgacacaaagaagtgtaagtataaagtatcttatgaattaccagaacaatacaaggaaatgaagagttagaaaattctcatggacagaagccaaacgacaaataagggatagctgtttcgtaacaagtcctaaccaatattatcttttttttcgccgggctggcgtgaagagccagccgagatttattaagagaaaaggaagaacaagttacaagctacagcaaagagctacatgccggcaaagccagcaacacacttttacatggctgcctgccgctgcgtcaaacgcgagacgacacctcccggcagcgagctaccaccactactactgcaagggctcggttgactgctgcaagcttcctcctggcaccaagcccgcagctccccacattccccactcctcctccatagtcgcacacagctgcacaaccgacattattatcttttttttttaaaaaaagaacaagtcctagtcattaggaatgtcatttttttactctggtaatggaaactactaactcatcaatgccagtttagctatgataataatgtcctctactagttgtacttgtggtaatggtagaaataagcacccagatgaaaactgcgaagcaaacaataataattggtactactaagtactaacataaaactaaactgacaatcgtagccaatgtgtgtatgacaattactgccacaccagcagcaaaatatatcttgcttccagagttttgattacaatgggaattatgtgacgatgaattatcctttgctagaagcaaagaggagttgcaccacatggttttaaatgatatcgaggtactagtactactttatccataagaccataactcatgtggattgctaagcttaatgagatgaatgaaactactaaatttgcaatgcatttcacccaattcggcaagtcgagctacaggatgcaatcattcgattcgagcaaactacctggaggtcggcgagggaggcggcgatagcgagcgcgcgggcgagagcccggccgccgtcgccgtcgcggagggcggggagggcgagcttgagcgcgcggaagaggaggcgcgacgacgacgaggtggccaggccctcccccatcctccccgtcagctcgttgaacgcgcccaccagctccgccaccagccgccctcctccctccgccggagtagacgacgacgacgacgacgacgacgtggatggagaagaggcggccgccgcggcggctgcttgggcagggaggcggaggcggtggaggcggcgcgggcggaggcctgggcggcgcgggtggggatgctgccggcgaccgccgccgccggtggggattgcggcggcggaggtcgtcgcggcggtcgccatgggggaggtggtggggcccactgggagggatgaattggaggcgacgtggcggtcgttgactcgttgtgtgctcgaagcggatgcgtgaagtgaagtggtgtagcgtagcgtggtggcgatgattggcttgcactctgccacgtaggatccgctcctccgtggcgattctcatccacgagttcgtcgtttttttttccatcaaattgatactccctccgttttataatgtaaaactttgtagtattgccctcatttctctgtggtcacgccccacaccggcagccgcgtcctccgtcctcagggccggccctgggccagtgcgggcagtgcgaccgcaccgggcctccaaaaattaggggc

SEQ ID NO: 77169 - DNA, 3656 bp, Oryza sativa
cgttaactgatattaacagaataggggcaaagtgaatattcatttgaaaaaagtaaggggtaaaaacataaaccctaaaaagtaggggcaaaatcacaattgaaacatgaagtaggggtaaagatgcagttgcccctattattatttgttttttttttgtccggacgtgcaagtgcaagtagtgtttcctcttctgcgacatgcccaagtagagtttgggccaaaagtgtgtgatggatggaattcgtgcgaccctcggtccagaaatgtaacatgctttcaccgccttaaaatataacaatttcgaactatttatctcaatgtttttttttaaagatacagggtcaaacattagtactatatttttgaaactgtattgtattctctctgtcccataaaaaataaagctagaatgtgttgtgtcaagatttatatgtaaatatttatatttatatatatactaggaaaaaggcccgtgcgttgcaacgaatgaagtctatttcaaccgttttattgattttttttgtctaaaaagtatatgggatttttatttgataattgatagtattgatatctaatttggaactcttatcgggatgatggtcatatcatgtacattgctttcttattgcctgacaagaattctcaaccaattatgagtatgactctcgtcccaagttagcatgcgtgattttagaaaggatttttcttatacgatttttatgtatttttaaaagcaaacaaacttaaaaactggcttaaatacggacgacgtaccaaagtatcggtgaaaacatttttaatttttacaataggaaagctcaaagttgttggcgaggacgcatgagagagctgcctccttgaactcttgcagcggccgcagaggacaaagttgtgcaggcacggtctgcatcaccctgacgaatcgtccgatccatgcatgcgtcctcgtgccacgggttacgctcgtagccatggtctccgtcgcgtctatggcagtggaacgtcttggcccgaacgccgcttttaaacattggtggcggcggcggcagccagccggccaccaaaaaatcagcacacggtgatctactattacgttattatcacacgtcgctgcctctcggatatattatgatgatcgtatatcgtatcgagccttgcgttttggaatggatcctattccgtttctcacacaagaacgcgatccgattgaaaattgaatcgggtgattttgttcgacagaaatgaaaacgttccatgctttttaagtagtagagaagagaagatataaatataggtaatgatagaattagaaaccaattcaaatacggatgacgtaccaaaatctcggtaaaaacaacttcaatttttataatagtatagacagagattccggtcaaaaaaaaatagtagagatagggatatggtttagttaagatgaatttattgtgggagttcgcttgaatatatatatttttagaaaatcatgagctgcagttaggtgtctgatcgtctcaagttagcatgcgagttttttttaaacatatttcttatatgattccttctgtattaccaaaagtgatcgatcttaaaaactgaatcaaatacagatatgtattttcaaaattgaatcaaatacagatatgtattttcaaaatcaaacgaacttaaaaaccgactaatacacggatgatgtaccaaaatatcggcaaaaatatcttcaatttttataatagtagagaagagataggatgagatgagacattctagaatttttttttgtttttaatttttttattaaaagttttacaaaaataattttccattttgaaaattgacagaagtagtcgccttaaaaatcgccatcccaaagggcggcgaaagtgacgtggcagacggctgttcgctctcgggcgacggccgtcaacgaaatttgcaggcggcccccttgctgccctccgctagggcgattttgtactgtgcggggggccgcctgcaaatgggcagcgagggggcatggaaatttgcaggcggcccccttgccgccctccaataaggcgattttctactgtgcggggggccgcctgcaaatgggcggcggggggcctggaattttgcaggcgcccctttgcagccctgggggaggacgattttatactgtactttatttgagaaatatattttttttataaatatcaatagttatcaaatctttttatattgaaaactatactagattaaaatctccaagactggtaaaatacaattttattattttttagggcctatttggaatgtcaccgtacaaatattttgttagtgccaaaatataagcaagttttggcactaccaaatctttggtaaggtaaaattgcatttgatcatatttggtttgctgccaaaatgtaaaattgtagtgaagaatgttctacataatctcaaatctagattaggtattaccaatgaataggcttcaatcgaaatcaaacacaagtactattcaaattacaaaaatattggtagggcatgtttttggtagcaatccaaataggcccttagtcttacgcatacaaaaattcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacacatccttggattgccctgtaaaaatagtaatgtaattcagtttgggtagtaattttgtgcaaatcatagcggattttgtaaacggttagacatacaacgaaatcgttgtctacattggggcagacaaaatatctccttccaaatgtttgttcagcaaaggatgtagccacctgacagcgatctctgcacccacactttggacgctcggaccatttaggtaaccctaatggattgttcctccagtctaagcttgcaatttccacctgacgttcgtactccatccaagcatgaatgaactgtatggtcggttcaggttgcgttatcggcccgccacttgaagtaactctgactgcgtcaatccattgtacgaattgacatttccttacatcctcctatgtacatccattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggacgctcacgccatgtggggagtcctaggggatttacctgccattctaaagcctcagcagcaattcgacgttcatgctcatcctttcgccttaggtagtccgatcttgtttcactacgtgtgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgg

SEQ ID NO: 77170 - DNA, 662 bp, Oryza sativa
ttgacagtgtcctttctctcatgctgtcacgttcgatggccatgcgatgcagccccgtctgtagacacatcttcataaaattgaggtgtctgtttgctctcctcgtaccatgcatgtcgtgtacgcttcttggccttgctgaatgcgatgtttttcttctctccttgatctgttgcctgttgctggactcccaagccaccaagtggcaaaaaggatttgcaatctcagctcctatttttacacgatcttggctggcagaaaggatgatatgataatatgatatgctcactctgaatattcagtgcatcttactactatctcatttctgcagttacagctttgctacgttatggcctctgaagagggttgcgtgtgcagtgtgctacaacaaactgaactgtctgaactacgatgttataatcaagagtgtgactgaggctgtgtttagttcagcgcaaagtttagattttggttgaaattgaagatgatgtgactgaaaagttgtgtgtatatgacaggttgatgtgatggaaaagaactgaagtttggatctaaattttagatctaaacacagcctgaatcttttctcttctttggaagctgtctgaatcttgaattgcacgtgaacattattagctgtaaggctcctttcgtttcaccca

SEQ ID NO: 77171 - DNA, 831 bp, Oryza sativa
ataaaaaagatggccaaccttagaccacacgcatcccatccccatcccttttcttgttatcatcaaccagaaaggttacaaaccaacaagtaacccagacacaagagcatcttggcagatcagttgagattttagccacaaacgagcgaacaactaaccacttaacccgaaccaaccccaacaactgtcatcatcgaccaaatcccccaattagcgtccatcccgattgcttctccaaactctatttcttaattctatcgagtatcaaccaccccgttttatattataagtcgtttgatttttttccctagccaactttttttaagttagactaaacttatagaaaaaatatattaacatttttaatataaaaacagacagattattaaaatatatttaatattaaatttaacgaaactaattttatgctataaaaattgttatttttttcaataaactgggagaaagaagtttaaaatacactcgcttgcaagcttgccccaaccgagtcagcgcctccttaccgtgggccccacctgtcagcgacccgtatacgaggggttagcgaagtttgacgcgataaaccgacagcgacgacgccgcgcggaagcaagacggattggttttatgccgtaatcaaaccggattagtttctcgccggagagagcgagcgagagcgagagagagagagagagagagagagagagaggagaagaggagaggagagcggccgcgtggggggaatctgctcgtcgtcctcatcggcggcggcggcgttgaggcggttgcggtggttgggtggtggtgggggatggggaatcaggtgggagg

SEQ ID NO: 77172 - DNA, 11881 bp, Oryza sativa
tgctggcgcgctcctacgacacccgcccgtcgtccatgacccggagtctccagcccaacgatggctggaagacgtggccaacttggtcatgacggcacagcaacgcctgggtgctggcggacggtccgccaccaccaagacctccggcgccgccactaccggttccgcgtcgtcaagacggagagcgcggcgagcggcggctgctgcacgccattcggctaccactccctcgtcggcgcctccgactcgggaggatcagcatgaagagccggatgcccgcctcgacattgagcgccgacgtagtgatcggcgtactccccgcgcaacggagggtgcctcttcgtccagggtgtcacctcgacatggacgtgaggatcagccctccgtgcccccggttggtggtgttggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcatggcgaatttctttcccatggccctgaagggacaggcgcggggttggctaatgaacctgccacccgcgtcggtccactcctgggaggatttgtgccagcagttcaccatgaactttcaaggcacctatccacgccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaggaagtgggaggaggacaggaggcaggaacgccgtgagggcaagtccgcggcagttccctccggtaaacggcgaagtgaggccaaacagaaggcccccgccgctgacatcgatgacggtgatgatgacctaggtttccaagaacctggggccaccattgccactgtcgacgggggagcgtgtgctcacgtttctcgccggagtttcaaggccatgaggcgagagcttctcgccgcggcccctactcatgaggcgacgcgtcgggcgcggtggtcggaggtggccctcacctttgaccagaccgaccacccaccgtgcgttgcccggggagggcagattgcgatggtggtttctcccaccatctgcaatgtgaagttggggcgtgtcctcatagatggaggagcggctctcaacatcctttcccccgcggcctttgatgctatcaaggccccggggatggtgctccagccgtctcaaccgatcatcggtgtgacgccggggcacacatggccgttaggtcacatcgacctaccggtcacctttggtggatcagccaacttccgcacggagcgggtgaacttcgatgtggcggacctcagtctgccctacaacgcggtcctggggaggcccgcgttggtgaagtttatggcggcggtccactacgcctacctccagatgaagatgccgggccccggtggccccatctctgtccgtggcgaccttaaagtcgcgcttgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggtgacaggccccggaacgtcaagccttcatccgcgaggaggtggcgaggcttctcgaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaataggacgtaatgttgaggcttatgtcgatgacttggttgtaaaaacgcgcaaccaagaaactttacttttagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctattgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccggttctagtcgccccggagccaaatgagtccctgctactttacttagcagcgaccccccaagtagttagtgcagcgttggttgtggagcgcgatgaggacaatcctcattctgcgcacccccactctgtgccgacttggcccgggagcaggcagggaggagaggcccccgagtcgaacggtggcctaaggcccccgacgaccggagtcggctctctgcccgcttgtcagacggtgctgggtgcccccgaccctcaggaaggccccgaggccactgcgggaaggccgcacctaccaccctttgaccccgaggctaaccctgtgctgattcgacccgggagagagcagggagaagaggcccccgagccgaacggaggcctgaggcccctgacgaccggagctggccctttgcccgcgtgtctgacgacgccaggagcccccgacccccagggcggccccgaggccactgtgggaaggccgcacctgtcatcttcggaccccgaggtcatcagcgcaggagacgagtgtgccccgagaggccactgggacgaagagcaccccggggatacggcccttagcgaagaggatcggccccgccgaaaggtgcagcggcctgtttactttgttagtgaggccctccgggacgccaaaacccgataccctcaggcccagaagatgctttacgctattctgatggcctcgaggaaactgcgccattatttccaagcgcatcgggtcactgtggttacgtcctaccccctcggccaaatcttacataatcgagaaggtaccggacgggtggtaaaatgggcaatcgagctttctgagttcgatctgcactttgaaccacgccacgctatcaagagccaagccctcgccgattttgtggcagagtggaccccggctccagagaccgtctcaatccccgaggccagcgcggacccctcacagctgcctcacgccgcccactgggtgatgcaattcgacggttctctgtctcttcagggcgccggtgcaggggtcacgttgacctctccaaacggagacgtcctcagatacttggtccgtctcgactttcgagcgactaataatatggcagagtacgagggactccttgccggactcagagtagcagctggactggggatccgccgcctcttggtgttaggcgactcccagctggtcgttaaccaggtctgtaaggagtaccggtgctccgacccacagatggacgcctacgtacgccaagtgcggcgtatggagcgccattttgatgggatagagcttcggcatgtacccagacgggacaacgtggttgccgacgaactctcaaggctcgcgtcctcgcgagcccaaaccccaccaggcgcctttgaagaaaggcttacccagccgtcggcgcgacccgaccccttaggggaaacggatacgcctgaccggcccccgaggcccgtcggagtccaggtctcgggacccgaagggagcgcttcaagctcccttagattgattgcgtggatctctgagatccaagcatacctcacagataagactctacctgaggaccgcgaagggagtgaacgcgtccaacgcatttccaaacgctatgtgctggtagaagggaccctctatcggcgcgcggctaacggaatcctcctgaagtgcattcctcaggaacaaggcgttgagcttcttgttgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccatgccaagcaaatccatcagccggcccaggccctgcagattataccactgtcatggccatttgctgtctgggggcttgatatcctgggaccgttcaaacgggccccgggcgggtttgagtatctgtatgttgcgatcgacaagttcactaagtggcccgaggcttatccggtcgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgcagagatgacctcgactacttagaagagcgaaggcggcgcgcggccctccgagccgcgcgctaccagcagagcttgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgcctaacccatggaacatcgaacaccttcgtcgcttctacccctgaagaggggggggtcgggtgtcaggttttggctcaggccaaccccgcacccccctcgggtgtgcagggttggccgggggctaccacacatgcattacattcttatttctcttttttcaacatttcaatagaagcagtttcaatttcctaaaggttgtgtctgtgctgttctttctttttgaagaatcttgacttaaaataaggtcactcgtactcaaccttgccctcgggggttcggttcggtctgctaaaatcgccaaacggggcccagaaccgagccgtgccctggggcgtggtgaactccgggggggaatcggcaaaaacccacaatcgggtcacccatacccctcggtcaccacgttcccggcctggccagtctcgacatgtggatctccccaggcactagccccgacccgagccattcgaggactgggacttgggcacgagcccttatttcaagctaaggcgcaaaaggaccatggcacagatcatcctcatcgcgtatgtatagcaaaataaaactaacacaaagattttttcgtcatttctgattgcagattaagttaatttgtacacaaaagaggcatgaaggccttagaagaaagaaaaagaaaaaaagtaaagattggcgggggctcgggggctcattccgacgcgcccgagtcgacggcctcgtcaccaccatcgtctgcactgctggtgttgccctcctcgtcggagttgggggcgaacgcgagccgaggggccgagccctcgaagccgttgacgatgtggtcggcggcatcccggacgcgcgcgcgcgcatcgtcctcggtcccgggagggaactcctccagcgccatccagggagagaaattggggtcccgggcctggtaactcgctagcacgagttcgaccgccccccgggcgaggtccctcgaggatgacttgatggtcttctcgagctcctcggggagtcgttcgaggacccaggccatcctgttgaggtgcggagcgaggccttccagattggtggggcgcatcctcgtctggcctttccagaggcccgcttgccgaccggcgcgatccatgcgagagaccgagtcccaaagcatgtcgggcccaatctcgcccgccaagcgaagggcctcggcctccccggtggaggagtccagcgctcgctgcatatcggcgacggtgtgttcggcagctgcgaggcgggcggctaagtcgctttcgcccgcggccgccccaccgatatgcgccctcgtgtacagctccttttcccgcgcctcgaggtcagcagcccgctgctccagtgcggctctctcggcgcggacgcattcaagattgcggcgcgcctgctcctcctgcgccgcctcgcgaagggacaggctgtccgccagccgtttggtcgtggcctcagcctcctcgagagctcgctcccactcagcgagtgcgtcctcgcagaggcggagcgcgcactcctcctcggcgcaggcggcctcgtgcgccgccagcgtcgcctcccggagagcagcggcggcttcgcggtccgtcaagcctttctccacggcgccggcgtgttcttccagcgccatagcacgggcctcaagggactcctcgcgccgccgggacgccgcctcagtctctgttacccgccgctctcgggcagcggcggagtcaaggactccctgggcggcgtcgagcttttctttcagctccgcctcccggctggcgttttgaaggcggagggcgtcttgcgcctcaatcatcgtggtggtagcgatgagggcggccgctcgctcctcctccacctcacgagcgatctccgtcagcgccgccttccgggcttcaagctccgaaacgtgacggcggtgagctttacggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagatgaggagaagagccgccttggagagaaggcgatgcggctcggccccccggaggacgtgctgggctcggggatgtcccccggacccgtttgatcctgggcatcacccggggaggtgggcccaggcgatgtgcccgcggcctcgtcgcgagcctccccggaggctgtcgcctgagggttgcccgagggagtgggcccagttggcgcgccagcagcagctgttgcctcagcctggcgagcccgggcggcctcttccttagcggcttcctcagcccgggcggcctcctcccgagcggcttcctccgcttggcgaatccgggcggcctcccgggcggcctcttcagcttcccgaaggcggtctgcggcttcacgccggtcagattctcgcctccgctcctctgcggccgctggatcttcggcctcggactggccggacttggggtggcgggaggaatgcgacgggacatcgctgaagcagaagaaaaaaccagaagacgaacaaaatgagtaagaaaaaacttccttttgggagaaagatggttgcaatgagagtgagacgaacctgcgagggggacggttgaatgaccaccttggaggggaaatcaggtttccccggcatggttccgtctcccccgtcttgcggagccgtttcttcttgcgctccccctcgggctgcgacgtcggcgcggccccctccgggcgccgactgctggcacgcaccgccccgccccctcggggaggagatgggggaggtgttcctcccagcttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccacggagctaagattcagcaccctttggaccacgatcttgaagtcctcgggagcccaatcccatctggctccctggtgggtccgcatgtagtcttcaggcccagagtactcccaagcgctccgggcgcgccgttggagcggcgcaatccggcgacggaggtaatcgccgtacaccatggccccggtgagcccctgggatcgcaggcccgctaggcggtcgaggacggcgtcgtagtcctcccccagatctaccggcgcccgccagctggagacctgcgccgggggctggcttggaagtcggaggcgcgcttcgttggtgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgtccctcgcccagcatcactatctcccgaccggtggcggactccggcatgaagcggcgcggcagtccggcgtgcctctcgctcacgatgcgggaaggcggtagtacactgccgtcgagcagagcagagccccgtgccatgacggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcatacggcgcatgaagtggatatgcggttgtggcaattgaaatggattgtatcgtgcacgcgttaattacgctcgccgaccgaagcggcgttaccgtatctccgggcgagacaaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttccctggggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctccgtcttcgggggaggtgggggtaggtgtgggctgtcccatcagaagggctcccggatggaaaccgtaccgatctccgcccattaaagagaaaaagaacagtccagtttggaaagagagaggtgcatgtggtatccccttgagatataaaaggaggaccttgcccatttagagagagaacttttttttcccttttggaaggcagaggggaaaggaagtgaatcttttgtaacttgtccatacacaaatccacaaaaacacaggagtagggtattacgcttcgcagcggcccgaacctgtatacatcgccgagtctcgtgtgtcttgcgggcgagtgatctttccacactcggagagagagagagagcttgggattgcaccctaagcccctggtcgaaccggcaaaggggggcttgcgcagtctcccggtgaggggccacgagctccgtcatctggcgcgccaggtagggggctcagcgtgtgttttctgagctctcagactcttccgtgtgcgccaagtttttcttgttcagcctaatggccgagcaaggaaaagcacacgacctctctccgagtgtgagcggcgacgacggggagccgaatccacgccgtcgagctcgtactcctccacctcctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggtgcgcttcaggctgctggcgcgctcctacgacacccgcccgtcgtccatgacccggagtctccagcccaacgatggctggaagacgtggccaacttggtcatga

SEQ ID NO: 77173 - DNA, 549 bp, Oryza sativa
ctatagggcgaattcgagctcggtaccccaatgtatgaatgtatttggttgagaggttgcacacatctgatgagagtggctttgattaggactaggattcattgttgtgctgttgtaatatgacttgtgatgtgcctgcctatatgtttgaattgaagggaagggttttgttggaacaacagttaaaagttccttcttttgttaatgacttcacaacgaatggtaaaattaggtgagctttacctgggtagttagcctcatattggccatgttggcttattattattattattattttgattaaacttttctttggatctattaatctattcagttataaacataagtatgctgccatcccttcatgtctttgcagccgcggctgcaggtccatatatcaaataaaaagatgagtgttaacgactccgccattcttccctgacattgttcttccacatatttacagtaattgtttatgacaagaacataaaatataatcctcactttatctgtactaatacaagctagaccaggttaccgtcacagaca

SEQ ID NO: 77174 - DNA, 622 bp, Oryza sativa
aaaaatcaagcagcaacaacatcgttcgtctctgtggacgagtcgctgctgtgtgtcgttgttgctagcttgccacgccatgctgctcgcttctcaccgccgctgaggggcatcctgtagttgacgcacaagaggggaaagagcaacgagccccccctgctgaagcgtagccgaggcgccctgctcctcccccttctacatcatcgccgaagccgccgcttgcccgtacgctgccctctggagctgccgccttcccgtggcgcttcaccgcccgccgccgctaactgcttgaggcttgagccctgcaccggatttggatggggacggtcgaacggacgtggtgttgggctagttatttcttccaggggtacaatagtcctttttgcattttgtaaatatttttttcttctcttttgtctcacaaatttgggtctccctaacggccattcaaaacaggggcaaactgcagctacgtttgaaaaaagtaagggcaaaaacacaaaccctaaaaagtaaaggttaaatcacatttgtaacatgaaataggggcaaaaacacaattgtccctttcttctaatagttctaaatgtaaaatcagtgatgatagtgtcaataacaatct

SEQ ID NO: 77175 - DNA, 715 bp, Oryza sativa
gtagacctattaggcaaatgtacgagcaactgcaaaaagagatgatcacatggttttgaatcatgtgatccaataaagattatgaacaggaatagcacagttgaaacaataagaatgaaaagacaaaattaaacaattcagaaaaagataataagaacacggaataaacatatgtactatcccctctcatgcttcctatgcaaatatactcttaattccgagtcataatatgctagccatcccttcttcctatatagttagtacccactatagcaattaatactataaagcttgcaatacgttgcaccacgtcatcgttaattctcgacatttggattggtcttcatggttccagatcaacggtgttgatatcttgggccagctccccatcaatgttttccattggcgcagccccacctcgcccacgctccatacccacagcggtccttgtggggaaaaaaaaaagcacgctcctaaccctcactaatcgttttctttttgctttgtacatgttccaatcaggtggttgattttgctagatttttcttcatcctgatatatgacaaggactattagttaatcaattggtttctacctattttcacaggtatccgtccaataggatttgcaacaattcatcgaattggtatatatcattccttaatgaagtggtaaaaaaaataaacactcttcctctctctttcattgcttgctg

SEQ ID NO: 77176 - DNA, 3812 bp, Oryza sativa
agaactttcatagtccaagtgttaccattaatcaatccagctaggtttgttttctgcataccttggggttgggatggactagtgcaccatcaaagcacacggctgcagagcaagttacgattgttgccaacctgctggtcttgttccaatcgaccacgataccactgcattgcataatctccttcccatctgaaaacataggaagaattagtagctggtaagaaatataattatcttgatctgaataaaagcttcctttacctatacttactaatataaaaaggagttgtacccctccaatcctataggccaaatcacatctatcaatccctaccgtccatccacgttgcacgcatcacaaccgtccctaccggctaccgctcaccgattccactccctccaccgcgatttctgcctgcactccctccaccgcgtgtttactccgcccccgcgagatgattccgccgtccactactcgctcctcctcgcgtgtccccgccaccgctgcccccgccggagtcgaggccgtcaccagccgctgctgccccccgccggagccaaggtcgtcaccagccgctactgccccgcctgagccgaggtcatccccagccaccgccgcactccaccgctgctgcaagccgccgccgccgaggtggttcccccctttcgccgaagataagctttcgttcgttagtctgctaatggaaacaatatttagttttttagatccatcctctcttgctccactggtcagtggtctcaggttgtaggcaggagaaggcgatctcatagcagggtgcaatggcaacatcataccatccctcgcaatgcctctggactaaagacgatactgctggatacatgttcctgtatccatgttggaggttgatttcctataagtaggttaattgcatggttgatggaatcttcatggcatcaggttctactttgcaaatttacaaattattttttcctctatagttctgtccctatggactgacatatattttgtatctgaaaatgcatttggggcttgatgtggccatgcggattcttgagtgaaatatccagcaagttccatgggtgctggaaatttgaatatagcatgacatccacaaacgggcttcaggaattaagaggaagccaatcaggacaagggcctcctgagctaatgttgtgtattgcaggtacttctttgtgtctcaatttgggcaactgttgtatcaaaaaaatttgttaatgaagctgatatctcaattgttgtgagttgttcctatgaatacatgtgcttgagcattaaagaaacaaatgtcttcagatatgcactttcatgaattctgagagaagatatggacctcccatagctagctatggagaaacatgcacagtttagacaaaatgtcagagtgcctaggaagacatgttgaagacatgttgggtttctttttccataaaataaattagtataccatttctacatcttggcaaaggttgtacttgataatcttttatggccactgtaggttagttattcactgttgtctctcctttcgttggagaatgggctccatggtgcaatggttgcagttgttggttttgaacaaagttttagtattttttgcagttcatggtacttattcaactataatagccctcaagacaagcatatattctgaggtaactcattgtctactaaagttgaaaatttaatttagttcatacttatggtacttattctgctataatagccctcaagacaagcatatgttcttgaggtaactcactgtctactgaagttgaaaaattaatttagttcatacttgaactggtttatcataaataaggttttttatgtatataaaatgtccagtggcgcaaaaaggtgcgtgattattcaaagatctaaagtaaagtgatcgatctgcatggtcttttgttcgtcgacaagaactctctgaagtttcattcccaggtatttttcctcttgtgatcatataaatgttatttcgattgcaatgtgagaagagcacatatgaagtccttgtggttgtaggaaaaccattgtatagatagtggagttcatctgcttatcaacagatatcatagttctttttttagacagtggagttatcttcaatcccactgaaagacaaatctcttgctttcagcttttcaagtgtttgtcaagcaattttgctctaacgttgcactattttcatggcaaatgtgtaacagggagttactaaaataggccatctcattattgttgatatctatactaatataaaaaggaggagttgcatccctccaatcctacatgccaaatcatcccaactcatctcatccatccattcaccaggtaaaataatcttatccattaatccgctgaaatctttcactgaatccatcttgggcgacctcgcgctatccacgcccgcaccaccgctctttccacgtgcccgacctgattactctgcccccctttccccgcgctatgccaccgccgccgctgtgctactcgctgccgcccctcctctcacgtgttcccccttccgctggactaccgcccgggacccaccgcagccacgcgcgtacgcgctgaccctgccgtgatgcctcaccaccacatcgctgcatcacgtagtcctctcacgataataacgctgccgcctattcctcccggacgacacatcctccaaccactgcgcacatcccccatccgcagtctgccgcacgcctcctctccccggaaatcgcattctcccgttgcaaatcacatcctccagccgcggaatcaccagaaatcgattcctctcgcagtctcgcccacggacgacacttctcgcattctctacagccgcggaatcgccggaaatcaactcctcccgccgcggacgacacttcttgcatccttcccagccgtggtggtctgcccttcagctggcggggctgctccatctccgtctccaccgtaatcgatggcccagtgttccccttgggccctccactgctgatgccgccgtcccggacctctctgccgccaatccttccatcctggtccgctctgctgccgacacatccacccttgccgctgccacttctcccagaggaggcgaacaatgaatctgagaagaagtcggtggccttttgtcctttttcctgcgcgacggagaagcaggaaaggtacaagaccggcagctgctataaatccaaaaacctcaacctgtgagttctcttcccagtgtctctctcatcaaaggtacagtagcagcgatagcgtggataaattgagcgagggagattattgtgtacagcttctcattgttgtttgatgtcatgtatagcatgcttttatcattttgattggatgctaatttagtttgccatacttaacgaaacaactcatagttcatatactttttttctctgaacttaataaaggaaacttgaatagaggattagaaggttatgagtgacccgtagttacttgctgttgaaacaagaaattttgctgaagatcacttctcttaataaaggaaacttgagtagtgcttggttggtgtgcagaatgggtaaaatgataaaagctgatttaaacgggaaaatgtctatgactgccttattgggctatctacaccgataactgtgttgcctggttattccacatatggccttcttctccctgggtgaatgtttatagccaactgccacttttgcttggctgacttttcattaccaagacttaaaatgcttccaacgggcaactggtggtgaattgatagaattatggtgatcttttttatcctagctgg

SEQ ID NO: 77177 - DNA, 4871 bp, Oryza sativa
tacgcgctgcaaaattttaatgttggtgcgttcaatgattaaaaaaaaagtgttccttcatgtgctatgttcgtggaaattctggctctaaggagaaccttttcctgaattgttagcccctggctataaaccagctaacgcaagtatctgtttttgaccaatttcaacatttttcattgcgggtagcatctcaactaagtttgggcaggatggagtcagcattaactgttctcaggcactcctgttttccctttggaaaggcagcaaattagtctacagtgttcagatgtgcaggtaaaaatgttagtggattgactctatccttgggaaacagtcacacttaatgagttgatagtgcgcatcacaagtccctgcatttttagtacaaggatcttgtttgcttgactttgtgtggttaggcctaccctaggattgatgccttggtagaatacttatccaacatccatcgtggccctattgctgttctttcacatgtagaagtgttggatatgctaggttgttgatttgctattctttttactcaccatgctgagtaatgaaattctgcatgaggaatagtgtaaccttaagtttcttttacatattgtttcttgtgtcatcatatgcatttctttttagcagaggcatactatgttccgcagaaacttgtgctctgatgatttgagaattgagatactcaaggcctcaagggatgatatggataccacaatatacaacaaaaagttcgcatggcaattggatctccttgatgtaattggctgagatcaatataaagcttccattatctaaaaaaaatatactacaaaaaaaatcaacaactagatgatgcttttgaaaaactcatgatctcctaattctgaagtcatctacttttttttcctgttgttcttactctacgtaacattgacaatagtcatggtagccagatagcttggtatggtagctttaagatcaccccgtatgagtatgaggtataatgcatcttgttcatatggagataatcaatatgttgaaaacttggcactttgcaatttggcattgtaaaatccagtgctttcttagcaatattatatctagtagtacagtagttactaatgttaagatgtctttatctttttcttgagatattatgttatccttttgcagtcgaacaaaacatggaattgttacctgaaaattcatatacatttgcagtaatcttgcatcgcagagaatctattcttcgatgctgtcattcactgtaccagacataaacagtacagttacgaaattattgtcgctgggagctgagttggatgggcccatcaaatatgagatccatggaaaggtaaccaatagcccataactatagaacatgtctatttccattgtttcttcaaaaaaattttgtgatactagttttcttttttatacaggttgcagccgtacgatgcatcgatgggcacatgcttggccttttcgaaccagcgtgaagaacctacactgcaatgtacataatgaaaaaattatttcaatttcttgcagatggtatgttttatttctgtggactgaagttgttgttgacagaagcaactgactgggcctgtagtgtctgaaacactgatgaatagttagatgggcatctctttctgttaagagaaaccagtatgagaattgaggtgctgtagctctttcgccaccgtttgcctggtaattgcctgtcgtattgcaatcggtagagagccacactgtcatggctctgctttataatggcctgaactattgctaacttggcaatgttctcatataagctttcaaaatctaatgcatggaatattctattaatgttgaagtcaagatgatataatttagtatctactttgagcaactggcataaaaacaacggtatttgatgcaagcacttaaaaaaatctgagctaaacataagttgttaattacgaccttaatgtccggctgactgtctgtagataggagcagatacatataccagcctttgttgtactagccaccagaaaccagtgatcagaatatgatcaagaatctgctggaatcctggctggagaagagaggcaaccagcttggttccatgcagaaacaacaatcaggattcagtacttgctccgtcccaaaaaaagacaaaccctaatttccatgtccaacgtttgaccgttcgtcttatttaaaaaaaattatgaaaaaaattaaaaagataagtcatgtataaagtattaatcatgttttatcatgtaacaacaataaaaatactaattataaaaaaatttcatataagacggacagtcaaacgttagcatggaaaaccagggtttgctttttttttttggaacgtagtcatcaacaacaaacctgcacccactcgcatgagcacatcaatcaacaagaccttttcttttgtcacatctattcatatagtaccatgcacaagtcaacctgcctgcaaagctgctctcccccaatcaatctcctgcacatgcactcaagaattccctatggttatttaacctttcaatccttgcatgtttgatattttgattgatatttgattgataaaggtttctcttttttttttctcttgggaactgattgagtgattggaaaaaggttagaactcactgcaattgttaatttgttatcaactgctccatgataaactggaaaatgatggttttattatgttgcaacttgcagtcagattagttgctgattaacagccagtgcctgctaaatatagcaaagcacacatttcctcttctctgtgctgattaatctctccctctctttgttcctcttcttcctcctcagacatcatctccaataatattccttcaaggaagccgcttcgattcccacatcggagatggcggcttcctccggccgccgccacgcgccgccgtcgggttaggaagggctcgaggttggagaggcaacaatggcgatcgcttcgtcatcgtcgtcgttgctgctgctgatgtttcttgcgttcttggatcatggcgccgcggtggcgaacctgtcgtccatcgaggccgccgtccgcgaccgcgcgttccagctgttccgccgcacgagcgagatcgtcgccgtcgacgtcccggcggtgctcgccggcgccggcgtcgaggcctcggcgacgcgcgtgcgcagcagcgccctgtgggccgatggcgtcaacgccaccgtgcccgggctcgccgtcgccgtcccgccgcgggtcgtcccggcgccgttcgcccgccgcgtcgccatcgtgttcgtccgcttcctcggcgacgcctcctcctggctgttcgacgcgccgcccgggtacgcgctggccgcgccggtggtcgcgctgctcgcgttcgacgcgtcggggcccaacggcggcgtcgcgctccgcgcgctcggcgcgcccgtccgcgtcgagttcagggacatctcgccggcgagcgggttcaacgccacggcggcgaggtgcctgaccttctcgtccggcggcgggaaggcggtggcggcgcacgccgtggccatggagcccggcccgtcgtgcgtggtgtccggcacggccacggggcactacggggtggcggtgcgcgtggagacgccgccaccaccgccaccgccacgaccaccgccggtgagggagcggtggtgggtgtggaaggtcggggccaccgccggcggggtggcggcggcgagcttcctggcggtcaccgtggtcggcgccgtgaggtggaggaggaggcggcggagggaggagatggagcggcgcgcgatgtgcggggaggagctcgggaggatggcggtgagggggagcaggatgccgtcggcgaagatggtgaggacgcggccggagttggtggaggagctaagctaacctccgccgccgtgagttgcaccggcgagccgccgtagttttcgtaaggttttttttttctcctttcgttttttaggtgtaattttttcttttcagattattacgagacaaatgtacagtacattaaactctttcaaaaaaaaattcacgtgcaactcaaactcaaattcaaattggattggaatgtacattgcagttgggttatgttaaattttgagagcaaacaccgccttcctttttcgaatactacttgcatagtttactttattcccttcagctcataaccaggatgggatttttgtcactaaaatgaacaaagagaaagcagtatttacccactttgatttattggctataagaaacagagaattattgtattttgatttgttttcacttcacatttcacacaatcttggcttgttcagtacctttaatactagtctagtatcccgccaaaaaaaaaaaatactagtctagtagtaagtagtacactctctgttcatggatttagtacctttaatccgtgacattgttaactttatttggtctaagaatttaaaactttaactattaatagttaaaaaaatatttagcttgaagacacaaaatcatatggatatatttttctttataagtacttctacaatattataattttatatcaagtattgtcgttatatactaatacaagaataatgttccaattcacacgccatgcactgaataaagtctacagtgccatatatttaaaaacaaaggtagtatataaattcacgaaaatgcacatgaaggggctgaggagacaccattacaaaatatacacacactttgatttactgtggctatggaaaaacagataagataccttcaatccatttatgagtgcataatatgatttagtagatatggaaaaatagatcacatatattgaatacttttttctctaagcagtttgcagaatttccagttgcacagt

SEQ ID NO: 77178 - DNA, 6114 bp, Oryza sativa
aattcctgcagctttggcaatatcacaattcaatgacagaaaggacaaggacatatagaaaggataacatagttttatcgtggataacctggtaactaaagttggtagaaaaaaagaactccatacaatttagaaagccacctaactgcctgaatgaaatgtttcacacgtatgcccatcccaattagtttactgatgcggcccatattaactaagtgaatctccctctacaagaagtgaaccccaggtaagatcctatataaagaattaaacattactgggacagaaagggaaaaccgtcagatcgcgccaactgtacaacggacaaacaaatcgccatcagtcaagaagtcctacaactaagaaagaactaacaccaatctccatcagacaaagatgatttatttcctgtcagacgtggcaaccacaaagcacctaaactgctacataagatatgaggtttggttgataatatgctaacaaatcaatgaaccacaaaatggcagtcgttatagcttgtttgatactttgacataacatgacgcaaagattaaatatgtcaagagaagccaagacactctaaaagagtgacgcaatgcaggctacatggagaggttccatacgcttgcttagcattcaccgagcgcacgttccaaatttaataacaagtggtggttgtgtgattattggatttggtttggatatgaacatgaatcagaggggggggaggaacattttggataaggactaagactatcatcaaacaaccaacacaaccaaatcacagcagcgtaccatttgatcttctcctcgaagattaaactaatgagagcaagcatctccctctgcgaccattggggtgattagctcgatgattcccttccagagttgaaacatttgcaaattgcaaaatagtttgcattggatctctttctcttacctgcatcggcatgtcgtcatatcagtgacctcaccggcaaagctatctccatgcccagactcggtgaggcatttcatcgaacacttgaacctcacaccgcagaggcgggttgccgccggcgaagtgaaggactcgccgccctccgctccgagcgaaggagtcgccgagtctcgccgcccttgaccgatcatctcgcgtgccctcgccggctggttcgcccaaccgcggcacccccgtccgccgcctcttggggtaggatggaaactgcagtctccgttcccgttgggcgattagcctcattggttgtcatgaaaagctaaagtaaaaaccaaattttatattggttttaagatattttcaatgtagttttattttccagcattgtctttattttctttgtctataaaaaacagatatgctacatcctaaaactagaatgtgttatatctcgtattaggtttgttttttattggacggagagagtaatttacttttaaaaaaacatatataaaagttttacaaataaattattttattttatggttagtggtcactaataaaccattacggcttattatttgttctggataaccgatgaggcccaacgttaattggattgaagtattttaataacatgctaactgtagtaataaaatgtttaaaagtattttaataagatgctaactgtagtggtaaaatgtttagccacaaaatattcgataaaatgtttatactaatggctaatgtttgtcaattttcattcgttttaatgcttatactttgaggtttttatttgctttaatgcctatattttaaaacagaagatgcatgccattgccgatgtttgccagtttttctgttttaatgcgggaacattcatcttttccattttaacgtttgctaggctgtgtttagttcagcgcaaagtttggattttgattgaaattgaagatgatatgactgaaaaattgtgtgtgtatgacaggttgatgtgatggaaaatgacttaagtttagatccaaacacagtcctagtttgccatttcgtttcaaatgtcagacacgtgaaatgacaaaaaatgggttcattaatttgccaggatgatacatgatctcaaattgtaagctagctcttaacagctactccctccatcccataatataaaggattttgagtttttgcttgcaatgtttgaccactcgtcttattcaatttttttttgcaaagataaaaaacaaaaagttgtgcttaaagtactgtagataataaagtaaatcacaaataaaataaataataatttcaaaaaattttgaataagacgagtggtcaaacgttacaagcaaaaacttaaaaaacttaaaatcctctcttatattatgggacggagggagtactatcaaaagcgccaagaaatcggttttttacattgacatgctacacgttaattgagaacaagggtcagcaaaagatagcgccttctctttcataacaagtaaattcaaaactttgcttccttccagtaatatcctcattcaaatggcatagacacacgaagaaggaagcaaacacatctcttggatctcgataacagtaatatcctcatgaggttggtacaaaactttgaagtggttacaattagcacagctcactacagcatttgtttcaaaaggctactacagcagtattcttggccagcaagttgaacagtgaaacattccccattttttatgtccgtgccgatcagattcttggtgctgcattacatatcgaaatgtgcctcaggttaaaggtaggagatgattaacatagaagacggatttgatagagactgccaccagcacaaaatacattacctcctccgattgtagcttcagggagtcgttctatcgagtacctgtgccgagtgatatacatgattggaacaccaggaacctaccaaattgagaacacaaacatgtaattagcataagagcaaggctgctgcaatgttcaggcttaagtgcttgtaaatgtacctttcttatcctccttttcaaatctctatcacatgttgcgacgatgtagcacttgtgctgttacagaaaagttgcagtttagcaaaattagcgaaattttttacacacaagctacatagatccaaatgattatcacaaaaactagtcttaaactttcagtagccaaccagccttaatttaaggccctctttgtttaggcttataagccaacttataagtcgaaaagtctaagccaaaacaaacaagcagctttttcatttggcttttttaagccataagccactctaacactattaatccaaaagctaggtttgagaagctttttttggcttatatgagatagatgtatgattttaccattaaacttaggacattaaatccactggcttataaatcatataagccaataagctgacttaaaagtctaggccaataagcctaagcctaaacaaagagggcctaagtgttcactaaaatgtaaatggaagctgtaaagatgaagagcagaaattggcgagactaaagaaagttatattagtaatttcaaaaggagattgcgaaaatttcagtaacccatacatgcatcatattctctactactcaactgcaagtaccgtcaagtcacctaacatctgctatccaaaacaatgctgccacttgcacacataaaaactcaattcgaacaatagaagttcaagtaggcagaattatacctgagtaaccctctctacgatacagtcatcagcataagttcccttgtgtgtgcatgctaatctctggaacctagggtcctttgcaattctgtaagaggtaaaaatagtatttattgatggatgaaaatcatagaaaattatattatagtaccaaacatcagaactatgtccaactgatactaatatgcatagaagacaatagctacagatactgggatagagaaacagaatgaataacggaatttgcaacaagtgaagaatataaattaaaggaaatgcatgaaccaattaccacagtaattattgggaatgaacatacctcaatgctacacgatacttttgtcccagcttttcaagctccgccataacacaatccgtgatacatggtgtgccttcataacaagatggtagactttgtcagcaaagccgtatgcatttcaaaatatgctaaaaaggatagcttaaaccctactcgttccattccatattataatgtgttttggatttgtcctaagtcaaacttcttcaagtttggccaactttataaaaaaatgtagtagcatttccaacacaaaacaaatatattaatttggtattgtagatgttgctacgttttttctataaacttggtcaaacttaaagaagtgtgacttagtacaaacccatcacttcttataatttgaaacagagtgagtaagaagatgcatgcttacattttgcataaaggcagtccatcattcctttctccaaatccaactgcataggtgtcaaagaagcatttagctattacccataagcataagctcagagaaactgttagttagctccataatccagtaaacccacatgaaaggaatacactctgaccaagaagggatgtagctagcacttgcaccagggatgggaaaagatacgatgatagatagatagtcaatgtatttctctgtcctagaaatgcaagatttctgttgtgtttgaactgtcaatatggacaatcacttggtcatctacccctataccctatataaagcctcataattcaattagttttcaatatggttctagcatctaataagtggctccaggttggttatgaaccttcttgcactcagatggatgtaaggcactccaaatgttatgttattccctctatttcacaatatttatccagtagatagagtagtactaggtctatctaatagatgtgatcataatccatattggttaaaaaatgattttaagtattgtgactcatacatctgcataccagaaaatattgtggagcagagtacaaataagttaaatgatgtgccagcgcttgttacacatgccctatactatatgcctcttattaagtgccaatgggcaataccattctgttatttgagggctgttgaatgacacttgagaatgtccaacagttacatactcgacacaattgagattaagctaggcttcacgaaatcattcagtggataaacagaagagcacctaattcgaagcctcaaagaacaaaccttgttctggatggagaaattgatgaagtttgtatccacaataacccggtatggcggcccgagcgctgtgttgtagctgaagaacagcgccgaagagacctgaggcctaaaataataaaccaacaagacttgattaatccaatcatcccaataatcgttaaacactttaaacaaatggatcccaaaacgcggtaggcactcacacattccgcccgagcttctccttctcgttatccttcttcttggggttcaacacatcctccttgtacctagaggagacaaaatttagggtcgcaacaaaaagaaccgaatcaccaagaaaccaataggagagggagatggtttgcctacttctggatggtcttcttggtgatgatcttcttgacggcggcgaacttagggcccttgctcttcgccctccccatcctcagactaaaaatcccagataacactatcaacaccagcagcagtctcgagcactacgcgcaccgcgggcggcggcggcgttagctctctcggtggagcgggtcctcgcagctgactgctcactgccggcggcgtgaagcggtggaaggggccgcgtgagacgagagcctaccgaccgagagcggcaggggcgcagagcgcgacgccaagtcaccgaggcgccgagctaccttctcctaccggcgggaggggcgacggcgacggcgacggcgacggcgaggcgggaagtgcggcgagccggagactctggcggcggcgtcgcgcgttcgaggagagtgagaagcctagggttggcgttgctgacttgagaggcctcattggtgggcctggaccgttgagttgggcccacctgtcagctaacactatgatgggccttttcaagctttgggccgttggatgcggcgagagatctgggcctctgggccgtcggatctgagagaagt

SEQ ID NO: 77179 - DNA, 699 bp, Oryza sativa
attcgagctcggtacccgataataatagcattatctatggctaactgtacctaagaagttacagcaaaaatagcacaatttttatatatatatatatatatatatatatatatatatatatatatatatatatatatatatatatgaatgaaagattacgatatatatattagacaacggaatagtttttagggacttaaaaatgcatatataatgagttattgtttttttaaaaaataactgtctattacaccgtacgaatattttgctagtccggacaactctaccctgaattttctgaatatatggatttagcattttcaggtgccggtaagtcttctcgctgaagattccattgccaacctgatggtacgaccgcacgcgcaaaatcttagccatttccttgcaaatgggcttggattggaaacctcccaatttccaagcaattcagagcattcaaccaacagctacgcttaaggaaagtaatttgaaatgttttttcatacttttttatgataaaaggaaatggtttgcattcccgccctggcctttggcttaagtaggcagaccgtcaatagatttttctacttatacatacttgtctggcgaaatttaaattttcaactttcaaatttagagttgattttagatttttttcatcaaagtttattttccagtctttgcttttaaatacataag

SEQ ID NO: 77180 - DNA, 1737 bp, Oryza sativa
ctgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttaatacacataatttgttgacttgaccaccctaaactctctctgcaaggaaactgcccaatgcttcaccgcctccttcatctcatccttatgagcataccttgcaccctcaattacctcgttctccttatacttccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatattcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctctagatcaaactaaactacatcttacaattaacactattgtctatgtctcaattcatactattatattctatgctctggatctacacatatgtgctgtgtgctacagatctgctaaaatatatggaactaaaactaaaacgcaacatatatactcaaacataacatattagtacaaatgcaaaagatgtatgggagcaaacctgtgatgaagtgagtgaaccagcagggcttcgccgctccccttctgctgccctcccctctctctctttcgttttttttggatttttacttaatataatgaaatttcagagagagggctgggctttatagggggaggcaaaaatcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgttgcccgagagcgaacggccgtctgccacgtcactttcgccgccctctgggatggtgatttttaaaaatcgccctcccagagggcggtaggcgaccacttctgtcaattttcaaaatgaaaaattatttttgtaaaacttttaataaaaaaaattaaaaataaaaaaaattcacggggagatggactgatggactatgtacag

SEQ ID NO: 77181 - DNA, 3593 bp, Oryza sativa
ctaatttgttacttagcaagaacaaaagtacaagactgaacttatactccaaaaaaaaaaattctccacaaaatatagatgacgaaactatcgttgaaaaaaaacttgataaagagacgcggtgatacctcaagcaaatgttgtcttcaaaaaagggatacactcaacaatgatatgatgatcaggggtacaatgggcttgaccagtatgtgcaaaaatatcaaatatctgtagcaagcatgaacgtggggcccacatgacagctccaattgctcataataaaaggagctcataatttgcatgccacaatataaatgaaaaataaaggctatatcacaggacatgctccagagcatgaaggttttatgatgcaaagtatcaattgacctcctgactaattttaagtcactgtaagcaaagtttttttgccaaagttttggactggacaaaaaacacaagatacctacttcaacccccaagataacttcagccaccttgaagggaacaactcatgagactaactttcagttgaaatcactgaggtacaaaacggctgcagaaatgcattgttgagcactcaagtaatgccatggacatgatgagcaatgggatgtaatcctcggcacgaagctggctcaatgaagctcctgacgatcgcctcccacatcttttctatgcctcaatatctcaacacccaaataatcgacgattccacgtacagcaacatgaggtttcccaactttcactctgatggttgagatttgagggaacttaagcaatgcgttacttgcgattcgatgagctactgcttccaaaaggttccgcgatgggccttcaacaacatccttggcaatcctgtaagtgcagagcatgaacatatttcagttctccaatgattggaattagtaaaagaacaataaaataaactgaataatcctacattgctgaaatggacaagcaagatttaatatcttaaaaagaacaatcaatcaagacatttctagtaaaatggtgaaataaaaacaaatcgggattaatttgttactcctacccgtagatatctgtgtagctaaccgtatcagatatgctgtcagtctccccagcaacactcaaatccatccacgcatcaacatccacaacgaacttttgacctagagttttctcttctgatttcactccatggaaaccgtggaactgcaaatctataagcacgagtttatccctgtcgattaactccctctccgccataatggtccttaaagcacggaacgaatccttagtccggcagcacacgggtatttggatcgattcatcggtggtggtggtgctcaccggaggcggaagggaagggaagcagcagcaggacgacggcgcggcgcggtgcggtgggagaaccagcgaggagacgggagcagcaggacgccacggcaggcagcgccgccgctcgccggcggcgtggcgaggagaaggatgggcgtcgactcgacggggagagaatttttttatttttaattttttttattaaaagttttaaaaaataatttttcattttgaaaattgacagaagtgatcgcctaccgccctctgggagggcgatttttaaaaatcgccatcccagagggcggcgaaagtgacgtggcagacggccgttcgctctcgggcgacggccgtcaacgaaatttgcaggcggcccccttgccgccctccgctagggcgattttgtactgtacggggggccacctgcaaatgggcggcggggggcctggaattttgcaggcggccctcttgccgccctgggggagggcgattttatattgtgctttatatttttttataaatatcaataattatcaaatctttttatattgaaaactatacaagattaaaatctccaagactggtaaaatacaattttattattttttagggtctatttggaatgttaccgtacaaatattttgttagtgccaaaatataagcaagttttggcactaccaaatatttggtaaggtaaaattgcatttgatcatatttggtttgctaccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacacatccttggattgccctgtaaaaatagtaatgttattcagtttgggtagtaattttgtgcaaatcatagcggattttgtaaatggttagacatacaacgaaatcgttgtctacattggggcagacaaaatatctccttccaaatgtttgttcagcaaaggatgtagccacctgccagcgatctctgcacccacactttggacgctcggaccatttaggtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacatccattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggacgctcacgccacgtggggagtcctaggggatttacgtgccattctaaagcctcagcagcaattcgacgttcatgcttatccttccgccttaggtagtccgatcttgtttcactacgtgggtaagcacgtgttccgtcgttttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatctccttccccgagtttgtatcatgagggaagacttgtgttgtgtgctagtggaaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaagcagcgccgaaagttaatagtgacaactcgagctgccgtttttcatgtgtgctgttg

SEQ ID NO: 77182 - DNA, 2170 bp, Oryza sativa
aaaggactgccttgcatgtctaggaagttggcgaatgtatcttcttgcattttcatttacaaaatccagatcagcctcatttggcgttccgatgagctgcaattaagaaatttatgataggaaaatcaaacacacaataatgtgaaacagatagtatataaatcctctagtgagaaatgcgtttgtattaatagccatgactcagaattcagtatcctgcatatcagccagaaagccaggaccttctggagcaacataaattctctcctctttgcattttccttagttttaacatattcccataggataatcaacatattatatatttccaaaacagtactccagttatgctaaatatatgaccacacaacataacctgatcaattcaatataaaataaagttcaaaagataagagtgtgttctaacctccattagtagacgtaattgatggacatgatctcttccaggaaacaaaggtttacgatccatgagttccataaaaatacagcccacagaccacacatcaattgctgcagtatattcagaggaattcaacagaagttccggtgccctataccatcttgtgacaacatactcagtcataaaatcggtttctgaggtggtacgagcaagtccaaaatcacaaattttgaggtcacaatttgcattcaaaagtaggttgctgggcttcaagtctcggtgaaggacatttgctgaatgtatatacttcaagccacggagaatctgataaaggaaatactgcacaaaaaggtaaagaattacgcaagaacagttataccaaacatgtattatttctcagaacatggtagatgcatgcacaaggaaaatacaagagaacacaatcaagttatctggataaggaaagataggtgaggcagccattctagagttccactcaagaaagggagagatctatctgtagcattgatcataagagcttgcaagctgcaatacagcaagacctctccagtgtgattgggcattgaacccttctcacgttgaatgtgttatgtggggaatcctttgaatgtctcaagaacacgagttcggtgagcgtgcatggcacgccacagtgtcgttctcgccgttatctgttgcttgcattagataagagttatcccttaagatttgaggtttgtttcagttagttctgattcattagcagattgtaatcgcctatataaggccactcttttttctgtttctcctcaccatggctttgtgggaggcgagggcatcggcatcaccctcccgtcaagcactgctacaaccttcggagctgcggtgccttgccgccagctcctaacagtatgtggtctactgataaatagcaatcaactcattattcgattttatatcggttagcaaataatatggtatctccaaagaaaacgttagtttgatccaatgatcaatggtgcactgagataacctaattgtagcactttgcatatatgctttgcagggcaaaggtacgttcaggtatattagtaggtcgctaaattcgtttcttaatttcaaagattatgcatacctgcagaattcttaaaatgtgatacaaaattaccataaaagctttacattcaaccttttgtaccaaattccttatagttcttacacaaaacatttataaaccatcaatacatacttcaatacttcccactttttaggtcttgaaaactcaatttgagcagaggcctagacaagcaagagaatccaagcagaccagaaaagccatttgtatgaaataaatgctaaagtggaaataaagttgtgtttttcttttgaagaaggtacctggcagtgctcctctgacaatgcttgatttgagcgaataatttgatgcagatcagtatccatcaattcatatgcaatataaacgtcattgaatgaattcctttgtggaggaggtatgatatcccttatggcaacaatctgcatcacataagtaggaagttgagacaagttattgccttttggagcatcgatgtgcaaacacaagagcttgctggatatgtgaaatacaacagaccagctccaaatatcttataggagtagataaaataagtaaatcaactatgtccagaccaaccaaagcaagaacaaacatattgcatggaccaggaaataccatatgaaaatgacttg

SEQ ID NO: 77183 - DNA, 1181 bp, Oryza sativa
atacaggatcgccaatttggaagtaatgttttatgtaataatgcaaaatagccattttttgtgcaagctatattttaaaagtagaattggacttgatgtacaaatcttagctcatgtttccaactttccgtacatacaattgaatttatagccagatttgaaaagtagaatttgacttgatacacaatcttagctgatggcaataaagcaggtgcattatctaaggacttctactccaaaatttgcctaatccgatcgttttctacaaacacccgtaactggtataactcccaaaagcctcccctgcataattggagcactaaaacctgaaattaaacacttctctttctgcagtaggatacaaacaaaatggatcagttttagtttgaaaaaacttccaaaaaaaggcatgagcatgcatttgtgtatgcctgtgtcaaccagtctatggttcagcaaaagcagtatctgagcaactttttgtatgaaccttttttagggaagtatcaattgatctattatgttataataaagagggtgcaaaagggtgccaccacgttcaatctagaagcctagaataacgacattaatcggggaaaaaagataaatatatgcccgtttattatagtggtgggtctagattacaacggtccaggttgaccagtaaattctatacaaaatataactctaattttaaatctagctcctctcatatttgcatgggaaaatccactagtttaattataacggaatatttatgaccatccaaatttaattcacctcttcagaagaagctgagtttttctagggctggctatgaagatatggcctattctctaattcacttcccctgtggctgtctttctaccactaaccatagaaaaaatatgttgcctctggtaagctgaaaatgatacttcaggcctacgcaggaaatacaacagtgggctactcctattagtcagtctttaaattggtaaatttcaaaggtccaagtccaacatgcacacacaaagtcaatctcaaaactttccaacaataacacaattcctagtactcctatcccctaattccctccccactggcagtcactcccactgcattcagactggatttgactgacttaggaaaaaggtgtaacaccagattggtcctcctcctcctcctactactactgctca

SEQ ID NO: 77184 - DNA, 2988 bp, Oryza sativa
tacgaatcatgtgatgttgctactctccaggtcaggtctgttcacatcactcgctcccccactattcaagaacacaatgaataacaacatccccaaaaggcagatggcttctttaaaggcatctccaaagttacctctatttctgaagctcgcagcactcatcatcagcagcaagaatggagggaaaagctctaccaaattaggccgagcagtgacgaactcaatcatttggtaacctaaccctcacctcctcctcctttccccatttaatgcaaccaacttaactaaccagagacaagagcattcaacgagaatctcaaaatctgcgcctaaaaatcgagggtgggtgggggggaagggaattccgtggtcgaaacaatggagcggatcgggagcactgacattctcgtggtccatgtggcggagcagcttgatctccctgagcgtgcgcttggcgtcgatcttgttgtcgaacgcgttggcgatcttcttgatcgccacctgctcccccgtctccgagttgagcgccgagctgtcatccaaacccaaaatccaaaatccaaaccaaaatcaggccgccgccgccaacggaatgggagagaggggggagcaaacgaaccagacgatgccgtaggcgcccttgccgatggggaggatggggggcttgtacttggcggtgacctcgaacacgttcccgaagatgttgtactggatgaacctcccgccatggctcagcgtcgcctggatgttctccatcatccccgcccctgcccccgcccccgccgccgcagccgcagcaggcggctgctgcccgccgccggcctccgccatctccgtgtccggcggctgcgccccggcgtccatggccggattcggatttggatcgctaccaggaggtggaggtggaggaggaagggaagggaaagtggaggcggaattcgtcgcgagatttggtcgctttcggcctcgttttgtagctctcgcctcttttttttttgtgtgtgttttttttgtgtgtgggtgtgtgtgtgctcgcgtgtgttttctcttgggctgtggaggtgggggtggtggcccaccggggtataaaatggttggcacgcggggctacgggtactaggcgtggcccatttttggggtgggtgggtgtggggggacgtgtagcaaaatggagatgctgtgccgaccctaacgactgatgacgtgtcatggtgacgacagcgtgagggaacactacctctgtacctagtacctttacacccataagagcaagtttaatagtatagcccactactaactccaatttatctatagccaacataatagtcaattcatacaatagttgcttactatattattaatatatggtctcacctgtcatacacacactgcgtcttggagtccgtgttgcagctggctacagatctaagtccgctattcttctctctcatcttttatctcattaaaatatgtttatagctggctaatagcctgctattgtacctgctctaagagcaagattagtataaccaactactagctccaaattatctatagttactttaatagccaatatatacaatagttacctataaacatatactacactattaatatatgatctcacttgtcatatacacattgcgtcttagagttcgtgctgcagctggctacaaatttaaaaggaaaaaaagaagaatgagaagaaaatggaaaataaaaagaaaaataaaagaagaaaaaaaagaaaaggacacatcatgtccatgtggcatgctacatcaacgccacgtaggatcctagaggtgatgtgtcaatttagaatctagatgatacactttgataagttacgtgactcagatatgtattttgagagtttagaggcctatataacacaaccctataagatgaaggaccgccaatgcactttactcaagttgaatggtagagctaactacttataaactcatattacaagtataagattggctataacatttgtcttcaccttttcttgcttatgtatttagtgcatgtaccttgaagcatatgactagagctttgtacttttcttgtcttccttctccatataaacttatagtttactattatccttgcttaaggtggttgcttcagcaacaccaaacacgagggcggcgaatgctatctagcgccagataatggtgtcattttcttccatatttttttttgctcgccatatcttcccgctcatgtcattctaccaacacttttttttttcgtcgaagacttcatactcctacaaatgattgagacagaaaggtgttttttcttgatccagtggagataaagaaataagcatcagtactaataacattgtttactgcttactttaaatgccaatggcacgtgttgatgtagaattacgcatagataacctgccagcggctagcatcctccaaggaaattgtaccatgagttaggcaaagtttgatgaaccagagcttagaattttactaccctccggtgaatgtgacagtgaatgctatggacaggaactctttgcgatgaatgcttcaatataaggacaagaacaaaacattatctagtcttgcaatcctgattaattaggattttttttatggatactagggacttgctggaaatttggaatatatgaggcaagtggtgtggaaatgatagggcaatagataaaataatgatgttctagcatctttatggaaacaaagttaacaggacaataattaattccgcaaacacactgatattaattataatacaaatcaggtctaacaaataaaaatgagagtttatgctaaaagagtttataagtaccatgaattatttgaagctcaaggaaacctccaatgcaggaagctattgtcatatctctggtagtagagcctcaggagaagaagaaattataacccctgtgcagagtttggatgagaagactttgataaatctagtgtatgtcttcacagctac

SEQ ID NO: 77185 - DNA, 561 bp, Oryza sativa
cctatctgttttaagatagaaagtaacaactgcagtggatacttaaatatatttgtagagcatctgtgcatgacttctatattactaaatcacatgcaaacctaaatattttttttaaaaaaaaaaactatgtcgatcctttttacctcttgatccaccctaacctaatccaggtggtataggtgtgtcatcactttattcttaatgcgtgaattgagcatcattcttaactcataggtgggaatgttgaaagagtcattgccttgtggtgttttctaatgttgaaaatgcattgttccctgtgtcaaaacttttgacctgattttctctgcatgtttcatattactgaatgcccccttatcttttctcctatttcttcttatccagttgaaggtgcccttgcacatccttacctggcatcactgcatgacataagtgatgagccagtctgctcatcacccttcagctttgacttcgagcagcatgcattgtccgaggaacaaatgaaggatctaatctaccaagaaggccttgcgttcaaccctgattaccagtagctgg

SEQ ID NO: 77186 - DNA, 629 bp, Oryza sativa
aataaataaacaaaaataaaaaagttcagatcagcagcatgtgatttttttaaccatttaatttctaaattttaaattgaatattctcaaaacttatttacaatgctgaacattttgtcacgcgtggcgaaataacaccgctagctaatactctaacccctcgtgatgtggcgcaccgtacgtgttagcaacaactacgggtgacattgtgacgttgttttagcacgtcaggcgggataccatggtctaaaggttcagatttaaaagtaaattttaaaacagcttatttttaaaataaaaaaataaaatggttcaataataataataataataataataataataataataataataataataataataataataataataataataataataataataataataataataataataattcggatgaagtagtgagcaatcagcagctgcagtacgtcgtagctaattggtgtgatgagtgatgagtgatcactctcgtcgatcggaagctccagctccaatcattcacgttttgatgatgcaagatgagtggccgggcggtcgctgtcggggaaatttaagaaacgggagccgtcggcgaactcaatcgatcgatcgaagtgccgtgt

SEQ ID NO: 77187 - DNA, 1494 bp, Oryza sativa
cctttcttcctcgtctacggcgcgaaagcggttctcccatccgagctcacccagaagtcccctcgggccaccatgtactgcgaggctgatcaagatcagcttcgcagagatgacctcgattacttggaagagtgaaggcgacgtgcggccctccgagccgcacgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctctgttcggctggccacgggcgacggcacagagctgcctaacccgtggaacatcgaacaccttcgtcgcttctacccctaaaggggaatcgggtgtcaggtttcgggctcgggccaaccccgcacccccctcgggtgtgcagggttggccgggggctaccacatatgcatattcttatttctcttatatctgtatttcaataaaagcattttcgatttcctaaaggctgtatctgtgctgttgtttccttttgaaggatcttgacttgaaataggtcactcgtgttcaatcccgccctcgggggctcgggtcggctaaaatcgccaaacggggcccagaacagagccgtgccccggggcgtggtgaactccgggggggaatcggcaaaaacccacaatcgggtcacccataaccctcggtcatcacgctcccggcctggccagtctcgacatgtggatctccccaggcactagccccgacccgagccatttgaggactaggacctgggcatgagcccttgttcaagccaagacacaaaaggaccgcggcacagaccatcctcgtctcatacacacaacaaatagaattgacacaaaaaatttcctctttatttgattgcagattaaattagtctatacaagaagggggcccgaaggcctcggaagaagaaaagaagaaactatttaaagattggcgggggcctaggggctcactccgatgcacccgggtcgccagcctcgtcgccactgtcgcccactccgccgtcatcgtcctcctcgtcggagttgagggcgaacgcgagccgaggggccaaatcctcgaagctatggacgatatggtcggcggcgtcccggacctgcgcgcgcgcgccatcctcggtcccgggagggaactcgtccagcgccgtccatggggagaagtcgggatccctagcttggtaactcgccagtacgagctccaccgctcctcgggcgaggtccctcgaggatgacttaatcgtcctctcaagctcctcggggagccgttggagagtcccggctatctccgagaggcgctgggcgaggcccccctggttggcggcgtacttcgcagtccgcccgccccagaggcccacctgccggccggcgcggtctatacgggagacggcgtcccgaagcatgccgggcc

SEQ ID NO: 77188 - DNA, 8572 bp, Oryza sativa
  unsure (1)..(8572): unsure at all n locations
ggcttcccgaagccgatccgcggcttctcgccggtcagattcccgcctccgggcctctgtggtcgccgggtcctcggcctcagactggccggacttggaatggcgggagggacgcgacgggatctcgctgaaacagaagaaagaccagaagacaaacaagatggatgagtgaaaattcgcgttgaaggaatgaatacggccacgatgggcgtgggacgaacctgcgagggggtcggttaaacgaccaccttggaggggaaataaggtttccccgggatggttctgtcccccccatcttgcggggccgtttcttcttccgctctccctcgggctgcgacgtcggcgtggccccctccgggcgcctgctgctggcacgcgccgccccgccccctcggggaggagatgggggaggggttccttcctgcttcctctttccccgggcgtcggcagggcggccgctccccgggcccccgacgcggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcgcagcagagggggaggactccttgaggaatgagggatgcctccacggagctgagattcagcacccgttggaccactatcttgaagtcctcaggagcccagtcccatctgaccccctggtgggtcctcatacagtcctcggacccggtgtactcccaggcgccccgggcgcgccgctggagtggcgcgatccggcgacgaagatagtcgccgaacaccatggcccctgtgagcccctgggatcgcaggcccgccaggcggtcgagaatggcgtcgtagccatctcccagatctaccggcgcccgccagttggaggcctgcgctggaggctggctcggaagtcggaggcgcgcttcgtcggcgaggggggtgtagaaccagtcgctcttccagtcatcccacttcttgcgaaggacgcagggaatgtagcggttcaacaccggcccccgcggctggaagtagcaaccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacagaccgccccgggtagcgtggcgccgggcgtccctcgcccagcgagactatctcccggccggtggcagattccggcatgaagcggcgcggcagtccggcctgtctctcgctcacgatgcgggaaggcggcagcacgctaccgtcaagcggagcggagccccgtgccatgacgccggaaaaactatttatttgaggtcgcaaaccacatttattgcggtttggacgagcgcatcacgccgcatgtaacgcagtgcagcgcactcgtttatccggtctgtgaccagtcacagaccggtcagatcgtgggttaggtggcgacaggcggtctgacgcacgcctcgccccatcccgttaggacgagagcctccaagcactcgtccctagccggagccggcgtgttagctcctggagatggcacgttagttccggtcaaatatatgccaggcttcatcctaaccattacaggcaagatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggtggaagtggaggtaggtatgggccgtcccatcagaaggtcattcggacggcaaccatacagatctccgtccattaatgaagagaagtcaagttggagggaagagaggagaagtccccacaaaaaagagagagatggtgcatgtggtatccccttgaggtataaaaggaggaccttgcccacttagaaaagggggggatgatttttaggagaaaacgatcccagaacgatcggaggctggctggcactttgtagcttcttcatacacagatccaccaaaacataggagtagggtattacgcttctcagcggcccgaacctgtatacatcgcccgtgtcttgtgctttttccattctcgcgaaccttccacacacagactaggagcttagaacctcacccagggcccccggccgaaccggcaaaggggggcctgcgcggtctcccggtgaggagccccaagctccgtcagctctcatttatgaaattagttttttattagtctatgtttagtactctaaattagcgtccaaacatccgatgtgacatgggcaaaaaagtttttagccccactaaacaccccatagtttccaatcgtttttatcaccagctgaaagcgaaagggaactactgcacacgtggactagtagcttggggaacagatcaggtcagggaggaggtggccttgtctgtacttcctcgatcgtcagagattgatactgcctgtccttgatcagagtttgatattaaattcgtcacatgtgcaatgatcctggcacagcgtaaagcatggcctgattacaattatcacatgtaccccgtagtttggtgagatttgtccatatgcatgaatctgctggaggctttagatcagatcttcaaaatcgtgcagaatctggctggctagcctgagaagcaactgcaaaagaaaaggagctattgcatttggtctatatttctttcctttggttttcaaactctagaaaggacacggagtttctcctatagattaaaaagaagagaattgattagtttacgagaaaaattgacccaaaagcattgcaattatataattatatagttaaaaaaatagacgtgaggatcgccaaaaataacaactaaagataaaacgccatcatgaaccgcatgaataaccatgatatttattatctatccctttgcatatagtttgatctctttattctcttggagaaaaataatgcaaaatttagtgaaatatttattatgcattaaaaccgacaatacctaggaagagctatataggcatcgatgtattatgcatgttatcattttcggccacacgcatattcttctactacatgatggacggtcacgctcacgttttagtaggaccattaactactcagttctccttcaatctaaaaatataaacaatcctacttctcaagactaaggttgaaggaaaaaaaaactttggtactcctcgttaaacgagggttgtttaggaacaagatgtacaaaatttaaacgagagatgattgatgatgcaataagtattaatatgcggatgaattttaaatgttttgaaatgcttaccactggacccatggcaaatagttaaatgcccgagtaccgctatacggtttatttaggtaatggaatgaaacattccggcctttgctcaagagctatagtcaattattacaaggttcacacagtgagtaccgctatatatgtatgacctatttttacaactcatgtacaactagagacgacgtataatcatagatcaattaaagccgagcatgttcataagcactatagccgtttataaccattgatccaaattcagttttacgagagttatacatggtcgtatgcatagcaattttctaaatgcccccatgaattctagatagagggagtactgtttcgtctcatgtacgctccttgcacctaaatagtagtactctgatcttagtggggaatattagcatatacggtgttgatcagtaaccttgttttgggaagccaggaaactcggaaaatatactagaaaagcaaaaaaaaggaatgaacaatattgctaattacgtacgattatatacacccatgtggttccttttcaacgcatcgaaatgacggtacagtatgtacacaggtgatcgattaacaataaagcatctttgcaaattgcagctagctagctaagctaggaaggattaagatagcatgagcgctttactactactggagtgtgggctgcgtttagtgcgtcccaccaccatgtatgacgccaccatgctgatatcctcatagccagcgaggaatcaaccatgaacgacacaggtcattaatcaggtagctactgcatgcacagtggagtacataggaaaaaaaaaagctttgtatggtgcagtactgcagtattcagaagtggattccaaactctcgaggaaaaatccgcttattatttatatgttatctaaataattataaaaaattttaacaagaaagattaatatgtgataaatcatttcacaaatatgcaggttaaaatgggaaactgttttaaaatttaacttctacaagttgcaacggaaaaacagattaagctgtaaatatatgcttcctccgtttcacaatgtaagtcattctagcattttccacattcatattgacgttaataaatctagatagatatatatgtctagattcattaacatcaatataaatatgagaaatgttagaatgacttacattgtgaaacagaggaagtattaattagctagccgtagtttaattttggttgttcgacatagtgttaaacttgcgatttcatatgaccgagctatatttttataattttctctttagaaaagtactatctctaaaaaaagaattcccaattaaccgtgcgccgtgagctagcggctctcgtcgtccctggcctccatccatccatcgctttccctcacgtcgcagctcgacaccgaccggtggatcgatcgtacgtgcgatcatctcgacctcgcgtcgtctcttctcggcggctcgacgccaatccacgacgcgcgcgccgcttgtcgcgcgcgcgcgcgagagctcgtttcgatctcctgtgtggctctacgctcatccacgcgacgcgatgcgccgctttcaattcgatcgacctcgtcgntgtcgcaattgggcatcgatctgtacctgtacgcatcgcatgtactgcgtgagagcgacgtcgttctagccatggtatagctacttttctttcttcgttgtggttttaacttataagctacacgtaaaatgagaaatatattattagcataaaattagttaagtattaattattaaaaatttaaaataaattttatttgaaatttgaaaatcatatcctgtatataaagttttttatacgaaacacaaccacttatccgtttgaaaaacatattaacgaagcttatttaggccgggcgctagctacaatggtgagctttaatttgtcagcctcttgctgcatatatgttctttttagagaaggatattttctatccggcctctatattcaatcggatatatctatgcagtctttttaaattaaaaacttagcctataaaacagagaatttactcatcaaataatccaatctgaaattcgtttctatagatatttgaactcacgacttagagtgttactcgagttactgtaactaatatgctacatgaggaactaggcactgcgatcgcgatcacacgtttatgcgatcgatcgaccgggcacgaactgacagctccagcatgttgaatgcatgtatttacctttacttttgccaaagggtaaaggttaagtttagagactatatagcttaattagggggcattgcgctgcctggggtgccactagcacgtactagtgtgtcaattagtcaaattgcttcatctgtcgtgtgtactagtgtgtcaaattctagcatcaaattgcttgggcaggggaatatttggctctatatgggtagaagtaggccttgaaatgtcatgctatagttaagtacacatcaatcatctatgttgattcttatgtttgccggctgtatctgctttctaatttgtcgatcaacaatacacctaaatttaattaaggaaaaagtacgaattacacccctaaactatcgaggtcgtccgaattacacccccgaactcaaaaacgggacattctacacccccaactattaaaaccggacgaattaccccccctcgatcttatccgcggtggttttgatctacgtggcatacacgtggctgtccagtcagcattttatttttttaaaatggtgggacccacatgtcatacactctttctctcttcctccatctcccttcctctctctttgtcggtcagcagcgggcagcgccgcgcacgccggcacgctatggcggagaggcgagcgccggcggaagcgtcgacgagaggatgcgatgggcagcggcgcgcgggggcaggcctgcggtcggcgcgaacgacggcgcgcggggagatggaggggatgggggagaggcgggcgcaggcgtccatctcggagaggcgggacgtcgtggcaccgaccgacagcatcttgaggacaacatcgtgaggccgcggcggcggtggtccaggcggagcacgagcgcaagctctctgctgctggggacggcagtcgcgacggcgaggaaggggaaccaacgaacgaatgcttcttccaagagattccccgcggaagacgcctgggccgcacggaagcggagctcgctagggcggcggtcggctgatgcaaagctcgcggtggcaaggtggagacggactgagcgggcggcgacttangcgaaggccgtcgtgcgactacctcctcgcggacctcgcccgcggcggcggccggcgctacgacggcccacttatccgccatggccgccggtgcccacctctcccccatcccctccacctccccgcgcgccgccgtgcacgccaaccactggcccgccatccgaagcttcctctccgccgcgccccctccacgccgaccgccggcccaccatccgaagcttcctctccgccgcgccccctccgagccgctcccgcagccgcctggagctccctcccatccgcgccctccgccgctcgccgccgaccggttcccctccgccgctgtccgcctgctctgcctccgccgctcgctaccgactggttcccctccgccacttgccgcccggggagctctgccgccggccgcccgctctacctccgcctctgccacccgccgctcgaggagctccacctcggccgcccgccgcccgaggagctccgcctccgccgccggtcgccccctccaccttcgtctcagccggcgttagtgagatggtgaggagagggagaagagagagagagggagacattgagtagagagagagagggggtgtggggatctgacagtgggtcccactaattttttttgtagagagggaggatgaggtggaggctgacatgtgggggcagtgccacgtgtgcggccacgtaggattaaaaccgctctggattgagccgggggggtaatttgtccgggggtgtaattcggtcgacctcgatagttcaggggtgtaattcgtattttttcctttaattaattatatgcaacgcctaaatttgcataccactagtttggtttcatttacatgttcttactatgtattcgtccatgaaagactaatagttttaactagctaaaagacaattagaaaactactgtagcctttattaatgcgaagagaaaatagggagagatgatgaagtactactgcttctatggctaaaatgagacaaaataatgtagtaagtagtccagagaatttcacgctaaaatctagtctttgtggtataaatttttagattaaaacaaaagtttaatttgttagggatggaggaggtattgtatatgtgtttttatttacgcttgttcatcatgaaatgagttaaagatggtgttctccaaccttataattagaatatctccccaattaatagaaattttatagttcttaataaagtatctcgagatatctaaattttacactaaaattttttgtgataggtatcaaattttaaacaaaatatggtaccttcaaattccgttctcaatgatgctagaattactcctctcccctcccaaattaaccactacaggataacaggaattaaaatgatccacatgaacatgacttgaaactaagaggataataaggagaccccacaaatcaaacaaggtatagtattcatgaaaacgagtgttattatttttatagttcaccgaacgatggtattggtgcgtgtcatatccttgtgtagttttgtgcgtgcgtgtaacgtacttttgactagttgcgcctctccctctccctccttttaatctctttccacgactttatcatattatatatataactccatataataagttatatagtagtagtatagcaggataaacaggagaagaagataacagagaggatgggggacgcatctgctgcgttgtgatggatcggcttatccacaacaccggcccggggcccccccaccctccctaccgccgatgatggggatgtccatgtgatccatccatccatccacccccatgcacttg

SEQ ID NO: 77189 - DNA, 752 bp, Oryza sativa
aaacatactatgccaatactgacctgttattctctgtctaggatcaaatgtcagcatcttttcaaccagatcaattgctaaaggatgaacatgtggaaatttttcaggaaaggactgccttgcatgtctaggaagttggcgaatgtatcttcttgcattttcatttacaaaatccagatcagcctcatttggcgttccgatgagctgcaattaagaaatttatgataggaaaatcaaacacacaataatgtgaaacagatagtatataaatcctctagtgagaaatgcgtttgtattaatagccatgactcagaattcagtatcctgcatatcagccagaaagccaggaccttctggagcaacataaattctctcctctttgcattttccttagttttaacatattcccataggataatcaacatattatatatttccaaaacagtactccagttatgctaaatatatgaccacacaacataacctgatcaattcaatataaaataaagttcaaaagataagagtgtgttctaacctccattagtagacgtaattgatggacatgatctcttccaggaaacaaagatgcagctaatagaattcgggatctcgaaggtggactagtggagaagaggtgctaattaattgcatgtatgcataaatgccttatattatatatgaaaaatctgaaaaaaaatagttgggccttgtattatgaaatatagggagtatctattatctacatagggtat

SEQ ID NO: 77190 - DNA, 757 bp, Oryza sativa
agtagtccatcatgaggctgatcaagaaaaacttgacgcacacggaaaagcgcgagagctcagaaaacacacgctgagccccctacctggcgcgccagatgacggagcgcggtgctcctcaccgggagaccgcacaggcccccctttgccggttcggccgggggctcagggtgagatctcaagcttccgtgtatgtgggaaagatcgcggcctctcaaaagagcatgaaccacaagcgatgtatacaggttcaggccgttgagaagcgtaataccctactcctgtgtttggggggatctgcgtatgaaggagctacaaagtgtgagccaacctctccctcgttctaggttctgaatctggaaaagatcatcccctttctctatggatgcacagaacattttacatgacccaaataaacatactaatgacactgattaaacaataaagtaatgcgtaaaataaatagataatagtaataagcataaagatggcatcccatcgaaccaagacatgacttaatgcatacctcccattaaataaattctcgactaactatcaaatgaaattccaattgaccccaaatctatttacccaaagttactaataccctaaactgacctaaattttaaatatctcattcgaattagcgatcaagatttttccttgtaaaccaaggaagaaaattctcaaattttccctgaaacaaatccaaatgccaaagaacatatgcgtatgaaagagtttaagtgagctctta

SEQ ID NO: 77191 - DNA, 690 bp, Oryza sativa
ctatagggcgaattcgagctcggtacccctttgcaacgggcttcacgaggtgtttctacattaagcgttggtgttcgtgaaggaaaacggaaggaaaactgttgaggattatatggtttctacagtgcttgatgtactgtagcgatggtactgtatcatgcagcatatgcatagaggattatctgcagctgcggtatatggaagagatatttacaatttggaaattgtagattggtttggaaattcagcaatagagtcctattgggaatatgagttgtatttctactttgagtaggaggttttcggtataaatagagaggaaggctatgccttgagggtaagccaagtttgagagattagatagggtttcgtgaaaacttgcgaggggtgctgtggctgcactttataaacaatacttgagcaataaagatcatatttaatcatcaaggcatcgacgatctattctagtttcgtaagttttgcgtttatgtttgattttggcatcatagttgactagggactcgtacgtatctatgggtacaaagatttaaaggtgaacaataatcaaggcatggtataatcacaagtaggatgttcatcattgcatgcattttattggtaaacaaaataatttcgcattgggatcaacatgttcaaagaataatgatgacttgcttgctcaggataatc

SEQ ID NO: 77192 - DNA, 8429 bp, Oryza sativa
cttggtttttctcaacgcacaagctgagatccgcgccttgaaagagcgtggaattcagcgcacttcgccgagtcgtgatgtctattgtcctattcataagacaaaaaatcacgacctctgaagctgcaagattcttctcaacgccatgaagacgtcgcctcctaaggtccagcagtcacgaatctctcctagagatgtgaacaaggaatgaggaacgatggtcatctcagaccgattcgttggggtgatcgacattgatccccacgagccatcagtcctacactcgctcgaggaccagggttcatcgttgacaagtacaccacgcgatgtgtttgctatcgaagggaccagcgcgtttgcgcgcgccgacgcggaagcagagaatcaagtggttacaccggcccagcatattggggccatcaacgcaatactgagggaaaccccttatgatcccgttctgaacgatgatctcgcacggtggacagaacgactacgggaatcagtaaccaacctcaacaacgcatttgaggaggccgctgccgcggcacacccagaacaaccgccagctggcggtgcaaatggcgcaccactagaacagcaggcctcaccccgacaagccacccctccacaccacggcaccagcgatctccgtgaccatttaaatggccgccgagaagcacgacgcgcgcaagacaacgtaaatcgttcccgacatcgtctctcttcacgacgtcgagagaacgaagagcgaggaggacacccgagcgagaaccgagaccatgataaccgccacaaccaccatgaacgcgatgatcgcgaacagcggatgccgggcgatactggtcccggacgccgccatgacgatgacgatgatggagatcggcgccggaacaacaacggtgtacgacgagaggattcccgagaacccgggcgtcatcctcggaatcgtacaccgaagccgagtgacccatcgtcgtcgtcatcatcctcttcatcctcatcatcagagagacatccgcgaaggacatacgatcgccgacaacccgccgcccccagcgctaggtgtagagctttcaaccgttcgctacgtgatgtccgatggcctgagagattctgaccaggagcaatagagaaatacgatgggagcaccgacccagaagaattccttcaggtctactccacggtactctacgctgccggagcagacgacaacgcgttggcaaattatttgccgacggcattgaagggttctgcgcgttcatggctgatgcacctcccgccctactcgatttcttcgtgggcatatctgtggcagcagttcgtcgctaacttccaaggaacttacaagcgccacgcgatcgaagacgatctacacgcgttgacatagaatccgggcgaatctttgagggactatgttcggcgctttaatgagtgcagaaatacaatccctgaaatcaccgacgcctctgtgattcgcgctttcaaaaccgatgtcagagatcactatactacccaggagttggcaacaaggtggatcacaactactcgaagattgttcgagatcgtcgatcgatgcattcacgcagacgatgcactgagacgcaagaacgacaagccgaaaacggggggagagaagaaaccagccaaggacacacctgaatcaagcaagaagaaaagtagcaagagtgggaaaaggaaagctcaagcggaagtcctcgcgtcagaatacgagcgccctcccaagcacccagacacacaaggcaacgtcacgaagagaatatggtgccctatacacaagtcggtcagaaattctctgaaggattgcctagtcttccaaaagtcgttggaaaagcaactggcattagagaagggcaagcgagtacgtgtagtcgagaaggccgttgaggcaaccactcaggactcggactcggcacacccagattccgatctccatgtctcgcacatgttcgaaggttccacgatgtactcctcaaagcgagaatacaagaaagtggagcgtgaagattgttcgacatggcagggggctgcacccaagatgaagtggtccgaacagaagattgagttctcagatgaggaccatcctaaggctgctgtcatcccaggacgatatccgatcatggtcgagtctactattcggaatatcaaagtcgcgcgagttctcatagatggcggcagctccatcaacctcctcttcgccagcaccttggacgcgatgggaatcccatgaagcgagttgactcccaccgatcaaccaggtgcacaaagactacaagtgctctagcccagagttattcaagtacctcgcggaggtcaggaagctggaaaaaagatttgatggaatcgaggtccgacatgtataccgcaaggacaatatcgaaccagacgatctggcgcggcgtgcgtccagacgggagccactagaacctagcacctttctggacgtcctgacaaagccatcggtgaaagagtcaaacgacgaaaataacatagtcgccttcgacatcagcttgggggctacagaggtagaacgcgccgttgccgacatcgagaccacagacgactggcggatcccactcgttaaattcataagtagcgatgagttgcccgacgacgatgcagaagccaagaaaataacccgctaggccaaaatctactgtatgatcggcaatgatctatacaagaaggcgccaaacagggtacttctcaaatgcgtctcgtccgacgacggcaaacacctcctcgtcaacatgcacgaagggatctgtggatcacatgccgccggtcgtacattggtcagaaaagcctttcgacaaggatttttctggccaactaccctcaaagacgcttgtgacatggtacaatggtgtgaagcttgtcagtttcatagcaaacacacaaagctaccagcccaagcactgcaaaccatccctctcacttggccattcttgtgctgggggctcgacatactcggaccattcccacgaggacagggtggctacaaattcctgttcgtggcgatcgacaagttcaccaaatggatcgaagcaacactcacaggggaaatcaaggccgacaacgccatcaaattcattaaagggatattttgcagatatggattgcctcaccgcatcataacggacaacggcacccagttcatcagtgccgacttccaggattactgcattggactgggagtcaagatctgcttcgcttcggtctctcaccctcagagcaatggacaagtcgagagggcaaacggcatagtactacaaggaatcaagacccgtgtctacgacagactcatgtcacatgacaagaagtgggtcgaagaactcccttctgtactttgggacgtgcgcatcacaccgacaacgtccaacaaggagacacatttcttcctcgtgtacggctcagaggccatgctccccaccgagctacaatatcagagtacacgagtacagaagtactccgacgaggatcaggaggaacaacgaaatgatgatgtgaacctactcaaggaacatcaagaacgagttgccgtcagagcagctagctaccaacaggctcttcgtcaataccacaagaagcgcatccgagcacgtacgctttcgatcgacgactacatcctccgacgggttcaaagccaagcagggcgaaacaagctctcacccaaatgggaaggaccgtacacgatcacgcaagccctacggccaagcgtattcaagattgcagacggcgatggtcgcgagttggcaaattcttggaacattgatcaattacgtaaattttatgtataaatcaatagcatccattcttgtaagacatcttacagcttcaataaagctatttttcaggaaaagattacaatcaaagtgttccttcccgatgatcccttaacccgatgacacctagcgttgaaacctatcctcatgtccctttacgccatcttgacaaggcctccgaggaacctaagggaacttcggcttgggacgcccagagccgataaggtcttgtcggatcctgtagaaacaaaagaccatgtaagatctggtcgtgtaagagttctcgccgtgcgtattaaccaagccgtgtaatcggaaatcgggttttccaacttcacggctgggggataggatcagtgcttgttcaaccaaggcaggtcaaaggtccaaaagccatatcttccaagaagaattctccgatgacaaggctgggggttagggagagtgtatgactcaagtgactaatcgaagtcacaaagtgagaagacactcgtacacacagcatccagagtaagaaagcttagttagatagatttcctttctatttcacaagtacttcttacagtccgcaaaaaattccaaaatatattacactttttcctaagatatttgtcacagatatataaagactaccaggaaggccaatgccaatcaatcgactggaagactttctccgccagcggcgccatcgacttcgctaggttgtatatctctgcaggagtcctccgagaacgagaaaacccttcgcggatgaactcgaggtgcagctgcggatgacgatcttgtatacaggccagcacgtgccctccgacataccggctcgatcgacgtcactcctgctttaggcctcgtcgatacgcttgctgatgccttcgagctgagcgcaagccccattcagccacgagatgtatccggccgctgactcctcgggatccccgcgaggtactcggagttccctgcagactatggccatggttttgcaacaactcctgaggtacgagttgaaccacacctcgcgacctcggagtgcttccagggcccggtgcttcttgacttccagcatagtcctctcgagttcggcgacctcaaacttcatcctccagtactggatgcgacgatcacgatcggcaagcgcactcacaaggtctgctcggcatggaaacgactaagttaagctgttctcctctttcgagaacacagcaaattaagccaatccagaaagaagagcaaaggggatggaaacaaaaagaaccaacctaaggaagtcgtcgccatgcccgtttccacgggcagattctggtccacgtcgtcctgcggcacatatggctcgagcgcaagtgccggaacgattacaggcaactcaggctgcccgcgctgctggacatcctcgacatctacatctgtacaaacaacaacacaaagtacccggaatcaaaatgctaaagaaaactaaggtaatgactgcacacacaaaggcagttggaaccgacaaaagttttacaaagcataattgattaaggagtacagccgaactgaagtcctactcttcaaaaagtgggagaacagactctcctagatcactgacttcttccatcacgtccttacgcgcgttgttagccgccccctgatccaagatcctctggaaatcgagttcagggtgcgacaaccttacgcacgcgaggaagtggcacgccccggtgtagatcccgttggacgtctcctccccgatcctggccacatgcttggagcgaatcacctccatcgccgtcgccagtttcgcgagcgaagtcgtcagcaagaactcgtcgggattcgccaggatggtgctcatgacaccacactccccggcgagctggtgtaggcctgtgtaggtaacccgcagcgaaccacggatctccgacaggttgttctcgagctccgacatgcgctgctcgagcccctgcctttgtcgctcgttgccggccaccagcttcctcatcttcttgaggtcctcgcgaacctctgccaggtcacgcgccagcttgttggcgcgttcattcgccgacgacgccgccgccgccctcgcctccgcaatctcgcgacctatgccgcgagcgccggcctggaggatgcgccccatctcgacttggagctcctcccaggtgaggacgtcagcaggcgggcctcgagcaggcacaagatcgccggcagggccactgggcgtcgcctcacggctcctgggcatgactacgacatctgtcgaggccactgcaggagacgcactggagttccctccggacccatcttgcgccgctttcgcccgcgctgccttgcaaaaaattgccataatggccatcaagacaagctgccagaattcgatcaagtgaaggacctcaaatttgtccacttacttctcaccaagtgtcaccagcctctgccgtcgcggaggcgggggagacgcatccgatgcctaagtaaaacgagtacggtgtgaggacaacatcttccgactacgcaataaatgaccaaaggggctcaccgatggagtgggcgccttccgatgattgccgagcatggaggagaacttcctccccttctccacatcaatgccacctaatggggaggggaggggggcggttggaagatctagcacctatgggccattactatccaacaccaataagattgtatgtagtagtgtgtaccctgacccttctattccttgttgatagcaacacctcatggatgccctgtcaatatatctatgtttatattataatagaaaatagttgtcaattttttttaattgtgtcctcgtactatcaacttggagtgaatatgtcagttttgtatgatttgactctcctctacatacaccagaggacaaatatctaatgccttgtttggttcacataattcttgatagaattaaactcagcatatatatggtcttgcatgtgcttccatagtgtgcttctgtaccatctcgtaccacatataatcaaattaagaagcaatggatggaactctctcataacccgatggccagaagcccagcactactgctacctcacgaatcgcgcttagggttaggaagtatcaggaattataacatgtccatttctgatcattttgacaacgatctggactggatagtacgtagaggggcattgttttttcaaaccaaagagttttttcaacctttggtatgctgaacttcggacttttggaaagaaacagataaacacaaaagatttctgccatcgagatgtctagcttcaacgttgttcttcgatcgccaaatccaaagacggaatgtggacctacatattagcagaagcattggcagcttaagacaagccaaagaaatttcatttctattttatttctctatctgaatgccaactcttctctcttgtaattaattaattggcaattctcctgctaagttacagaaatcatttccacaaatatactggttcaaactgaacatcagtatgataaatatatttttttatgatgtcaacctcttctccatcataaataactgttcagcataagaaatatattcagacaagtatgtacttttaataattagggtttgatgggtattggaaaactatccaatcaactgcacggacaaacaaaaccaatcgttttctctacatgtcgattgtcgactattcgtgctctgatgaaaaacacaattagagcgatcactgccaacgattcgtatgatgttaaacactgccagtctaccaccattttaccctcaccattttatccttgctggatatatatagcaatacctcattctaattcatctgataataaatggtaacacaatatgtatcaaatcatccttttggatagtttggtttttgatcactgaaggtaacttgcatcacccgttttttcatgtacgcatggcatgcatactgcagataatgtatgttcgcaagtccaatgtcagcgtgcatatgcgattcctaaccaatgaagatgaaggtgaaactaaactgctgaagttatcaacagatagaaaacatgtctacaaatccaccctgtttctgagtccagaaagattatttaaaactgattaaaggatctgttattatagctgattggacatctagagagtgatttatgaaataacctagatgagatgaatgttcgttgctataaatgtcccagaaaatatatccctcaaactcgaccatacgagcgcaagcaacagccccaaatcagatacagtagattatttctgcttttgtgttggggttgggggtagcttaattaatttggcagcaaattgaagtttctgacagtagttgtcacatgcattatatatatgctagctaatttgcatgtgctttccatgccgtgcatgattctgtatatataatctcatatatataccatatatggaggagtatatatatatattcaggaagcaatcgatggatcaccccaataacccagatggccagaagccctgcactgttgtcacctcacacgtcgcacttagggttaggaagcatcggaaattttactgtgtcgtttttcaacaattaggctggaagtttgatgaaattttgaagtacaacaatttgtaccagattgtaggggaaaatagttttttctgtg

SEQ ID NO: 77193 - DNA, 11207 bp, Oryza sativa
gtcacgcggttagcgtttggaggcccatcagacgttcagacgatcattgcatgcgcgggctcctctacgccgagggttttggatgtctttggtggtgtagaatcggcgagttgcactgatgcgtttctgctacgtactggttttctgatgctcaaaagcaccgctgcggcaaatgtgatttttgcattataatcagagaaaggagagatgtatgtacgcttcggtttcactggttggatgatacatgcggctgaggtttttttttttttgaacgtacggtatgtggctgagttgctcttccttttctttttccaacacgtccgtacgaacgtttaccaaatctttttttttacggtttttcctcccggttgattctcggattttcatcatccatcaccttgttatccttgttctcaactccgatatcgacatcaacatcaacttgctccatgtttataatggcatggttccaattttctcttactatcccacactcccactccgcgcacgagctgttgccccagtggcctcgaacaacgtaccagctacaatgatttcacggggccaattgacattgattacgtgctacatgctttatcgtcttctctggctgcagtaccatattgctcgtgaacatgaagttgagagaggtggtactctcgtcgtattataaaaacaaatctaatataaattgtgatatattctaatattgtaaatctgaatatatttttactcatatttataatattagaatatataatatttcggttgtagggagtatttggcatggttgtagcgttggtgacctgagtcattgtctgagcgacataaatcatattgcctactttctccgtaaaaaaaaacccaacctaattagagatgtgacattacctagtccaatctggacataggtaatatcctatccctaattagattgggcttttttcttttgtttgaatggagggagtacgcagtataacataccagaccacatgcagtaaaagaaaaatccatcagccatctctttccgtcgcctctgcgttcacccgcaacgaaaggtatgacactgtaaaaaataattagacttcttgttgccttcacctattttaacacatgtgtactttttaagtaattgaaacattgaattagtgagatgtagcaatgggaatatagaccctgtttagatttcttggcaaaattttataccctatcacatcgaatgtatggacacatacattgagtattaaatatagatgaaaaaaataactaattacatagattgcgtgtaaattatgagacaatcttttaagcctaattgcgccatgatttaataatgtggtgctacagtaaatatttgctaatgatagattaattagacttaataaatttatctcgtggtttaagacaaattctgtaatttattttgttattagactatatttaatactttaaatatgtgtctatatatccgatatgacacgccgaaactttacacacatggatctatcacgaagtcatatatgtattcgatacattaggaaagattattggcaggtaacttgtctcatcagtcgttttgatttgggaaagataatatatcttgctactttgtcttcttccaaccgatccatacgcaaaatctatcgtccttgcccaacagcgccaccttggtagtctgctactagctgcgccatgtcttcctcctccgtgcaaacctctccctcgccctcgcatgaagtcgacgccgaaactgacgaggaactctacaagcagttcaccgactcggtgtcctcctggccgagctcagaacccatgcccttcctcccgctctaccgccacgacaaaggctggtacagtagcctcatgcctatggtcggtgcgatggtcgccgacgcgcggttcgccgcgcgcccctccgacatcatcgtcgccaccttgcccaagtccggcacgacgtggatcaaggcgctcctctacgccacggtgcaccggagggagcaccccgccgacgccgccgccgaccaccctttcaactccctcggcccccacgagtgcgtcaacttcctcgagtaccagctctacaccaacaacagagtcccggacctgggcaggctgccggacccgaggctgttcgcgacgcacgtcccgttcacgtcgctgccgagcgccgccgcggcgtcgggctgcaaggtcgtgtacgtgtgccgcgaccccaaggacaacctgatctcgatgtgggacttcgccaacaagttcagggcccgtgaggggcaggagcccatgtcgccggaggccatcgccgagctgttctgcctcggcgtgtcgccgtccgggccgtactgggaccacgtcctcggctactggggcgcgcacgtggcgcgccccgagcaggtcctcttcttcaggtacgaggagatgaagctcgacgccgcggcgcacgtccggaggctggcggagttcgtcggcctgccgttcagcgcggaggaggaggaaggtggcgtggtggacgccatcgtcaggctgtgctcgttcgatcacatgatcggcctggaggcgaccaagagcggcaagacggagctcgtggtcggcacggcggcgaatagctcattcttccgtcgcgggcaggtcggggactgggcgaaccatctttcgccggagattgcacagcggatcgacgccataaccgaggccaggttcaatggttccggtctcaggccaagtggcactaaatgatatatacctgatacctcccgttgaagtgggctaaggtgaaatgcaaccttcaagcttagcgtcagtacgtacttctataatctatttactcccttcgtttctttacctgtacccttacaaattaagcattgactgattccctttgccaataaatctgtaaaaatttactatctctttcatattataaattatttgattttttttattagtcaaagttataagcttatagaaaaaatatactactccctccatctctaaatatttgacgccgttgactttttaaaatatgtttaaccattcgtcttattcaaaaaatttaagcaattattaattctttttctaccaattaattcattgttaaatatactttcatgtatacatatagttttacatatttcacaaaagtttttgaataagacgaacgatcaaacatatttaaaaaagtcaacgacgtcaaatatttagggaatgagggagtactacctttgtcccaaaaatataaatatttttgggtttcgacacggtcttcaaaatacaacgttgtaacaaatataattacgaatgtacaataactatttttagtttggcaaattttgctacaggacatcacaattgtgtggttttagctcaaggacaccgcaaaaacaaatttttagggaaagacactccataaccgtggatatttgccaatggaaaccgcaccgtctaaatgaaacttgtcttgttgacgtggcggtcgggagcccttttttgatgtggtcggaccgaaatacccctgtgccttatctcccttgggggagtagccggtcatggtgaagaacccctcgctggagtagaagatggggcagttcgggcgcatcgcgtcggagatgacgaacgtctgctgcaggctggacagcgcgtccttgagctcctgcaacacccgcggcggcgagtcttacaacgcgcggtggccgctgccgccgtccaccgacgacttgccgctccccatccccgccgtgcctccgctgtcgcgccccgccgccgccaccggatgctatgcctgctgctgttgggcgctgcttccgctagggccctcctcggcgatgatctccaagccggcggcggtggaggtggggaacgccatccacttctctctcgacgtgttgagtgcggctcgacgaatacagcaacggcgcggctcgcagtggctgtgtagcctgatgcgggcagccggcgacgcagcacagcgcaatcgtgcaagagcaacggccggcacgaaggcagacggcttgcagttggcggacgactaggcctgattagcggagaggaccaggggctgcgcgccatgatgagcgacggcgacggttggcgttgacgagtgccgcaatgtgcggcgaggacggcgctgtgattgacgactagccgcgcgtagtgagggacgatagggctgatggtttggacggggttcccgccaccggtgcacatggatgcgtcatgcgtgtggatgaggcaagaacgatgttcctggatctggagttgcttggtgttgctgctgcttggagaagattggaagacggagaggacggctggctacttgactacttcttgttgcttgttggatttggtgaattggatgtgctcgttgttgcttgttgcttgatgcttgaacgcttgaagagcctgccctacaactcgacgatgctatggacgggttggcgatggagacggagcccggggacaccacgaggaggcggcggtggcgattgtctacggcgtcgtcgtctacggtggcggtggtcgtcttctgttgcagccgcgagccgcgctgccgcaccaccaccgtgccggctgcggctccgttttcgcggggcggctgctccaccttcgcgccggccgctgttcctgcacgagtgcgctgcgctacgtcgccggccggccgcccgcatcaggccacacaaccgccgcgagttctcgtaccagcaagttctttcgtcgatggtggtggcgaattgagccaaaacagctccatacgaagagataaggtgcaggggcatttcggtccgaccacgttaaaaaaggctcccgactgccacatcagcacggcaagtttcatttagactccgtgatgtctatcggtaaatatccacaattatggagtgtctttccccaaaagtctgtttttgcagtgtccttgatctaaaaccacacaattgcgatgtcctgtagcaaaatttgccttttagtttttgttgtaactaatagaagtcgaatttggcattgtatatttgtggagtgatatatttcatatattatgttgttaatatttttttaaaaaaaataataaccacttagatgagcaacgaagaacatccccaaagatgaaaatccatatcccgcacaattcgttcattccatttggacttaacaagtccggctgggccagacagccagaggcagtcctgctcacttgctcagtgctcacgagttatcacgactaacagacatgacacgaccatgagaacagaaccacggagcaatacctgctagcctcttcacacattattcaaccagcacatgcgcacgcacgcacgcaccctactacctatacacgctacagaggcaccaccgcaccacgcaacgcatgagtgaccccccccccctcccctcccctcgtttactctggtgggcttggcctggccttcttgaagaccacgacgtgaggcggctggctcgcgcccagccacgcccgcgcgccgtcccttgacacgcccaggtcctggcacgagtccctgcacgacaccagcttgtacccaccgccgtacttctccacgcggaacgcgttctcccgcccgctcgggctcggcccgatcaacggccccgtcaccacgcgccgcgcccccgtgagcggctcgtcgccgacatgccactcggtggactgcacgcagatcgtcgcggcgttgaagcggatgcggacgtcggtcgagacgcggatggtcctgtcctccggcgccgcggcgccgccccacggggtgaagcgcacggggaaccccttgcggcgctcgtccgtctcctgcgccacgaggagcgggcaggggagcacgcggggcgccatcgtgaggccccctccgtggccggggctagccgggaggacgtagtagctcccgtcggcgctcagctcgtggccctccgtgtcgtacaccggcggcggcgcggcgctgcatgagaaggagatggccaggagggagaggagtatgagggggaggcggaggctaaccatggctgaaacccttcgtctcctgctccggctcgtgcacgacgaaacgaggggagtgtgcgagctggtggctcagggctggtatatttgtactgacctgtagtagagtcgctgtttttctcgacttctggatttgcacgtgcgtttggctggtggttagtggtactactcaccactgcgcatgcggtgcctgtctgtaaacaagtagtagtagtacaagctgatttggaaacagcaatgcgaaacgacgatatcacgtacggttcccaatcgtttcgatactagatgggtatcccgcacgttgcttcgggagaattgtgtgataatatagtagatataagttctaaaattttctttattatctattgtatgattttttttcatgtatttatataatttttacctttatcaattatccatagattataaataaatgtctgggttgtatagtgtgcttttttaggggtgtcggtgacatgggaccgggagtatcatgacttagagacttgaggcagacacgatcacccacgtggcctaacccactcggggggaggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggagaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagatgggggatttatttttttcggatccagaacgaccagagagggagagagtaagagctctctggttctccagcttttttgtagcttcttcatacatagatccacaaaaacacaggagtagggtattacgcttctcagcggcccgaacctgtatacatcgcccgtgtcttgtgtgtttcctttctcgcgaaccttccacacacagactaggagcttagaatctcacccagggcccccggccgaaccggcaaaggggggcctgcgcggtctcccggtgaggagccccacgctccgtcatctggcgcgccaggtagggggttctgcgtgtgttcttctaagctctcgcactctttcgtgtgcgccaagcttttcctgttcaacccaatggctgaacaagcaaaggcacacaacctctctccgagtgttagcggtgacgacggggagccaaacccacgccgtcgagctcgtactccaccgccccctccacgccaaagtcctaggcgggaggaggcgctcgaaagggtcgaaggatccgcgacttcgacatccacgggtgatggggaagggcggcgagatggggagcgtcgcctcctcgtctacggcgacggcagcacgccccagggcgcgctcctacgtcacccgcccattgtccctgacccggagtctccagcccaacgttggctggacgacgtggccaacttggtcatgacggcacggcagcgcctaggtgctggtgggcggtcctccgccaccaagacctctggcgctgctaccaccggctccgtatcgtcaaggcggagggcgcggcgagcggcggctgttgctcgccattcggccgccactccttcgtcagcgcctccgacccaggaagatctgcgtggggggccggatgcccgcatcagtatcgagcgccagcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcacatatccgcacccaggtgaagaagcggacttacatgcagtccagcgaagggatgatgagtcacttcgctcatacattcagcggttctgtcaagtccgcaacaccataccatgcatccctgcacacgcggtgatctacgcgttcacggggggtgtgcggcacaaccgcatgctcgaaaagatcgcctccaaagagccccagactaccgcggagctttttcagctcgcggaccgagtggctcgtaaggaagaggcatggacctggaacccctccggttccggtgtggcagcttcggccgcccccggatccgctgctcggacagggcggcgtgacaggaggaagaagaagaggtcagcccattccgacgacgagggtcatgtcctcgccgtcgagggcgcttcgcgggccacccgaaaggggaggcctgcgaccgacaaaaagaaggaggccggcgctcccagtagggagcgcccaaccggcaagtggtgcatcgtccacaacacctcccttcacgacctcacggactgccgcgcagtcaaaagtttggctgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaatgtgaagctggggcgtgtcctcattgatgggggagcagccctcaacatcctttcccccgcagcctttgacgctatcaaggccccggggatggtgctccggccgtcccagccgattatcggtgtgacgccgggtcacacttggccgccaggtcatatcgacctcccggtcaccttcggtggatccgccaacttccgcacggaacgggtgaactttgatgtcgcggacctcagtctgccctacaacgcggtcctagggaggcccgcgttggtgaagttcatggcggcagtccattacgcctacctccagatgaagatgccgggccccggtggccccatctctgtccatggcgacctcaaagtcgcgctcgcttgtatggagcagcgcgcggaccacctcgccgctgcgtccaagcccgagggtggcgacgagaggcttggcacctccgtccccgccgccccgaggcagcggatagtcacgtgcgacgaggtcccggtcaaggaggttgccctgggcgacggcccgtccaagaccacacgaatcggtggtcttctggatggcaaataggaagacgcgctcgtctctttcctgcgggcaaacgctgacgtcttcgcatggagaccggcggatatgcccggggtccccagggaggtgattgagcaccgtctcgccgtgcggtcgggcgcaaggccggtccggcagaaagtacgacggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcatcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccctggagccaaatgaacccttgctactctacttagcggcgaccccgcaagtggttagtgcggctttggttgtggagcgcgatgaggacaatcctcattccgcgcacccccaccctgtgctggcttggcccgggagagagcaaggaggagaggccccc

SEQ ID NO: 77194 - DNA, 677 bp, Oryza sativa
agatggtgcattctccagagtggtgattgaagaaatgaaacactacagttttactgatcaaattcataaaaggaaaggctacaatcaatgtgggccaaacctgaaatgatttactgaaaatctttattcttgatgtactttccctgatagcatactctccttctgatgaccaaacaaactccaatgcagatccaaatgacctattcctccaagccaatgcagtataaattatgaattcaccatctccacaaactacgacaaatcttccattggggttatgctttaagctctgaccaaacaaaaagatgacacatagtaagattgaatactattcaagatatgacaaacaactaacattacctagtagaaagaaaagaaatgttgtagccatctcagtctaatatcacatcaaggaatcacaaggaacacaaaatagaggtagtggttgtgtgaaaactatcaatcaaagcaattaacactaattggacaatgtcacctattgaactacaagttccatatgttctttcactaagcttattagcataaccatttacaagtcatcacaattcacaagctgcaggcatggatgataaccactatatatgctgatgtgagattaatggatgctatttatgcagaagttcaaacacataggttactgcagcagctgcaggaat

SEQ ID NO: 77195 - DNA, 542 bp, Oryza sativa
atccaagctatagtgtttggacccatctacttaaacgtggaacctacagcacttagcatgcatgtgctacacttaaacatttcagctctagcaatgtgcatggtttttataactaactcagtgcctagctaatctagagttaattataatggcatcagcaactagctagggtctttggatcagattgcattgcagaattaatccagagttaatttaatttgccagggtggagggcactgtcaaagtgcttggccaactgaaagctactaagtaggccaaaattcacacttgcagacacacatcatgcataaacattatcttaattactaggagtgaaacctgaaatgcatatgctggagctgaacaaaaaggtagtgtttttatctgaagacttatcaagtactctcccagccaatcaaaactcaccagttgagcacaaagcctttgtggaaaagatgagcaagcatagattagcttagctataccagaaaaaacaggctaagtctcaagtgaaaggcaaagtacagataccaataaagtgg

SEQ ID NO: 77196 - DNA, 1215 bp, Oryza sativa
tgggtaccctattcatggttccactagtatgaatttaggtagatgcttcgctgattaaataggacaacattaggtggttttataactttagactttgggaattctcatatcatttggacattatggaattgttggattatggtggaattggacatacccctctcttcctctttcaaaacccctaaaacctgttttccagtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcctggaggttccggccgtaggtggggttgggtcggtactcttgtttatggctaggatgggttgggaactatgtcacgtctttcgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatctgcttaacaactaaaagaaggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaatgctgtttactgcaaaacttaacccctatattattaccccttgtacccccttgcattaatcatgcatctgccggtgtggcttgctgagtactgtggttgtactcattcttgctcaatctttcccctcttcagtaagagaagctttggagaagttgtcttaggtggagtcctggcttataccccagttgagcgcctgtgaagatggagccgtaggcccgctagtccgctgctgtttatttttgattgccaggcctgaagcgcctttgtaa

SEQ ID NO: 77197 - DNA, 2515 bp, Oryza sativa
gtaggtcgtgctgagtggcctgagcctccgaaagctcaaccatgcgagtcagcactggctgagactcgctgtacggacaagggtacctggcgtctgagtggccagaaggaaggcgtggaagctgccgaaaggcggagcctccgagacggtggctgtagtcatgggccaggcgacgaagcgcagtccaggagaggtcctggtacgcgatctgcagagtgggcctggccacggtgaagtggtgtgggcgaaggccagctccgtgtatacctccacgggggtaaaggtacacagagagctcacagtgagggggaacacggtccacggagtaccccgtgtactcgggacacgagaagccaaggaaacgggagaggtcacgaagctgggcgacgtggtgactctcaccaaacccgtgggaactgaagctggcgttcactgccatctacaattttgaaagagggagaaagatcagtaaccattttagaaacaaactattgaaaataaagaaaacaaaagaaaccttagcttttcgcaagtagttttgaacttagtatccttagggtcgtcctaagcgtcgggtttcgccctagggccaagcctgtgctctgataccatctcttgtcacgccccgaactagtcccgaccggaactagcccgtgacgctccaatttaacctgttaatcgataccagtcccaggaaacagtgctggtatcacagggagacagaatatcacagcaacggaggtctctttattatagagtagaagtacagtcatgttgggctgcggacagatcccgagctcacaactgcattacaaaaggaaagcggaagccaggacttggaccatacaatcacaggcgcgacttgggaactaggccgaaaccctaaaactcatcgtagccggcttgctcctggaagaactcctcatcagcaggatccgcttcatcttcttcagcaactggggggggttatttatatagagcaagggtgagtacgggagtactcagcaagccaggggaaataagtgtttaatgcaggcttcaaggaaaggctgttgtttttgcaattgattttatttgaactcttttctaaaagcaactaagtgagtgcttctcaaacgacacggatgagacagtgcgtctcgtccggtcggggtatgtgcaatgtatcagtctttagatcttgaaacagggctggcacccggccaacagcttttcaaacggccacccgggccaacaacttttcaaacggccacccgggcctagctgatcccgtcagctgctgattttccaaacatcgaacccagtttcacaacagcaatttcacaagcagtagtcaaacaaaactacgctaggaatcacctcacatccgccgatgaccgtgggcacggctgttcgaacagtttgttaacctctgcagagggggtacactttacccacacgacattactaacccggatcacccagcccgtggggatcagccacgtcgggagacctgcaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacactcggtgcgttccccggtccgcggttttggaaattcatttagttcgcaagcaccgacccaggtgtcgggttttccaagtcttttgtaaaactccagttttacccaagttgttactcagatttttaagtttgaaggcgaccgtcgatattcgcacagagtgcacgaatatcgaggcgcaactggtcggttacgaggggacgtagtgtaacaattaacaacggaaggatcaaatgcaacaagttaggtaagtccgccaatctgccttgcagacgggacaacagatttagtgtgatcctatcaatgcataatattttgcaagcaatataattaaatttcaaatataggctcaagatgttcaaaggtggcttgccttgctccagatctggagcttgatcctcgaaatcctcgcactgcgggtcttcgggctccgaaactacacgcgaaacgggataactcaacaaacggcgaaaataaagccctattaatgacctctaagcgtgccactagacagatctcgagatttgggaaattttggaagttgaacggagtcaaacggatttacggttgggaagatattgaatttctaggattattgaatttttgatctaaaggaaaaggatttaattaaatcctttttggaaaagaaaaggaagagggaggagaagtagacttttctcgggcggctagggcgctgcccaagggaaatggagcggaccggccgatctcaa

SEQ ID NO: 77198 - DNA, 2702 bp, Oryza sativa
tttttgattgccaggcctgaagcgcctttgtaataatgtaaatattatcgatataataaagaagtgtcttttatatcatgtttgtgtggtgtaccccggcttttcctgggacggggattaatacactagcgttcgggaaaagcaaattttctcggtcgcgacaaacgggtacttgttatttatagttacttcattcagggctctatagtcgattaccattctctcagagccatcctttttcttaaccagaagcactggggctccccaaggggatgagctaggtcgcacataacctttactctccaactcttcgatttgtcttttgacttctgctaactcattagctgccattcggtagggtctttttgcaattggagctgtgcctggtgccagttctatggcgaactcgatctctcggtctggtggcattcttgttaattcttccggaaatacgtcgggatattcacagactatgggcaccgactccaaggaggtgacttgtaaacaggttaggatagactgacttgcggtaggggtgttaggggtaaagcggacttgctttcctccaggtccttgcaaggtgatggacttttcggcacaatctatctgtcctttgtgcttagccaaccaatccatccctaggatgatgtccaagctttgcgagtctaggactatcggtttggctaggaagtcaacttcctcaattctaaggttaacttccgggcatatttgagttgcccttatattccttccaggggaatgtactatcattggtacacgcaaattttgggttttccaaccatttcttttcacaaaagcttgcgatatgaaagaatgggaagctcccgaatcaaacagaactattgcgggtacggagttgacagagaacatacccatcacaacgtctggagcatcctgggcggtttcagcttggatgtgattcacgcggcctcgaccaatgttgttggaagcacgtgaaccttgtccacttgcctgagagcttggacgagactgagctgccgctggagtaggagttttggcagtgctgccattagcatgtcctgagttggtgttggtaggattctgaggacactgtctaacatagtgacccatctggttgcaccggaaacactgaactgctgacggtccctgcggtgatttgaaagaggtaacactgttaggcgcagtattgccactaggggcatgcttctgtggctgaggtgccggacggtttatctgaggacgaggggcgtagcctggctggtggttagcctgagtgaccgactgatggtattgcatgggttgaccgtagcgagggcgaggtgcgcctcgggaagaatttccctgatggttagacttgcgcttcttgtattcttcggtggcctcttttctggcatcctcaagtagaagtgccttgttgatcatgtgttgaaaggtggggaagtcatgagcaatcaactggagtctcattccaactgcgattcctttcaagaatttcctgatcttcttcttgtctgtgtccacttcctcaggggcgtaccgagccaacttgttgaactgacttaggtactcattgacactgctgttgccttgcttaagtctgttgaattcttctttcttcatgtcaatagtgctttcaggcacgtgagctgcacggaaagccgtagcgaactcatcccaagcaatgttagtgggttcagggtgtgcattgcagtaattctccgaccaatctgcggcaggtcctcttagctggtgagaggcgtagagcgtcttctcaacaggagtacactgcactaagttgagttttctatcaacatctttcaaccaatcgtcagcctcgacgggctcgatggtctgagagaactctggcggacgagacctcagaaagtctgtcagcttggatctgttgttgcccatgtgagggtggccatttccatgcgcattatgctgaaaactggctatggctgtggttagtccttgcaagatttgtgtctgaactgccattaagtgttgcatgttggtttccacatgaggtggggaagggaggcgttcttctccagaattgtgactggcagtgcggtgagagcggtgagactgttccatctctgcatcacgggaaactgtgcgatgcgagcggttgctgcggcggggttgctcaacctctgcgttgcgggaaacagtacggtgcgaactattgctgtggtgtgactgttcattagccgactcatgattttcttctggctcaactctaccatcctcaaaaccaaagcgggctggtgcacgagctgcacggcggggacggctagccatctaaactcccagaagagggcggggtaagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctaacacacggacggctgctgaagactgcctcctctactcctcgtcggcctggctgcctcctgaagtcggctcctcagtcgaagaaacgtcgatcggctggcgcaaaggg

SEQ ID NO: 77199 - DNA, 10863 bp, Oryza sativa
ctattgttctcagagcaactctatgatatgggtgtcgcttcttgaatagtgatctaaatttgttctgtaaatttgatcaagattgacactgctttggagcaaggggtggatgctgtgagaactcttgtgttgaagggttttagtggaagtattgagagattcaatctggttcagaagtacaagttccacagtgtttgagaattattaagaggcttggatatacttgctgaggacgcataaatacgcatcatcaatatcattggaagtgtcggacgtggtactttgcacaatctacgtaagtgcactaagttgcttctgcagtatcctataattttgaggatgctaagaaacttgcagggtgtatataggtagagtacttttgcattctttccttagagcaattttcattagagaggtagttgtgacctctaattttgttcatatgtaagctacttattaagtataagaggtagcatatacaatacaccacctctacactagctttattacactaaccccaataatctaaaagtattttcattttatttgtttgtttaatctactcttctcttttcatatagagcttatgtagagattgccccttgagtgaggggtggctcctcctatccctcttctcttctctccctcacctcatcatgtgagccaacatgcaatcttggggcaagtgcttaggggtttattttaattgctcttaagaacacaaattgtttactcaaattggaagctaaatatgttattttgacaaagtctagaattacttgtcacttctgtaggttaatgacgaagacactttagtgatgtaaaagaggaaagagtctttccttctcctgcttcctaaatctctgattttatcatgcaaataaatgtagctgtctttgttggagtggatcatctgcctgcaaagtgatcgtataggtgtttttattactccggccgtacaactcattttcatcaacttgatgtggtaaagttgtttagtagtctggcatgttatatatagacttatagttatacatgtctatgccctgatgttatcttgtcattaagaaacttaaggagatccttagcaaatctttgataaggacttgatattgaatattgttttctattttcttgtgctgatatgtcagtctgaactcgtgagggtgagtatgggcagaaaattttctttgccatgtaaaagttatctcaacttctcgcatcagttaacctacagtactatctagaataagagtcaagctgatttaaccctctactgttcagggctaatctgtaacttttggtgattaaatgccacctgcagctctcttgcaacctattatctagcttagcttaataaaaaactaggtctagaacattgcgatatgtgataatttaaggaggcgacatctgttaggctttggttaatctattttcaagtgatgacaggatcctctgggtattagagtacatgaagatggtgattataattgtatcaccttctgctttcatgccttgtttccctattctcactttgtttctgcagtcatcctatacttatatctgtgcatgctaatatgctaccaaatgtgcacaaagccacaaaatatactgaaggcagttgtttacctcttaacatggggccatatattttttagtaccatgaaatgcaaacaataatctgatgcgaacatccataacactaaaatcgcatcatattgttttcctttttgtgttttttggtggctggtaccatgagcatgaaaaatatcatttgtttgtcagtttttataaattctatttttttttctgtggtatactttctaacaataagaaaggcagtgagggagcaatgggtgaggagagcatcatatagtagagactgaggatacatggagttgagcaagaaggctaatagtttttctttttttctaaggtggaatgccatgtgggctagctctgtccagcatgcgtgattgttatcatttgatgaggcatttaacacacttatcccacacacttgcagtaagtattttttctgccttaaatggttgcttgattaaatttatggttatgcattgcattgtctggcattgcaagtgtgtgaaagctaaagaaataagcatgcaccccttcaaaaataaaatgcaaaagctgttgggttcttcattcatattcggtgaagagatgcaaatcaaattttaaaaaaatcatcgatgttgagttactattatacattggtccaaaatacccgtgttttagtaacaatttgtaagctgctacttcctccttttaacatttctagatcatcacttaaaatatcttgtgaaagaaccatctagaggtgaatgtctcatgaagtggaaattctatcttatgatgatccaaatgtgttcgtttcttgctggcttaaaaacaaagtgtaacattaacttaatcagttctttttactagtacatcaaagtgaaaatggaaagaactagtccaagtgcagtactacctatgttccagaaaagctagagataacttgtggtgtgatattaccaataaggcaataaccaccaggtgatttgtctaatacatcacaaagatacgatatttgtcaaaggcttagttttgaccttggtttaaagaccaaaaagcattagtctaattacctcacttccactactttctgctaggaaaattccctccgcctaattcttttctaaccaccaagtggattccaaagttttaaagattatattatctaaagctctttcctccaccatcacgttacctaaactacttgctaatccttttcttaaagccatcacagaagtagggtatggagtaatcatacatctaatccatgtgcatccatctgttgatcactcgctcacagaggcgcattagatttaccaagtgtcgtgattgtagctgtatatattagcttaattcacgggctatgctggatccctgttttaaatattttctgctgtgacgattaatcctagtgcttggttaagctttggacattctagattataagattttgttctaggtgtttctttaatccctcattgcataattaagtatactggagaatcacttcacatgactttaagtgaaatccacccaatctcaagtacttatttttatggagtaggtaatgtcacttggcatactagaacatagtttatagtccttgctcacactgcctgggtttattaactagctttgaaacttattcttaaggaagatatcaaacccaattattaagccaaaccattctttaatcccccgtggtggcccaaaaagcacttgtggagaaaataaagagatatggttactaacttgagtgttatatatacacgcatttatatatatatatatttcctaggagcaaaatgggtgaggtcatccaggggattaaactatgtgctaaacttgtcatcatgagcccaaaagaaggattttcctttgagagcacaacttggtgcgggccccttatgggattcgggtgatcttaaatgttgccaactttgtgcttgcaatcaactaacaaaaatgttggggatgtgaccaggagcctttgttgaggcaacacaacaaacaacaaaaacatgggacctagtgtgtctagcttgtaatcaagcggcaagtgacatgcattgtatcttatcagcacccgtcaaggctactgagtggtgttttcctgctgctgtgattaaatgcttaaatgaatggttcacatgtgttaggtgctccatggagtaaggtgccgtgactgccgtctagggaagccttgtgcaagccatacaaggcagtggcaagctttcttatctcctttttatagccttgtttctgagcattattgcagtagctttgtagaagatatttggatcaaaactatattttttctgtttgtataattggatagtcaacttgatagattttattttctagttgcaaataaggctctgtattatattagagaagcaaatatgcataaccagctaagagtgccacaggagaactatacgagagccaagagtgcataatttgtgttttcttttccttgagggttagagaatgtgtagatgaggtgctcagtgcactgcaatgcaaggtggagaccactgtagcagaaaaagctattgacctatgcaacacccaaatgaagttgtcccttgttggataacctctaatctttaattggtgggacactcagatgattcaatgaccttatgcttgtttttggtcataaactaggaaatagtaagtggaacgacaaaaggaaacgggtacatgcattttattccctacattttagataggacataatcaaataaagggagataatattgacatgtacagagatacatgtaggaactcctcttattgtgttcctaaaaccaaacctgtctaaaaccctaaaagaacctgtctaaaaccaaacctggaggttcatgacaataacacaattgttaaactatataaaattatatccagagcttatgtttgaattcaatcctgagataatgctttctagcaccgttttcatattacaatgattacttacacttctgggatcaaatcttaataatttgagtaaagatgaatgtaactgtaatactattttattaactcaacttgcaaaatatgatcaagtgcatctgcatgttatgatcaagtggattttttagttaactatcttgccgagtcatcaaaaacctgaacctcatcatacaatgcatgtgcatttgctggtcgactagaatgcatattagattctttgcaagcataaacaattcatattagtgaaggagaacttgcatattaaaagaaaagaccatgtgctttgctgcaacctgcagtctgcaaggaaagcattttggatggcttgccttccaaccgtccaagcttctttcagacaattcctcctggaataaaacatgttagatattccgaaagtagttggtgtctttatggggtcctagaattgctcatcctataaggaagctcagagtatggaaggacacaggacaagtagatgaggacttttgaagttaaagaagccaaagtttctttatagaacgtagcaacttggctcctctacatttttgtattttgctagaatagtcactagcttgggggatgggttagaatcagtcctaacaagttaacttttactgctctcttcttgttcgatccatacatgggagatgaatatttttggctcaagttctgtcctatgagattggatggttgatcataatgaatatgtattttttttgttccactttaaattattagatacgttacagtcctttaaaatgatattatggtttgtggaactagctacatttcttcagattcatggaaaaagtagttactgtaacttgactaaaacggtgtttgtttggacaaatttattgataactgactattaaaaattagatggttggacaaatggacatatcattgagatcgaacctagctaatatgccttctatgtcaaggcaattggtattcatttcatgtcatctttcccagttgctccctgtagagtgaaggggtctcaaaatcagaagaaggtttgaaatgaaatatgactagatctgactgaaaggaacacttcaaccactctgttttgggtatctgacaggaaaattactgtagtagataagaacccaaacaggtttagtgttcctaataattcaaattggacctgtacaggagtaggatctatctcaattatagcatgcatggtggtcacatgtgtacaactttccttcctcacatcattgcttttctgaaatgtgcatcatattgtgtaatattgttgatgttttttatgctttccatgcattagcttacaggctagaaaacaatcttttctatttttcttctctgtttcaggacagtcatcttaggaattcacgtgaattggtacctcatttggcatattaattacactgttcttcgtaatctagaaacttgaaacgattgagctgctgggttacaagttaatagaattgtttactaggagatcctatacattgattgaattagataggtgattagtctagatcctccaattatttagaaacaaaaactccctcgtccatctgttcaaaaaactgtaatcacaatatgaactcgtgccgtgtaaaataattcacaaagaagcttgcttagtttttgtcggtaaacggtcttgagctcattgtaagccgataattatgcatgatgtgagtaattattggctcttacaggaatattcatgagctttggttattgaatgcttgtctagatatgtagcaccgtttacaaaatggatcaactggggagcaagggaagattcaatgcatgtgatgtttcttatgtagcgtctgctagtctgaattagaatctaggaactgttactagctatgtatatcaaaagtttatcatctatctattacatatatttgttggttagttttgtacagaatattagtttaggttacaggtgtcaatatcaaataaaaggcagctttgttgaaatgaaatgggctatcaggttaactgattcataagaacctatggacgcttattaaatgattctttgactctacatttgttgtggatggaggctgtttagaataaaaaagggtacggacatatatactttatggtcaccaatgcaatcaagtatttgatcaacttgtctaacctgaaacaattaaattaagctgaaggtccatgatctaagcataggtagaaactacagagtaaaaaacgaaatggatcagattaaagccaccttaggtgacagctatataaccaccactcctctatgtgaaactactgataatatattgaagatatcgtcatttctttaataacagcacttgctacctcaaagctcatgttttggtatttgaaagggatagaaagaaaggaactgaggggagctgagtttaggggacagggtgggccttgtttagaagttggagaaagactttagaaagagaggagataagtagggaatttgggagtgaaagatacatagaacctttcttggatggtggaggcgagattatgttagagaaaaaaagatgcagaattctagctttctctggggttagtaggatttggggagatttctttacaaccgggttgaagcaaaagtctaaccaaaaaggttgctgatttgaacttgagacgcaggagattctgggcttgatatacagcccccaattagtttagctgtgtgaaaacacgtactgtattaagataaaaggcaatctctgcgcactagttacaattgtgacttataaaggcttgcacacacacatgatctgatcctcctggatgctgcaaaagttgcaatgtgtatatagtgaatgcatggcaattccttcctccttttgattgtaagtcaaacatgatttcttctaacaaggtagttcaactttacaagtgccagtgacctctcaggagttgtcttttctctacaaatgacgcctatggcaagtacaaagacaagaaaacccaccgcatcagctgagcttttaagtacatgtttttcttgtaagacatgactgatccaatgttcaggtaaaagaattactaaagatgttagtaaagcaaacgtacaagaatatcagatgactgttcttgaagagttgtaggatgatctagcatagcctggtgcttaattactaacctgcaccagcattctactcaattacatcataatactgtggtagtgcataactgtgcaaattatgacatacaaaataagatcgtattctaattgacatggattccgcttcttattttactttatagatcaatttcttgaaattgccttttatatttcgatgatcccagcttccgttgctgattaattcccactcatagtagtacaccaagtggaactcttttcacttgagtagactagcaataattgaacaaatcttaatgcttcattacttaaattaataatgtgaaatgttggggaaaatataactagctaggttggcaaaatatattttccattttatcgtgcctcttttatttccccttttgcaaagtttttcttctgcattgtgttccttttttgtgattaagcttaaatttctgccagataaaaacagatacattccgaacactgggaacataattgcgtcaattcttgtccttgccacttttcctgcaacattgtttattattgtgatggaatatatgtttaatgcttgctgcaagaaaattccaagtgcgtctcaatgtgcgttcctagtgacataaaatgcggtgaggacgaagctgtgcctgcatgtgcgctcatgagctaatcagtgaatattcttatttggttgatcgtatctcaatggtttatagaaagcgattaacaagtttttcgagctgtggagtggtaaattgcatctagatgaaacgaagagaacaaaataacttttttgtgtacgtatatgaagtaaattgaacagataatccctactgtttagagcatgcaactgtgcaaatgcctgttgaaatcaagctagagaaatacagctacaaatctacaagttaagctaaagggttattatttcgaactactctggttgtcggtgatttgagctttgaagttgttgattgcttaccatccgttattaatttgtttgtgcttgttgatttgcttgatacaactatgaattgtaagttgatttaggtgctcgaggaagttgctcctgcggctttaatccgttgaatgacgttggatttcttagcacttgcgcttcttccaattttgtattttattaatcagtttcttggaagagcaataaatgttattctgtcgcctggtggaatcatatatagacccccacttagccgctaatagcgattgactatacaagccatttcatattggcagtattacactgggatctatattctactctgttttttatagccttaaaagaaaacatattgttcataccttttccgtacgcaaacacgaatatacatgcatgctagctagggctgattttatggctagaatatttttatgatgtaggagtacttcattttatttgtgaaagaaaatcatgttgaaagttttcttttcttgacgaatatctatatattgttctgcagagacataatattgattccagggatgggactcaaaggcgattctttgccgaggtcatccatcatcatgataggaattgaaagctatagcccacacaacggaacaaaacggagcaaatacgtacgtacatcagtacatgtacatttcctacgtacgtactactgctatactcttctgcatcatatacatttctacatggagaattttaaaaagcatatagtccaaccccaacacgcatgagcattgcaactttagtttgtactctacacgcgcagatcgaataagttgaacaatcgggtataatttagcttagctaagtggcacccacttaattaattagctctcctgcacatgcatggtccctcactgatctcttatctctttctacatacatcgatcgagccataatacaaggcaaattaagatatttaatacatagacacagttatatataagtacaaaagcgccgtaacaaccaggaacccttgaataaaattatattgtattccgttgcctctcctctacacaacaccgcgactctatcggtataaactatttgcattacgtacacaaaacaacataattgagcatccggctgcatgcatcggtcgatccagctttgattaagaaatgagccctagtacgtattagttggccacagacctaagctacatgcctacaaagatatacatatagtactcatatatatatttatttatatatctaaatatcctatcatgcgtgtgcctctagccccggtagtaattaacaaatcaacgaggaagacgagcacataaaatagtgcaacatggagccgagacaagcgcaatctagacctcgacctgtctcttgtgacctctgtgtgtgtgttgcttctcctgttcatcacaagtactccaactcatactactactaatctctctctctttcctactttgcatcgatcgtccctctccctctaaagtgcaagaggccgggatataatattgtgtacatgctgcatgtattcaaatcattcacctgcctagctatgagctccatgatatatccattctcgcctgtgcaaatcctgcagctccaggtcttatatatactgccccttctcacctgacacagctccaacccatgcacatccatccaacttaatttgacagcaactcactgcagcttagctctctttctctcttagttctcttcttctgtagcaagtaccaccagtgccaagcttctacagtgtgctgctcgctagctactcgtctttgcagccatgagcatgacgagccccaggctaaagctcttcggcttcgacgtctccgaggaggagacggcggagcacgaggagcagtactcggctgagccggagagcgcgccggtctgcgggggcaacggtggcggcggagccgtcggctcggactcgtcctcgtcgtctactacgaccaccacgacggccacggccggcggcgacgggcggaggtacgagtgccagtactgctgccgcgagttcgccaactcgcaggcgctcggcggccaccagaacgcgcacaagaaggagcggcagcagctcaagcgggcgcagctgcaggcggcggccgcggccgccggccgtgtcgcgggcggcgccgccgcgctctacccgcgcgccaacccgatggtctccgccttcgctccgaccccccacctcctcggcggcggcgaggcggggcccaccagctgggtctacttctccccgcgcg

SEQ ID NO: 77200 - DNA, 1026 bp, Oryza sativa
aggaggaaggaaggttatttttaggtttttctttttactaaactttgataattgtttttgttgcttaataattatttccggtgctctgaaaattcaagtaaaatttgagggctccttttaaaccaaggagaatttaacaaaaattctctgggccacattcgaatttttcttgtacgtattttagtgtttgccaatttcttttcgaattttaattaattctattattccttttagaaaataatttttattttgggatgaatttatcaggacgtgacaccgttgccacggattgacgatttattcgatcaacttaaaggagcaagagttttctcaaaaattgacttgaggtcaggttaccaccaattgaaaatcaggtctgaagatatcccgaagaccgctttctcaacgcgttatggtctatatgagttcacagttatgtccttcggactcaccaatgctccagcattcttcatgaacttaatgaacaaaatctttatggaatacctggaccagtttgtcgtggtgttcatcgatgacatcctgatatactccaagagcgaggaggaacatgctgaacacctgaggctgataatggaaaagctcagagatcatcaactattcgctaaattctcgaaatgcgaattctggttagaccgagtagcatttcttggacacgtaatctcctccaacggtgtcgaagtagatcccagcaaggttgaagctgtacttgcttggaacccgcccaagaatgtgtcagagattcgcagcttccttggcttagcgggatattatcgaagattcattgaaggattctctaagctagccagacctatgaccgagctgttaaggaaggaaaagaaatttcaatggtctgcagcctgtgaagacagctttcaagaaatgaagaaaaggttgaccactgccccagttcttaccttgccagatatccaaaagatttcgagatcttctgtgacgcatcaagacaaggcttaggatgtgtcctaatgcaagaacgaaaggttgtgg

SEQ ID NO: 77201 - DNA, 1243 bp, Oryza sativa
ttaggtagtccgccaatctgcctgcagacgggccaacagatttagtgtgatcctatcaatgcataatattttgcaagcaatataattaaatttcaaatataggctcaagatgttcaaaggtggcttgccttgctccagatctggagcttgatcctcgaaatcctcgcactgcgggtcttcgggctccgaaactacacgcgaaacgggacaactcaacaaacggcgaaaataaagccctattaatgacctctaatcgtgccactagacagatctcgagatttgggaaattttggaagttgaacggagtcaaacggatttacggttgggaagatattgaatttctaggattattgaatttttgatctaaaggaaaaggatttaattaaatcctttttggaaaagaaaaggaagagggaggagaagtagacttctctcgggcggctagggcgcggcccaagggaaatggagcggaccggccgatctcaacgggccggccggcccaagacggcccaagcgcgcgcgcgcgggagggaggagagagagtccggtggaccgggctcacctcgtgcggtcccgggtgggacccgcttgtcagcggctcggctcaccgtgcggagggagtttgcggcgtacgcgcgcgggcggggctgggacgcggtgcacgcgcgcggttcgcggaggaacggatgcggcgggcccacgcgcagcctcacggttcaccgcggaccatgcgcacgggggaaagacggagggagcggctggccgggtcggctgatccggtcgcggccaaggtggcaccgacgtggcgcctacgtggcagccacgcgggctggcgggaggtagacgacgacgccggccggaacggacggcggacgacagcggcgagcggcggagcgactcacggtgattcgggcaaaagcgagcacaccgggcggttgcacgggacgaggggagacgagccaacggctcggatttgccgggggttgctcgacggcggcggattgcggcggcggcaaccggcggcgggagaaggggaaaacggcgacgaagctacgaggggtcgattcccggcggtgagagcatctacgcggccacgggaactcgacgctagcgtcggattgggcggaactacgccgagcgaggccggcgacgagcgggtgctacggagctcgggcggcgacggcggcaagcacacggcgagcgacggcaacggtcggggcggcgccggctaactacggggagt

SEQ ID NO: 77202 - DNA, 756 bp, Oryza sativa
taatgggctaggcccaattaaatcctaataaattccattggcccacattaagtgctatgggtaataataccaccttggaaatctaagtgaagaggtctcaacttaaatacggagctagtggagagtctctgttgaccggttgagatggtgcgcaaacaaccaggcggggcgaggcgaggcgaggcagacagcagctgctgctgcactctctcgttttgtaacggacggtaataaacacggagaattgatttcgtatcaataaacacgtcggttacggaattaaacgtcatgaattgattccgtcggatacggaattaaacgccgtgaattgattccgtattaacgagcacgtcggttacgaaattaaacaccgcggttgatgactccgaacgttactctcgcgctcgcatatatatactccacagcaaccagaaggacgaacgaagttcttcacgactcttgcacttcgagttcctcctcctctgttcctgagctgcagaatccttccccggttctgttcacctgcgcgcacagatgtacgggatgagcaggtgcctccggaactccgtccgcttgagaacttgcacgggtaggtgggcgatcaagtttttgggtagcgcttcaagcgcgactgctcttgttcttcgcggctactgctactgcatcggcaccttcaccaagatgtcaacggagattggagacaagaagatgaacaacatcaacggaggcaatactgcctcaaaatccagcggtggg

SEQ ID NO: 77203 - DNA, 555 bp, Oryza sativa
atcatggtacaagatgggctaatagctttatgtcgctgcttcaggcgcaacttctttttttttcttcgataatggaatccaatccggcctctacatcaaagatgtatccggggcaatgtgtgaacggtttgcaccagtgattggatgatccagttcaaatcttctagtcggatcaaggcatggtgaatttggggaaagagatggaattccatcgaaatggatgcatcaaaagatgccgcaggtacagatgagttgggaggcctttgttcctagtaaagctgtgggaagtggctttggatctttcctttatttagcactctggcttttgctttttgtggcactcttttgttcatggtccgcagcagcatacgtgttgatcatttctcaacgcgacagagacattcacaaatggaagaaggcaccatgaatttcatgcaaattcacgctgttggagtatgacatcactggtttttcttccttgtgaggacttgtgagtgacgacttcttagtgagcatgccctgcttgtttgttctgtttattcatcccaagaacat

SEQ ID NO: 77204 - DNA, 830 bp, Oryza sativa
tgctaggtcgatatcttggcaattagtgtgaaatagtccctgacaagcaagtcactaatttctgggccagggcagctagctgaatgtcagcacggtatataccatggagtagtataacgacaagtagtttgttcgcttgatcagatgggccgtgcaccacctaattaaacccgattgagaccagccaggactactgctatctgatttttttacttgactttattcattttttcgatgtgattgccacattcattctatatgattttctagttacccggaacctcctgtccctgaactccggatgtttcgggctgcctgccaggaagttccgggccctgtttaaatttgaccgccgcgattatttttagtgtttttcagttaagcctactcaccctccccccctctctaggttacatcttcagcttttatgtctggcagcggtgagtacggtgtcagtgagcgtggatggctcttcctcctcgccccgactccatgcgactccgggatagtggtaacgttggccatctccttgctctagcggcatagcagggcttgggtcagccttcccctttcgaccatggcacgggagcaagcaggtgctctgcagcagagcaagaggacgaagctgggttgggagggtgaggtggtgcggcggtggagataggggcaggtacgtacttttatcgctatttctctctccatttcctcctaatataataaaataataccgcaggtgtccagcaaataattaccttttttttgcggtgtcctctagcagaaacacgttcttgtggtatcctctagcaaagagagccattgagtgttgagta

SEQ ID NO: 77205 - DNA, 627 bp, Oryza sativa
catctaaaatcccttatattttgcgatggagggagtacatgcttgttctaaaatttaagcaaccttaaatatagagccatatacgtataagcatttggatttcaaatatattaattgaaggaatgaataacctgaaaattctttttcgcatcaatccatgctagatttgttccatcattcaaattgattcttaaatttcatcacatgttcaactttttactcacctgcctgagaagtgtgaatttctgctgccgtgaccttcactctatgtagggggtgaaaacggtacggaaatggacggaaaccatctttatcgttttcgttttcattttttttttcggaatcggaattggaaaccctggttacgaaaatggaatcgaatattatcgaaaccgaaaacggagcgaaaacgaactggcgcgaatacggtaacgaaaatttatcggaataaaaaacccctcaaactgataaatccaattgaataaattatctatgtttaaaagagtaaggttgttgataaatcctaatgcaggacaaaaaaatattcttatgtaattttagatttgcataacaaatatttttttaaaaaaaataatagccaaacacaatagtattcactatttagtg

SEQ ID NO: 77206 - DNA, 1845 bp, Oryza sativa
atatcctcttcgccaagaccctggatgatatgcagatccctcgctccgagttaaaaccaagcaatgcgccttttcacggagtgattccaggattatccgcaactccactcggccagatcaccctcccggtcacttttggcacgcgggaaaactttcgcacagagaatatcagctttgaagtcgccgacttcgagacagcataccatgccatactcggacgcccggcgttagccaagttcatggccgtcccgcactacacttacatgatgatgaagatgcctggtccccgaggagtcctatccctacggagtgacatcaagcaagccgtcacatgcgacaaggagagttgcgacatggctcaaacccgcgagatgacgtctgcccgagaggatatccgactggctgcagccacggcgagcgaaggagaaatacctgctaccaagacttcaaaaagtggagaaagcgaagccaagactaagaagattcccctagatccctctgatcctactaaaactgctgtaataggcgccgagttagattgtaaataggaaagcgcgctcatcacctttcttcagaacaataaagatatctttgcatggaaaccatctgatatgcccggtattcctagagaggtgattgagcattccttacatgtcaaagaagatgccaagcctatcaaacaacgactccgccgatttgcacaagacaggaaagacgcgatcaaggaggaattaaccaagctgttagcagcaggcttcatcaaagaagtccttcatcccgactggctggcaaacccggttctagttcggaagaaaacagggcaatggcgcatgtgtgttgattatactgacctcaacaagtcctgtcctaaagatccttttgggttgcctcgcattgaccaggtagtcgactcgaccgccggctgtgagcttctcagtttattggattgctactcggggtatcatcagatccgactgaaggaatccgactgcttgaagacttcattcatcacgccttttggggcatactgctacgtcaccatgccgttcggactaaaaaacgcaggagcaacttatcaacgtatgatccaaagatgcttctcaacgcagatcgaccgcaacgttgaagcctatgtggatgatgtagtcgtcaagaccaagcaaaaggatgatttgatctcggatctagaagaaacctttgcgagcatccgtgctttcaggatgaaattgaatcctgaaaagtgcaccttcggagtaccgtcagggaagctgcttggctttatggtgtctcataggggcatccaagccaacccggagaaagttactgctatcctcaacatgaaaccgccaagtacccagaaagatgttcagaagctgactggatgcatggcggcgctcagccgatttgtttcacgacttggcgagcgggggatacccttctttaagctgctgaagaaaacagataacttccagtggggacccgaagcacagaaggccttcgaagattttaagaaactcctcaccgagccaccaatcttagcctcaccacacccgcaggagccgttgttgctgtatgtatcagccacctcccaggttgtgagcacagtcttggtcgttgaacgcgaggaagaaggccatgtccaaaaagtccaacgaccgatttattttgtcagcgaggtcctaaccgactccaaaacgaggtaccctcaggttcagaagctgttatatggtattctaattactaccaggaagctatctcactactttcaaggtcactcggtaacggtggtcacatctttgccactcggtgatatactgcacaaccgtgaagcaagggctgcaggaa

SEQ ID NO: 77207 - DNA, 2804 bp, Oryza sativa
cgtaaagacaataagaacactgaaattagtataactagttgataccccgtgctttgccgcgggatatgtaggtgaatacattttatatattatagaaatgtgtggagattatggatatcccatatctacacggcgatactatttgggctggacataggataccgaatatgtatagaatatcttatttgtatctcgggtttgtttcttaacttgtacaacaaggaaacaccttgagacttagttggttacgactgtattttgtctgtgtttgcatattccgttagggatatgtattctcttttgtaatacggactccttcccatatatataaggggggtctaggtgcctctaggggcaggggttgaattttctccaaatcatacaatcaataacacactcggcggattcatccccggacaggagtagggtattacttcttttataagaaggcctgaacctgtataaatcctttgtctccaaacccatacactttcctagcttgatagccacccccttttattattgtcgaaatctagtttcgacagttggcgcgccaggtaggggttgcgtcaagcttttcgccgatcagtgcaatgggttccgtctccggcatcgacgacctcgtcttccctcccgggcagacgtttcggttcggcagcctcgacttcatcaccaacaacttcggcaagatttctctcctcgactcggaatcagaccagtcgggagagaaccggatttcggtcccgtttggattcccgaacgcggctgaaagctacttcaagaccatctcaaccgagccggcttcaaaccactcggccgagatcgcatcttctccaacgacaccagatcaagatgatggggcttacccaccagtcctgatgaagctccccgacgatttagcggccgtctccaccatgacagcgtcttcatcccgtaggcctaggcggaagtcggcttcaacaccgatttcgcctagcttcagggaagtcggcgtcatcctccaaccactcggcacggtttcgacggatcagctggatgactacaacagctctcccaccgtcgactcacgtcctactgacattgtggagtacgacgaatttagttctcgctacaacgacttcgacgacttcgacgacttcgacggaagcctagatgacaactacacccctctctactttggcgttttcatggccaataatgagacggaggagcaacgccaagcccgggagaccgaagaacgtcgccgactggaggaggagcatcaagcacaagaacaagaacggctacggtgtgagcagcaggaccgtgagcggaccgcgaaggaggctgaggatcgacgtcagcgagctttggaagcagggcgccgagtgcgtgatctcatcggccagcaagatgtcgaagggacaccggtcttccgcacccctcaacagaatgcggttgccgcgatcacccttctcgacaccctcctcaaccaaaacgagctcaatcgatccgaccacgtcgtcaacatcttgaaccagactaagaccatgattgcggcttcggtcctagttaactccgaaagcgtccacacgccgactggcagccgagttccccacttccgatctcatgactaccgtcatccaagcctcagcatcaccgccgcaggatccaaccgcaggagcaggggtcacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcgccggaccgccacgacgacgaccttgacggagtagcagccttcaccgacgacctgcgtcgagtggattggccagccggcttcaagccgactggaatagagaagtacgacggtaccactaaccccgaatcgtggcttaccgtctacggtctcgcaatccgcgcagcaggaggagacagcaaagccatggcgaactatttaccagtggctttagcggattccgcccgatcttggctccatggattgccccgtggtacaattggatcttgggccgaactacgcgaccacttcatcgccaacttccaaggtaccttcgagcgtcccggcacacaatacgacctctacaacgttattcagaagtccggagaatcccttcgagattacatccggcgattttctgaacaacgtaacaagatctccgacatcaccgacgacgttatcatcgccgcgtttaccaaagggattcgccacgaagaattggtcggcaagttcgggcgtaagccccccaggacagtcaagcttatgtttgaaaaagccaacgagtacgccaaagctgaagacgccgtcaccgcatcaaagcagttgggtcccagttggaagcaaaacaagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaattcgcggatcaatacaccaagactgcacggaagaactctgacgaagaacaaagcacgtcgaggaagaaggacgacggcgacaccccggcaggttttcaagatcaccgcaaggagctcaatcatatcttcggcggccccctggcttacgagtctaaacggaagcagaagttgactgaacgggagggg

SEQ ID NO: 77208 - DNA, 9299 bp, Oryza sativa
tgggtaagtcgttggcgaagtcacaaggccctccacttttcattttaaaaccgataaacgagaaaaagatggattgttttgcgaaagaatctttggacccataaaaagcagattttgtgcttgtggaaattctcgagcgagcggagctgaaaacggagatgaaagattttgccaaaaatgcggaatagaatttgttgattctcggatacaaagatatcaaatgggatgcgtcaaactcacattagtttctaatgcaaccatttcatggatcatttacccaaaatatgtactccctctggttctatattaattgacgttttggacaagattgagattaaacttttataactttgaccatcaataactttaaaaatatttagtttaaagaaactagaaaaacatatatagatttgtctttcaaaacactataataaaaataaacatgtatttatttattgtatatattataatagaaaaataaggtcaaagatatatcttgtagagcgtgtcattatccaaagcgtcaattaaaatgaaaccggagggagtataaaatataaattattgaacactgttccaattccaattttcctaggcttgggctgggccaggaaaaaggcagtgggcctctggctggaaagcaaatttttttttaaaaaaaaaggatggatgggctgcttggcttgggaaaagattcagcccaagaagaagaacagggaatttagaactttacagaatttcagattggagattgatttggaatgtgcaattgaattcaatatttgatctgaggattgcgtttagaatcctatatttggactgtatatggagataaagatccagaagaacacacagaaaaaagattttttttaattacatattttgaatttaaagtttccgaaaaagacaaaactgtgttaaattgctcttccaattcgcgtctcctgcctcatatatgccctggcctctggtttggtgggtagggtcaaattcctctcgagaggtcacacttttgacatttcaataattcctgaaaagtcatcttctagcactgcaatgtgaaagctgttttacgtgctatccttttgctttgctttttgtttgttaaactacttagcattgaaggccacattttgacttattttagtctgtctacactcctttttttttccccttaaacgctactccttcgtccaaaaaaaaaaaaaaacccaaccttggtaaggatgggacgtaacctatgacaacgaatctgaacaaattcgttatcctaggtaatgtcccatcctcatcaagattggacggagggagtacaagtgagagccaaagtagcactgatggaaaatgttagtcaattctgtttcacataatatagcacatagaaactactatgggaagcacctgatgcctggtgccacgaatattacgcgcacacacgagtgcgttttgactagttatattccagtacagtacatggcatttgactagtttacatatgatgaaagaacaaaagaacaaaaaaaaaagaataatgcaaaatcgctattggctgtggcatttccatagatatagaaaaatgccaaattttcaccactgcggcatccatcagcccagcacaaacctctcatcttttcagataaggaagatcaaattacatctctggcctgtgcatcataacagcctctttctctatctagcataacaatttacaaatggaataagttggttgatacaaagttctttttttttcttttcatagcgatgatcgtgtagtcgtgtctgatgatgtggatgggtcagtggtggcaaaggatctcatcaggagagactgtggatcaattggtctctgctggctgctacctctcaggtctcccaggtcaccaacaacagagggcttggtgatcctttctgtgttgacatccttctctccggtcagcatctggacgatgttgatcatgttgggacggagtttcatcgcatcttgagtgcatagtagtccaaccttcaagaaccggcatgcctcctcgacatccacatcatcttctatatctgcatctatgatctcctctaaatgcccttgctcataacatgtccatgtctgcaagagcaccggcaaacctttacaggttagtctggagtccggacgtcaatgcataaacataataattgtcagtattctttagtatggtattatggtagagcttaccctctcaagcagaaattgttcttcataaggcaacctagaattatagttgcatctgccgctgacaatttccaagatcaaaacaccgaaactgtagatatctgacttcttagtcacttgtcctctgagtgctattcaggagctaggtaccctctgataaaataaaaggacagagtaagacaacatggggaatatctatgcaggaatttccaaaagaccccctaaacacagttaaacttacattgttcctgcaactcgggtgctcacatgagtcgcatttggtgggaggagcctggccaacccaaaatcagatattttgggggtcatatccttgtcgagaagaatattgcttgcctttatgtcccggtgtattatgtgaggacgaacttcttcgtgaagaaatgcaagcccacgggcaacacctacagtgattttgacacgagctctccaattgaattggatgttgctacggcctgaccctgcattgccatgtgagtgaggttactgttaaagagtgtcttgattaagcaaggacagactaggtagaccagtatgttacctagtagtgtatgttgaaggctgttgttctcaagataattgtatacaaggatcctatgagacccttcagcacagcagccgactaacgtaattaggttttcatgcatcacatcggaaattgctgtcagttcattaatgaactcacggacgccttgccttgaagtagcagagagcacctttactgcaactattgtcccatctctgagccttccctgatcaaccaaaatgaattttaagcaagtgaggtcgatgtaatatagaatggatattagacttagttgaagcgaccaaaggctttggtacattaccctgaacacagaaccgaagccgccctcaccaatcttgttcgccccactaaaatcatgtgtagctcttctcagctcattgtaagaaaaaatcctgaccgctttttctcctgaaaccgccagaaacaagttgcaagtcaacaaatgtatcagaatgaggagcattctgtatacagaagagactatagaactaaatgaagacatgcccaccttgttcaccttcactagtttgttttgtatcattcccaaacataaagcagcaagccatttttgcaaatcaaacagaggaagtgccttctgctgaatatctgcagaagaaagaggaacatcaaaacggttttttttttttttggtgatgaggaacaaccagtcagagactcagagttactgtaataagtagtctcatgtcacaaccattgttgtgtaaacaaatatatgtccgtttaccagtaccacttgaccatgaaaacaaattggttgaccacacaataagaaactggcatcagcattagtaatataaaattctttagttagtgagttctacactatctaatcaacttgctgcatcactagtttactgcattaaagtatgtccagtggagtacagggaaaaaaacataatggtgaaaccagtcaatgcaattcatcggcgcacccaaccgacatcacaccaccaagtgaagggtcagaccctcctccacaccctgcgtggcagccaaacaaagggagcaatttacaaatcaattccagcaattgccacagctggcaaaatttatatctatttcaaagtcaaaggggattggatccagttgacaggcacaaggtgggcactccttcagatccataccgaacaaatgtgtatatttctcatcaaagcacacgttgtactaatctgaatcttatcagacccatataccgaaaatacagagtgagcttttctgaaagttgcagtttctttctttttctcttaacattgcaagaagtactccattcatttcaggcaatcactcaatcagggggagaacaccgagttaaatggttcatacttcctgttacttatccattaataactctgtactaatctgaatcttatcagacccatgtactgaaaatacagagtgagtttttttttctgaaagttacagtttttttttccttaacattgcaagaattactcccattcgtttcaggcaattactcaatcagggggtaaacaccgagttaaatggttcatactgcatgctactaatccactaatcatgtttctaaggtgaaaaatcattttatacatccagcattccagctcctacgcaacttgagcgtttgcagaacaatcaccgaccaaaaattcagcaaaaatggcaaaacagcacacaataatgattcaagaatcaagattacttcaaaccctttttttccccctgaggccgacaaattctgcggagagaacccaagaaacgaaaccccgacgggaggcgaattcaatccgaatcacaaagccaggcagcctcaaacacagattctcgaacaaacagaggactgcatcagcatcaatggtggtcgtcagagatcatccccgcagcaacaaacagagagacccgcattcttccaccgagatgctatataaaaagattcgatctcgaaccaactaggtcgccccttttctcatcccactaactaaaaattcgcggatgccaagaaatagaaacccaaccacaccctctcaaatcaagaagaatcacctggcgtctccgtcggcgcgccgcccgccaccacccctctaatgccgacgctgcccgcgcggcgcacgcactggctgcctcagcggaggaggcaagaggaggaggaggaggaggaggtcggcgagagggcgtggcgacgttggtgagctccgcgagtcatccagctatagtggggtactggggtgtgggtgtgtaggcaatggttgacttttactcctctgccggtctcctcccctatgagtctctctctctctctctctctcttttggatagtgactttctctctctagcaaatgggagcccatcagcagttgtaatccgtagttcttttcgctcgtacaaattttatctccatctttgttagcgcgttttttaaattgcttagcgcccctttaaattaaagtattttatgtacgaattttataggattcagattttatagaaatttttgctatatggtcatttgattaaaagatttaagctttccgaatcatatgaaatttatcgatatcgtttccgtaaaattaatatgataataatatttttactgatggttacccttttaaaatttagtttttccaatttatgtctgcatggcattggtaaatatggaaatttcccaaccatttttgtctgttttaaaaaattataaaataatgataccgtttgtgaccatttccgaccgtttttaccctaaaaattcatatgaaatggctcattgtatatagattttagagaaaacttagtaaaagcttaaatctcttggaaaattttctttggatctatctctctcatacgcttccatgtgtgttttcctatgtttttacaattctctattttacacttggattcctattctgtgtttttttctattactccatttttccaatgctatgattcaaaggagctcttaatggtacggaaacattttagatagacgctacttcaaaaatattagataaactaatttttcaagtttaaaataattaaatttaattacttatgtactaatagttttctcgttttatgtactaatagttttctcgttttatgtgtctgtatttaatcctaatatttagtgtactcaaacgggcctaatactagtgataaaaaatggttggattagggtattttcgcgcgtggccgacgtgtaattatcacgtggccatagggcagatcacagatggttgctgcaaattaaaacaagaataatgacagttaagaaaatacgggtatgatgaatgggagcatatagtattataggcttcaggttgtttgtcttttgtggactgtgatcgatgataggagtagtattatactgtatcccatattgctgaacttttgtatgtgatccatgtagcacacaagggcaaataggagggtcgacagtaacgtggtctcatgacttcattccaagttgttttgtacttttgaagattttaatctcttcgaagttgcagaggccaaaacttgttgcatttttatatataattaacaccatttattttttttgctttacgcaagttgctgttaaaacctgtaataagtttggcctgtagaggctggagtgcttctttgatgcgatcttgtgtttcgaaaaaattggtttggggttacacatatcttataggtaaaaactaggttatctagctttttttggcaatactccctccgttttaggttataagacgttttgatttgatcaaagtcaagtttgaccacatttatagaaaaaaatagcaatattttcgacacaagattaatttattataaaaatatatctaattattaatttaataaaactaatttgataatgtaaatattactacatttgtctataaacttagttaaacttgaagtaatttgattttgactatcctgtaacctaaaacgaagagtgtatattataatacgtccatttgaagtatggacgattatttgagaggttctcaccgtattgcaagatttatatccacgaaataaacaactgtccaaaatccaagaagatatatggggacattgtgattctagaggactaggggcttctttggatcgaatggcttccgcgtgcaatcctagccttgtcattttctttttggcgattgtaagaatttgccaattttaacattcaaccaaaagacaattaatgaataatttggcaatgtcaatttttctttacaaaccaaacagatgtggcattatcaatcattttggcgtggctgagtttggttacaaaccaaacaagccctagaattaattatcttctttcatgtaaagactttctaaagatcactcatgtgtatatatatatacacagtatatttctactaggttctggcgtcctgccatctttctcatgaggtgatacattcacttattcaccaatagatcaatcattttatcatttccccctaatatagggaatgtgaaaataaatatgcacatgcatcaacagagcgtagtcatgttggggccctgatttccctcgtattgaattgtccaactgtcggagtcatagaagaagtcatataagaaaatgactgtagagaaaaagaaagtcttctctcctcacgtccaccctaggattttcttttgaacgcattataatttcttctgatttttttaaaaataaaactaattcatatgaaaatcccaatcgaattctataaagttattgcgtttgattgaaggcctaagatcatgtgagtacaattccagtcttgagattgggaatcacatcactggtgtagcagtggcaggggacgctggcatgcaccccaccagcttgggttcgacccttgtcgagcgcgctcaccaggggaaatatttacctctcttaaaatcattgactcaagttcttccttgggtccaaccttattttttttcacatcactagtgtacaaaactgggaatcacatacaagatctctccttgactcctttattggtccatagcaaaatttaactctgtttctttctatctcattttcttttccctctttttatgaaaattttagaagggagcattttatctttccttgtttaacgtttatgattgtacttcacttgtaatcatacacatgcgatgcacgttatggcaatatatgttatgaaatataaaaccgatgcaagatatttgaaaatcatatgcaaatccactacttattatccaaaagactttacaatacaagtcataatcgaaagacttacaaactaatacaaaccattggaaaatcatgctagaaatcatatacagtaacattaacattaaaatttacatgtagttccggcgacttgggataaattcggaaaccaatagaaacctagtactcccttcgtctagttttgatagtcatatttcatcttggcacgcagaccaaggataagtgattctacttatcatccttttaaacatgctactagtcattactcgtaaacatgcgattcattaatatttacatttctcgatgcccatgtagccaatcttgtgtggaagaaaggagagtcacacattaaatacaagaaagtcattaagatgataagttgttggattgaaatatgcctatcaaaaataaatttttcatatttggaaatatgactatcaaaagtagatggagggagtatcaattattgcctttcgttcttcattgcaagactaattgaggggttgatctgatgggcatgtgattacgcacatcgcgagcacgcggtgaaaaagacaaaacagtgtacgtgcgattgcaaattttctctcttgcttggaccttgagcagattcgtagtattagaatatatcacattcgtagtattagatttgtaggttagatttttatggaatggtgggaggatgttttctcctagtcggcatttgagcccacgaacagagtgcgggcaatcaaaagaattatagacatagactttatagataaaatatttatacataaaactttatacaccgatattttatacttgcatagagacttttatacgtataaactttgaatatactaaattcccgtgtataaatttgttagcagatattcggcaaaatgaaaatcaatactaaaatagttcttgaaccacacactgaaacactcctaaaaataattaattaccgtggagggaattggatataaaaaatgcagaggaatagataacaaaccttaaacatgctaagaataatttattcatgtatccatcgaacattgacggcacctttgtcagctaactcagttggtgagaatagtgccgcgaccacatcaccagctctaaagggtcttgatcatcatgacagcataaatctctactactaaaagacaacataaaaacattaaccgccacaataatttgacaatatgcctaattacaaagcttagtcctagatgggtctaagcttttgcgttgtcaattccaatgcctttgtcgtagcctagctagttactccctccgtttcataatataaatcattctagcattttccacatttatattga

SEQ ID NO: 77209 - DNA, 14296 bp, Oryza sativa
catttagcaggtcctttagcctgccaaagcagaccagtgcaagtgaaaggagtgctggatggcctaggaagaagcctggtagaccgagcgagccgagtaatactgatcacttgtccaactttagacaagacgctcctttgtgcgactgtgctcgaagagagctggacaggaagtaccgtattccagaccatccgaaattgggagatgacagggaccgtgagagtgccatggatatccctaacccatcttgacagtatcaaatttacatgtaagtaagatcacatcaagacgttcgatcaaatggggaaaaaatacaattctgatggaatttttgcttacgttgtttgacagtgttacatcgaggcataatgagacgagtttattcaagtggacacatcaacttgtgatggttagtatgtacctagctagacctacttcccagctactagtatgtgatctctgatcaactgctgactttgaccagctcttaatttagcaagcaactagctagcacaattggaatactaaacctgtctcgttctagctagtttatttaattgctgggttttcagctggaagaatgaactccccattgttttcaaggtaatttaatgtagctaattaattatgtagtggtagtttttttgtttagtctgatactgtgtcaacatctgttatctgcacaataatctccaatagtagcaactttaagacaagatatttgtcatgtcaagatctgcctactgttcatgcaagcatccgtacgtcgtctcaccctcaaaatatattttagcagtatcgaaagggaaagagaagttcatatatgtattattaccagtttattagttaattaattagcctttttttactaaccgattggaataatgcagatgtcagatgaaagcgatactccaatacatatccattattcccatataatctcatcctttcagagaatcatatacatgcagtacatgaattaagtatgtaaagcatcgaactcggtggaattgttccgacaacgactaggcatgcatgcagtgcacctaatcatcagaacccaacaaacaattgctgcatgcttttttcaccatcatcatgcatgcatatatacttgcacggctgcaatgatatctagctaactagtgagacaaagtacaattagtagtactagtaacaactagtcaaaccaagtaggattagtactagtaactaatttctaattagagtaaagtacatggctggtctttaaagttggagcgaggcgtcacttaggtatatgatcttgaaaaatcaacattaggatctgcgatcttatttaagtgactcattaagatccaaaggacctctgaccgggctaatcactggctccgatagtcgtctaacttagggaggactagtggacgaagaggtcctcgccgccgttgtccgaacccgttggtggcgtcaaaccccttcatcgtccccttcaccctctccgacaccatctcgcccttgccaccgcaagttgaaccctccaaaatcctagaagccgcccgccgccccactctgcaggccagccgccgccactacccttctcgcccttcccgctccccttcacctggggcgacctcgactcggccaactccgagtactcgaggtggcctgcccagcgcttgcaggtcctgctgcggccgccacaagcaacggcgagaagggctggccgccatcccttgcccttctccccctggtcgccgcccttcaccctctttgcgcatgctcgccaacccgccgctgtacccgcctccctcctcatcatcattgtcatcgtcactgccgccgtcgcgtctccactgcaacccaaattgcccgtgcaaccgcaaaccatagaaatcacaatgaaagaagagttggggaataagggttggatcggatgcagggggcaaaatgcaaatatgctaccactctggacggccacgtaagccagtcaacccggttagaggtcctttagacctcaatgagtcacttaaacaagatcacggatcctaatgtcgatttttcaagatcatgtgtgtcgaatatgtgtacgtagtcggttacagtttaggacttggagttgtactaggtataggactagagtaagagttggactctgtcctaggatctctcataaatagaggggcgtgcctgttgtaaccgcatggcgacatagcatagcgagagggagcggctgccggcggcgacctgccgtgagtcgttgtaactctgatacgttgtaatatgctggatcggggaggagcgcccgtaatcggtgccccagagatgtaggcctcggttgaactccgttatcaaatatcgtgcatcggtgtcgtcatcgtgtttggatcttctatggtgtttcttccacgtttggtttccgatatgatttcggggccggttttataacatcatgaacctaagtgacaactcgctccaactttaaggaccggtcgtgtactttactattccaattacctacattaactccttacaacctgatactacattagaattttgtgacctttctaaaatttcgccatttagcatgtatatggaaataattatatgtatgtgcgtaaatttttttttccaatatgcatgcatgagatttatgtgtcattcaatcaaacattgagctaatgtttggagtagatccaaatatatacgtgaatatatattcttttgtcttttagattacacgaaagacacatacgcacacaccacacccactagccttgatcccggccgtacccacgagtaaatccttaacacacactttaattatctgataattaagctcgagtagcaacaccgtaacaaggcctttatttccaatagtacatggttactcccctgtactaaaatataaatatttctacaactcataatttgtaccacaaagtatttttggcatttattttattaatgcatagaaattcatatatttttggacaatcaggtacttgggaatagaatctaagcaattcaaaattcgaccattgaggcgactgaaagagaggttttttttcttaatctttgtattttgctaaacaacaataaaaaagaaatacttatattttaggataaagagtagctataatccatcatttgctctacgactaacaagccatggaaaaaaatgtcgcaattaacaaaaaaaatatttagacaaaaaacttttatacatgtgttgttagcgaattaaaagttaatattgaaaaataaactataataaaaaaactctcaaaatcaactccaataataatttcctaaatttaaattttaactacgactaataagccaataagaaagctgtaggtaaaattaagatagcatctccatccatccatccatccatccatatcgatctgtcttgtcccatctcgtcgatgtctcacatctgctcatctcatcatctttcatctcatctcatctcatctcatgtgcaagtgcagccaataatgggagccaataagcactaggagttggtttcagataaaagacgaggcccctttcgtccagtatttaataatctcagcaccagcattgccggggccctcgacggcgaccggccgtcgatgtcccggccgtcggcggccgatcgggcggccacggcggcaacacgccgcccgccgggcacgtgacatgccacgtgaagagagggccggccggccggcggtcagtttccggccggtgtcgccgtcgccgtcgtcgtcgtttatcttgcgagataagatgagtacgtcgttgatcgatcgagtagtggtgatcaatgttgaagctaaagctttggaaaaaaagagttaattaaattaattaattaattaattaattaattaattaattaattaattatgtgcgtgattagacttctgtgagtgctgaccagctaataatgcatgattcctgctgatctctcttttattggcatatgtatgttaggacagaagtggtaattaattagatggcttaatcacacatactcccaaaaggtctccaaacgaggctgcaccagagagagagcagagacgatcctccttgcagatggatcccataaccatcgagatcggcgaaagcaaaaatcgaaaaccctagcattccgctccttccaaagctgctaggacattagaaggaccaacgagtcaaaacccttgcgaagatgcgcaggcatgcaggcaaactttagctgtcggccaccagacctaaatagaatcgccacgggtgagggagataggatgcaatgccagacttggcaaacgaacaaacagtcgagcaggatatagctcgctgtttcaagctcctgagtgcagaaggggcaagccaagtggttgtcaatgccgcgtttatgcagaagatctgtcatccagcaacactgctggaacgcaagccaaaggaaaatcttgcacttgacaggacccttagcctaccaaagcagatcgacacaagggaaaaagtgatgccccacgaagaaggtgtggtaaggtgaggcgggggagtaacgctagttgcttgtccagcgccagacaagacaatcctcagtgctcggagtgagatggacgagttgcaccgcatcccatactaacagaaattgggagatgacggggactgtgagggggccacagatgtgacccacccaagagttgtcaacaagagcggaggctaccgtgtgcgtcgcctagaggcgagggggtagctaggatgagatccagagccagggatatcacagagcggccctgaatccactggtccaaccataagagggtcgactcgccatcactcagcatgaggaaggtggaagccacaaacatgtcaaagacggtccgctcaaggggtgacttgaggtcggctcagtaggggtggatagagcgcagaagccagagccagcgcatgcggagagcgaaaaccgccgtccgcaagtccgagatgcccaggctaccgacgactttagggcggctgacattcgtccaagacacaaggcaacgctcaccctgaaccgaatctgtccccgactacaggaaagcacagcgcttcttatcaaaggccttgatgacccaggttggtagtccgattgccatggagacatggatcggaatagaacaaagcatggactgtataagcacataacggctggctaagttggtgagctgacccttccatgaagggaggcgatgggagaacttgtccaccagaggttgcatgtctatattacaccaattcatgagaatatttgcacatggaacacgcgttttatgatagttgtcatgctcttttttaaaaaaaaagaataaatgatacttttatatatttttttagatttttacatgattcttggtatttttattaattgactgtcaataaccaacttttgacttagtggagcggcaaagggacaaggatgcaaatagtgtaacggagagagagagaatgacatttctcgagtgtctgaaaagggatatatatcaacaagttccacaccaaccatagaaaattttctgccatttcatttggcgacaaatttgactataacaatttattacttgtttgtcgacatgctccatatatatataacgacctatttaattaagaccagaaaattgtgccaccaatttaaattaatatccacctcaataaatgtggtacgtgcggtataaattcagctctatcaataatgcacaacatgcatgtctttttcccctatcttttgcactactatgacgtccaaattaacctctgccgcaaacatttttgctgctaaaaattattgatgatatatatatcgttcccatcgaatttccgatggatatgatatatcgatatcgagcagttgggccgagttgatctgatggcatgataaagagagaggcttgcagcgaactgaactgaactgaatactgatatgatccgagagagacgacgacgattaaataccgtattccggacggcacggcacggcacgctccccaaacaagcgtatactacacatgtacgcatacatacgcattgcgtatgggtgtgtttagttcacgctaaaattgaaagtttggttgaatttagaacgatgtgacggaaaagattttggaactaaactcggcctatatatacaaagtaacatttagacatatatatgtttaatcatttgttttatttaaagttttgtgctaataaaaaatgcacaagtcataaaagtgtctttataatatagtaaaacggaccacaacaaaataaataataattatgtaatttttttagtgagatgaatggtcaaatgtatgtgtaaaaatcaacgacgtatagtttattaaaaacagatggtgtatgtaatagtttacaacattgtacatatgaataattaattaattagtacgcatgcatatcaatctgcatctgcgtgccgcaggattttcagtacaaatttgctatatacatataagtatctatatgtagatcccaattgcagcttaactagttgaatttatatattcatgtacatatacaaccacctcaaatttagttcagttgattaattgtagttaaccccttgctgtgccaaggcagctattttagttggtctatactaggctggttggatgagagtatacagcttcttgaatcattcaattgtctctcgtaggctggttctcatgtactaattatattgttctctcctataggttaatgaaagctctggaattctcctaaaagaaaatttaaggtgtgactgagtaatatccatactatttcaatttcaacttttaattaggtggttttacgatcggtgaagatgcatgcatctccacgtacgcataaggctccatctgtttgatctggccaacactacctaattttgacaagaacaggtatagcgcagtttacttcattcctagctggtgactttatcttcttttgttacttctctttatttcttactatatttagtattcaccagcactttctgtcatttgcttttcagcttgtaagtcgcggccaaaatctaaatattaaaactaattttttgagttgattttggaatcttttttagcttagtttatttttaagcattgacttttaaattacataaaataaatataaaatttttgttcacaaattatttttttagcttatatataacatttttttggcttatcagctagaaacaaaacgatcatgcgaggaaccgaaatatattaattggtatgtatgtgaggaattgaaatatgttgttttttcatcttgattattaatatagtaaaaataatataattgtgtaaattaataaataatcatgtagaaaaaaaataagaacttggtagttcatttattagaataaaaaaagaagacataggcgtccaaagtcgtcaagtacaagtgtactcaaacttgtgcgtggacacgtgaggataatgtacaattcaactcccctcgagcttgaaaggtcataatgtgaataaaatatatatcttcatttttttacgagaatatatattcatttcgaaggatgatttagaacaattaattgttccttatcagaatatttgaaattttatactatatagattgactagctctttattaattatggccagctccatcgatcacacaccccttcagctaaccgatctatgcttactattcttccacccaaatctaatcttaatgtagctataggccatagcttgaccaatctatatgcatgcatgtgttgcggccctcacgcattagtagccaaaattgtaatgataatatggaatcttgtactctctgtctgttctaaaatatactctctccacgccgaaatataagaatctagaattggagagaacatattctaatactgtaaatttagactagacagacttcttagcaagattcgtacatatacttgtatatacgtgtcccatctgatatatatattttaggatggaggtagtagtaaattttaatctttgacaccaatagtaagaagagtagtaaaacaaattggttgccttgttgggatgagtgaggtatagatccagattaattagggctataatataaccatgcggtagtgtgggtagtttaatagtacaagttttttaataatggaatttattttgatctttgctttaccttttgcaagtattaactaaggtgttattttagaacaaattttgaattttaaattgttgttatatttttagggcagatgaattatatatctttagagaaaaagaggaaaatatgtactacctccgtcctaaaatataagtattagagttagacacggttactaagaaagtatgtaaaaagaaattgtggaagattatcattggttgagaagtggagattggtgaggaaattgaatggtggagggttgtgattggttgagaatagaatgttggtggagaaattgttatattttgaaacaaattctaaaggctaaagttgttatattttaggacggagggagtactatatcatagtcattaatgattaggacatattattaagagagaatccactcagtgccattgagttttcactacttctacaatataccactgactttgtcaagttgaataatatgccatcgtgttttcccgaacgtctactgcgtgccatcacagtccagaagctgttagttgggcatctgttagagctgtaaaaagacctatttgcccctaactcattgtacatgtttttttttttgccgagggacatatgtattatatgaatacatatagagaaactgattgaatcatataacagcctatgattgctagcttcacgcgttggtagagacgtagtgaactagtgatctgttgactttgaaatgggacatatcggaaaaaaataaatgtacataatgaaaaaaaaaatcaaccccatacagttagatataaaacaagtttgaacatggtgcatggcactgagctcatatagatatagaaatgaataccaaaatattttactaaaacaggtgctagggtttattagtcatgggcattttagtcattaagaaaaaattcaatacaccaaacggatgcaccctaacggcttgtggacggcgatggcacgcagtagacgtttgggaaaactcgatggcatattattcaatttgacaaagtcagtggtatattgtagaagtggtagaaactcagtggcactgagtggattctctctattattaattaccatcatgtaaaatataaaaatggattgtgacatacgcacattccattctgacctgactgagctatagctactaattaacagctccagctcatgcaatgcaatgcaatgcaaccctgaaacaacaagcaatatatattgaaaaccatttagaccggtttatatattcagcaacagaatcgtactagtagcatataattagctcacatccaaatccttaatccgtaagcacactcccaaattaaacccggcaagttgcatattatccatgaaaaacccatcagttgctattgctatatactagcctctagctctagttgaccggcgagagtagtattaataccgctaccacgcgtagccgccgagctcgccattagcttgctattctctcttcttcttcttcttcttcttcttcttcttcttcttcttcttggtgtgattgaggtggaggaggagatgagtttcataggcatggtggaggcgagaatgccgccggggttcaggttccacccgagggacgacgagctggtgctggactacctcctgcacaagctcgccgccggcggccggggaggaggggtgtacggcggcggcggcggcgtcgccatcgtcgacgtcgacctcaacaagtgcgagccatgggaccttccaggtttgtatatgcttatatgcgttttgatcgatcgattgattattgattttcttggagaaagaaagagggggggaaggaatattttcttgtgttgggatgttgttggttgattcgtttcgagaaagaagatttaaattccattattggtattgttgattggtccctgttcttaggtttttgggggtaattattggtggtgtttgtttggttcgtgttgtttatctagcttctttctgggaaatggaatcttttccttcacatgacatttgtcattttgaagaaaaaaaagagatggactctttccgaagaaaaagatggcaaaaaattgtaagatttggttttttatcttcaaaagttggaaataaagaagaatttccatcaaagtgaagcagagtggcttctcacaggttttgaagaaaatgatgaaaaaggtaacacaaaagtggcctctcacagattttgatgaaaaaagatgataaaattgtaacagaaaagaatttctcatgtattttaaattgaagagaagagataaaaaattgaaaatgatgaataaaatcatatattttgaattgaagatacgagataaaagaaaaatgaaatgatgaataaaatcatatattttgaattgaagagaagagataaattaaaaatgaaaatgatgaataaaacataaacacagattcagattttgatgaaaaagatggaacaaaacataagaagagataaattaaaaatgaaaatgatgaataaaacataaacacagattcagattttgatgaaaaagatggaataaaacataacacgaagatttatacttcaatgaaacaaaaaataaaatggcgtcgcccggactcgaaccggagaccttcagtgtgttagactgacgtgataaccaactacaccacgacaccgagctgttcaatcatctcctcttcccaattcgatcttcgtctgatgagttcatgatcatcttctcttgtcttttccaatcgatctttcaattctctgccgccattgtttgcagacgcggcgtgcgtgggaggcaaggagtggtacttcttcagcctccgcgaccgcaagtacgccaccggccaccgcaccaaccgcgccacccgctccggctactggaaggccaccggcaaggaccgctccatcacccgccgctcctccatctcctccggcgagccctcctcctccgccgccgccgccgccgtcggcatgcgcaagacgctcgtcttctaccgcggccgcgcccccaagggccgcaagaccgagtgggtcatgcacgagttccggctcgaaccgcagcctctccacctcaaggtgaagacagattctgaatttcttcttctctcttcttctgtttttcttttttttttgttgttgttcttcgttcggattgcgtggatccgacaagatcagagcacgccgttttcgtgttcatgttcggaggaagaagattgatgctgagttttcttttttttttctgaagaaaaaaagatgatgctgagttttattaaaatgataggggcgaaatgaaaagattggttgctgtttgctacagttagaatacctgtcaaagaactcactgtcagattatacatgttcagaaagctctgttacaaataggggggaaaaatcagcttttagggaaaaaaaatgatgctgagtttcttttctttttctgttttgttttcacacactatcatgaattttattaaaagatagggggaaatgaaaagattgattggttgctgtagatgtttctgtttgctacagtgagaatgcctgtcaaagaattcactgtcagattatacatgttcagaaagctctgttacaaatagaaaaaaaaacagcttttaggggaaaaaagatgatgctgagtttcttttcttttttctgttttgttttcacaaactgtcatgaactttattaaaagatagggggaaatgaaaagattgattggttgctgtagatgtttctgtttgctacagtgagaatacctgtctcactgtcagattatacatgtttagaaagctctgttacaaatagaaaaaaaaatcagcttttaggggaaaaaattagactttttttattgtcatgttgctacctccagtgagctcatcatcatctgttgtgtcatcatatgcgtgttgccgtcacctaccatggcaattggcaaagcctgaattttgtaacaatatggtctctaactgttcgttttcaggctaactcgatgcttctctcaacattctttcctgataaactagctgcaagttgccagggctctagttttagttggatgaccctacaaaaagtttagtcttcttttgatccagtccatagttgttcagctggctccatcagattactgagctagattaatgtcataaacattccctccaaaaggatttgactgtcttatcgtggttgtttactccaagttgacacttaaaacattcaggcttccatgattgctaactcatcaagcaactatataacttgccaacaatgatttcctcatgcaacttgctgcagagtctgttatgttggttgcatcagcattatccatcgtgctaataagttaatgaaatttgaagtcttcttgtccttaaccactacatatgacctgaaaatgatttgattctctacagaataatgttcagttacagttattacttattacaattttaacctttcatagatcatttgcacttaataccatgttaaacatgaacatcacctaattacacgaaaacaaaatacaggaggactgggtgctatgcagggtgttctacaagaccagacaaacaattccaagcccatcatctgaagaggccgtcacactgcccaatgagctagacctgcctgccacgccttcgctcccgcccctcatcgatgcctacatcgccttcgatagcgcaccgacgacgacgccatcgatggtcgggagctacgagcaagtgtcctgcttctccggcctgccggcattgccaatgaagggctccatcagctttggggacctgctggccatggacacctctgcagagaagaaggccatcagggtactgcacaacagcaacactgcaaagctggagctctccccagattggggacaggagagtggcctgtcacagatgtggaacccccaataatgatcttgatcttgatattgatattgatattgatattgatattgatattgatgatgtttgtgttgctacttgctagatagcgattactactgaatgcagtgtggcaaataacttgtaaagaggtgacatattctttcctctgctggagtagtagctgtgcatacattttgtatttgattggaaaatttgattaggggtgtgacatacacagtagagtagtgaaaatggcttggtgtagaatctgtacataggattgcagaaaagggttatccctttctctttactctctagatgtatttgtcattgcagatgaataaagatttcagagacaggcattgtgtggataaaccattcaacaccatttgacttccatttactgttccatttccattttttgtgggcttgaccatttgttgtgggcctttagtgcaaacaagctaataataatgtatggtctgtttggctggggaaaagatttggcctaggaaaaagaacagggaatttataattttactgaatttcagattagagattggtgtgggatgtataattgaactttatatttgttttgaggattgggattagaattttagatttgaactggactaagattaagatccatgtaacaccaaaagaatcacttttttaaaattacatactccgattttaattcaggttcattgcaacagcacactaactctgcagccacaaaattatggtgcaccatgtgcctgcagaaggtttatgtttgacaaccttcaagtcatcgattcaagctgtgtgttcttgggagtgttcttgagtgctcatcatctgttttgtcaacctgcacatttcagtgacccaccatgacgatttgcaagcctgaatttgatttctaactgttcctgttgcctgaaatgatcttcaggctaacgatgcttctctgaacattctttcctgataaactacctgcaagttgccagggctctctagttgcatgacctagaaaaaatactcttgttttgatccataccagagtttttgatccattctagagttgttcagatggctccatcagattactgaagtagtagattaatgtcgtaaacattccctcgaaaaggatgtgattgtccaagagtatttgtttactccaagttgccacttaaacattcaggtttctatgattgccaacttttcaagttgttgagttgtgatccaaatttatttacacttaataaaggccagcttctgccgtagcggagcgaaggctgaagttggcccattgggctgtgcgcctggggatgcccgggggtgc

SEQ ID NO: 77210 - DNA, 4448 bp, Oryza sativa
ttcaaattgtcagctggcagtaccttcaacctccttcaaggctgagtccctttccgcagccagttctaccttgtctcttttcaaggcttcaatttgtttctccatctgagccattctggtggcttgcactgtttgaaatccaaatgtttgaggatacagttatgacagcataaatcaatggaatagatctggaaggttaccttttgatgaaccacttagctcgaagtttgaatcctggagctgggcaattcggtcccttaactccttctctgtctttttagcatactccttggcctcatgcagctggtccctaacttcttcaagagttcccaaatgaggaaccagcttttccaaagttgtagtcttggcctcattgcgaagatggattctctgcatgatggatcatggttcagttctgctaaagagagaacaaagttattaaagacagtcacccggaagatttacattcacaatgcgagtggcttctccaagtgctttcttcagctggcacacttcctcatcttctttttgacgatttataacgatgccggcaacttgcgagttctcgtcccaccatttgagcaagataggaggacgggagtcatcagccgcctttatgcgaggaattgtttcttcgtcatcgcctagtgttcctgatgtatttccaagacattagacgagtaagctgaagttatttaaatcggcatcacttgagaagatgtgttacctgaggatgttcctggctgaacatgaggtggtccttgttctttatttagagacccaatcattgagtctttaccagcctctggtccttgggaagttgtcgtttgcgcttcaacttcagggatttcttcatcgggacctacatccgactggtttccagtcgggggctctctggttgttgcagtttcagttgttgccgactggtttccagtcggcggctggtccctcggattggccttgtcatccgaagcatgggcgccagtcggctgactttcggcagtcgactggctttcagcagtcggctcagcatccttggatatatttggttctgtcacagctggatcaggatctttcccggttggatctatgtcggatggtttcctgcaaagtgttctctcgatattcagcgtaatctctatgagagaagcatgtcaaagggagatggcaccgagaagtttttacctggaggatgttctaatctttggcatttgacggccagccagtttcttcttgggcatgctacgctttgggagtttgtgaggcgagcccttgtccccagatttgtcgccgtcgtcaccttcgtcgtcatttagcaccagttttctcttgcgagaacctgtctgcccagtcggttgggaagtttgaggttgcggatctggtctgatcgctggccctccacctccctggacggtgtgctggcgaggcgatcggcgctgagtgactggggggtcagacttcatcaaagtatattcctaaatgagatgcttccacagttatccaactcaacatggagatgaaattatgttttgaccttgggttgaagattttcagatacatacctgcggaggcggattgaatgcattatatggcacaactggcagctggtgtgagtagctaacgacaatggcattttagaagattttatacattctctccttcatgattttgaaatccagagagtctggttcttcacggttgggatcatgcttgccgtcgaactcgaatgctgtacgagatctttctttgattggcgccagtcggcatttaatgaaatgccgagtaatctgctctccttgcaagccttgttctttgagttttaacatgcggtccatcaactccaaggcttggactgcttcatctccgattggaagagagttccaggtatcttggtacatcggaggaagacaagagtactcgggaagagcaggctcaggattctgaacatagaaccagtttgcatgccaccctttgtttgaagtcttgaagggcatggaaaaatacttttggctcagagttcccctcagctggaatcctgcctccccgactacgcacggtttgctcttgttcggttggggtttgaggaagaagatccggcgaaacagggcaaagtgaggcttgattcccaaaaaggcttcacaaacatggacgaaattggcgatatgcactatggaatttgggtttaggtgatgcaagctgattccatagaagttcaagatcccgcggaaaaatttcgaggtcggaagagcgaagccgccgtagaaaaaatgcgagaagaccacaatctcatgtgtatcgggggtcggaaaaatctcaccgcacgctggccgccacccgatgatctccttagcagggagaacgccgtgcgccaccatttccttcaggttctcttccgttacgtcggacggcgcccattggccttcaaagctttctttctcctccgccatcgattttacccgaatgcgttgatttgattcgagggatggccggggagaagtgagggattgaggcggtggatcacgggaaggattttgatgcacttttcgaaggtgaatttgagtggagtggtgaaccctagttcgccggcgcggttctgcactgtagcaaggagtggggaaaatggcgagagttccggcggggaagacgaagcgtcgcttggatctcgggatttcttgttaagggtatcggaggtgcaaatgggcctaggcctgaacagtacttcagcccaatacttttaacagcgtggcccattgtgttccttagggacttaggcatattttgctttggcaatattatgcgcacaatagtgttgcccaatgctgataaaatcctttttatgcggtcatataattctttggaattattgcaatgcaaattaaaaggtgcccgacagaaaggtgttatactgctttttgttagctttattaggctacaaaagctgtctgggttaatttggaatgacttgtttttatcatagtcgcttccttggtatgttatatacctattttcattatggtaaatagtcatagcctaggctattagacttactcattaccataatttttataatacttggtgggtaatctttagagttttatattcggatgcctgtccagtgtgttcattcgtgaaccttttagagtgtaaaccactcggatttcttttattatggctaaaaagcagtcggctagaatgcctctttaggcgccgcgtgtgcttttgtcatatgatgcatgattgtgctattatattgttctcaactatatgtttagtttgttaactaatcacatagttgggggctacacctaattaggtgcgtctattcaatgcaccatactctttatcttttcgccctttacagtcttcgtcttcgctactcggcaggccttggcatgaataatttgaagcactcggattgctatctttgagaaggctatggtggttgactgcaaaggtctcgggggctactgtggagattatggatatcccatatctacacggcgatactatttgggctggacataggataccgaatatgtatagaatatcttatttgtatctcgggtttgtttcttaacttgtacaacaaggaaacaccttgagacttagttggttacgactgtattttgtctgtgtttgcatattccgttagggatatgtattctcttttgtaatacggactccttcccatatatataaggggggtctaggtgcctctaggggcaggggttgaattttctccaaatcatacaatcaataacacactcggcggattcatccccggacaggagtagggtattacttcttttataagaaggcctgaacctgtataaatcctttgtctccaaacccatacactttcctagcttgatagccacccccttttattattgtcgaaatctagtttcgacaaaatggtatgtgtatatgttaaaataatgtaaaaatgatatggagataatgatttagcattacttgcatattatttacatgatatttaatatattctagataataattgctagtgggtggtgatgtggtacacttatatgtgatttaaaatactctaaataataattgctagtgggtgatgatgtggcatacttgcatattgagctttaggagttagtggacaccaactttatagtaagataggatgtgtacagatccaaacacagtaccaaatccaagggtgaattttgtgaggtacctttcaggatgatacaactgttataggtataacagaggggtaaaaagtttgtaaacattaccataagataatcgtaggcccctttggtttatgctttttgaaatttttaaaacatcatggaaagttaactaatatctctgaaaatcctactgtcggtgacatgggaccgggagtatcgtgactagaggcttgggcagccgcgctcacccacgtggcctgatcccctcggggggggagg

SEQ ID NO: 77211 - DNA, 2092 bp, Oryza sativa
  unsure (1)..(2092): unsure at all n locations
gttgaaggttggctggacttcaaattcgtcaaactatatgggggtttgtcattcgggttgagctcagacttcttgtgcaaccttggtcgacaggcttgttgttatagctccttacatttaatgatgaactccgtgaaaatcctgtgctgagtccggcgaatcaaattgtacggctcagcaaaaatcctctgtattgtgccgtttccgtggtggcagccgaagaatattaccatcctgtcaagcggagtgcacgcccaatgagacccaaggaagcagtcgtcgcggtaatgccggaactccctatcaacttgcttctttctatactgctcggatatatcaaaaaagatgctcctttagttcagttaatcctccttttaaaaggatagctctttgctttcagcttctgtcttctggcaatgtactgggtttattaatttattccatataatctctgttcttgcttaatgaagtgattgtgtgatctcaagaacacaaaaaatcctcccaaaaaatggttccaatgacgagtgggcccagaagacttggtagtcgtagataacgaaacccttggtccgtgagcgtgacacgcagcagttgaaggctgagaccggagacggagacggagagagacgacccgagcagagcagagcagagcttcccctcgactcgatcctcttcctccctagggtttccgctcctcctcgatcccgtctcgccgccgaagtgcccctccccttcctccccccacccccacccccacccccgccgtnaatgcgtggcggcggtttcggtacgtcctcgcgatcttcaatcgcccgccgatgcatttatcgcctctctcgcctcgtcttcttttttttatgggacagtcagtcgaaacattcttgcttgcgtggactcgcgcattggaggagatttgggcattggaacctcaagcgttaggttcttgatccgaggcctctcctgtgctgtgcaaatcccgtagaatttcactctttttaacatcatgttcaggtttggatcctgcaagttgcaggctgacggggggtgctattattgccatgtctacgtcatccttatctgataaatccgtaactctaatcctgttgttgtaatgattaatccgtagaccggatcccattttccgcgtttataatagctctggttgtgttttgcttggtgcggatgccacatccatcgcttagtaattcaaatgtttaatagcttgatgttctcagttcatttataatgcgtcccatgattttaagcctgcatttttcataagcagttcattaaaaatatgatttttatcgtgcatcctcttttgcagttaacgaaatgaggcatactggcaaacgccttcagcaacacagggaccatgacagagaagaaaggagggaccaaaagaggaggccagtgccacgtgcccaggaaaactctggtaatgatgaattggttgtttaccgcatactctgtccggacagagtaataggtaatgtaattggcaagaacggcaaggtgataaactctatccgacaacagacgagtgctaaagtcaaggttgtcgaccctcaccctggtgcagacaagagggttattttggtatattgttttgtcaagcatagaaacctagatgttaatgacgacgatgacagggagcctgtttgcacagcacaagatgcattactcaaggtacatgatgcaattgttgatgctctgtccatcactagggactctgatgatgaagaagcaaatatccttgtaccagctagtcaatctgcaagtgtcataggaaagtctggtgctgtcatcaagaggcttcggtcaacttcgaaagcatttattaaagtgagcccaaaagatccaaatgaagttacacattcatgtgctatgagctttgataattttgttcaggtaatttctcacatcttttacttttcttaatttaaatcatttgccaacataataggagattaacaattattgaacagtttgaggatattgagcagcatatttgcagtaatttccttgactttcatacgacttgtaataatatcatcatatatattctttgtttgtgagtgaccatgca

SEQ ID NO: 77212 - DNA, 2554 bp, Oryza sativa
catatgccatctataattgtttgaagatactaatcttttaactaaagttcttaggttgagaagagaatcatgcatgttaggtgttcctttttcgcctcccggaaagagtgaaaaattcctgctaagatgtcaccatagagcttaaatacatgaattcttattcctcccttcctcctgtacgtgcccaacccttgtcatttcgtgtatggcatcgtttcaaggtcttcattgtcatcgatgatggggatgttgggcctggtgtcaactgcaccaaggatgcccccaccgcatcgccttcgatgtccgctgtggttatatgaaatgggtgagatgcttcaatcactattcgatgatatattctacttaaattttacgttagttgccgatggtaatgtgtgcaagatctgatcggcacaatggtcggccgctcacatagaagatttgtttgccaggtttgaggagagcgactatgtacaactcataggccacagctcaagaacaatggttatgccgattttcaccaatcatgtattgatggtgttattgctgtctttaagctagtgttcaattagttttcttgctatccatgaagctatgatttgtaattcatggttgttcggcctgcacactttgtagtaatcggctttaacttctttgaagaaaagactatgatgatttccataatctaaaaaagacttcaatttggcacctattgaaaattttaacaagatttattactacctccgttccaaaatataacaacttttagctatgaatctgaacacacaattgtctagattcgtagctagaaatagttatattttggatggagggagtacctaccatatcctacccatgtacattggatacacataagctaggagtagtaacatatgtatcctcctacttgtgatttacttatgtgttagaaaaggctgttctctggcccaatttggaacaaataattagtcggaatattctagtaaattatttacatgattattgatataaattactccctacgatacatcccaagctatgaatctggttgaaatgattatattttgggacatatgtagtaagatattttcataaataaacttaaaaaataatttggaacaaaggaactaagcaatgcggtagaactcaccaattttttttggaaaaacatatttttagagttgtagagcagataatccacaacaacaacataataaagtagctgaaaagaacatggccttagcttgtttctagataatgggtaatgaacataaccgattagcatgaaaacaatactagaaaatgaacgcgccaataacaaaattttatacagtgaatcatgttaaatgctgttattttagacatatgctgtgggttctttagaaattagtttaattattttagacatatgttaagtgtcaagcatgagccgaaaacctccaatgttctgttataaaaatctagcagtgtcatagttaactcttatcgctaaaagaaataacttatgagttatatttttatatatgattctatgatgctgccttctatttatcatgggtgagcgatgccatataaccgaggcttctcgcaccattacccatggggcaggaccgcaggagcttttcgagaagcctcggctttatttcggactgtttttttttttcaaatagtttttttttcttctctgcattttttttctcgtagatatttcagttttatcttcaaagattaaggtgatacgtgaaccaataggctggtcaggaatcagccagcccgagaataattgatatgcggagagaaagcgaaatagatagtttagattaaccgaatgaatctaacaagtagatcatcaaagaccactcattcctagatgatagttctgagctcgatgagaaagcttcgggattcgggaatgatcatatcaaggctgctgcaaggaaagttgaagaactggcatgtattcatcctctaaccataaagtttgaggaaatccaaattcctcaatgttttcatctgtcctaattctcgatgcctccctttccgattggaactaatacctagattcattgtagaactcctagttctcaatcctcctggataatttctcaatgaattccgaagaaatggttagtttgttggtctaaaacatggacacatagtctaagaagttataatctaggaaggtgcattcctatttgctatgagtagtgcttgctgtatttagctagcctagaaggactttatatattactccatccgtttcaaaatatttgacaccgttgactttttagtacgtgtttgaccattcatcttattcaaaaaaatttaagtaattatttattcttttcatatcatttgattcattattaaatatattttcatgtacacatatagttttacatatttcacaaatttttttaataagacgaacggtcaaacatgctaaaaagttaacggtgttaaacattttgaaacggagggggtacaattactaagggaaatgaatcataaaacaaaacaattttaccctatccttgatagtaaaaaggacttg

SEQ ID NO: 77213 - DNA, 602 bp, Oryza sativa
acatcatataatcttacataagagttcaaaagagtacatgtagacatcatataagcagcagaaggaatattgagatatcgtatgtctaaaaacgtgaagcaaataatccgtggtaataatacggtgaataaagttgtaaagaacagaacggttggctgtaggcaatgtaacgacacgtctgaaattcagaggccgccatcatattcagatataagtatccggaaggactttaaggtgtacatacctatatcagatgcagagtaatatcacatgtgcttggaaggaccaatttgttagcaatttagcatgaaccgtgcagctcgaattcatgctggttcacatgagtagccaaaatttttttgtacattagtgacttctacctcaattttgaatgtattgtacagcagaaaactctctctccccctccctctctttcaatttctttcatggtttcacatctccatggcgtcctgcgccatattctgcaaatcctcttcggttaagagagtcttgttgccgccgctccccgtcttatcgtaaggctgcgccatcctccgtaggaactgttatacaagatggtaataccagatgttagaatatat

SEQ ID NO: 77214 - DNA, 10233 bp, Oryza sativa
tgggggttagttttaacatgtttggtaacaaatatgttcttatgcaaaaaaagaactacgataacaaggaggcagtaaatattggtgtcaaactaaaggaaagatcatttgcctgcaaaaatcttgaagtggtgaatattagatgctctaaagatgatggaagagtccatatgttagcagaactctttggtgctaatgggttacctcttgagaagatttttgttcgccgaacaggcagcacctgtgagtaattctttctgatgtccttatgttcctttttacccatgtatttgcagtctttatgttactcgattacagtcttctagatctaagatattatgttccttacaagctaaaaagaaaatggccttgtttcgatgttgtaattatgcttaaattggtagatacaagcaagaacttaaatctcaaaattttctttgctctaataaatgtgctatgtgtgttgaaaaaagaaataaataaatgtgctatgttattccatctctatatatctgttccttgttgtgacaatctaaaacataagccgttggcttttacatgtttcttgcagaccttcgtaacatgaaaaaaatgagaaaaattgccagggatgagctgcgaaaagctaggtggttccagctgttaaatctataaacactacgtaagcaacaaaattacttgtcttttactttttgttaaaatgctttctgatgactgcaaaacatttttcttaatagattctaaggacctgatggccaacaaagttagacttcaagcacactgattactcgtccaaagttgtgatcgagcttacctcggcccaagaaatgttacaaaataactatgcgattatttaggtaaattttagtttctttcctcgatctgcacatttcttccacttgggcatcaacctttgatgggcatgtgttgtgctgtgtgctgatgcttgaacaaagtttgttttagtcagaagtttctcatgctcctctgggcatgatgaaaccgtgactgccaattgtaagcagctagcttcaggcagtgctacagaatggttggttttacttgtgtgtcatgcttgagcttgcattgtttgcgtaacatccctagattggtttcacctgaaatgagcttcatcatgtactgtatggcatctgctgatgagcaggtccgaaacacggatgttacagtgttagttggtaggctattattaaagttttctttgtttctagtttcactctgtcaacaagtatagattggaaaagtctgttcttctttgctctgattgtttttcttgtgtatatttgttaatgaaactgggcagtatattatagctgaggggagggggaaagagattaggtttataactgaggttattattattagattgtttgtacggagtgcctaactagggagttctttatgcaactttcagtttttacttataccaaatggataatgttcgagatagcgatttcatcaattaattgagctcgtcatcttttccaactaaaaattataggaacggtaagcaatcacaatattcattcaatctccctgatgaacattcttaaatatatctaaatagtagcacaatataaacttcagctctcaatcaagctagcctatcccgaagaaagctttctgagaacattgctgaagagatggccctcttgaatgttgatagcacatactccgctaattcatcacctcctgttcttcttgatcacaaccacttagtttttttttcccaatatcctgtttctatcaagttctctttctaaataaatagatgtggggaccttttattatgtattcccctgaactatgcagaaccatcaaattatatagcatttacaatgaatgaagtgtcaagctggtgatcatagccatggagtaaatattagatggctcttgctaagattgtgttgggagtttggccaccagagctgaacaaagatcacaaagctagttcatgcactatcggtccaccaccaagcatctgctgcaacagaatcacatgtcctactttgttatctccagttgaacggtaaaagaaaacctgctctattttggccagcctaaattgaacatgaattcccattgcctgtcattcctactgatttttttttactgcctagttagatcatggttccttacactgtctttcatttgcttccatgatcctgcattctatatatcatgggtgagcgatggccgatgggtacgtgcaatgtatggtatgtcgtcaaaaatgtgaagtagcacaccaaccatctgaaagggtttggaggtagagtaaagtcacttgtaaaatgtaattcaatacttactataacaacattgtatttatagccataaataaccagatggttcatgatatttctgacagatccaagtaaaggtagttcagagtgatttctggacaaactaagagaaactagttagtggttggtggtaaaatccagactctaaacagaaaattgtgatacaaacttccagttatttttcttcctttcttcactttgttgttccaatcctaataagagataattgcaaaatttatttttttttgttggtagcagttgcctaaccaccagctaagcaggagcacaccacacacttgtacatccaaatatgtgatctaagtcaatgatgaatactcctggttaactgtttcagctctatttcgtcatcttcgcatatagtcatatactcctgtgtcatgagtctgtcatgtttgatttaatcttgcacaaattatatggttacacctgaatcacgattctttgcggtgtatgcacccaactataattgtttgaatccccgcaaaaacaaaaagccacaattgtttgaagacattaatctttcaaataaaattccagcttcagatgagcatcatgcatgttggattgttgggtgcaccttttttgcatcctggaaagagtgaataccggatagtaagaaaacaaaatagaaagtgaaattaatatatgaacctaattaccttgcgtttaatcaagttttcacattgcgggctactggatttttcacaatttggtcattttgaaaaacttattttgcaaatagacctctgaaaaaacttatccgagaaatggtcctttttggggcgccagagtagctggcgtcgtcccgtggcggccagatactgacgtggtaagaggagcgcgccagagagggtggtgcccccctccccctggtcccgagttctccctcccctctcctcaaattcactcgagattatatcggtaagagacttcatgttcttcgttgttttttttcctatattgttttttttcctatagtccaaaaaaaccaaaaaaaaatagtacattgctttttttttttacatcctataaaaaaataagggtttgttgagtttttttcttttacattcgagtgtccttaaaacaggtataactttctcatacggactcggaatcaggcaaattatatatccacggatatgtacagaaaaagttacatccgatccccccccccccccccccccgcttcgtcgggttcggagaaattagaacctctaaattccgcttgcaagattgtacctctaaattccgcttgcaagattgtattttcaagagctttggaaaattttacaggtcacatatttcatccatttgagtttaacttttctatggttggtccttatgggctcctaagtatgaaaaaatatcaaaaaaaaaataaaaatataaaaaaggttgtacatctctcctctacactagagaggagaggaaaaaaaatggcttctgattttgggagaagctggagcagctagaagcttccctaaaccagcccatagtctaggcccaaagccccatccaccccaaggaggtaaacacatcttagaataatggaataagttcatccgaggtccctgaacttgtcaacgaatccgattttcatccttgaaccccaaaaccagatacaataggtccctcaactatcaaaaccagtgtagataaggtcccttagcggtttatatggcggttttggctgacgtggcgcctacgtggctattttgactcagtctttatcagacgtggcgcttacgtggcaattcgatctagaaaaataataaatccgtgggacccacgtgtcagttacaaaaaaataattaaaaaatggtgaggcccacgtgggccccatgtcatcctcaccctacccttcttcctcccctctctctcttcatctctctcccctctcctctctctccaggcgccatgggacgggaaggtttggcggccggcggcacagcggcggcggcggcggcggcgcaagagaaggggagggcgcaagagaaggggcggccggccgggttcctcaagggcggcgacgacctggacgacgacgacaacgactgcggcagcaaggaggcggcggcgggagcgctgggtgaaggggtcgctcgtccatcccctcgggcgagggcgcggggagacgccgcgggattagggttctgtggtgttgtttttggttttttgctttcggattggatttcggggcggcgggggctcctccggccagccttccctcgcatctaaccgcaggtaacgattgattgattgatggattggatgtcccccatgatttgatctggggacaagcggcctccgccggtgcatgtcctcgtccccgcaccacggcctcagcaccatggtgatttatcgacctgttctcttatgttggattacaaattagaacaatgtgaaaaaagcgtcttttgatgtattggttttggtgattgcatgcatttcttgaatgagcagatccgtccgccgctgccgccgtcaccgccgcgtcgccagccgccgtcgccggccgccgaacttccccgtcccgtggcgcctggagagagaggagaagggatgaagaagggtagggagaggatgacatgtggggcccacgtgggcccaccattttctaattattattttgtgtaactgacatgtgggtcccacgggttttattatttttcttggatgaattgccacgtaagcgccacgtcagtgccacatccgatgaagaccgagtaaaaatagccacgtaggcgccacgtcagttaaaaccgccatctaaaccgccgagggaccttatgtgcaccggttttaatagttgagagacccattatatctggttttggggttaaaggatgaaaattggattcgttgacaagttcagggacctcggatgaacttattcctagaataatatatctatatggagaacattggataagatataatgataatctcccatgactaatcatgatcctcatcaacatgcaaagacgaagaagagaatttacctaaaaggacatttccatgataattttacggtagaaagggttatagacaaattatgaatctttgatgaccaactgtgatcttcaaaatctttgtcaaatagagctgattgacggatttttacctaattacaagggacggtctattacccatctataagataagacccccaaaatcatacaaatactggaccgttgaatcactttgagattcgtgcgccaccccatcttcctccgttccctttccttgtctagtccaatgcatgtcccccgcgctgccccccagccacatcagggaggtccactagacatcccccttccccctccccacctctccttctcctcaagctagcagcggtgaggtgctcctgcccccacggtcttgcccccctctccggtagctcctcgccatcagatccgccagcatcggccattgcatcctatcctctcactttgctttgccccgttgtcgaccatgcggctccaacgctgccgccttgccacccattcattcctccgcccaccagaagtgaataaagatccatcacaaagctagtaagttgaaggactaccactctaggaaaaacatccgcaccgatgcaattatttggatctccggtaaaaaaaataacatttctaccttgctgggctacgttaggtgtttggtatcgtcaaaataaactagcctggtgagctagaaaatcgtcgtccagggaggagagatgaattggctcgccttcaatggaaagatcgctgcgcgcgtgaagccatgaactgggtggacatgagttcatgaaaaaacaggattgtgtgccaaactaaaatattgcctcgccaaagtaaattagccaaacagctagcgtgctaaagaaagcatggcaatgcccctgtgggctgggctagttgggctagcttagcaccttagcaactagcctagctcaggagaggaaccaaatgaggtggtgtttggatgcagggacttaactttagtccctgtatttagacactaatttagagtattaaatatagactacttacaaaactaattacataaatgaaagctaattcgcgtgataatttttttaagcctaattaatctataattagagaatgtttactgtagcatcacataggctaatcatggattaattagactcaatagattcgtctcgtgaattagtccaagattatagatgggttttattaatagtctacgtttaatatttataattaattttcaaacatccgatgtgatagggacttaaaagttttagtcccatctaaacagggtctgaatctgtcatatcgtgctattgctagctgaatgatgaaagaaagcctgctatattttggccggtctaaactgaacatgaattcccattgcccgtcattcctactgatcgacctttttactgtctagtgagagcacccttgcttccattgtctttcatttgcttccatcttcttggcttacaagtatgatgccatgatcctgccgatctatttatcatgggtgagcgctcaacacgtgcaattgtatgtaaaagtagcataccgcaaccatctggaagctatggagttagagtcaagtcattctagcatttctcacatttatattgatgttaatgaatctggataaatatttgtctagattcattaacatcaatataaatgtaggaaataaatgacttacattgtgaaacggaggaagtaattcagtattgactatacaacaacactgtttttatagccataaataaccagccttgtgatgtttcaacacatccaagtagcatgtaggtgctgaaagaaatttctacggacaaagtaagagaagctagtgaggttgggggtaaaatccatagacactcttagacagaaaattgtcatacaaacttccatttatttttcatcctttctttcttcacttcattgttccagtcctaatcaccgcgatggggatagttgcaacatatcattttttgttagggcctgtttagttggtgaaataaaaatttttaggtgttacatcggacgtttgaccagatgtcggaaggggttttcgggcacgaatgaaaaaactaatttcataactcacttggaaaccgcgagacgaatcttttgagcctaattaagccatcattagcacatgtgggttactttagcacttatggctaatcatggcctaattaggctcaaaagattcgtctcgcgatttacatgcaaactgtgtaattagtttttctttttatatatatttaatgctccatatatgtgtctaaagattcgatatgatgtttttgggaaaaagtttttgggaactaaacaaggccttaggagcaggtgcctaacagcgaataagtagcataattatacatgcaaatatgtgatcaagtaaatggtgagcattcctggttaattaattatttcaagctctattgcatcaactttgcatagtcctattatttagttactcgctaacagaagacaatcagtcggaaaacaatggatgtagatctcagctgaatcaaatgatcctgaacaactgaatgaatctaactaaaaaaaccacccctttctaaatgggcagtttgtctttgtggaatgcggctaagtttttttttagcgattttgtccacaatgttctcctcaaagattgatggttctatgcttgatggttctgtgcaatgctctagctagcatgaaaccgttggccatgaagcttcaagaactagttgatcttcatcctctgaccaaaacatttgagaaaatccagattgttatgcatcatccatatccttccctgatgcctccctttccctgttggctctggtggctcagaacgtctctcatgctcctttgggtacgatgaaaccgtgaatacctttcggaatattatgatattgccgctagactgcatataattacaagcagctttcagttagtgctacagaatgattgatcttgcagttgatatagaggattcatctttccttttcctttcccgttttatcgaccaagtgttgatactcttcttcgattttctttctgtcctcctttggtcgcagcctccttttttttttgtttctagttttggtcttgtctggataactggatccctgtttctatgaagttttctttctcaataaaaagatgcatttacgtagtcctataataaaaaaaatctttgtcaccaactattttatagtgggtatggtgtgtcatgcgctttatgtcaaaaaagaaaaaaaaagcaaaggagtgccatgcgatcatagccataaatggctttggctgagattgcatctgaagctttcccaccatatcgagaagaacaaggatacattactgtaaaatcaaagtgcgtttgattcttattctgtgatgaacaattggcatatgagattattggttttgatatttggagattattggcgaagtgtttttagagatgattggatttgtaggtgatgaacaggaactgctgttttgtcgggtccggttagactgggcaggtgttgccggttagaccggtgtgtatcgtgcggtcagactggccagcccgcggtctgaccagacgacattgtgttggtttcgggttgtttcggccgacacttctagatggatatactatgcgtatgtaatactgttgtttgctaacaatgagtcaaattggagatagcttgatctcggaatatggtttctttgtttgattcatgtgtaggtgtcttgatgcctcgggagagtattgctgatgatggatcgagagtcaacttggagataaggtggcgttcggacggtcagatatcatgcgggatacttaggctaaagatcaatgcacgtggttggtgaagattccatatggcatacgatggagatattgtgtgtgtatgggatgcggagtcgaatttggagggagtccaaatttagtacaattggagtttgtaaagttggtttcttatacgggaaggtttactaggtgtattaggacttcttgtatgagtttggttcgtggctttaggctgcatacctcatgtatagatagagagggagggtgaggcctcccggtatcgtttaagagagcattgagttgagagaatagtaagagtttcgagtttagtcgagattttcatgaggagtgctgttgttgcactttgtaaacacaaaaagaaataaaaagttgtcatctactttgagagtttttcgatcatgtttgttcgggttcggcggtctaaccggtgagacaccaacgatcagatcggcagcaacgcagcggtcagactggcgggacaatggcggtcagaccggcgacggcttcaggtgactacagcttcttcgggcagttagaccggatgatctactccggttagaccgacgacttccaggcggtcggaccggccgatcatcttcggttagaccgtagatcatcgatttgagggtaacttttaattccgctaaaagttttggtttttggatactacaaccattcaccctccccctaccctctggttgcgttggcttatttgttattgttcgaccctacaagcacaaagctagctcttcagcttcatcggaaagcatctggtgtaatgcgattgaaccgtagtgttgtcttgggtgctatttcatgttctctgcaggagaacgatgagggaaaccttgctctattttgtgctatctatcttgaacttgaattcccattgcctgtcattcctactgatcttttactgtcttgatgagggtataaataaaaacttgccattctctatcatgtctttcgttcgcttccattgtccggccttacaagatagatgctatgaccctgtctcctttttatcatggttgcagacattgcaggtgatgcatacttgcaatgtatggcatgtaaa

SEQ ID NO: 77215 - DNA, 1673 bp, Oryza sativa
gagcataattatataattatatgattatcaatttagaatctttacttttttatatagtgatcaaagtggaataaagcagagaaacttagacttcttcaccaaaatatctataatacttaaaatgttagtatttttgtattcattcccacaccacctctgtcactaacagccggatctcacaatatatactaggggcatttgcaaatttgccaccggttttttcaatattgcaaggatgccactcgaatgacagttctaatggcatttttgcaattttctagtggcagttttgcaataacgattcaaagtagtggtaaatttgcaattgcccctatatactattatatcacctttcaataagtcataccctattgcactattggctcccctaaatttcaaaatcacctaactgtgttcaataagaaaaatcatttttcatagtactacttatactaacacagaaaatcatagtattacttatgcttaataagcgcttattatttgatttaataaactagtccctccgtttcgtattataagtcgtttgacttttttcctattcaaacttttgtaagttcaaccaaatttatgaaaaaaaaatataataatatttttagcaaaaaaatatatattatcatttaatgttagatttaatgaaactaatttcatattttagatgttgttaaattttttcaacaaacatgaccaaacttagccaaatttaactaaaaaagatcaaacgacttagggggtgtttagatctaggggtatcaagttttggcgtgtcatatcaggtattatatatggtgtcgcatggggtgttcgggcactaataaaaaaactaattacagtaactgtcagtaaaccacgacacaaatttattaagcctaattaatccgtcattagcacatgtttactgtagcaccgcattgtcaaatcatgaagcaatcaggcttaaaagattcgtctcgcaaagtagtcgtaatctatgcaattagtttttttagcctatatataatatttcatatagatgttcaaacgttcgatgcaacggggtgtaaaattttaaggtgtgatctaaacatgcccttataatatggaacatgggagtacaaactaaatttattttccattgcaaaacaccggctctaggctagtacttcctccatcctaaactaaacgcatctataagtttccgtgtccaattttgatcgtccgtcttatatgaatttttttaataattaatattttattattattagattataaatatgaataatactttatgcgtgatttatgttctataattttttttttaaaaataaaacagatgattaaagctggacataagattttttttaacacggagggagtccaactcaacctgataaactccccgcggcctatacgcatcgtccccttcttcttccctcacccccttttcccaccaaaaaccctagcctccccctcctcttccagattcatcgccgccgcgccgccccgagcccagagtagccggcgacgatgccgcccaaggcgtccaagaaggacgccgcccccgccgagcgccccatcctcggccgcttctcctcccacctcaagatcgggatcgtacgcgccccttaattccccaccgctatatctctactctcctttgcttcgccgtcgacgcg

SEQ ID NO: 77216 - DNA, 688 bp, Oryza sativa
attcctgcagcccctgaattgtatcaacttttggtgtaccttgcctcctgggacaaggattaatgcacgcacgtaaggaacgcccgttgggttatttccggtcgtgacaagttggtatcagagcccccttgaccctaggacaagccgtagatcccaagccttagcagtattttcgaaataaaaatcctctgttatttgtgaaaaccctctagtctttctctgtcttgctgcttcatttatctccaaaatctgacctttttaaagtgttgcttttctttttgtttgtagatggccggcagcgtcacccgtcgtggtttggacatgactggtttcgtcttggagctgcggggcatgtgcgttgtcctggggtatccacatggggtggactaccagggcaggccgcttccggagcaggagggtgacgatgcagagccccacgctgcttgggaggtcactgcagtgatcctcgctggctctcccgagcggacttcgttggcagtcaccgcgggtggagattctttccccgccacttgccagagcgccgctctcctcgccatcggcactcttcaccagcgctacccggacgagttgcagcactcgccctttcgctaccaccctcgccgcggaggagcccgcgactacgccacctttcgggatgctagctcggaggatgacgctaccatcatgc

SEQ ID NO: 77217 - DNA, 517 bp, Oryza sativa
caaaacatgtggtacataaaagagagatatcctggtatccttacccttgttctcattgatggtgcaatactcgacattagaatgcttcttccgattcagccaattgaacacctggtagtgccataaaaacataaatcaccagtaatctcattagatataagaacagtgagttgaatccaacgcacttgtttaagagagacagaaactgcaaagacctgtactttacagcatacactatacacggacaaatggtgtatcagcatgaactaactgtgtacctttagagccatctctctagaaccaatatgaaaccagaagagaaagccagacagtagctcagatcctcaaatgcatggcatggttttataaaaagacactagtctcatgattgaatggtccaggagacagaagaatggacttttggttgcaactggcttggcctgactcactgaagtaaattctttcaccaaggtagataagcacactttcgacagccatatgctacattctgttcaaa

SEQ ID NO: 77218 - DNA, 1946 bp, Oryza sativa
tcctcccttttgttgtagttcctcagtagacatccatatcacatatgcatgtttctgaacttggtgcattgtagcgagttgcatctcctcagaattgtcatgtagaacagttgtagttataaatcatgtgcatcctacccttctgtttcttgcttcggaacaagcagtaatacattctgaataaatcctggtgtcaggtaggaaatgggtactaaagcaccccccctggtgatatgctccaaccttttactgtgctggatgtatgcttgttgtacacagtaattctgtctcatgtagcctgttgattgtcctgcttcttttctgtattgagattcttgtatcagttctgggattgtaggccatttcaaatcttctgtttgttctgcttgcaacctggcgtttcagatttttttttggtgctgtttatcaggtcttgattctgatataattttcacttctgtgtatgtacatggtcttgttaaggagtataaatggaaaccataattcgacttttgccagaattgagaattggtaacaaccatttgatttttttttatgaattattcgtaccgattcgatcaattgaaaccaacgccgtgtttagtactaaaataattctaaaagctttcaacttttttatcacatcaaaacttttctatacacataaatttctaactttttcgttacatcgtttcaattttaaccaaacttctaattttggtgtgaactaaacacagcccaattgtgacaagtatcacggcaacctgaaattaatcctacagtacaaatcaaaattttaaaaatccaaagaagtaacgtaactactcgtgaattgtcttgatcctctgacctgactggtgggccctctagtcggcgggtacgattcgggaacccaatcgccgaggttggcgggcccacatgtcagccagcgcaggggaggacaaaatttgacgacgaaatctcttcgtcacggggagtcgagaggagaggagaggagagaggaaaagagagcgcgatatgggggaggaatcgccggcggccggcggtggcgcggcggcggcggcggccggaaaaccatcgggcacggcgcttccgaggagggggaaatcctgcaagggctgcctctactactcgtccatgctcagatcccgcggattcaaccccgtctgcgtggggatcccgcgctccatcccccaaggtaaaacgaaacgaaccctaatctccccccccccccccccaaaaaaaaaaaatcgcagcgcgcgatcgatcggcgtgcgggttttcaatccatcggcaaaaattgtctctatcgatttctggtggttcgggttcagattgatcggagaatctcacgaaactgttgttgtttggttcggtgctccagtcccaagctacgtggtggacgagcccagagaagaggcggcggcgcaggggcatgatttgaggcagttcaagtacgcctgcgctggttactccatgtttgtggtggataacaaagacggccgaagcggcgagaaggagggcaagacgttgttgccatattgccaggggcttgaggttggtttccatctcgtagttattaattacagtatggaatctcaattcttttcgtcgatgttgatatgaggttggtttccatctcgtagctgcagtatgaaatccttagttctctccattgatgttgattggtaatcacaaacatattaatgccaatgaggcaatgacttattatgtaggtagtgaatcacaaaacacgtgatcataggaatctcctacaagaaggaattagagtagtagatgttgatcatactatcttccatgatctttgcattagttttaagacttatatcaaatctcaacattttttttatttcagacaaaaatctatgtttgcctaagcactgtaactaaatgtgatagacctatcttacgattttcgtgtatca

SEQ ID NO: 77219 - DNA, 2626 bp, Oryza sativa
ttgcaaagagtgtttaatcaactccgaaatccattgtcaatatgttgatgcaaatgccttcggtgcttaaatcagcagcagatacaactgtactcttgtgatacactgtcctctttatttgtctacaatttcttttgaaaacaggctatttacattagtatgatatgatatgacatgatcatcttttatcttttagaatgatactggtaataacaggctgttattgcaggcaataaacagcttgtccgttcaagttcaaacagaagggttggaataatcaaaccaaattcacccaagtcccctgttgccagtgcaagtgcttttgagagtgtagaaggatcagatgaggatgatgctaaacaaccgaatggtaaacttgaaaatggctacctgaagatgaatggaaatgttgtaagtttcagccatcctgttgtcattacagtttttcttgttatatagttcctaattcctttattaatcgcctatatttttggagttaaaataggtttggcatcaagttttgcacgcgcaatcagtatatcatgcacataaaggaagtgaatttgtggctatcattttcttaatctattgagcatcgattcttgtggttatctattttcttaatctattattgcattgttttatatgctgtagtttattgatttatcttcttgtcgtttagatttaccttagacaaaagacatcttactggctcaacaatggccacataaatctagctaggcaatactgctggcatgcattataaaaaggtactacacacattgaacactatctgtatttgctggctgcagattttgttagcctgcagattttatattactcaaaacctagtaaccggcaggagataaatgtgagttcctcggacagtcattctacagttagtgacttggtagaagaaatcatattgctaactttagctgtacaaccaatagcatttggtgctgatatgaataaagcgtctgctcagctggctgtgatgctgctgcactgcacagccgcagcaaagactaccaagtgcccaaatatgctgatatttctctctgtttgggggaaatttgctgattttcatttggtacaatggctgcgactgattctgtttttttttaatgtctgatcatatatgtttcaatcaggaaggagaacagaaaggaaacaaagtactggaaaatggggctgcagcgccattagctgcagcaagtttgattcggtctcatagtatatccaatgatcttcatggtgttcaacctgatccagttgctgcagacattcttcgaaaagaacctgagcaagaatcatttattaagctgttaactgctccacatggtatggtattagatcttacagaacagtaatattctccctgtatgaatatcctttaattttgttatacttccattttttatgagcactaccatttttgttcttaagaaaatttgtccgataaaatattcacatgctgtattttatggactatggagttctccatttctttgaactattaggtgcaagtcaagaacctggaatactagtaaaaattcatggagaccatattattgaaatgtatgcatgttagtttcatatttttcctgtcaattagtcagtaattcttttgtattttaatgcatataattttagtcggatacatcaaatttcgttgttagtaagagtaaatatttttgaattaattcttctcatttccctttattcccaaatccaaagtaatttctttcataatattattttacattttatgtagagattccgtctcctgatgagattgaggtttacaagctccttcagaagtgccttgagttaagagactgttatctttttagagaagaggttgctccatgggagaaggaggtcataaatgatccctgtactccaaaacctgaccccaatccgttcacctatgtgcctgaaccaaaatcagaggtagcctagttcatttttttttcagtatttcgattcttcctctctgttttgtccttctgatttctgccattgattatgatttcagcatgttttccaaatggtcgatggtgttgtccatgtctatgcagataaagactgtaatgagcactgcccgttagcccttttgcttcatatgtttgaccagatgctttcaatttcctatgactcatttattttcctcattttgcctcagatacggaaatactttatcctgttgctgatgcgacaaccttctttactgacttgcattatatgctccgtgtgatttctgctggaaacacaagaaccgtgtgccataaccggttaaatcttttagagcatgtaatcatattgtcaaatcattgaccccttgcttaccttggtgaataaacttgactcctaaaattctgtatgtgtgaatgttttttcatttctagaaattcaaatttcatttgatgttaaacgcggatagggagtttcttgcccagaagactgcaccacatcgtgatttttacaatgtcaggaaggttgatactcatgtacaccactcagcgtgcatgaatcaaaaacacttgctgagatttataaaatccaaactaaggaaagaacctgatgaggtatatttttgaaacaattgctgaactgactgttg

SEQ ID NO: 77220 - DNA, 2530 bp, Oryza sativa
cacgttgcagtgaattgaaatatcctttcgctatttgctaaatattgtttttatatagggtgaaacaacgcccaattttttttggaaactgttatttcatacgttgtagcaaaatgtttcacgaggtgatttggttgtgtttcaacttttttaaaatattgaaacattttttatctacttagtgaaacaattccgatctacttggtgaaacaatgcccgatttttgctaaaaaaatcgggcccccgatttgtaggtggccccctattttttctttacaaaactatgaatgaaagattcagaaggaaacagtccttgcttccttacatacccttcttaatcctgcgttacatatacctcacacatgcaaggccttaaaattaaccccacacttaggatatgtacaacaacactcaatagctggcacataatcggccaactagaccaataaaattttagaagaagataaggagaaaaatttcttcatgatgctggaaaagaaagaaaggataataaaattattttgtgggtaactgttagaacctttattgtctcaatttttagaagaagatagtctctacttaacatttgttgcctaggatttaatacttaactcgagtacttgcctgaacaagtataataagaaaaaaatggctagttataaggagatcgcgtagcatggccgagatatctggttaaaatcatttattgtctcaattgttaaaaaaagagagtttctagttgatatatctaggaattactgttaaactcaattgttatacctgctatacttgcccgaaccagtacaataacaatagagataatccaagaaatgccattgacaagcggctagatccaagaaataccatcaacaagtgtgagttccaagaaatgccatcgtacaaatgactttgtcccaaaaatgccatcgccgttacggttccgtccatcctgcgctgttaagtgctataggatgaacagtgtatttaacggcacgggatcgacgaaaccttaacggcgatggtatttttgggacaaagtcgtttacacgatgtcatttcttggaactcacatttgttgatggtatttcttggatttggacgcttgtcaatggcatttcttggattatctcataatgataaaagggctagttataaggaaaccacataacattgcatatctagctagagcctaaggagagagatgaggagagaaagggtgagttggctactaaatagtactcctaactaattgcacatgagctcgaagaaagtgaggtccaacgcaagtctctactattataaaaattgaagatgtttttgtcgatactttggtacgtcatccatgcatgagtcggtttttaagttcgtttgcttttggaaatatagatctgtatttgagtcaggttttaaattcgttcacttttggaaatactagaagtcatataagaaatctcttaaaaacacttgtatgctaacttgagatgatcggactcctaaatcctaattatagctcataattttctaaaaaaatatatatccaagcgaatcctcacagtgaaactattataaaaattgaagatgttttcgccggtactttggtatgtcatctacatatgagtcggttttgaagtttgctcgcttttggaaatacatatgtgtatttgagtcgggttttaagttcgttcgcttttgaaaatacaggagcagtcgtataagaaatctctttagaaaaaacttgcatgctaaattgagatgatcgaactcctaattgcagctcacgattttctagaaaaaaaatatccaaacgaattctcacaatgaattttgccttaactaaacctataataacagtaaaattaaaatagccttcacctgttacaatgcacgagcaatttttatagtaaataacaatgcgtaggatatagtagagtgtgaaaaaagggatttggctaaaagtctactccctttataaaaaaattcaaatgctaaggatgaatctagaaaaacaaattcaaatgctagggatgaatctggacacaagtcagagtcaccgctaacaaatactagcattacatacaggatatgggagtgtgtgtgaagtgatttggctgaaaatctattggtaaaatatgtttcatgattattgtgtcaatagctacctactatatgctctatttgtatgtgtatctttaaatgatgtggcacccattcatattaacacttgccttacaagttgatgatcgacttttttttttaataattttacatggcttctaatatttttctaaagacatactactccttccgggttgataatacttgtcgttttggacaagggtgaggtcaaattttaaatctctggttataaataattttaaaaatatttatctttgaaatatggtgactatatgtatagattagtcttaaaaaaatactccaataaaatcatatatttgttaacatttatatacatattataataaaaaataatggtgaaagttgtttttttaagaccgtgcccttgtccaaa

SEQ ID NO: 77221 - DNA, 3149 bp, Oryza sativa
tgaccatcattgataaccgttgctcgcatcatagctcaagggagacgtcatcaagttgtccaagttctacaatccaattcggttacctactacagtgttgacttcaaacggccactaaatatacatacgaactccgttttgggtctatgagtacctgatgaaaagcaaccagagtcctctttccaacggatcaagccttatcttcaaatttcatctcagtcggtcgcaatcatagaaacaaagtattgtgtcacctataatgggcatatgagcttataacttcatctgggacccatgtggggtgcgtcacagccaggtcgagcacaaccgtagggatcccttggccgtcttcccgcctccttaaatagctaggtaccccttcaaggttgctcggggttttgtttataaattaaagtttagccattactattttgccttgtaattacgcatgtcagctagaccccctaattactcgtcttcggaacctcacattatcgtgagttctaattcctatttgcagttcagattgctttgtatcttgttattatttgtttcttcgatttgcttgcaggaataagattgatctgcaccggcaatatcaataactcactgagagatgtatcgatcgctaaggcacaacacaacaatatctcgtatggctgtagtcgtgtcaacaacttctctcccaaatcatagttatctttaactcaccgaaagatcgggccaataagaacagttagcgtatgaattgtagcttaggattaccacagctaggcccacaggttcactcatcaggattgtttgtggtaccatagtaatcgcttttataattataaacttatcgttttacctatattaccgtaataataaacactagctatcaaaaactcagtaaacataaattaattaataatttggatattatcaaaagaataaacactcattaaggaagataaggtgatcttttgtactagcaagctaaatgagcaactggcggctaaatgcttagctcaacccgattgattatgactacaagtttaagtcgagctcaatcaaaaccgatttgagccataagcttcgagctatttttttcccaccccaattaatgcccaacttcatagaaccaacatatatatataatacattcacacatgaagttgtgaatagttcacacgattttaaatttcaagttcgaatctaatttgttccgatccggcctatacatttccaaccggtcttaggctgtgtttgaggagaggagatagagaagatcgggaagacacgcaaaacaagatgagtcattatcacatgattaattgactattaactattttaaattttaaaaatgaattaatataatttttaaagcaactttcctatagaaattttttgcaagaaacacaccgtttagtagtttggaaatcgtgcgcgtggaaaacgaaacaaactcactcacaatcacccagatcacccaggaaagaacatagccttaatatgcaatgttccgaaatttggatcctttatggcatctgatgcttgctgcccctcttgcagtacgcaaatatccttggtagaatgggagagaaaatgacgtgcaactatctccgaagcctatctttgcaattttgcatccatccatcccatccatgcatgcagccacttgacctttggtgagcatttcttcttgttcgattcagaaagcgaaatatcaatctcttctccaattctccaaatatgcagcaacttcatggttaattgagctgcacgtgtatgaattatgaaagcaaagcattcatatgaatttcttcaaacgtatgacaggagtgaggaacgttggaggtgttactttctagagataccaaaaggactttagtagaaaaaggaactttaattagactaaagaagacattaaaaagaaactgaattagacgtgattaattcttgtaaagctcctgcactgcaaccacagtgccagacagagggaagaattcttcagccgttcggcgatgcgaaaatgacaggccatggtcccagtgccacggcgccaccaaacgcacgcaagagcgagattaaattaagtgctccccaacaacctcgtggttttcgcgtgcaattataataacctacgtactctgctcacttatttgaaaatgaaagaaacattcttcctctgttctaaaatatagtattagtttttgcaatttatatataatatatattgtttagtaaacaaaataccctacacccatctctgcctttttaaaaaaaaatcaaagctataatagtatactaattttatccatctctttaatacccatcttgaagttatatttttggatagaagaggattagctagtcgtcaatattgctgttgtctttcaaccgtgtctcctagtcgatgtggacatcgttgtccctgtcgaacgggacggatcagatgagccgacgaggcgcgtgcgtggatagtgaggtggatcgaattgcttcgtacacatgtaccattagcttttattcagactgtttgttagtgcctccaaagatgctctcatcttgctctggcaacatagaagaaaaataagtgtgattattattattattattactattattattgggagtaataaacatgaatgaatatcgttgctattgggacttatactctatacatcactcgacacaattcccttttcaaatcacacgaatttaaaatggccaagattgatttaagattcatacaatacctcctaaccatatcctatcctttttgtcttcatcactctttgactccaccgccaccctccgtcttgtgcatctcctctagtgtcggctccagtacgtccatcctccatcttctccaacaacaccgttgagcaccccccctctcccggtgttcttcttctctgactctagcaatatgatgcccttatcccaccggtccttcctcgcctccactgttatcattgggctttcaccaccctaggcatccctccaaaaccgtcggtcactatccccaagacccctaccctccatcacatctcaaccccaaaacgctaatctcaaggttctctaccaaagttggaaactcgctagagacgaagacaatgcataaatcttgaagtagatttaagagaaaatttgatccatagcat

SEQ ID NO: 77222 - DNA, 615 bp, Oryza sativa
  unsure (1)..(615): unsure at all n locations
gatttaaaccaaccccaaggcccaaccaagaaaacccgagacccgacaaaattgggattcagagtcatcagccgatctgatcattgccattgggccaatcagatcgncggtgtgtggccggtcagaccggccttccataggaaacctgatcttctcccaaatttggcaatgtttttctatttcgtgtctagatgtcaaatttaggcgttaacacatacccctgcctttttggcgaacttgtgagccgaaaagcataggacatgtggtcttagggcaataatttttatcggccatatgaggttctaagtgtttagtaaatcaatctctttgtaatatcctaacaaatcaataatttcttacgaacgattcacacaacttggtatagatatttccaactagataattactcaccgagcaccttgcacttagacccaacaaatggcgacttcaagatgtgaggtcgtacctatcatcgttcgtgtctcctaatttccttagaagcatattaacattttgcccccgagcaaaatcggctttgttgaatgcacgatttcgaaggtaagataaacattgtgttaacccctatagaatcatgtggaagagattcatctctaa

SEQ ID NO: 77223 - DNA, 3221 bp, Oryza sativa
  unsure (1)..(3221): unsure at all n locations
cgttttgatgatttattggttcaaccagttaaaccactggtttgaagcggatcaatgcaatttaaatagataggttattctttcaaaacacaaggtgcatcgtagcatgctggtcgtttggtttgcttctatgcatgtgatcgtgggatcgaatcccacatgcgtactttttcccacattttccctctccaacagcctccaggacgcatgtgaccttgcacaaggcaatccttggtggttcaattccagttcaatagcaatttttctacaaaaacgggtgacccaaccggtttctaccgggtcaattgcgcaaacggtcttttagctggaccaaactggcggaggctctagttctagttttttcggtccaaccaccggtctagtccagttccaataactatggattcagccacctgagggaagatgatgatggtgacatcgacaagcagccgtgcaccacgatgacaggaatagtacagtgacaagaagctgcgcgcgggacggggatagtagaacaataagagccatggcacggaaatgatggcggcgtggcgacaagcacaacctttttggatttttttggccaaatttccctatcatagtcatggcaattttggccttttttgtgcagaattttcctatctgtgatgggtcacaacttgtagaccgttacatatgatttcatcattaacgggggtgtcattctcaccactgaccaatagttaaatgtcgggttgctcacccaacccgccgttgatagtctttctgaaccatcagagatgacccgttctctagcagtgtgtcctccctagaaatactccaaaaagcatatcatattgacatcttcagaattagtatattgttgtatgtcatattgtaaacttccactaatttagcgccattttatacaagtttcttgcaactggctacactgcatagtttttgccgtacactcactactacaaaaccattaattgaggacaccctcatgtgctggtcatctaaaaccagcacatgaggtatatatttcctatcctcccaaaacccgcacatggattaaatattgaaaaccagcacctatcaccccttataggtgccagattattaaagaaaatcaatcgatacataaaatatatgtaccgaattttttaataaaccaaaacttataatgtggatataattgctagttttaacaaaaacacagcactgttaaggatgcagccgagccaacaaaatgtgggactgtgggagcccacctcgatttattaggtacctctcgatcttatctccctgactccatccccaacacaccatcctttcttcatgatctttatctccctagccttctctcttctcgaatgacacgccggtcccctcggccgtctgcctcctctcccctagcctatgggcagcacggccacctcctctcccccaagccgacaagcgacggggctgccttctctctccccaactcgtgagtagtggggccgccctctcccatagcctttgagcggcgcagctggctcctctctacttagccaacgagcggcgtggccacgtgtcctctcccccaagccggcgagcaatggccttgaggtccttgttgacctctaccagatctgatcatccgcgaacaccaaccgtgcctcatggagttcctcgctagtcaccacgcctccatctcctgatcctactgttcgctgctcgggagcagccaaatccagccacctcctctctgccaagccggcgagcagtagaactagagatccccgggggacaaatctggcttgtatggtggtgggcgagcaagcagatttcaccttcacccatggtgagcagcaacggggatggcgaccttctctccagtgaacctcctcaattattgttgttgattctgtgagtttgtatgttaatgatttctaatgtcaatcgagctcagagacgaccttgttcttggatgttattatgtgtgtctgttcttggatgtcaatcaaaccttgggggctatggggaacgctcaaagcatcggctttggttcgagctgatgcatcaagccagttttagtttttnttattcgtgacacctcaaaggtaccggttcctatactagcacttttgattctccccatcagtgcctctaatagggtgccagttgaaaaatccaacacctatgggggttctcaactggcacatattatgggttctgtactagtgtcttgttgtattaataatcatctttatcaccaatatatctataacagtacaacaatgacaataaaacatctacaaaacctattttcactcggttaaatttatacaactgacggtaattaagttgtgactaactttttttttcctctaggatctagcttattagctgcttacagggacacagaattttgagaacccatagagaattactagctatgattcaaaatacccttaactagactaacatgtttggcagacaatagtgaaatcaatgtaattaaggacattattacgaggttaacaaaagtaactagtggaatctaatcattttgtttacctttcgttggagctcactgatttcttgcatgaattgctggtcctgcataagcatatattgattagttgtctgaaaaacttgatattgtgcctgccaattcatacgaagctgaaaagggaacaccatcggatgacacccaacctttgtacagagcacccgctgcagtcctgcctcgaggttcttttccatctgctgcagctcttccacactcaatccctcaagctcctcacctctcatctgtctataaatgtggaattgtgacattatcaacttataatacgggctatttctgttgcaaacaattttgtgatatatcgaaataataaaatcaatatggatcagaacataattaacctaagttgaagacttgcttctgccagttgttcattcaaactgctacacttgctgtgctctaactgaagaagaaggtgaatatatgcataactgttagtatatgtacgaagcaatataattaagaagaaggctagttacaaagacaatttctatgagattcttgcatttatattcctaggttagaggacatataaatgtgtggagttagtactttatgtcacttttctttgcagatccaggatattaaatagtgtctcacatttacattaattacatggtcttattttcattaagagcaggtacaatagcaggctattagc

SEQ ID NO: 77224 - DNA, 6832 bp, Oryza sativa
gagattgagaggaagagggagagagagagagagattgagaggaaagtgggcaatagagagagagagattgagaggaaagtggggaagagagagagagagattgagaggaaagtggggaagagagagaggtgggagagtatgacaggtgggtcccgccattttttaattaaaaaaacgctgactgggatgccacgtgtatgccacgtagaccaaaaccaccgtggattgggtcgagatggggtaattcgtccagtttacatagttgggggtgaagaatatccgattttgtggttcatgggataattcggacgacgttatagttcaggggtaattcgtactttttcttttcagatattgtgggatggaagaagtatgaatttgttatagtagctcgtggaccacaagttgcagtaggacatacgaaaatgttggtccagccgagcaggagactcattcgagaggaaatcgacattggcctagtacaccataaacgggctattttggctgttgctcgaagaggcacacacatgctctgaccgatgttaaaatgaccccaacagatagttttgtagagcccaatagctagttttattgcggaataagttcacctgccatcccttaactttacatcgagtttgtttgacatcccttatcctcaataacagaaatcttcgtccctaaactatacaaaaccgtgcattttaagtcccatagcagtatagatgcccggtttcgctaatgtggcaccctacaattttctcttttcttttattcttttcttcggctgccgacgacagagggtgagaggcgacggcgaatccctcgccttcctccgtcgccgcttcgacaccaagtggctccttagccggcgtcgactggctgcttcctcgcccgcgatgataaccccgttgccatcaccttctgccgcgcccggctccgcaaggatccctaccgccggccggagagcggaggggagacgcggccgactgctgttgctgctgacgtcccatcgtcgcccaactccagcagcgcccgagggcgggggcagctggatccgcccgccggccggagagcggaggggagacgcggccgactgctattgctgctgacgtcccatcgccgcccaactccagcagcgcccgagggcgggggcagctggatccgcccgccggcttctacctctctcacctctgcctcttcctggctgagccgtccccactgttttcctccctctgggtgtccgcctcctcctcgctgctactccatctccccctgctcggagggatgaccggcccgacgaccctcgtggcgcctctgcccccaacatcgccgccgtcggtgcagccacttgcccagcctacgcactacaacttcctcaactccaagctgtctgttctgatgctgtcgccactactgttgggcgcgaccgtgggaagccaccatatctggcagcaggtcatcgccctggaccacggccaccagcgacgtggcgttccccagcagctacttcatcatctctaccatcctgcccgtggcgtcggtcgccgcgcgtgtcaccaccgcgttggagtagctgtataggaggcccctcaactccacggcatcttctttcttctctcttcttcacaagattgagagggaggggggaggtggccgacaggagtgtgtgagcgcggggcagcggcaggcggagcgggcacgatgccgccgagagcttctttccgcgctggtgccaccgcctagcttcttcccgcgagctcgcccgctgctgccgccggccacctctcccacatctgccgccacccgaaaagagaaggagagaagagaagagaaaaagaaaagtaagaagagaggtggggcccacatgattttctctcacttacatgtgggccccatattttttttttgctgactaggatgccacgtcagcgaaaccaggcatatatactgctatgggacctaaaatacatggttttacattgtttaggggtgaagatttctggtattgcagataagggatgtcaaacaaactcggtgtaagttgagggatggcagttgaacttattccttttactgctacaaaagatccagcctgctagttctacttcaaagagttcaaagaaaactgtctattttctcccccaactatagaccaagtctgacctctgtccctcatacacaaagctagatacatcatacaagcatccctcaattatatcactatagtcgagcaaggtaaaaaagttggttggacgatggttttgtcctacataacacagtgacttagtcagaaaaaaaaagtcatatggccctctttcaatgatccattagttatcgttctatcttctgtctccctcttttccctctttctacgagaagcctcaagcttgagcgtagagggagcgtggcatcagcggttggcgaggccatccgcggaaaggcacggtggacggtgagctccgtctaacttgagctccagttctgcccatgtagaagcagtggtggccaagcgagccccgttaagcttgagctcacccacctcacctgtccgcgagaagaggaacatcggtgatgatatctggctaaccccctcaagctccggtgaaagtgcgtagggagagggggggtggggaagatgtggtggaattagaggagctgtggtggaaagatggtgagctcggatctctaaaagatattcagatgaaagtatcagggcgtgtctagttcgcgaaaagaaaatttttagatgtcacatcggatgtttgactagatgtcggaaggggttttcggatacgaatgaaaaaactaatttcataactcgcctagaaaccgcgagacgaatcttttcagtctaattaagccgtcattagcacatgtgggttactgtagcacttatggctaatcacggactaattaggctcaaaagacatgtgggttacttcacacttattgcaattagttttttatttatatttaatgctctatgcatgtgtccaaaaactttgagaattaaagtaggccttagattttagattgctttttttaattgaagatgaaagtgtgaagctatagttaaaactttcgtgtgatttgagttgacagttttcaaacgaaagtgtactaaatgaggaaaaaaaacgtatgctacagtgcacccctgcacataaacggcatctgtacaagttcataaagacaatcaatacactataataaaatacaacacaattattttaactttattttccgttaaggtgtcgtggtgtagttggttatcacgtcagtctaacacactgaaggtctccggttcgagtccgggcgacgccagattatcgttttttttaatctccacatgtttaataccatgaattttctctcttattcccaaactatttaacgcaagaaaccatgaaaatgttctctcccaaacttaggggtggattactatttaatgcaagaaaccatgaaaaatttctctccccaaatagggttggataatttagccaactcggttcatttgtgcttgttatcttaataagctttttcagtgtaaccataagttaccacgctcaatcgttttatttgaattttttttataattagtaattttattattattatatgataaaatatgaatattactttatacataacttatgttttaagttttttttgaaattttttcaaataagtcgaacgatcaaagttatgcacgaaaaattatggctggatttaaaataggatggaggaagtaataattagttgcaaatacgaatacagtgctaattctaatatttgaactcgggtgaacatgcccaagctcagttcggagaaaccatgaaatttctcttttattcccaaaatattaatgcaagaaaccatgaaatgtttctctcccaaaatatttagggtcccccaaaacaatactatatgctaaccatcatttgagtaaattttcttcgttctcatttttctttttgccactttatctggtttgatatttctatttgatggttgaccgtggaccttacatcagggatctgggaggtgagacgacaatgacatactccactaattaataaaatatttaatgcaagaaaccacaattttttctctcacaccacttatagggattagtatataaaaaaaaccatttagggatttgcttaacaatcagttaagtacgttgtaaaccaacatacctattaacgaatcactagatctgttccctgttcctcacagcagtagaggcgtgagatgatgtggaacacccgcgcatatccctttgcccttaaaaacattgcagaagtagacaataaacatatatatatatggtgaatgctctctcttcattatagatctgattagtagtacaaccaaccttaaatgtcacgtccttgtatatataggggttttaggaggagatagatgttatctctactctactctagttcggattggtcaaaaaaaggatcttatctccccgggagataatattccgtaacaaagtaaacaattttttttcaatcgaattttcagccatttgatctgctaatttgagatctgcggtagatggcgggcctggcataagtggttgcaacgtggtgttggttttgttatcagaaacagcccagcccatggtcaaggcgaggcaaaggtgatgtttccattgcgggggctacgcgtttggtgaggtaggcacgagatgctgcagggtggctgcgatgaaggtttcgtttgattagctcactgaaccatatagctaatttattacttcttttatttcataatgtaagtcattctagcatttctcatattcatattaatgttaataaatctagatagatatattaattatcatcaatatgaatgtgagaaatgctacaatgacttacatcgtaaaatgggggagtatatgttggttttaaaataaactaatagctgacagtgaactctactgttaaacttgctctaagtttggtaaggcgcctcactactttgttttaccggcgaggaaggcacgcagccggtgagccatcttaatgttcaaccaggtgtcaacgacatctagcatggagggtgtcacctgccaatgtggttgtgcaatttgaaacaccaatgcagggttggggggcttgggggccttgggggtaattcggccggatcttcatcctgcataggacgtcatattatatactgcaaggatcatttatccaaaacaaattctcaacagactatcgttgtgttgttgcttagatcacttctttttattttttatcgttgtgttgttgtttagatcactttttttttctcgaacaatatagaagaactacgtgaaaaaatgctactccctccattaattcccctcgatagaaggcgtaatcactcgttatgcaaagaccaatgaaccgagtaatacccgttgcttcgatcgttcgaacgcgtgctgcttcaattgtttcgcagacatcaatggccatgcccatgcagcccacgcttggatccaacacacttcaacactgtgagagagaggtgagagaggtagtgtagctaagataggggttaatacagtcccatggtcgtggatagagtcgagtgctatgctcgctattaggttttggttttgggtggttcggcagtagcttctttgttggtctagcagtggtcggtccggtgctaatcttctcctgggtgttgtataagcactgttggcgcgtggtgcgtggtgatactgatttttttctttcatggttactgtcttctaggttactagctttatagttttctcatgctatattcaatgaatcatcataccatctggtgttggtcattcaaaagaaaacgagagggatccatagccgatgcttttaaactagccaaacaaaagaatcaatagctgttattctacatgcacataaaacacgcgagagccaagtagttgccgtcgtgtatttggacattttgacaaaatgcagttacgccttctattgagaaatggagggagtacccaacacatacaacggaagacatttttacatgacaagaaaaactgcaaccatgaccggccggagcaccctcacagcatctctctttaatatgatcaaggcaaatgatttttgtcgattcaaagaaaggcaaacgacttttatctacgaaaatattcaatgcaagaaaccatgattattttctctcccaaaacatttaatatgagaaagcattccgttaatgttttatatattgtaaacgcaaccgaacgttacttaaaaaaaccactaacatcgaattaatttcaatttagggattcaagcatatgtcatcatataaagtactccctccatcccaaaatataacaactttcccttaagatttgtcctaaaatataacaacttcttcaccaacaattctctcgccaactaatcacaaccctccaccattcacttttcccacctatctccactactcatcctatcacaaccctccaccactcacttctacctactttcttaataactgtgtccaactttaaaactttttatattctaggatggagggagtaaatcagtatatccataaactcgcaacgttaaatgaaattactcgtcagcgaaaaaagtactaagttattatgatgagaatgactagcttaataattgtgccaataataagtctcagccgaggtcacaagtttccatacagttcccatacaggtacgtacataacttgcacgaattaagcgaacgatacatacgtacatgtcgcatttaaattaagtgcgacgaaggtagtatggtacactagtacaagttgagaaaaaaagatccaagcaaccggacca

SEQ ID NO: 77225 - DNA, 12097 bp, Oryza sativa
ccgtttcgaaacaagcggacgtggcagacaaaaggcaaggcacccaaagaatatcagaaaagcaggtgagaaaagccacgcacaaaaggtgtcaattgtcaggttgagcacacaacagtccaagacgaaaggaaatgtccattggcatgccttgcagcaaagtctgaaaagtggaaaccgtgctgttcagttcaatgtctcggctttaacagcgttgatacgcacaattacttttgtagtaatgcaaaagaaaaacaaaggctatcctctcccccactattttttttccttgtatctagatagggagtcagcgtcttttgcgttagctgcgcagactcccttgttataccctgcaaaaagaaagcatatcatttaatcagtatatattaacaaaattaaagagtgtaaatggtgtcgtatcgtataatttggacctcttcacggttccagtatgtatcccagatcaagctaccaaaagttctgccggggaaaggaaactagggatcacttgctctcctacaggagaacgaaacagccattagtacctttgcttgataagtgctgaaagcctggataagaaattaaggggggaagaaaggataaggattggcatttgagaattacttcattgtctttgtctgattttccagaaggttggaacatccttgcaaatgccttccgctcctgattccttctgtcggcaatctgtaatcatttgcatatagttggtaacgacgcgcatttatcaagattctaggttcacaagaattacagactgaccttcttctttgcagcagctagctctcgtttaattcctcctaaggattataaaagattattaaatacgcggttgcaacattacagaagtgttgccagtgaatatgaaaaataagagataccatcacttggctccaactccaatgcatgcttgaagctctccactgccgcatcaatgtcattgagtgcaatgtgtgcctgcaaatggcatttatgccatatgagttgcgcagaaaccagatggtaataataatacgatatgagtagcacattgcattgattaaaatgtcaatagtttcaccttgagctaggtttaacaaatactttcacctcacaccagggtaaagcaaattaagattcactttgcaccaacccaagcacctctcatctactaggtttgcaatctgacaagcatctcactagcatcagcatgcccatatggacaactcacctatagctgggccatacttatcaagatgtgaacagagtcaattttcaagtggttgggctggtgcaaaatgaaacatatttcgctccacctggtgcgaagtgaaatatttgttcaccctagtgcaaattgaaactaataatgagtgccagtgcacaatgcaatttactcataagatcaatatctaaaaataagcaaatgaactgatagtcccaaacaaatggtaatagcaatatgatggtttagtggttcgattaacaaagctcacaagcacgcagacaaataaatcatagttcagagaaaaaaagcatcagcaaatagtgaaaccattactgcaggtcaataccaacctgtccttgtcgaaaaaatgccttagcattgccctcactttcacgcagtgcaaaatcagcatccaacagagcacccttcaaatctcccaacttcaatttgcatgcctgaacaagatttgaagggcaatgtaggtgaacaacagagcacgaatttgaagtttgtgtacggagtgagtagcaagcaggaacagaaagacactgctcctgcagggtaggtaaggattttgcagcgatgaacacaaagatttaagtttagatgagaatacaatagtactctaaaatcatattagaactaatgataaaggaattaaaagaaaatttattcctctgctttgcagttagttgtgtataggtattcaaagatgaactcaggaaaacaacctagagcaaagcaacggacaatcagatcatgagaaaaaggtaattggatatacacgagccatgtacattctacctaacttgcgccatgcccatgcactatttattctacaaactctgttccaaaaaatataagtatttctgagtgttttttaaatgtatctggacatcctttcgtccacgtacactttgggaaacacgcagaatattttagaacagagggagtaaatgttttgcaagttgctataatcccataaccatgtgcggaagcagtgtggcagaggtaactcatgataatataaaatgacaataacagtttcctttaagacaaaacgttcatccacaaataagttactggaatagataatgcaacttacagagctatttgtgagtataatcgatttggtcttccgcagtgctgagctcttctctgcataagtgttatgtgacgtgtttatgatcagtatgcatcatgtgacagaaacaacaaacattgaacagttgtagtgagacagtataattgccttcatctatatcttctttctcccagcaaacgtccaagtaacgcagtgctttcctgtactttctcagagctgccttgtaatcctgtttctgtaaagaccagaagtactaacttcagcttcagggaaacagataatgaaatattaaattgtgccaaagtaattaactagaattgttcaactgatacaagcaggtatttcattaaaacagcagtagtttggctactaaaccattcaaaaatcaacagcagaaggcttaagaaacatgaatctgtaaatactagaactatcgaagctggtatcgaacaagtaaggactaccatgcactaacttaagctaaaacctaaacatttaatcatgattaggatttgctgtcgtcacctgactttgctgatttggttttatttagtaaatgatgcaatattaatctaacagataaaaatacttgaaaattagcttgaagaggaaattaccttgaaattattattcccaaaagccttagcagactcaacagcatccatccaccatgaaacctccataggcttctcatcaagatcattgggccaatcaggatacgtatcaccatcattgaagaagttcacaactccatcatcagcaccttccggaagttccccacaatcgacaatttcaacatcagaagtcgggcggtcagcctctccaacaggagcatgctcaacagagcgaaccacccccattcccttaattactctaccaaaaactacatgtttcccatctaaatgaggtgtccgagttgtagtgatgaaaaactgagatccatttgtgttgggaccagaattagccattgatagcattcctttcctctcatgcttcaaaacaaaattctcatcctcaaacttcaacccataaattgactcccctcctgttccatcaccagcagttatatctccaccttgtaccataaagcctttgataacgcgatggaagcaagatccctacaagaacaacaattaccggacatggtctcagagattacggtgaagatgtgacaacagttttcagtgaagtatatgcagttgtatcaggacaaagtttctcatcatcatttttaaatcccaagttaacagagagtggaactgtcctcttttggtgttaaaagcaaaaggaataaaaagagcacagcaaactagaaaagaaaccatccactcaatcatatagaaaatattactgtagtagatgcatccattagctccatgaacagaagttaaaatgaggtacaaaatgccaagcagctattcaaacaagaaccatgtcagcatgttatgtgctcctcctgtaaccactaaaacttgtactagactaaatgtcaaactaatgaaaatatacagtaaaatggctagcaaagaatcttggtacagtactggtgactgtctctgattctattctaaaaggctacgaggcctttctatgcgtacggaatattacttaacgatacgcatacaaaaccctcttcatgtctacctaataacaaaacatccatgcatgtggctgggccacctgtcaatatgtaaaacaatgaggccttgtatgtgctccattaaaaaaggagcgcctatatacagattgcacaaggctaatcgctaacctgcacatggaatattttgagagtaaagtgccacagaaattggtaccccatatccaatttctggactagtctactgcaaaagaattggggttactcgtgtgcaaaagaacgttcatgtgatcaagtcacaagcccttgtcccaacatattgtataagtctaatatgtactactgccttagtttacttctaattgtcacagttcattacactatgcaaattttgaccattaataactttttcagtaattctgttttaatagacttcacaccgttcgatttgacaagcagtttgaatgaatatatttgtgtccttagatttttcaccgagcgtaggttaatgatgctatttaaatatttcctccttacaagtttattggaaagaaaaatagaggtgaaagtttggcaaaagccaatggagcgagtacatcactgtctactcttatacatggacttaaccatactgtaatagcagataacgaatctgccaaattttaacaggaaaactgtgactgttccacaggcatatgacaaaccacaaaagttagcacaggtggtacttgataggctaatatctgcaaggtgcagataaaaggaagccaaaatggagggggcccgttttaacagtcagaacatgctgtaccagcagtaccagtgcatagagttcatttcatatcaaaggacaatgatttgacaccacagcacaaatattagccggaaaataaatcgacagattccaaatgggccgcataagtaagaacatatccatacgacaaaagaagaccatacaatggcaggatgcagctgcccataaacacgctaaatgatcattaggaaagcaaatcggtggcacaaaggccggccgaacctttttaatctctaaactagaactgatttgcagtagtgtaaactaacccaaatgtttcagaatgcatgtttatgaaatccgcatcaaaatcctaacaaagtaacaatcaccaatcgcccaaattaaaaaagaaaaataaaacagttctctgtctctgatcagacgcctaaaaatttattgggagcggtgggcagtcaatcgcaccaagacacaagacatgtgctaaacataacagaatcgaatcattcattgcgcgcagtactaccgcccaaatccagagcctaagacgctcctccacccaacgaaaccaattcgagtccccactccccaacaccctaaacctccaccacggcagaaagccccgaaagggactacccggacgccacaagcatctcggcctcggcgatggctccaaatcggcggttccgtactcaccttgtagtgtaggtgcttcccggtgacggcgccgacgcccttctccccggtgcagagcgcgcggaagttctccgccgtccgcggcaccaccgacgcgtagagctctataacgatcctcccctcaatctcgccgccgatgctgacgtccatgaagcacctcgggttcttcacctccacctccgccgccgccgcggaggcgacagctgctgactccgcgccctcgccgccgccctccattgcgatctcgggcctcctcggggtcggggctaggctaaaccctagaaactagtggagcttcacgaggcgaggcggcgcggtggtggtggtgtccgtcggttacctcgggggccaaacggcgaaggctgcgttgtgggtgggtgccatctggggttttgtggggaaattgggtttataggggagggccgtcggtgagagagagtgtagtatattgtggatttgtggttttaccgacatgtgggcctcctctttaggagtagtactcccggtatatgattcggaattcagaaataaaattcagcaagataagaaaattaatactatataaaaatctactcctatatccaccgggcaatgaaacagacgatataaaatattggaatatgcaaaagtcttataccattaacctgaaatggtagtggatttaacccttatgtaacctacttaatgtttacagagagcgtagacatcgaatgctttttttttctccatcttatgaataagacatggagataatgtacatgtttagatgtaacaagtgactagttgtctacttgtcttttatttttttcagccaagctatcatgacttgtaaaatgacttcatcttccttattttcggtcaaactatcttaaattttaaaataacattaagataacttttcaaggaaagaattaaaccatatagatacctatcggtcttcattacgagggatggtgtatcatctcatatataactcttcgtagagataattttagctatacgaagatttcgaggtctcaaaagaacgttatctcacatcatcttagagagcctaattatacataggcaacatcttttcatgtatttatatagttatcaatatataataaattcaaccttaaagataaatcttagtacacacttgtacactcctacgcgcttcaataggtatcatgagatccatgcatgtagagctcttaccgtttctcgaaactactaattttaatgattatggacgaatgcattagaaaattctttgagcaggtacaatagcagactatgagccaattataaacatattttaaagagataaaagaagagagaagagcagcgggctacagatctgtagccagctgcagcacggactccaagatacaatatgtgtatgacatgtgggaccatatattaatagtgtattaagtaacaattgtataaactggctagtaaattagctatagatgatttggtgctaatagttgtctatactattaaacttgctcttacataatcataaacactatactaaagtaatatcatctaaaaggaaaagttaattgaaacactacaaacataaaagactttcaaatactcccatctcactcatatattattagtatgaagaatacaacgataaaaggtagtggcaattatgatggtttcgctatccaccatcaatgtatgtctattcttttatatgaatttctaaaacctacaccacatctgttcttaaaaaaaatcaacttccaaatatgaacatatatattcatgacctctgcccatatttccacgcattcatgactcatcacagttcacaccggtccatgaaccgtccgtcgtcgtgctatatgcacaacggcgccccacactccttccaccatcttcaacctacccaccccgcctgggccccaccaccccctcgttcgttccataaccatctacagttagtactactgttactacaccctgccctctgactgcgggccccacaaaccatcaaaccccctcctggtccccacgcttccgcctccggctatctcggtcctcggcgcgtgtcaactgccaccgccactatgccggcaactgtaaacaaggcgggggaggggaccggggccgggcccaccaaccccgatcggacggcgtgattcggccttgggcccttggcctcacctttttttccgccgctgctcgttttgctggcccatccggtgacgtccggtcgctgtccggtcacctggcgacggagggcgagcggcgcggggccggccctccgccgcgccgtcgccggcgatggccacgacgcgcgtgacggcgatcacagcggcagggactccattgattgaccacacgctattctggggcgtggttcagttcagtatgaccgtgaaacagtcagtggagcgaatcgtgaatgcatgtctctcctgtgaccatgagcgattggccggcaagcacggctgcacggggcggatcagcatgggagcagtggggtctcgagcctctactacttgcgtgaaggctacttgagaccccacgaaaaccctactaattattttttttttgccatatgcaaatggtaggggactgtaactctatctagtttgctcagatcccactgctattttttttatggatccgccactgccggcaagtacgtcggcaagtacgtgatgagtcctggataggggtgaaaacggccaaccaacgttcatttccaactttttaccaactgatctatatggaaatggtaatcgactgaaactaaaatggaaatggtaaaagaatatgaaaatggacacgaaaatagttttgctgttataccgatagggatgtaagcggggcgggtaagcgggctttttttatcccgcttatcccacttctagtttattttttcttctaaattttatactaccatgcgtaaaatagactagcaagcatatttttatgcgaatagcgggactacccacttgcatctctatataccgatcgtttccgtatttaccatatttttgtgaaacttaccgttttctataatatggtaattaccgtatgtttccgtatttaccgtattcttgtgaaaattaccgttttctataatatggtaattaccgtatttctaaatatgcctctacttgacccacagtttagagattgattgactctttaatcaaatctctaacttgagtgcatggctaaaatggagttaatttatatatatagtataagcttgaatttatttatacatataacatacttatgtaaagttaaaatagagtatatatgtttttatagtttaatgttttcgtatctgttactggtttctaatctgtactgacatgtttccgtccgtattgctccgtttctgatttttcgatatttctgatatcattttcgttttcgattttactgtttttgatttcgttttcagaaaaatatggttatggaaatggtggtgtctgttttgccgttgtttcggaccgttttgatccccactcccggatatgctgctgcctacaccatcaattattgggggtggtttggattcggttcgtctggattgtatgagattcagtcaaatgggacagccgagcacaatcatggcggatgcatattcagcttttgcagcctggggatgcgatgctggaggagagtactctacctctaccagagtcgtcgcacaaggggagcgtccggatcactggatggatgatggattggatctactggtgtagtactactgtaccagtgctttttctctcccaggtgtacaacgtagtacgaacggattatgctgacgtagtacggttccgtgcgtagaaaacggtgtacgtgtacagtgcactgcccatgtgaggatcgagaggggggtgacgagggacgaggagcagttcggctgacgcaaccgcccaaccgcaccgcatcaccgcggctgattaatttgcctcgttcgcccggggcaaatcaaccgtgcgtgcctgcagcccagcacgtcgcgcgcgcgcgcgccatcgatcgatcgctgctgccgtggcccgtgctacggtgcgggtgcgtccgtttccagcagcccgcggggaaggggggacatggagatgcgtcggcacgggacaccgccacggctgcgcgtacgggcgtgtcacggcgtgcgcgcctctccggtttttacggggaggtgaggtagggggggggggggggcgcgatgcggtccgagcacgggacaccggtgccacggcgtcgcgagcgtggcttggctggcacgagcttggtatggattagtctaatcaatgtactcacatgtgattaggtttttttgacggaaggaatatatccatgttcaaaatgttataaattagcaccgcctccccctacttccctaacctcttccttaaggatccgctttctctctatcagcaccaccgtcgcctcatcttttctctctatggatgtggagggattagaaattgagaagtttcttgaggggtgaataagatatttcgcaaatgagagaatccaacggcttgaaacgtctggagtagaaatcggatggctcataattttttttgatgacgtggcaaattaccatttcgagaatgattagctcttccactattttagatatgaaaaagtacgaattacccctgttcccaaactattgtggtcgtctgaattaccccctgaaccccaaaaccgaatattcttcacctccaactatgcaaaccggacgaattacccccctcgacccaatctgcagtggttttagtctacgtggcatacacgtggcatcctgttaacgaccaaatttggtaatatcagtatcggagataaagatgggatcgaagcggaatcgaagatgaggattgttgcggaaacagagtaaggatcggctggagtccggatcggctacgactgggatcggctaagtctgagttggactggttaagtgatacagccgattccgacaatacgacctgtgtgcgacattaggatcgagttgatgtgcttcaagatgattgccacacatggataaagtcctgggaaggcaattgtatctattaattaggatattttatgtaaattccttagagataaatatgggcaaaagtctgccgcaaagacttatggtatcttagagtttgttagagataagagtcgtgtccaatatggacatatcttgtaattctcgggtataaatagaccccgagccctatgtaatgattaacacacacgttcaatacaatttcggcgcatcgccaccctttttgctttagttttatttcgacgagttattgctttcgggttgagctgcatcggtttcgatcttcaacaagaggtaaaacttgttatggcggcttgtgttctcgcgattagtgcttccatctttatgatactctaatcttgtttatgtaatccgtcaagttatcatatatcttgcataatccttgacaatatcgtcatctaacctacaatcggctaacatctgttaccagaaggcagccgattaggttaaataacgacgttggcttagattatctgagatatccaccactctatgaaacatccagcggcttgattgtctagatattgttcttcttttcatacttaatgctgtatcagttgagtttgacctattaagtcgtgcttagaatttcaatctctagcctgcctactggttgccgattagggtagtatcggagtttcagccgatcgtatctgatctaattgcttttatcttacgtgctcaattaacatgttagatctgccctttatatcaagatcttgttgcatttaagtatattaggtttctgcttagtatattctatttgctttaatatcttaatataaagtagtatcggagtattagccgatacatgctagatctatctgatcggctatgctatgaacatatatataatctcattattaatatatatttcgatctaagtgatttatactgtctcggtaaggtgaccgatctatcccaatcacttgattcaagtatatatcgatataaggattatatatcgttgatatctacagccgatcgagtagatttagttctaatttgttcacttaataattgccgatcgatttacatatgacatcggctcaaagataaataatatgtcatcggcatttagccgatcggctatcatttatggatttaatcacggtttctttgtctttgtttcttgttgattgcaggatcaaatcaactagcacgctcatatatccgatggcgagttttggacctacactggagttaagcagatctcccaggtctcgtgttttctatcaacacatcccagtcagcgttttttaataaaaatggtgggacccacatgtcatactcttccactttcccccctctctcactcttcctctcttctctctctcactcttcgtctgtctctctcacggatcggtggcggcgggagacacggaggggcgggcggcgtcgcggcgacgaccgagcggaggcggttgcggcggcggctgccggcgctgctgggtgagtggcggcgggcgcggctggacgagcggaggcggcggcggcgacgggctcggctgaacgagcggcggcggacgcggctggacgagcggaggcggcggcggcggcggcgggctcggctgaacgagcggcggcgggctcgactgtgcgcaacgccgcctcgcgccccgccgtgcccatggtgcccgtggcgc

SEQ ID NO: 77226 - DNA, 662 bp, Oryza sativa
attcccctccctctccttcctagccgccacttagtgccgccgccttcgcgtcgcctttgcgccgtcgcctccgccaccggttgccgtcgccggcaacgcgttcgcgcgcgcgcgccgtcgccatcgccgtggccggtgggccggccttgagccaagccgagccgggtcgccgctgcccgtccgatcaaccccgagggcgatctgggccgtcggtcccgtggaccggcggtggaccacccgcgtggtcccggtccacggtgaaccgttccccccttgagtcgctgccgagtgggcccacttgccggcgcccctttcctccctctcccgagccgctgaccggtgggccccgcatgtcggcgccgcgccttctccccccgtgctgacgtcagccctgggatttattgcgcaataaatttaaggtttttcttttatagtaataaacacagtgaatcttctaaaattcataactaattcatccgagctccgtttaagcccattcaagtctcagtaaatcaagaaaaatgtgtagaatccattaaaaattgttttgttccctgtttcagtagtctttagcctgtttgcaatgtttgtcttgtatgtcgctagattaaggttcctctgacgctccggtgtacttagaaatagtcgccgaggttcctcca

SEQ ID NO: 77227 - DNA, 6326 bp, Oryza sativa
atgatagagacatggttcaatgtatgcctttaccatgtttcaaaaaattcacacaactaactacacatactctatctcctcttcacctatccatacatgcatgcattcagtgactttcaaaataatttttctcataaactacttatctaatatacgatccgattatactgttgtatttgttggaattaaatctttataacagaatatcatatgattatattctgatgaaaaaaaaccatatatttcagtttgtcagcactcaatgtttcatacgcgataacaatatgtttcaacgtgtgtcttcactgtgtttcagaaaaaatatttcagtgactgattttttttcaccgtatatatatctcaatgttttaccggtggtcaactaaaacatttaccgtttgattttttaacaaacaaccgggcacccgattgggagtttcttccttagagaaggaagtgtcttgcgtaactaataggtcccacgtttcggagaagcgcaacacgtggaaccaacagaaaaaaagccacgcttctcgtacggtaccatgcgaactggcgacgcatgtccagctgccacccgcgcgagccacgtctatcatgatttttgttagaccgagcctacgcctatcacgacgagttcaagccgccggcccgcagcttgaagtctaaccgtccccagccgcacgagaagccgtggtgcggccctgccgaaatttttttccggaaccaacgcctacggaaaaggctatacgtactaactttttcttactaaattcttactaacactgatgtgtcatgctatgagtgtacctagaatttttgtaacttccatctacttaaatcaaacggttgagatgattgttagtaaaagtttagtaagaaaaatttagtacgtgtagcattgctattttttaaactgtcatttatactaatggaaatggagggctctgccctttgaaaaaaaaagaaaaaaaaagaaaagtggtccccatctgttagggtaaatttgggcttgtcttcatattttatgtgggccgtcagttaggaagcgaggaggcccattacgcaaagctctctcttatgggcctaagcgattttagaagattggtttgaagtgagcgcaacgcttcttgtccttaccttttgttttccagagtagcagcctcagagtctcaacggcgggctttccatcgccatcagcccatcactcaattcagctcgattgccatttgtcaagctgatcaaagtactacgtaccgtatgagctttttccacgtcggcgaagtatagaaacctcaggacgagttaatactgtagccatcatcagcagtgctattcattttctttattgcgtacagtactatggagcacgagggctgtgacagcgcctggctaatcctcatcctcccagtctctcaaatcctgcgtgttcctcatgggattcggttctgggatatcgcagcctttgccatcgccagtatcacatggcaaagctggaaaataggagtattttaactcggtacgacgctgtcgctgagaagagagacgacgcaccggaccgaaggttcgggaggcgaaaacgtgaggaatcggccggtttttccctgcacgccatcacgagcggcgacacagtgagcccggccggcgagcgtggtggccactgcagctcagctcggcagtgcgtgcggccgctcgtcgccatccgcgcgcgtgtgcagatactgaggaaaacggtgcgatttgcggcctccgtgcctcagttttttaccaaccttttttgtcgaatcttgcagtgaatccacctccaactatgtgagccatggcaacttggcaagagcaaagcaaagccagcacagcagttgcacgtactacctgaatggcctgggttcgccgcgagctgagccgatgggcggttgcgatggagcgggagacgcagcgacgtgccgctcgtgtgcgacagctggcagccgggggcacgactggtgagttgtcctcctcctcacatgcatcatggcccctaccatccggatgagaacgacacatatgatacggctactcactgatcccccgtcagcttgtcactggacaggctgcgccgcttgctatctgcagcctcgttacgccagactactaccagtaccagattgttgtgaactgcggcagtgtaccacaataacgggttcttttttcctcatttctgtttggtgttcatggaaaattaatcaaccaagattgtaagaaattgcgacaagtatctcgagcagcaaagagctaggttgaattctggaaaactacccaggatggtctggaccatagcaaaacattccactcactcattaaaccctcttgcctgcatgtcgctctccatatcccaaataattaagccacaaccagtggtcgttgagtgatgctcattaggccttccgatagatttgtttacgattatctctctgcttaatccctccagttcctctctggatagccaatcatcaggccacaaaatacatcatccaactaaatgatgacattgataattaggctcataaaaaaaataatcagaggctagctggtgcatgcaccggaaacccaaccaaccccccaacaccacaatttcagcttcgcttacgtagtcgatcggcgccgtcccctaggggttggccggttgctactacgtactacggcctacgggagcgacggagttgtggaatttggagaggtgaagagagcgacgggaagagacgtttttttgtggtggaggtgggttggccggtggcgcgagatgtggtgagatacgaccaggttgggagaccgttggcgtgaaatgataggccatgcataccgcgcgcctgcacaagcggacaattgctaaatatgatactcactccattctaaaatataacaattttagctcttaagatttatcctaaaatataacaatttctccacgaaaattttcttttcgaccaatcacaactctccatcattcacttttcccatctacctccactactcaaccaatcacaaccctccaccattcacttttaactactttcttaataaccgtgtccagcggtaaaaatgcttatattttgggacggatggagtaattatttgatagcaaatgaatcaattataactgttataagattttaaaattgatttcaaataattcctaaaaatataaaaattcatatataaaaagcttttgcaaaaatatatgggcttgatcggtagtgttgtagccgatccacgctaatcaggtgatttgccgcggttagggtcatatgctttgattttttacagagaagggtattttttacccggcttctatatccaaccggatatatgtatttttttttaaaaaaaaaatagaaacttacctatcaaacatggaattagcactcaaataacccaatctaaaattcactcctataaagatttgaactcagaactttcggatgctactcaggtcactgtaaccattaggctatgtgtcctttcactagtcatatgttctgatggttgttgtagcaaagacctaattccttagtcctaaaatattgcaagtttagaaatataatcattcatcagttcattcctgtcacaccccgaactagtaccgaccggaactagcccgtgacgctccaaattaacctgttaatcgataccagtcccaggaaacagtgctggtatcacagggagacagaatatcacagcaacagaagtctctttattatagagtagaagtacagtcatgttgggctgcggacagaccccgagctcacaactgcattacaaaaggaaagcggaagccaggacttggaccaatcatcacaggcgcgacttgggatctaggccgaaaccctaaaactcatcgtagccagcttgctcctggaagaactcctcatcagcaggatccgcttcatcttcttcagcaactgggggggaagttatttatatagagcaagggtgagtacgggagtactcagcaagccaggggaaataaggtgtttattgcaggcttcaagggaaggctgttgttttagcaattgattttatttgaacccttttctgaaaacaactaagtgagtgcttctcaaacgacacggatgaaacagtgcgtctcgtccggtcggagtatgtgcaatgtatcagtctttagaattgaaacaaggttggcacccggccaacagctttttcaaccggccacccgggccaacaactttccaaacggccacccgggccaacaacttttcaaacggccacccgggccaacaacttttcaaatggccacccgggcctagctgatcccatcagctgcatatttttcaaacaccgaaccccttttcacacagcaatttcacaagcagtagtcaaaccaaactacgctaggaatcacctcacatccgcccatgaccgtgggcacggctgttcgaacagtttgttaacctctgcagagggggtacactttacccacatgacattactaacccggatcatccagcccgtggggatcagccacgtcgggagacctccaagctttcatgacaaggcatttcgaaagccgacacagatttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggataaaattccaatgaaacggtccttaggtgcaagagtgggaaaccgtacacctggtacgttccccggtccgcggttttggaaattcatttagttcacaagcaccgacccaggtgtcgggtttttccaagtcttttgtaaaactccagttttacccaagttgttactcagattttaagtttgaaggcgaccgtcgattctcgcacagagtgcacgattatcgaagcgcaactgggtggttacaaggggacatagtatggcaattaacaatggaaggttcaaatgcaacaagtctagtaggtccgccaatctgccttgcagatgggacaaaagattaagtgcgatcctatcaatgcataatattttgcaagcaacataattaaatttcaaatataggctcaagatgttcaagggtggcttgccttgctcgagatctggagcttgatcctcgaaatcctcgcactgcgggtcttcgggctctgaaactaaacgcgaaacggaacaactcaacaaacgacgaaaataaagccctattaatgacctctaagcgtgccattagatagatctcgagatttagggaattttggaagttgaacggagtcaaacggatttacggttgagaagatattgaatttctacgattattgaatttttgatctaaaggaaaaggacttaattaaattctttttggaaaagaaaaagaaaagaaggaagggagggaaaatagacgtttctcggacggctaaggcgcggcccaagaggaatggagcggtccggccgagctaaatgggccggccggcccaaggcggcccaaactcgcgcgcgcgcgggagggaggagagagagagccggtggaccgggttcaccacgcgcggtcccgggtgggacccgcttgtcagcggcttggctcaccgtgcggagggagcatgcggcgcacgcgcgcgggcgggggagggacgcggtgcacgcgcgcggtttgcggtggacgcgggtgcggcgggcccacgcgcagcctctcggctcgcggtggaacgcgcgcacggggaggggctgaccggggtcggttcgacccggtctggctgagctgtcgccgacgtggcgcctacgtggctgccacgcgggccggcgggaggtagacggcgacccggccgcgaatggacggcgggcggcggcggcgagcggcggagcgaaccacggcgatacgggcaacagcgagcacaccgggcggttgcacgtgacaaggggaggcgagccaacggctcggattcaccggagtttgctcgacggcagcgggttgcggcggcggcaaccggtggcgggagaagagggaaacggcgacgaggtcacgagaggtcgattcccggcggtgagagcatctacgcggcttcgggaactcgacgctagcgtcggattgggcggaattacgccgagcgaggccggcgacgagcgggtgctaccgagctcgggcggcgacggcggcgagcacacggcgagcgacggcaacggttggggcggcgccggctaactacggggagtctactcaagctacta

SEQ ID NO: 77228 - DNA, 9725 bp, Oryza sativa
gggattcgatttggaaggaatggcattcggaaatgaactcgacgatagatcggagatttagatcttgagatggcacggacactagacaacaatcaaagaaaccaatttcgcaattagggtttttaagagataattttcccgctaggcgccacgacggaacgggcgctacaattccttaatcagaaaacaacactgccgcatatagttacttggtttactcgttgttaaaatgatgaaaggaggaggaaaacaaatgaagggaagacagaagaggagaaaaagaaagtcaccagaattctctcttccgtcagtctcagcgcggtcgatcgtccggagatgcgacggcgttttcacgatgtaacctgcctaatttctcgagaaccttcgctcaatcattcaccgggactacgtcgatgagtcgatcgactctgcacgcctatctcgggccttacagattgcaccgtgtgcatacgatcgcctgtacatatagtgggggcctgattaggatgctggaggagatatatgcactgcagttttgaacagttgcacagggccttcaaatttgagaagactcttcagcaaatcaagcggttctaccgtgcaccgtgctcttttgacagggagctccaggcgatattttctttttcagaagtactaagatctattatactgactctagtacaaagtgttcgtactacactagtactactgccaattgtcttgcacaaatggtccattgcagctcactctgccatgctacgtacggaatagtaacatgttattcacgcacttttcacatgtatggcacgtacaatgtgtcaaatttcaggtacagataacttactgagaaatttgtatatacctgttatatgaactcatctatatcacatttgttaggaaaccctcataatcttagtcaccttttttttttacaaaacctactatacaccttcccaacgtgagcgccgcaaacatcaacaccatcgctgccaccgcctccttacccctagtgtgtcgccacacggtctcacctgctggttggaagacaccaatggcattggcaaggcccctcggctggtttcctccctatctccactctctgactctgccctcccctgccctatgttccttctcaagccggcggcaataaggtgcccctgctccaccatcttccatgtctctagtggctatctgtcgttggatccgtcaccccccgattgccgcctcctaaccagtgggtttgttttgcccctgtcagtcatcctccgtcacacacggttatctctctaagctttgggaaaacccttcctcttcctcctcctcctaccccctcccatcccaaaaataacctagaaccctaactgatggggggacgttgctgccttgctagagctagaggagaagaaagccgacacaaatcttggcatggaccctatggtctgaaattcgacgaaaatctttccaaatttctgccatatgaaggttagcgattccgtaaaaattatgaatgagcctgtacaatttacctaaatggatggtccggatttggaacttatctacccttaaggatggtcaaaattctcatggttacacgaagaatgtcaaatacactcacacatctcgctaaggaaaaacagaacagccaatcagagcataaatttcaaacttttcttgaaaactcaagcaatttttcactgatattggacaattttttttatcaaccataatcactagtgtcacaaacaccttgaaattcaaatacattcaaaacttttgtccaaaagcacatccgaccgggggacctcaagatagaaccgaaatttcaaattttcaaccgaaatttatgaactagatgagagtgatgcgtaagggggaccatcagggagcaaacaaccgtgaccgaattgcataggagttatggctgatcacttgagaaattaaccatccattcccggtttccctccaatattgcacccatccatcatccaccagggatgataccgttgccgttgctctaaaaaacgttaaaacagcggcaggcaacacgacagcacatcgcatcgtacgtacgtcgttcgtcccgctctcctccgtcgtcctccctgcccaccgtcccccacacccactccccgccgtcacgtccttccagaaccacctccacgactcttccaatcccccgctataagacgcttctccactcaccactgcaaccctcacccagccagctcgagcgagcgaagccagcagcagaagcagtagagagaaagtagagagatggaggggaaggaggaggatgtccggctgggagccaacaagttctcggagaggcagccgatcggcacggcggcgcagggctccgacgacaaggactacaaggagccgccgccggcgccgctgttcgagccaggggagctcaagtcgtggtccttctaccgcgcagggatcgccgagttcatggccaccttcctcttcctttacatcaccgtcctcaccgtcatgggggtcaacaactccacctccaagtgcgccaccgtcggcatccagggcatcgcctggtccttcggcggcatgatcttcgccctcgtctactgcaccgccggcatctccggcggccacatcaacccggccgtcaccttcggcctcttcctcgccaggaagctgtccctcaccagggccctcttctacatggtgatgcagtgcctcggcgccatctgtggcgccggcgtcgtcaagggcttccagaagggcctgtacgagaccaccggcggcggcgccaacgtcgtcgcgcccggctacaccaagggcgacggcctcggcgccgagatcgtcggcaccttcatcctcgtctacaccgtcttctccgccaccgacgccaagaggaacgccagggactcccacgttccggttagtataccaactactactgcagtaaagattcagagatggaagtatttttactgttttctgagtgattgatttttgttttaatttgcgcgatcttccacagatccttgccccactgccaatcgggtttgcggtgttcttggttcacctggccaccatccccatcaccggcaccggcatcaacccagcgaggagccttggcgctgccatcatctacaacagggaccatgcctgggatgaccatgtgagtttaaattcactgaaaccaacccctttctccctccttacatgtagaaatatatatatatatatatatatatatatatatatatatatatatatatatatatttgacagttcgatttgcatcatctgttaatgcgcagtaacttaaaattgatgcacaaaggtattctaggaatatataggatagctggttgtagtaaaagaagaaccttgtatctgataactgatgccatatccccatgttgaaattatatgtgatattacttaactgctagcaataattcagtagctctgtagctgtagctgacttctataggtgcaagcatggtgaggtagcatttgttgcttatttaattatagataggcttagcttaacaccctcatctgaagggaaatgttgagggactagtttcagtgtagcaggcaactgctaccatctctgacaatgactcaattggctattactgtatgataagtctacatcattagtgaggacatgattgagcaatggcacttaattacaagcactaactcccgctgcaatttgctggttctgcagtggatcttctgggttggccccttcattggcgctgcccttgctgccatctaccaccaggtggtcatcagggcaattccattcaagagcaggtcgtaacctgcatcagctattatcactgtcaagatgccaatccagagcaagctgtttctgatgggcgcggctgtttcccgctgcctgctttgttagtaattattgtggagtcgacgttcctcttcaagtttgttgtactactgtttttatctgaacacagacttgtaatttcagtactcagttgtgtatccctcttttactatgtgcaaattaagctatcctcctcctattggagttcggttcagctgccatctttctgcaattgccaacacggctatccacaaaaccttaacatcaaaagggataaggcatagtgggtgtcgagaagaataatcattgggttccaaattgagacgaaacctctctttctgagctatctgtcacacttgcatcatcgagatcgtgatgctattcagcctactccaatctgccagcacacctgggctgtggttggcagcttgtggatggagtaacatctcggcgaattgaggttggtggtgacggccgagaggacaatgatgtgagtcattgcccgttggcaattggggttggggctgtgtgtgtgggcgctctggtcctaaacgcaacactacaaaaacttacaccgtggcacatgccgtgctgattgtttggttcttgcaaacagcctagctgcggaagatctctccccctttttaccttcccctttgtttacattttggttcatgtttgcggccactgcacggtggcttggtacgatgaacccccccgtgtgcccacagacagaccgcactgatttggccggaacctgaagaggaggtattgcgttgtttgcaaggtttcgctggctggacctctgtcttctggggaccgctccaatgccagcaaacggctcagtgaagaggaccagatcaccgatccaacataaattgcaagagataccgcctcgtctctgtgcatgtgggcttcacggatcatcaattcaccatgacctgatgatgataagcagctgctacattgttagctgcacggttcaagcttgtaagaactaagcatacaagtctcagtaacaactgcaagaaagtctacacattaattaggtaatggttatagtcttatagatagctcacggtgcagatctgaagaacatgtacatgcgggagaagctagtttaaccaaggatctgattctttgtataaatttccagagtaactggtacagtgaataagttggctcattggctgagttctgctacaaaatactttcagtatgcagtttgacttgcagcagtagtttcaacctcaggtgagatattgtgtgagagaggatactgaatggctggactgtttctcctgtgcaaaatcttggctcttagttgaggttcctctgtacaatggcatcaggacgccaagaagaaaatagaaaattaagttacatataaaggcaagaggagtatacatgcggcgaactactacttcggaggtccttcaatctgtagggtaccaatatacagtcttgtcatttgacagatgttagtacgccaattgtagtatgcttccgggagttctgcctaacaggaatggacgatatctgctatttacattgaacaaaattagtaagagctattggtcaagacaaacttcagtgtcctgaaaataaatataacgactgaagcaaaaggttcaaatgtggattctgaactctcaaagtgcctgattcacctgagattctataagctgctaacaggtgaagtgcttcagaactacaccgaacaaagattatacacagcaaggcagcaagataatagacagcaaggcagcaagccccatgccagcaattaggaaaaaaatgtcactagccagtagtgctaccatctgagctgggatcagagtttttcttttcttttcttttggccacgttgagtttacaagctcaggaaacaacattgtgagccatgttgctttgacgtttaaagggagtgaatctagcaactagaatgccaataaaccagttcttaatctaatagtaagtgactaaagctgcaaatgatgtaggacagtcttgacttaacgtataatagaaagttatgaattgtgacaagtgaccatgcatacctttgccaacttgaattgtgttgatgacaacaaagattccatccattgccaactttagcttctacagacattagtgattttcttttcctcatactatgatacacttcaagccatcggatggctaaaaagcagccaaaccaccagttacctttcgaagctccaaaaaatgccatctgaatactgattcttgatattagttaccatgcttgagtccaaggtgtggagatccagacgtcaagtctaatgaaggatttagtttcacatgatccacaaaggcatgatgtgtgaaacgttcagatggtgacagcttatcacgcaaatcaaaaacatttccaagtctctttccaaactgagggcttagaatgtcagcttcagataccaccctctcctgaagcccctgagagacttgatgcactcgaataaattgcccaagatcaggatctgtaggccggctggcaaagagatcatccgggcttcttgatgggattgcaaatccctcgttgctgtaggttgattgcttcagatggttaaaaggaatagcaccattaccaccagacagaggcgtggaggtgcctgaagtagttctggggcttgaaataggagaaggtgacattctgccattggaatgttgtggggaccttgattttagcaaaggacttccacatggagaaactggacaagatatattgcttcgtatacggatatcactgtaaagttatttaaggattagaggctgcacatatatagggaagttcaccgcaaatcattttccaggtaagactgagtttcactgaagagaacacaagttactaccatatggctagtggtgagatactcattcatactagtgctaggatactcattcaacttagattagccatttttttaacagataatactttgtacttgctttattgcacacattgtttggacttaggactaatactattaataaacacaaattgggaaatgatgtacctgtgttttgaagaaaattttgcacctcttctctggtaaattgtctgaccctccaatcccaatgaggaaatatttcttgtatgcgcagccatctgaaaactcaaataataccaagcaaagtgaacaggccatgaattatccatgtaaccatgttatgtcagttatggcagtattcaagtggtaccttggcgctcgatctacaagatataacagccaaatgttccaatggttcagaaagaacagatttctctagtgatactgctttttgaacaaatgggtgctgcaaaagctccattgcagtgggacgttgagaaggatcacgttgcaggcactttctgatgaagtccttgcctggctctgaaaggtgatctggtattggtggaagttccttgctatttccgatcttgaacattgcagcaatctgcaggaaagaaaagaggggaaatgttcatgccaaagttgcttcggtgaaacttccaagtctcattacgagtcaaaagaaggaagtctttacatttcaagcacctttcataaaattgcatgcaagtaaatgatctttcaacattctacatcagacagtgataaattcttaaagaattcatgaaaagaacatttccatatcccattcactcatggcgaaaatcaccataattaggttatctatattatagaacaaataaactgtgcctcagaagtataatactaaccccttcatactggctccatggcggtttcgatgtagccatctccaggacagtgcatcccaaactccatatgtcaacagctaggttgcacccatttgagttttttataacctgcgtatgtgttgcatagtatgtgatgtacagaaatggcaataagatatgcatgaaacaaaaaattaacaagtaaagattttcagtgatacctctggagccatccaatatggactacccttaaaggagaaaggacactgctgcccattgatctgcataaagacacatttaatacgtattaatgagtaaaatacttccacattatacaaaaggcattttgtaacttatcaggagtgagggggctagcaaggtttcaagcacccttaacagcagtactcaatcaatgcattaaccagtgacaggagctacaagatcaagttgatatagatactgctatatattttttgaagagctcgatataattcaaacagttgtgactatgatatgaggcatagatgcagaaatggaatgacacggaaaataaagttcaattgacaaaagtcattttcaaaaaattaaagtgggcagaaaaacttacatgttttgccattccaaaatctgcaagcttaacacgaccactaggatctactagtatatttgcacctttaatatccctgcaaaattgtgatgaacaggacttataattacaccataattccaccgatacaaacaaaccaaagaaaagagagaaaaccaaagaaattgctacctatggactgtattcttcgcatgcaaataagccaaccctgaaagtatctgctgtgtgtagctgcgtattgcttgttcaccaagctgtccatactcttgtagaagtttatggatagatccaccagatacatactccaagtatatataaagcttatcatcaacctgtattggggcacaaataataagtgaagccaaaaaagaaaatcaaaagtggtacataaataactcattaatgaaatcctagatgctatcatgcaacttcttgttacccttggtaaagggaggaaaaaaataattatataatgaccaaacaggaaacaataattgagttaatggttccaagcaaaggaaaacctagcctatgtaaacagactgaaggcagcatttataccgtttctgatccatagtattgtacgatatttggatgctgtaggcggctcaatagtgatatttcctgagaaacaaaaaaagaaaaacagggaatcatatattgaacaggaaaagacataatctgaacttcttttgcaactgtaggttaaagcacaatcaacagactatacctgccccaactgctttgcactttcctttgatttaggatcatccaagaatagggtaacttctttcatcgcacacatttcaccactatcactgatataaatggtaaaaccacattaggaggacaaatcattgtggggacaccgaagttacatggccccaatcccctcccccagaatagagaacagtaagatagccaaaatagagctatattccgagttacatggtgtcttagctaagatcttacaaaaattccaagatgcttagtatattcatagtacgtcatatgattttttaaaaaaaaatgaaatttcaaagttaggaatattcttacctgttaaagccaacatatacatgaccaaatgttccacggccaattagcttccccttcttccatcgtgacccaggacttggtggattctcagttctaccagggctgcgaggtactgaaataggactagttggagtggagttatttggatgaaatgaactgtgagagatgctcagtggtggtaggggaagtttgtgagtttgcttcttcttcccatcatcatgacggtttgttggagattcaggggccatccctccagaccttggatgcaatggtgaaacacttccactatgcaccctcgaactagggccaggacttgtcattcttggacttggaattggtgaacactctgggctacttctgctgggctgccaaaagagctgggctagcatatcaccacccacagaattatgcccagatgtttgccctgaacctggactggaacattgaccagatccaacaaaagttacatctgtgtgaggtttcactgcccaaaaggccgaagt

SEQ ID NO: 77229 - DNA, 9965 bp, Oryza sativa
atcatttccaacaggactctgaagctgagaatccccatgatcatcactatcagaacagttactagagggagaagcaaccactatttctgaaacaacctcactatttccatgcctcctcggaggccggttgggtttagggagtggtagaagcagtggtggcttgccacgtttttccaatatgggctttgattcagtgatatcagaaacagtccgagtcactggaggacgtactccaggaatagggaggggatgggcatgtggtctatcagctgaaaagctttggcagcgagaaacttcttttgacggtgaagtaggacgtgacactgtggtagatcggcagcttttttcaacagatgaatcattgccacgtctacaactccgtttcgacttcgtgcttcccttttgatcatttggacttatcaaccgatgaaatgtatcgatgaggttttcttttgtggttttcttagcatcttttgagaaagacttcccccaccatggtggcatattgaatatgaaataatttgtggtatgtctaattggctaggtactaatcacggtgttattcaagctgataattaccatattctgccaatcagattaacatgtgtagcgcacgattttcttaacaacccatatagaacccccagcttccgcaatgcactggcaatggagctagaagcagacaaattgatgaccacaaggtggtgtcaggcaccttctttacccccaaaaggctgaaatacatatggtaacagacattttagcatttactattaatgaaaaaattgcaggataaaaacaatgggttattccatttatgtttttcctaggtaattagtgtgattcaacaccagaaacagactgcccatagcattatgagtgttttatgattattctttcaactcaatctttaatcagtaaaagcaaccattgcaaactcaatgcaaaatgaactacaattataagaagaatcttttttattgcttaaccacaccaatcgcttatttaagccagtcataaattagataaagaaattatctccactgccatcaatcatccatgggagtgcaatatatcaagtatgttttggttgaatggcataacactgtgctagaaataaataatgtttcaaacttcactcaaggagttgtcaaggtcacagttttcagtaaaacacaacggcataatcggtggtgcctcctagaacttcaaatgtatcaccaatagtgatagcctgcgtgcatggttcagtcgctcattcacatgggaaggatcacatgcatattgtacaaggcaacatatacacctaaacctaaagtaggttctgttttttttttcttgaatacacaagagagttgcatatcatttcattaagagagaagaggaaacacgggatgggagctgaaacgcccccactcaccacaaacacatacaacgcttacatttaaatgacaccttacccaaccggggttagcgacctaagaaactcactgagtttagaggttccagccatgtaccaaagaccacactcatttgccaccgattggatgatagccaaagtaggttctgtttggaattacacattacattctataaagccccccagtatactgcataacctaaagtttcgtggcgatacatacaaaatacaccactcgtgatagagcaccaggtttctgggtgtaaggtgaacttttgcagctgaattacaatcaacgaaacccagtgttctgtttggccatgtgtactattgagctttgatgctgagagaattccatgcttacctgaaccccagttgattgcactacagtctaacgaactaacagcgacttaaggcctgatagttaacatccgcagaagaatcggcacccgtccacaagtcaaaccacagcagtcgcaatcgtaaactcccagcaattccatcgcacgagagctaagtccaagctaactctagtaccctcgagacgaacctacataagcgcagccagttaccacctctcgggagcaatcgattttgccctccaaccgcgcgctcagatctcagcacaaatccacacgcctcagatccacggcgagcaccccctttcacccacgaaatttaccatcccagcttcccagcccagcgcgagcagcagcgtccacaaccagaacccaccccccaaaaaacgaagcgagcagagcggaatggcaggaggaggaaggaggcgagcataccttaccggcgcgccaccacggcgaggcgagctcgccggcgggggggagatccgacaggcggagggaaagccggaggggaatctggaggcggtggtggtggtgatggtgcgggcaaaaggagaggaggagctcgcggaaagtgggggaatcggaaaggggaggggggagaggagggtagcaacggaaaaaggcccaggccgacgaggtgaggagaggaggaggcggttttgttcgaggagagtggtgttggcttgtgctgctcgctcggagaggagaaaggagggggaggcgacggtggaggtggaggtggaggtgggatcgggtgcggcacgggattccctgtggccggtctcccgccgtccgctaggacgatgtggtggggcgcagaagatcccgctggcgctttggggatttattctcctgtcgcctttaaaatttgtttttcgaaagctttttgcggatttatttcggcgcatcggggtagcaacggttctttttttccccctgtgttctgtgttcccaggcgtgctaccgcagtaccgagtacgcttcgagcctcgatatggaggggatgtatataaggcgccgttgctacggactacggtagcttcatcgagacggtccgtttctggatctaatggttccttgacctcgtctattttgatcgtatagaatttgatattttttttatacagagggaatacacatgtacggcgatcgctaatcggcgcgcgcgccggcggcgcgtgtttcaggcccatggggcccagcaccgggcgcgcgcccctccttcgacgttttttttccgtttttatgtagcgatttttttcgttttcttttccacttttttctgattatttttttaatctttagcatgatttgagtttgaaagttttaaaattttgagttgaaaatttttaaatctgaacttgaaagttttcaaatctcgatttgaatttttaaaaaattttcaaatctggacttgaaagtttttaaatctagacttgaaagtttttgaatctcgagttgaaagttttcaaatctgaaattgaaagttttcaaattttttaaatctggacttgaaagtttttgaatctcgagttgaaagttttcaaatctgaaattgaaagttttcaaatctcgagttgaaagttttcgaatctgagttgaaagttttcaaaatttgactttaaagtttaaaactaaaatcgaaaattttcaaatctaacttaaaaaaatttcaatctgttagtaaaaaattctcccaaaaaatctccaaaatcttttctaattactatcattagtgttaagtgtattaactgatagaggtagttaagtatactaactagaagtgttaatagagtaggttaataggcgaggagtgctcgctagccgcgcgcacgcgttagctaggaggcccccacatgtacaatgccatcagcatgcctatcgttactattatttgtgtatgagaaatgtttctaatatttttgtgttttaatacctttgttctaaatagacctttcacaattgtacgacggcaaacattttagattaactttttaacaaaatgtcaaagagcaattatgatgaactcctctataaatttttttgttggatctataaaatctaaaaaaaataaaaagagttgaatttaattggtgattcggtgtacaattaaaccgagtatagacgaaactagtagttggattatggatagtcatgcaaaagagtataactgattcaccggttttaaaatatcaacacgtggtagcataaccatgtaaggttatagctacatggtgcaataaaattggttcattgatttacggtgtgtttagttcacgctaaaattggaagtttggttgaaattggaacgatgtgacggaaaagttaaaagtttgtgtgtgtaggaaagttttgatgcgatggaaaaattgatagtttgaagaaaaagtttggaactaaactcagccttagagaacctaagtcagcaaagttcaagtcgccaagtgatggatcaaaataatcataacatctacaaaacttgcgccatggtatttgatgttctactccattgattatttaatgatggagatcacaaaacttacgcttatcttcttctcacttagtaactccagcgtagagcactagagccttagatgatcacgttgtgttttaggcaatcgtgttacactacaccatctatctctcacacatctacattctatcattgtagcgttgccatatacttagggtttgttcgttttagggaaaaaaacagaggatttgaattcctagggattaattcatgtgagtgtcgttcggtttatagcattaaagtataggaaaaccaaagaaaaatttacttttctacaagttgtatagaggaaacatggaaatttttccatacactcaaacttcttataaaaattcctatggattgatgtgcgcaaacatttatattctttcacttttcatgttccttcaaaccgaataagtcctcagcattgagaatgtaatattactaatggagaacttttgaagtactacactttcactcgctacacaaaagaaaagggatgtcatttcatcattcatcgatttaaaaaagacgcgaatattagagaatgatataatatcaaataattagaagggatgaggtttttaacccagatcatctagccaccatcttttggagctagttggaaaacactagacgtttcctccatcgttcgtcgatctcgccgtgatattttggctaaagataatggtttcattcaatacactaattaactactcctgtgtatttgcatgtactccgcgcgacagcaacgtcaggcgtacacatccaaatacccaatgaaagatggggaacggcactacggcagagaaggatatttttaaggtacccttagagtaatactggccgtccactcttatcgatctaatggacctgatcttcttctactgtcagtagtagtatgtgcagtagaaaccacgtggagggcaaaaccgtaaagaaaaaaacacagtaatattacgctttatcggtgattagatggaatgggctcgaaatgtgcggtgagaaggcggcggcggcgaaggcaggatgtgatgagatcggcatctatgtcgccgtatggtggccgtcgctcttccggccttcctctactgccatatacagatttaattttgatgcttgcactcgctggttcagcgcattgtggctgtgtcgcgcaagcccagccagacgaggtcagaagctgcccggccaggagccgttttaatccgcacaagctaactcgattgtaattagattcacatgccgttaatgaagacttaatcttgattcatgagtgatggagttctattacggagtaccagttaattcgtccgattttgctagatatttgtcatcaaatttctccccctaatatttgtcagatgtaattacagtacaatcgtagtgtaattacactgtaacttgcatgtaattacactgtaactataatgtaacttgtatgtaactttcaagaatctctcggtaacatgttatttcagtaaaatagaggtcgtgggaacaaattctttcatatatgtgtgtgatgtgatttttttcttcctccatagaacaaatcttgtaatagatctaacgattcaaaattacgtgaaacttacatataagttacactgtagttacatacaagttacagtgtaattacatacaagttacattgtaattacactacgattatactataattacatctgttatatttttagtagaaaatttgtcgacaaatgtataggtggtcccaattcgtctccgcgatggccaaaaattatcagacggcagctggaccagtcttcgatgcggcagtaattcgccggcagagcacacacaagaaatgtggccagcataatcggcgatgccgacgccgtccaacgggtcgcacaaatgggaggttgacccttccgggtttctcggcggctacaccggcgatataactttctctaatagataaatggtcagaaatacccttacaatttacaggataaagtaaaaattatcgtataaatcaacggtcagttttgatttatactaccctactgccatcgctagtaaaaggtactgtaaaatgacccgcagagaaagagctgtcaagcgacatcgccatcagcagatttcatgatcagccagtttattcattgaaacttggcaagttggtattgcaggtagctcaccagtgaagacggtgcagacagcagcagcattgaaacgccgattgcaaaaatgattagatcgacgaaatgccaaatgcatcgaagaaagtcctgagcgatctttagggtgtgtttaacgtcaaaattaaaagttgggttgaaattgaaacgatgcgacggaaaagttaaaagtttgtgtgtaggaaagttttgatgtgatggaaaagttgaaagtttagagaaaaaatttagagtgtttacatggaaagcgactgctgtactgctcatgttcatcgacatggtcgatcgatcgagacttccatcgagagagaggaagctagaaccgtgaacacccactacatgcatgcaatgaagtgtttgacgagtagctatcaacaattaaaatgcccaaaattaagagagattaaccaattgatcgacatgtttcagctctctgaacaagcaaccatccaacaacaattggcggcacattaacacaaaccgcccagacgaatttggacttgccagtttgggttacacacaggagattaattattaattattgctccttaattttggtggctgcacaaccaaaatcatagtactacatgatctaagaatcttaggtttggagttttctttagacatttcctctatcgactggtaatgaactgtaaaagcaagtgatttaaatgacctcaccaaccatacaaaccctttagtaattactatcttggactctcatctatctacatatttttttgccatttccaattgacttcgtccaacgcccgggatcttctaagcgcaggccgcggtggcgcgcgccgcggcggcgtactccccggcgccgcggagctcgtcgacgatcggggcgaggtcgcgcgggcgcacctccatccggagcccgtgcttcatgaacagcgtgagcgacatcttctgctcgacgcggtggcccggcgccacggccaggcggtggcggaggagcacgctgccggcgatgttcctcatctgcaggtacgcgaggtccttcccgaggcaaatgcgtggcccggcgttgaacgccacgaacctgaacgagtcgtgcggctcgaacttcgtgccgtcggccgacagccaccgctccggccggaactccaggcagtcgtcgccccacaccgtcttcatgcgccccgcggagtagatggagtacgtgaccgacgaccccgccggcacgaacgtgccgtcggggaggacgtcgtcggcgacgacgtgcttggagtcctccggcacggaggggtacaggcggagggtctccgagagcgccgctttgaggtagacgagctggtcgagctcctcgaagttgagcggcgcggcgagccacaatgccgggtcgtcggcgccgcgcgacgcggccaggacggtgcagagctcgcggacgatcttgcgctcgacggcggggtgggtggagaccagccagaagaaccaggagagcgccaccgaggaggtgtcgcggccggcgaggatgaagttgagcgccacgtgctgcagcgactcgtcggagtaggtccccttccgcatgaagcgcgacaggaggtcgtcgtgcggcgtggccgacgacgcgtcgcccttgccgttgccggcggcgagctcgagcttgcgcgccttgatgaccgccgagaggtagcggtcgacgtgctggacgctgcgcgcaagcgtggtctccatgccgagccccatccacttcttgaaccgccacacgcactccgggaagatgaagcggttgagagtggcctcggtggcgcggtcgaacgccgaggcgaagtcgttctccggcaggccgcgggcgagcgtctcggggtccttgccgaacgcgaggccgcagatgttgtcgaaggtgaggcggaggaggaggtcctggaggtcgacggtggcgccgccgccaccgccaccggccgcggcggcgtcggacaggatgggcagcaggcggctgtggatggaccgcgacacccaccgcgacatggcggtgcgcagcgtgcgcgtggtgaactccagcgccgccgtcttccgctgcgccacccacgtctccccgtcggagttgaagatgccgtcgccgaggaggtccccgaacacgccgtgccagaaggggcccttggggtagttgtcgaaccgggacttgaggacgtgctccaggttcctcgggtcgcacgtcaccgtgaccagcccgccgcggcgcgccagcccgggcacggcgaagatgcacgtctggtaggtgccccgcgtgcggcggaggttggcggcgatccactcgtgcatgtcctccgcgtgccgcaccagccccggcaggctccccaccaccggccacaccctcggcccgctcagcccgcgcgacatcctccagaaccacgccatgtacgcggccacggccgccacgaccaccgcccacgtccccgcctccatcaccaccaccaccaccaagctaggctatggcgatcgatctataataagtgagctcacatgcatgggccggggcaagcagcgatagatagctagcagcaaggacgagagagtgtgtgtgtgtgtgactgtgtgagtcgccagtggccagctagcgcccctgacctgagatcgagagagagaagcgagacgatatataggagtagaacctgcccgagaagcaatgcgatggatggcaattaatatacagaagggaaaaatatatatatacagagttgccaggatgccactctactccagctgcaagtgcatgctcggtacagtatatatcgagcgtccgggcggaccataaatcgccggcaggggccgttgggtggccgtcgatcgatcgaaggcgcggcgcggccagtgcgcgcgcgtcgcttgcctgcctgccggtcgctgcggctctcacctacgccattcaatgcatcggcgggcggcacaccgaattgaagccgtgatttcaatggcgcgcgtacggccgccggttgtttgctagtagctcgacgcattttaaccgcgccaagttttaaaaggatcagccagtagatcgacctgttttacgacgctttccactgcgatttggtgatagtaatatgctctgaggtgccagtatcatgcagatgacggcagggccggatgcgagtagatggccggggggagtgaaactggccaactgaccaacggtttctcggactgtctgggctagttttgggactttgggggtgtgaggtggttttgacgaaggcaaaggatagggatatcatggtcgcctttggagcgtcagcaagcggaggcgtgtgatcgtgtcaagcaccagctagcacccgggttgacgatggtttggaggggttgggtcaccgaacgaccaacgtcccaacctttcacaaaagcgtatagctcccagatcgtacagaatgtcgcgtagtttgtgtgattgtgtcatttctagtactaataaactactccttccgtccctaaatataaaattttgatgtaccacatctaatcaaaatcccttatatttgtttggcaacgtgagagaa

SEQ ID NO: 77230 - DNA, 17854 bp, Oryza sativa
ggggggtgtagggaggtggttggtcagacatggtcgccggcggcggaggcaaagccggcgcgcctgctcgataaatctggtgggggtttagatggggatgggaacggtgcgagtcggagccatctatctggtcgggtgcgcggcgcggctgtgcgggacctagcgggaggtggaagacggtcgggggctccagggtccgtttcgctgtactggtttccgtcttctgagatagaatacgtaattccacgctgtacatcatcaagccttgtcagatggacaggctttgatcccagataaaccttaaaataatttcttcaaactattgggatgacataatgaatgcttttcacccgctgagcttgaaagtaagtttggatgatgctactcgcttgtttacccccgataaccttgagcatgtttcttaaaccgctaaatgatttgttttttaaatgttttttatatataagtttttttttaaaaaacaaacaaatacattttcaagtttatataataattaatactcaattgattatgtacaattaatactcaattgattatgtactaatagtgacttcattttgttttaaatgccactaaaaatctaagccaaacttcacttaacattactctactccctccggttttattttaattgacgctttggacaatgacacgctctacaagatatacctttgaccttatttttctattataatatatacaatacatgtttacttttattatagtgttttgaaagacaaatctatatatatttttctagtttctttaaattaaatatttttaaaattattgatggtcaaagttataaaagtttaacctcaaccttgtccaaaacatcaattaatatagaaccagatggagtatgtgcattgggattggggtgcaaaagtgattcccaaatccatgatataattaataggaatgtttgcttcaactaaactattcttgccgcatgtatataatgctatcacttctggattggaagtactacagaagtttcttgcagcaccattcagtgatttcctctgaatggccaagtataaaaatatgcatgatttgcaggaagtagagtttttaccttttagttgaggattcttcaacaatcaaaactgactggtaagtgataacatatatacactaatacacatggttcattgttgaatgcccttggcttcttgaatccagttgatgaagaattacaacaacaaatcaacatgcatgtattcttacattctgaatcgatttcttcaatatgctcatgaagtaataccactttacataactgtactaccccactacaatactacattgtggcaatactcttgttgccaaaagaatggtctgtcctcaacattattacttcactactattaacaaccgatggtttctcatgattctctaagctatatgtgactgaaaatgaatccgtgaaaacaccgaaaaatgagataagtggatctgctcttgcaccgtcaatagatagcttcagaaattgaccttcgacaactggaaattgaaacagcctcttgtaaccaattgttgtgccttcaacaattgtttgccacaattcatccaccaagatttccacacggaacttgattacacgttgtcccatctggataggctcctgaagctggatcacattgaatgaagcagattgtccgagatcaaagagcatttcccaggagctctgcccttcctctggagcccagtaagagtatatgctttcctgaagaacattggagggtgcaaactgctgattgccaaggccaccgcgcacggtgcttgctgtgacagtggcatttgcagcaaaattctgagagaaaattgtctgccgaatctcagtaaattcctgaaggacttgcatatcttcagtagaaattaagccagacgaatttggggggacattcaatatgagtaggcagtttctaccaactgatttgtagtatatgtcaagcagagttgtggcattttttggtttctctgaggcatgccaaaaccaaccaggcctgatagaaacatcacattctgcaggaacccagtcttgcccaaaaggatcaccacagcgtgaatatctgataatgaagttagcatcttagtaaatagactgttgaattctgaaatgtaggatgcttgtcaataacaagcaaatctctacctcatcaaaagtttatcaaatccaaaatagtccaggctgtagaattttcatatgagatgtaaattccaaaataaagatgaagcacaaaatatatctcatactagaaaaatgtaagtccatcactgctataattagttaatgagccaagggcaccattctaatttctgtactgcacaaggattcattgaactctgtggacattcttgtggctaattccattctctaagggaatgtaacatctaaagtctaaaccacataccactgaaactattgattgcactgtaaattttccttattgatgaggctacacaagaaattaatttttacaggctttgcaatagtagtctcttactcatgctgtcgctgtcacgcatgcacactaaaataatgctgaatagtagcactctaatcaaataatttcaacagcctattgtcatgagtaatcttccttaacttcaaagagaagaaaaccacattgtttgagtgttacaattagttactcatttgagaggtcatcattaggtacttttgcaaggacatcagtaattgcttaaactttaaacttatcacggcagacagttggaaggaatgcttggagttttggtcctatgcatgatacaattttatcttcccacaagtaaaaagttgtcttgttcccaaaaaatatttgcattacataattgaaatttccattgatgtgatttgggagaacaatttagataactagaaaagccttttaagaagttaggtactctgcagacctattagagttacttaattccaattctagcatttttatccaggggactagggatatgattgattaggatcttaatagaagtaaacagcactctgttttttccccagctcaataatactgttacttactcaggaatgatgtgcccaatcgtcaccgtgctcttattgaaaggagaccagcaagtataacctgcgacccctgcctcatctcctacccatcttgtatctggtccagcatctgagaagatgacaaccctttgctggagctgatggataagtgcaaaccaggcatcaaacatgtaatccatgtccttgccctctccctttgcaccatcaagccaaacttcctccacatctccatacctgcacttgtatagtcagaatctttacacaggagaaatcgtgtacagtaatcaaatcgagtgtatgtagtttactcgaagtccaaagcaaaacaataaatgcgtagggattaaacattccattttcatagataattgcgtagtgattaaacattccatcatcatagataattggaataagggtagtgactcatgaaaaaagtgtagcgactttgattaaacaacacaaattaagcactgactactgcgccccgagaaaaagttcccaaaaaaaaaacccactaataaacataactacttttgatcaccaatttctgaaaaggatcatgcagaaatgcaatgttagtttatgttcccacaagcgcacagccacatctggatcgaagctctcctcagcctgaacccaaaattcagtagtcgacctgcaagatccccattgacgaatacaacaataatctcgcaattcgaacgcaatcgctgacatacctggtgagcaattccgtcatctggcccaagtagtgctcgttgtacgcgacggtgtcgccgtacaccggctcgtgccggtcccacggcgagaggtacagccccagcccgataccttcggcgcgcgcggcggcggcgagctcgccgacgacgtcgccggcgccgcccttccacggcgaggcggccaccgagtagttcgtcagggccgagggccagaggcagaagccgtcgtggtgcttggccgtgagcacgacgcgcccgaaccctcccgccgccgccgcgcgcgcccactggcccgcgtcgagcgcggagggcgcgaacacggccgggtcggcgcggccggagccccactcggaatccgtgaaggtgttggggccgaagtggaggaagagggccatctcggagagctgccactggagctgcgcgtaggaggggacggggaggaccggcagaggcggcggcgtcggggccgcggagccggtgacgccatgggcgcggaggagggggaggccgacaagcaacccaagaagaagaagaagaatggtcgccattgtcactcggtgatccctcgatgagggtgttcagttcacctcagcgtggcgtagagttgactgctctatagtttctgttgttgccaacggctgattattgaagaattaagaacaccgtcaagaaatgattagctataagcaagaaaaaatcaggggaaatcttgtaaataatctgaaaacatggacacgagtaggggaatgaataattgtgtgtgatgtctagccggatttttaatgatgtgaagttaagaaagaaaaagaaaaagaaaaagaagaaaataatgcaatgggttaattaacagatgatctaatagatcacatacagtatatcactgcatataataccatccataacactaaatcattaattatttactattattacggataaatcgttatatcagctacatgtacattatattgatatgatgtggaacgattatataaaccataacccattgaaccattgttcaagtcaacttatgaaagaacatggagtacaaatagattagagaataatgctatatttttatattgtgggaaaaagaacaaatatattagagaacgttgctacagagtatttgttaatcgggttgttcactgcataacttaatattttcttcgagtaaaaatgttgctacagggtgataaatgatttaacttattctaggataacaattatggacaaaaattatattctattatcttaaaaaaattatggagagaaatttcaaatgatgtcgtcgttgacatatgaatcccatgcgatttacacattatatataaaactagaatattaattatacaaatctatctgaaataattatgttgattatctatatgccacaatttagtattaccgattactaatcgccttgcataccaaattgttcttggaaagtccaattatctgttacaaatatatgcataaacggaaatatatgttcactttccgtggggcacacagacgaacacatcgcgggggattaaccaggccactcgttcgctcgctcccaggagctcctccactcctcgattcccgaatcttcccgccgaaggaatgtgctggtgtgcgcctatcgccaccgcgcccgtcgccggcggccggttccctccgccctctctccgctgccgccgtcgtcgagggagatcggtccgcgcggacgcctccccggagcccgtcgacacgcagcggaagaaggtcgccgtcgccggggccggctgggcaggcctcgccgccgcgcatcacctcgtcaaacaggtctgctctcgctgctccgtggcgccggattgctcctgctgcattcgcgttctcgattcgtagcgggcaccgcgctcgttcgcattatccgctcgtgtgggcgcactcgcggcggcggaattttctcccaaaatttgtttccttcgccgtctcttttgaaacagcagtgacaaatacgcatctgccagtacgtggagcagagaagttttggtgggttttgttcttcatcactgtactttccattgatcagggatacgaggtcacgcttctgggggccgagagcggcccaaccgaggagattggtctcagaggtaaaattttcttcagctttcagtttacaactgttaaaacttggtgtgccagttctgattcagtaatccttgaatcgtggcattgcacatagggttttggtacccataccgtaacattttctcgttggtggatgagctcgggatctcgcctttcacagggtggactaaagctgcatactactcttcacaagggcttgcagtacctctctctctatgttttacttgcgaaatcgttttttcttcagcttgaatgccctcaaaattgtgatgtgcatggatttacctagtttgattacgaaacaaactagtatttttctctgtatattttagtagctttctgataagattgtaaaatctgaattacagaaggaataattttcttctaccatgtgcatattgaatttagccttatatttttgtggtaggtttattttgttagttttcttttctttcaaaattcctcataactatttggataacatgcacaaaattagaggatagcatgccatgttgtaacaatccatccccatgtatcatgttgtttcacgccgaactttgctctgaatttaaatgatctgagggacattattcttcctttaactctgatagcattgcattgttctgaccacttgcaggtggaatttcccatttttcatgaccagccccgattaccagctccctttggaatgttaacatatccagaagtatgatttattccgtctggatgtgttcgctgctacctatctctccagtcccaaccaccccatattctcatactatcctaatttttctttgttacagttcccaagtcttcctttaattgataggttgacatcgattcctgtcatggctgcaggtatgcacgtccatctgtccaggttctgtctttaaatgctaatggcctcagttctaaccacttatttgttgctttgatctagtcattgacttcaacaacacagacactgcttggatgaaatatgatgcaagtgaggaaatttagtacatattgcacaatttataagagttgacagctatagttatagtagatcatttcttcctcatgtcttattgtcatatttcctgcagtgagtgcaagagatctgtttaagatgttcggttgctctcaaaaactctacaaggaaatttttcaaccagcaattcaggccgccctgtttgctccaggtgagcaatgcagtgcagctgcaacactggggatgttgtattactatatgctctctcatcaggttctctgttctgtcttgcccttactttttaccccttttctttcttcttatcttcattcaaatttacgttgatcaacaaagctctttccaatgatttctcagaaattcccaaatttacaggaaaactctgattttttgttgtgccgtggggaagtggaagacataattttctctccttggttgaaatcactggaactgcaaggcttaaaattccatggaaacagagtgccaacaagtttggccataaataaggacactgcatgtatctctggaattgtctgtggagaggaggtacatgaggcagatgcatttgttttggctaatggactctcttcgctacaatatatcatcaagaacaggtatatacaagttacagaggtagtcactgcaagaatcttgggcctgtttcaccactaattactctcagtaacttggaagctaagattgctatagaaatacgtactgcttgaggaacagcacttttcttcacttgaaacatgtcttattttcatatatttgagtgcttctctgactattgaatttcttctatggagtagtccgtttctacagtctcggcaagaatttgttaatcttcttcatctgtccacgattgatgtggtctctataaagttatggtttgataagaaggtaatcgcaagtgacaaaatatacttcatttgccaagaagtaatacacattgttctcacatattttgtttttggtgatatgaaatgccagatcacaattccaaaggttgccaatgtttgttctggttttgatgatccatctaggtggacattctttgaccttacttcaatatatgatgattatgctgacaaatcaacaacaattgtggaggctgaatttgtatgtttcaactttaaatcaactaccccataacaaattaaagcacttccttccaggaggtatcttactgttatcaatctcttgttgcagtacaatgctagccatttgctgccactgaatgatgagcagatcgtttctgaggcttcatcacaccttatcaaatgcatacaggattttgaggaggctaccgtgatccaacaattggtcagaagatctcctaaatctacaatgcacttccttccaggtaaagtcaaactttaaccttattgcagtacaagtgcctacaggaatattgctcttgatgctctttcttcgtgggaacgacccgtgatgacaagacttacacccgtgctagctcgttaaactgcatcatgcttgataaaaataatcaagcattggttgtaaaatgattatgtgatagggttccataatcagaacatacacttgtgatctctttcagtgcacagttgtacactagcatctttagtatttataaaataacgctctaatttaccttacactgtctttcttgcctcttcgaaatacctactgtgatgcatatgccataaaaattacattacatgcaggttcttacaagtacacagtgcgaggatcaactaccttaccaaatttgtttattgctggtgattggatagtgaaccgacatgggtccttttcaaaggtgaccgagtaatatgtcacacaatgctttggagtcattacaaatttattcatgaatttagaacttttatgtaggaaaaggcatatgtgactggactcgaagctgctaatagggtggtggactattttggtgatggcgactttgcgaaaataattgcagttgaagaagacgagcctcatatagagacagcacggaatctcaatagaagagccaacgaattaaagactcagattcctttctcggagttctttctctaatcacataactgggagcttttcagtatgaccatgagatttatgctctacaactcattcagaaaaaaggtcaagccagttctcacttccctttttccccttataggtcaaaccagtttttcgtacataaaaaaaaaaggtcaagtcagcttttagtatgatcatgagatttatatttcttttactgttgtgcatattgacctgacagacctttgtcattgacgcttcaactgaattaagttagcaataattaaaaaagtagaaaagaaggtatatccagtcttctggagttgcggtaggtaaatttcttgattctatatatgtttttatttgcatactggttatcaacaaatacacatactagatcaaaccacaacagccaaagcaactgcttttggggttaacttttttgcgtttcatctgcttgcagcatatactcgaacatgtctatacaaatttattcacaaagagaccagagagtttcctcaggtttgtattcctttcctcatcatttccacaaactcttcatagtcaattctcccgtcctgtgaattcgatggaggaaataattaaatccatgggaatgaccctaattagtgaaaataaaatactttaggtatgctttaccttgtctttgtcaacttcatccagtacttgtttaatgtttgcttcatcacccattccgtactctgccatggcttgttccagttcatctcttgttatgtacctggaattgtttttcatggtctcttgttaatatatactgattttttaacaaacgagtttatagcaagaaaaatatgatgcaaggaaagcatgtgttagacatcgttacacaatgaacatgattgttgcgcagaacaagttccagtgttggtcaatttagagctctttattcatggtgctgaacgagataaaaggatgtgcattggctaacaaaatttattttacccgctgttatctttgtcaaaatgttgaaatgcacgaagtaaatcctcctccttttccagtttatgcttatttatcatagctgtgaggaactccgagtaatcaatgctgccactcttgtctacgtcaacctgtaccacagtatcactagtaaaatccttttgtaaactaaacctgcagcgaagagttagcaaaagcaaatgatcttactgcttccataagcttctgaacctcggcttcactaattcttgatcctagctttgtcagaccaaccttcagttcttcaaccgtgattgtgccacttctgtctgtatccatgttattgaacatctgtttcaagcccttgatttcctctggtgataggttctctgcaattaccttgagatgaaaggaggcagcgtgtcaatttgattttagccaaagcatagtagttatccctgttaaggaggattctcaccttaagagctaattgctttaacttgttcattgccttgaattgcttcattcttgataggactgcgctatcgataggtctgtcagatgcaccgccttctttgagccatcgatgttctgcagcatggagacatccatttaaagagttggctacactgtatgtatatatacagttgcagataaattttacattcataaccgcagattagaatagcgaaacacaattcaggtgtgctacctaaggcctgcgatgcagtaatcctcttctggggatctctatgtaacatttgtctgataagatcctttgcactttcagatatcgaaggccacgggctggtactgaaatcaacttggttgaccagtatagcatcgaatatgcctttctctgtctctgcgcagatattcaaatttgacaattatctccacgatatacttgatagaatgtagcaaaattagccaaagagtaaatatgtactatggatatttacctgcccagaatgggggcgtcccgcatagaaggatatacaatatcaccccagcgctccagatgtcggcttctttcccataatttcgttgtaacacttctggcgccacataataagcacttccgacaatgtccttgtacactttacctgcatttgttgttttgttgttggggaaattttaccttagcttgtacatatcttgttatggcgagctaaggtacgtgcattatctctcgcaagatctttcaacatgcatgatcgatgcatttctgcatctgctttgatattgtacgtttctactctttagacccgtgcatttctaacagccaaattaactcatggtgttgataaaggggggaaaagaaagaaagaaagaggtagtgtagcttatgtgtgatatcgcgaccctgaccttcttcgatgaagacggagagtccgaagtcgatggccttgagcggcgcgtcgtcgtcggcgctggcgagcaggaagttctccggcttgaggtcgcggtgtatgacccccatgaagtggcagacgtgaacgacggtgaggatgtcccggcacacggcagcggcctgccgctcggagtagctccccttggccgtgatgcggtcgaacagctcgccgccggagcagaactccatgacgaggtgcacgtggtcgttgtcctcgtacgcgcccctgaactccgcgatgttgggctgcccgctgaggtgctgcaggatggtgatctcccggcgcacgtcgtccacgtcggtgcgccgcaccagcttccgcttcgacaccgacttgcacgcgtaccggttccccgtcgcgcgctccgtgcacaggtacgtcgtcccgaactgcccgctccccagcttccggtccagctggtacagcgaccgcacgctcaccatcgccctctgcagcacggggcccatctccccgccgccgccggacgccctccgggacagcgcccccgccgccgaagacgagcccgtcggcggccggtgcggcggggccccgtgcctcgggaagctcggccgccgccacgtccccggctcatcgccgccacgcgccttgctgcgctccgcggtcgacgccggccgccgcatcgtgcccgacgtgatgggtatctcgtacgtcttggtgaagcagttgcccattgcaaagcctcctcgtttcctttccttctcctggggtggcgccgagacgaagcgagggtggaatggtgagttgggtttgggagaacgaggagccgaggttttgaagggtttctctttctctgcgcgggcggtgggcggcgggagcggagttgcttgacgtgatgccctaccccttcgtttcgctgtttgcttttggtccgggctttgagctttatgccttgtttggttatctccggagggaaaggaagattcaaagaaagcctcgggatcacgctatctcaccttatgcaggcagtacaatatacttgcggcggtgcgacagccgattttattcggctttggaggtgtagaaacacatagcactacgtgcttttattgatctagcaatagccattttacttgagggatatgctgtactagctttcggtaacatcgtcagaatcaggcgcaggcagcactaacaaagtacgccccttttcagaacggaatcaacagtgggccggagtaatgtgacgagccaagccggcccagaagatattccggcttacaaaactcagagcggaatcaactatgggctggaggtaatgacctggtaagtctatcttgactcaaaaagacgttttattaacatggtggcatgtgctttcacggcttctggcctcagcaagcggtgacgcgcgctctggcaatcgctaacacccggagccgcctcgcccgccgcccgccggtggcgccccgcgtcgatcggctaggggcgaggggctcagctgatgtctacgctacgcgagagagcgggcggatgccacctcttccactactaatctctttcagcggcgcgtggcctgagcagggagagtagcagacgcagcagcgccaacctgccccgtgacgggcaccgcgcaccatttcggaccgatatgccgtgacgggacgccgcattgcgcttctgataaagcatccggagagtcaaactcgattcggaagttcagtgtacttcgtcgcccacacggatgggttgggggcatgaatccgaagtgagatcatttccatgggaaaagaggccaaaaagataaactaaggaaatagtccattcatgtgtttctctccaatatacgtcataaaacctttttttcttctctttacggatatcaatatacaaaagttcctttgaaggctagcatatgtgtggtgtttgcagtccaaggtaagaaagtacagtaataagtacccttggtgaccgaccggtacagttcttcagttatcaattcttctcagattaaacagctgtggttgtatataacaagtaaactggttttcagaattgcagcactagagtggtgtgaaggcctgaatgggttcatcatgattcttgatgcaaactcagtctaggtctttctttgtccttaattaatatatatttgtgaagacctaacttcgagtccagaaaacaaaaggagcttttcgttgtttcttttgaagcctagtaacaaaaacgaaggaacactgtgttaaaccaaaactaaaaaggaagaatatgtgaaccttttgtatgccggtaaggccgtatggaatttcaactgcactcgttttcaaattaatagatgtggttgactaagtagaaaaaagaaatactagtatgctgatgcaagctagtgtgatccaggggttcgttttgtttcttgacacacgcttgagtcttattctttattaccccaaagcaccttcctaatcctacctattactttggttaactttagaagacactgactctaccaactaacatgtaagcaaacactagttgcataaccgttggttgagaagagtagacgagaagggacccagtctagtagtattcctctagaagattaggttgctgtagccatgactgtgagttgtgactaggttttttcagtgggcaaggcaacaccctacacatgaagccttgaagagttggtgtatatatatcagatgaccctgttgagcctgaacttacaatttagaaagaacaaggaagacagcaggtgacacctttgcggacacaccaaaactgccggccatagcccatattcccacaagaagatggcgatcccggtttacagcatcacaagggcagagatcgaggagttctggaggagaaaggagatggaagaagaggagcagcgcctcaccgccgagaaggaagctgcaagaatcaaagccaagacacttatggtcagttcttcttcttattgatcaatcgtaatttgttgtattaccaatcactatctcgtcctctgatctcctttaccagctcaggttcagtatggttcttagtcaaaaaaaagttcagtatggtatttagcatagcagataaatcgacgcatgtaaggcaataaaaatctgcgatgcagatacaggccaaattatcctaccatgaatttggagttcaaaaatactgtgacttgtggtgtctgaattgtttgaaaagcagattgaagattatgcgatcttcgagcaaatgataagggagattcttgaggagggtatcaaaggtgacagcgcaagggcggagagagacatcaccacgaacggcgccgctgccaccaagagcactgagggaaggattggcatcaaagattggtaaccgttctttctgcaaatttcctagagttatgctatccgttctttctgcaaatttcctgaagttgatatagcagagtgcgtccctttctaaatagtgcgtttccacatcctctttggaagttggataatggtccaatgtggaaaacaatctgtatcccactttccatccatttccacggttggatttcctgttacaattctatagtggaatttatagtcaagaagaattatatggatgtgagaattaagaacctaacaagctcaacgtgtagttagtcaaaataagaagcaacgcgttaagatttttttgtaacagttctaaggatcaagacggctattttcgtgtgcatgtgcaatcgcttaaaattctggtgcaattacgaccttagcatcctatcagaagtaatcttaattacttagtcttcaaaaaagaattaattaaatagctgtggatatgactgaccaccatcttgcctccctgggtgcaggtggagaaaaagcacttatgcttatctgaatgaaccagcaatgacatccacggatgagaacggcagaaggaagcacgccatcaaatacatcccacaggagagatgcatgaacttcttctcatcgattccaagtcaacataatactactacttttgcaatcttctaaatgggcaagccaatgataagctgaggcatattggcaaattagaaaatatgcaagtggtatatgcatcagcaatgctatgggtggaataaactacattgtttttaagtgtataagtatgtccaaactgaatggtactttaaagttaatcattttgtaaccttgttgccttgcgtggtatagaaagcaggccattttaacttattattcattgtaaaaaaaacaattttagttggtgcttgcaatgatatatcagaagctattgccaacacttctgtgatggtatcacgaatgttattcggcattatactgttcagcacacgtaacaatcttcttgcatatacactcttatctgtttgaattgattaaccttgcaacatcttatgtatacatcagttgtgcactgtatcttcaaatgtacaaaatatggccttcttgaacattgtttttattttttaaaaaaggctagttcctcttagagtaagtttaatagtatagcccactactagctccaaatcatctatagccaattcatacaatagttgcttactatactattaatactcggtcccacctgtcattgacatattacgacttagagtccgtgctgcagctggctacagatctgtagcctgctgctcttctctatcttccttttatctctttaaaatatgtttatagttggcatatagcctgctattgtacatgctcttaagtattactctatcttttttccccttcctgtacttgcttgaagtgtccagaggcaaccaagttctgtgaatacgagggatcaaacaaacaagaaacaggtaaaagaaaacaagtgtaagaaaacgaccttacaactaaaaactgatgttacatatctttgtcctcacttttgctaagataaagaaacagttctacctggaaactatccaagggataaaaaacaagttttctacacaagagtcatcgctagcatacaacaaaaagagtgtcgcctttgttattttgcagcgtactcggatgctgacatgttgttggctaagaaagtgcatagataacttcattagttccactaaattagattaccttggtggatgcttgagcaggtaggtagatagcagcaatcaaaggtgtctgctctgctctcctctgcttggcagaatttcattctgaattttcgctctgaagttagcagtgaccaaagcggagtagagggagctccacttcattttttttaacagatcaatattacaatttgaccaaactgaacctgtttgcccaaattggcctgttgcccgagcgtttctctcgaggaataagttcactttgggtccctctatttgtcgcccagtccgattttcatcccttgaccacgaaaccggatgcgacccgtcctccaacttacgaaaaccgggcaaacaaggtccctcggcggttttggctgacatggcgcctacgtggctaatttgactcagtcttcatctgacgtggcacttacgtggcaattcgatccggaaaaataataaagcccatgggacccacatgtcattttcacatataaaataataaaaaaaaatagtgggacccatgtgggccccacatgtcatactcatcccccctcatcttcttcctccctctccctctcccctctctccagcctccaggcgccacggctcacgaggtcacggggaggtccggtggtggcagctggcgacgcgacagccgccgccgccggcgagctccacctctcggcgcaaccgtgcagccgcgtgcgtttctgatcccgcgcgcgcgtggctgtctgacggcgtgggtggcacagatggattcatggatctatccgtagcgcccccctcccccccctcccgcgcgatgcgacggccaacgacgtcgctctgatgccggcgagagagagagagtacatcttcaactgccagcattaatttgcatcgagagagaaaattagcagtagcatcaaataatatcatttcagtttcatcgcaattaagctagctagccatgtgaggagtcagttcgatgcctcgatcgatcgtcggcgtcgaagaggggtcaagaactcaagattaggcgatcgattccatctgacacatcggctgaatcatacgagctaccgtcaattgagtactcgtactaacgtacgcgtgtaaatgctactgactgcatgagagaaactgtacaagtcctgtgcttacacaatgtactacggcctagccatgatctatatgatgcagcacaataccttttaattaattagtcgatcgacaagcgatccatgcatgcatgggagtaatttacaggcttcgagttcatacactgttgcattgcaacttgcgaaaaacacagtgctacactgagaatcaatgatggccatccgcagctaagtgatgatctgtgagcaattagcaattaccagttactgacgagaggtgagtaggtaaaggcattactagcaagaactgcatcggaacaaagttcattccggtggtcaaaactcaaaaccccagcgagctgaggcatgagagcgacgtcgccagccgtcgccgcctcgccgtcgtgtcgcggcggggggggggggggggagt

SEQ ID NO: 77231 - DNA, 15370 bp, Oryza sativa
gggattagatccatgaatccattcgtgccgcccacgctgtcagacagccacgcgcgggcggggtcaaaaacgcgcgcagatgcacggctgcgccgagaggaggagctcgccgccggcggcggctgttgcgtcgccggccaccaccgtcggacctccccgtgacccagtgagctgtggcgcctggaggctggagagaggaggggaaagagatggagagaggggagatggaaagggaggaggaaaaagatgaggggggatgacatgtggggcccacgtgggtcccactttttaaatactatttatgtgtgaaaatgacatgtgggtcccacgggctttattattattttttgatcgaattgccacgtaagcgccacgtcagataaagaccgagtcaaattagccacgtaggcgccacgtcagccaaaaccactatcaaaaccgccgagggacctcgtttgcccggttttggtaagttaggggacgggtcgtatctggttttgcggttaaggagcaaaattcggactgagcgacaaatagaggaacccaaagtgaacttattccttttctcaatcatgtactgggcctgctaaccactgtagctacatgggccaaaagagcagcaaaagcaactcgcatccataacaatcaatggatcgtggtctttttttatagctcacatcgtttgtaactttgtatcacttgttggaccggagcaaattctttttttataaaagagattttttagggtctaataggatggtgcggtaccgaatatggacaattgaatctccaatggattaaaaatggtggtactgtgaggtaccatcgaggtcaacgggtcgtaccacggttgaacaagtaagtgcaaagggcatcaacgtaattttgcatgggagtatagactggatcaacttgagtgcggcaactgcaaaaatctgaaacctaagtcgtcacttttgaccgtgcttgccctcttgtcaccgccgcaatccttaggtttagggcaccgccaccaccctttctgtactcctcacaagagtccttttcaccacaacaatattcgatgctgcagagctcatcgcatgtatcttcgtgatatcatcgcatttgtggcgctcctcggcggcgctcttctcgctacaacggtcatcgatgccacgaatctcactgcctgtctcttcaacggcgagcccgttggcacagtggaccattgcagaggaggtggggagatgtttcctttccagacatggcactggtgaagcccttgctacccctacgtcagcgaagtctttggagaacgataatggggttgacgactgtcgatgctacccatcctgtccatcacaaatggacggttagattcgatttggtacctcaaggtaccacttgttggacctatagatgatcataaggcctaaggccccacggcccgggccaagcacggcatggcatgactggtgttgggcccgtgtcggccagccgacagttggcccgtgcttgggccgatgcctttgcacggtgggccggctcggcacggaacgatcaaagaaaaatagttgaagcatccaaaatagacttaaatcaaacatataaggcatggtccaaagagaagagggatgcatcatagacttattccagccatatagacaacccaaaagagataagggacttattccattgagaagcaggatgggttgtcatgcttttgggccggccgggcacggcccggctgacctcggcccaggttcagttatgcctgggccctgtagggccgggcggcccgtttggctatctatagttggaccggagcaaattccctcacaaagaggaaaggagaatagtggtaatctcagaattctctatagaagtagtaatatctcccacggtaggatggcggaactcaagtcttgttgtgggtttccgtgtgtcgacggtgggtacccgtagaccggatatagagggtattggggtacactggtacgaggatctacgtagtacgacatcaaggaaacaagagacatagattatactggttcaggcccctcaataggtaatagccctaatccagttaatatgggattatatggagagaaccacaaattacaaagggaataaatggaactcgacgatacccacgagatcgtagtcgagttgattcgactagatcacccggcgacttggctcctgtaggctccggcttcgtaggctgtggtcgttgtgttggctataagattcgatgccttaggtcctcccaggggtcccttttatatcgcagatcaggtggtctccaagtaggacttggagacatcggaccctgcatgatatagtgatgacccagtcctatacgggtaggaacctttccattagtggacttcgtgatggatttccttagcgtatatagagaacgtccgtacgcgcgcagatgtaccatattaccgtatagcgtacatccaaaggtagagggtatagtttatccgtaatcctgacaccgtgtccaatgtatgactgttcgtcttattaaaaaaattaaaaaaataagttaggtataaagtattattcatgctttatcatgtaaaaacaataaaaataatattcatgataaaattttaaataaaacgtatagttaaacgttggacgtaaaaaatcacaaatacacttaaaactggacatatggagtcaaattttcgacacattttgctatcagcaacgggtttccggaggatctctgccccagaagtgggtcaaacgcacgtgagatcccgcgaagcacatcaatggaagaacgaaagcccctctccctttttcttttttcccttttccttttcttttcaagccgtaatgaagagatcgagcgagaggcccaaaatgaccagcacagtgcgccgccgctggtcgcggagatcacttccctccttccgagttccgagcagtctccggcccggcgcatgcatgccccgctcccccccacgcatatataatcctcgcccgcgacgctcccgcgcccgggtagcttagacgaccactgctcatcaccccgttgctctcgcgccgccctccccgccgagccaaaaagccttcctcctcgaaatagcacacctctcgccgccgctggtgcgtgcgtgcgtcgacgcgcgcgatcgatcgatgcctgtgtccctccggcgcgtccacccacgccagccggcgagcctcgtcggcgagtttcgggggcgctgattagatttgcccggtctcgatcgattgatcggtctcgccttcccgccgcgcgatggatccgcgggggaagggcagcatcacgtcgcatgcgtcggacaagtcgtcgcggtcgggctcgttcgacttcgagcacgaccaggacccggaccgcgaccgccgccacgacgacgcccaccgccgcgaggtcgtcgtcaagatcgagcccgaggcccacgtgccggtggacctccacgccggcggcagccacgccgccaacgcgccgggcgctggcggcgtggcggtggggggcgtggtcccggggtccgggtcggtgtcgagcgcgtcgtcctcgccaggcggtgggggcaacggcgagtcgttcagcttcaagaaccggccgccgcagtcgcccgcgtctccggcgatgagcgtcggcggggagggcagcgacgacccgcccacgcgtctcattggcagcttcttgcgcaagcaggcggcggccggcggcgagctggcgctcgaccctgacctggagatggaggagatgaggaggccgccgcgcgcgcccacgtccatgaacgcctccagggagctccgcgtctcgttccaagacccgcacaagcggttctccccgtcgacgtcgtcggcctccacctcctcctacgccggcgacagcaggaaccaggcttgcagcacagcggaggcggccgaggtgatccgctgcacgtcgatgtccaccggaaacaacctgttggcgcggagcaagacgcgttcccggctaatggatcccccgccgccgacgatcagtcaccccaccgaggcggagcgcaacgaccgcaagtcgttcgtcggcaaggggccgcccaagtcagggcagctccggtcgggcctcatcggcaagtcggggctcatcggcttgtcaggccccatcgggaagcccggcgccttcgacgacgacgacgacgacccgttcgtggacgagggcctcgccgccgacctcaagcgcgacacggtcgactgcctcctcatcctggaatgggtcggcctcatcgtcatcatgggcgcgctcgtctgcagcctcagcattcgcagcctcgccaacaagaagctctcgggtctccacctctggaagtgggagctcctggtgttcgtcctcatctgcggccgcctcgtctccggctgggtgatccgcatctgcgtcttcttcgtggagcgcaacttcctgctgcggaagaaggtgctctacttcgtctacggcgtgcgccgcgccgtgcgcaacgtgctctggctcggcctcgcgctcatctcgtggcacctcctcttcgataaggacgccaagcgtgattcccacacgctggtgctcccttacgtcaccaaggtgctctgctgcctcctcgtcgccaccgtgatccgcctcgtcaagacgctgctgctcaaggtgctcgcctcctccttccacgtctccacctacttcgaccggatccaggacgcactcttcaaccagtacgtcatcgagacgctctccggcccgccgctggtcgacgagagccgcatgctcgccgaggtgcagaggctgcagagcgccgggatcaacatccccagcgagctcgaagcaacggccatgccgagcaagccgcccatgccggccaagagcgggcgcctcacggtgaacccgtcgaagcgaggaggagcaggaggtggggccaacaagcagctgcagaagcagaaatccgaccgccattgcgacgacgggatcacgatcgaccagcttcacaggcttagccagaagaacatctcagcttggagcatgaagaggttgatgaagattgttcgttacggggcgctgaccaccatggacgagcagatcaagcatgcaaccggagaggacgagctggccacgcagatacacagcgagtacgaggccaaggttgctgccaagaggattttccacaatgtcgccaagcctcactccaagtgagtagcagcgcaccagtgctacacctgtttttcatgtacaaaatcttgttatcaaatttcatggctatatgcctatccattcctgaaatgtcaacgtgttgcaggcacatatacttgtcggatttgatgcgtttcatgaggcaggaggaagctctgaaagcaatggatctttttgaaggcgcacaggagcacaacagggtcagcaagaggtcactcaagaactgggtggtaatgatattgtcaatcttgacacagtcacagctccttttaatctgagagacacaaaatgttatgcttaatctgtcatgtgaactatgcaggtaagcgcgttcagagagcgcaaagctcttgctctaacgctcaacgacacaaaaactgcagtgaacaagctccaccagatggccaatgttgttgttgtggttattgtgattgcactatggctttccattctagggatcgcgacgtcacgcttcttcgtcttcatcagctcgcagcttcttgttgcggttttcatgtttggcaacactctgaagaccatctttgaggcgattgtgttcttgtttgtgatgcatccttttgatgttggcgatcgttgtgaagttgatgggatgcaggttacaattcttttcattgttctatctgcattgtatgattgcttcacactgtctgacttggttctaaactgttgcgaaattcaggtagtcgtcgaggaaatgaacatcatgacgacaatcttcctccgatacgacaacctgaaggtctattatccgaacagccagctcgccatccaaccaatcatgaattactacaggagtcctgatatgggagatgcagtcgatttctctgttcatgtcgctacgcctgtggagaaactggccctgatgaaggaaagactaatgcagtaagtatcaatgcattaacctcagtttttattgtcttaaatcatttttctcctgaacattccatgcacaagaatgtactacattgactgctttagggttatcaatcatgtcatttgaaatttcagttaccttgacaacaagaaagaacattggtaccctggatccatggttgttctccgtgacgtggatgacacaaacaagctaaaggtatccatatggtgccgtcacacgatcaacttccaagacatggggatgagattcgagaggagggagctattgctccaagaaatgatcaagatcttgaaagatctagacatcgaataccggatgttgccactcgacatcaacgttcggaatgcgccaatgatccagtctttgaggatgccatcaacatggataacgtattaattcttcttgaaatgcagtaccaagttaaacatgcctgatcagttcagtgatgagattatggtttgaagttgctaggtaggcagccgtatttcttgagtaaggtgacgtagtactgtaactgaagtgcccttctcctttcctccatctccttcttgccaagggcatattcggttgagtggattgagctgtgacagcttgccaaaatagcaagaggccgtcttactgtccttgcagccaccgcttgtgctttcctgtaactgtagtgttatgtgtttgggtacttcttatgagaactttagacatgttgctacttaataattttgatgacttaatgcatcaaaagatgaatgcaattttgacagcaaaatacaagaatatcgatctaaatatctaatgttagcttgcagcatacagtactagatctcattttacctggaatttttatgctctctggataggttaagcaggcattggcctgtcttaacaaaagaaggcagatgcttttgtttcctgtttttgccctggtatttgcttcgcctagaataaggttgagaaggatttggcatttgcatttacaaataggcatgcacttctttgtttctcgaataaaaaaaaccagttgaaactgggcagcatacatcatagtgctggaaaaggggaggcaaccgtagtaaaaatagataaatttaagatgaaatggttcatttacaaaggcgacctggacactgacaaaaatgaaacttttttattaatattgtttcggggaaacaaaaaatgagcgttctgtcgttcgacacaagaaaacagagaccagaaggtccagaacaggtgttaccattgaactctagacaagttcgttcaaagttcaaacaaaataaataaatctctagacatggaaggctcgacgctattaaattccacctactgatccttggacctgtggagaagttgccgggcgcggacgcgtacctgaagccgcacgagcaccttcatgaaccggatggcgacgcccgcctgcttccgcacgtacgagccccgcgcgagcgcctgcagcttcaccaggctcctcagcgcgcgaaacgcccgcctcgcctgaaatgaacggacacgcctttctgaatcatcgtggcagcctttgcagaaatgcagcggtaaatgcggccgggttaacgtgcgcgcgtaccaggtgaccgcggaagccggcctggatggtggccgccgcggcctcctctcttgagatctcctcacggttgttgacacctccgtcgcgcgctcctttccccacacgacgcgcagccgtctgacgccttggttcgacgacgacgatgccggagtcgggtgccacggccgtctggccgcacggaggagaccgaccgaagacacgcttcatcccgctcatcaaccggcgtaggcgaggccgaggcgtgggccgcgtctggcgttgccgagcattatcttcacgccgcgtgccgaggcagcagaggaggttgctcctggccatgttcatgtggttgagatggcggcgatgctttggtggagacggaggtgtgcagtgtggttttgggccatttttggaggtgctccagagacacccgagtcttggtggaaagttctcaaacaacgtggcgggatgaatcccaaccgacgaatcgcgtgcatcttgatttcttgaaccggatcttttctcatgccgtattattttagcgcaaaaataagttcccgagaatctgacaaaactcggaccatttcatcttatcattcgcgcacttcccgccaacactccgatttgtacagactttccagttcccaggtacaccaaaacagagcagctataatggtcatcgaaaccagagcaactaccggtggccgcgactgacgaccggtgcccactaggaggcgcagcgcagcgaatgcagtgacgcggtggtgtccatggacgcggcgtcgaacacgccgcaccgttcgctcgcctcgatgccgtagtccatgagcggccgttgctcgagctcgtcgtcgtgccggcgcaccgcctccgggacgtccagctcccccttgcgcacgtgcgcccacaggtactccaaccggctcacgtacctcagcttcccatacaatcttcaggaaaaaaaaacaataacacaaaaatcgcttagtaagcaaatcgatactccctccggttttattttaattgacgatttagacaatgatactctctacaagatatacctttcccttatttttctattataatatatacaataaataaatgcatgtttatttttatatagtattttgaaagacaaatctatatatgtttttctagtttttttaaactaaatattttgacagttattgatgatcaatattataaaagtttaacctcaatcttgtccaaaacgtcaattaatatagaaccagagtgagtaatctctagtacggcctaacatcgcgcgtaacgtatgtaccctgagctgaagaggaaccggccaagggtggagaagaagaggcgggactggagccccgggtgaaggaagtacacggcgtgtagcctctccctgacagccgccggcatggactcgtacgccgtccggaccgcgccgacgccggggaagttctcgcggcgatccacgccggagtgcatgtacaccaccacgaactccgcgtccccgatcgccggcgtcacccgcctccgcacgtaccccttcagcgccgcctccgcgtgcccgccgccgcccagctcccgcgctgcaacgccaacaaaaacgaaacacccgctcgcgtcacgagcccaacacgaacgtactggcgtgtgtgacgtgtttctgccaccgtaccagggaagttcttgccgacgatgcggacgatgggccggccggccttgtcgcggccctggacggtgatcacccgcttcttctcgagcaaaatctcctgcttggtcatggcgtccatatcctctctggactgttctgctcgagattttcgcttcgtaaaactttcgtacgagcgagtatgatgccgtgatggtacgagcgttgttggggttaaataggtcagcgtgcggtgtggggacgatcagatcgagagctgttggatcagggtgaggtttggggacgggagacggacggccaggatggcttgcggtgttgggaacgcgtgccggcgtatggggtgggggccgcgggatccggcagaatatgcggaggatccgtttcggctgcggcgcggtctgcgtctcggcacggcgcgcgggagcggggcgtctggccacgtcgcggtgcacccaggtctcggcgttcggacgcgagcggggggccgggggctcggtttttcgcggcgaaaccgcgaaaacgctatatttaagttctgggtgtcaaattttccgctacagctccacatcttcttttcttgaaaaaacaaacactgcagtgtgtatatactcactcctataaacgcatatacgcacactttacccctaagtactcgttgtcgatgggtatgtcaaccactgaaaaattaattaactgtaaatacgatcacccgtgtaaaatatagtatttaaacccgggtggattggttccactgcaaagaaattaaccagttgagataggctcacttcgctaactccatctcttttaatagtgaagcccaaccaaacgatttcagctccacctaaaaaggtgaaccaggttgaaatactctcacaaaatgagttaaagttatagagttgtttttaggctgcttcacaatttcactttagacccagctcctaaaactaaatttagaagttaaagtcctaccgaaagagtccttagctgtcagttgccaatcacttttgagagtccatgtgtacgtacgaactcgtgtatacatataaagtttatacacgtatgtatgtgtaaagtatatatatgtatatataaaatattttttataggtctaaagtgtacacatacatgtgtgtgtaaaatttatgaatgaattttagaaaacttcacgttttatatggtaaaagttaaaaaaaacactgcacgtattataacacgtggtagatttttaactccaaaccctcttgggccatctcacagctagctattcgatgagggcctttgcggcccatataagcgatccgatggtgaatagtttgtggaccccacatgtcatgcacgtgataggttgcgttggcttttatatgggacgtaaactttcatccccgcctcgtttcctcgccgatgggcgatggccatggctgacggcgccttctgaaccattaaccaaccggttccacctcatcttggaaagaacgtgcagagcccgttcgttcacattggcagcctagcaggcaatggaagtcgccggcgatgtgtggttccctacctcctcagattgtgcgttccatggcatcgatcattctacggcggcaacggacacatggagcagtcaccacctgctatacagcgatgcggccagtacttgaggggaacagagcggatcagcggatagaaggtggcagactggctgtcaggatgcgacggcgctgcggtcaagcacgtcatgaagtggcggcggtgttcttgtaatcgacggcgatccatgccatgtcgcatccggacgccggcgccaacgacccctccccgtcccccaccccggccgcgaggtcgtctctgtcgtggatcttcgtgggacgccgacgacacgcggggtggacgacggcgagggcgcacggggtggcctctctctccctctcccgctcgcgtctgtccctccctctctctcccgttgctggcggccgcgaggtcgtagctgtcgcagatctttgcggggccgctatcgcagatctctggagtgtcgcgtcgccaccgctctccctccgtccgttggtgtcacggggttgtcgctaagccatctccgttgcacggatggtcaccgtcccattctctcccgcccactctcctgccccccgccaccactccggctaccgcccgccgccgctgccaccgtagccgtctccgctgccactgccgcctcctctttcgcctccatccgcgccagcaccaccccaaagtgcctccccaccctctctcccgatgccaccactccgcccccgtccgccgctccatcacccgccaccaccgctccaatcccattcctcgcagacgaccgacgggaagagaaagagagagacataaggggagagtgggagaaagaagaagggttggagagatgatgaccatgtggccccacggtcagtgggtccattgtattttttacgtgtaaatgacaaatgggtcccgcatatctatttttaattctaatattacataagcgccacgttaacaccacgtgggacgaaggctaagttaacaccgccacgtcagcgaaaccaccctctaaaaccactagtgcagtcaaattacaccggtttcaatagatcggggagtcttcttatccggtttatggttaaggggtacgaattagattcagtttacttttaagagagtcaaagtcagtcgactttttccttgtttttaactccgaacctccttgtgccatcttacagccgttcgatcagagcctttgcggcccagattagggcaaattgagttttgggcttgaagttaaactgtctcggtaaacactgggccgggagagggcgctagtcaccaaacaccaggctgtgtcatagctcacgtgcctctgttacatgtagggcaaattttgctacaggacattatgacttcgtagttttagctccaggacaccacacaaagtcacttttggggtaaaacactctcaaaacatgttatttgccaacagacaccgcgtccattaaaataataatttctggttaaagaggagagagaaatcgcgtgaaatgtcaaaattacccttgggcccacatgtcagctctcttatctctcttcactctttctccctctccctctcccctcccctctcttcaccgacagggagccgaagctcctctctccctcaacctgcaggccgaggaggccatgtccacaccgtccccacacgagcggcaactgtagatacagccagtagcggcggcagcaacagcagcggaagcagcaaagagcggcggcaacgacagtagcaagagcagcagcggcggcggcgcgacgagggtggcgctggcataggcggcgcgacggcggaggacggagtcgagcatctcgtgtcggagcatggggatgggggcgctgggtggtagcgcgtaggagaagtcggcggcgaggttggatggcgagaggacgcgcatgcgggtgacaaagtggttgacatggacatgcgggatggcgaactcgttgagcatgcaaagcgggatggcgccgccgcagggcttggcgccagacgagttgcgctcgaggaggaacgcctagtctcccacgaacgccaacgcctctggcgctgacgtgccggcgtggtcgccacccaccacggccatgcgcagcgggcaacacaggtgtggtggagctcgagcaggagatcacgaggcgacgtcggcgtaggtcggctcgagcaaatcgtactcgagcacgcgcgaggttgcgcgtggtggtgacggaacatctacttgtcgagttcgagctacgcgagcacgttcgttgctgatggttgttgccgatgcagcatagttgatgcccagcaacgtcgacgacgtcgcgtcggccattgtcgggagcagcagcgaaaacatggctccggcctccacgccccgcctcgcctcgtagacaaagagctaacatggaaggaggaagatacaaagagaaaagaagagagataagtgttgacagaaaacacgaggcctgggagatctgcttaactccagtgcaggtccaaagctcgccttcgagtgttagcgtgccagttgatttgatcctgtaatcaacaagaaatagaagcaaagaaatcgcgattaaatctataaatgatagtcgatcggctaggtgccgatgacatatcatttatctttgagccgatgacacatatgtatcgatcggcattcatgaataaataagaaggaactaaatctaatcgatcggctgtagataataacaatatatactccttatatcgatatatacttaaatcaagtgattgggatagatcggtcgccatgccgagacaatataaatcacttagatcgaaatatatattaataatgggactatatatgttcatagcatagtcgatcagatagatctagcatgtatcggctaataccccgataccactctatactaagatattaaagcaggtagaatacatcaaacaaaagcttaatatacttaaatgcattaagatcctaaaataaacggtagatttaacatgtcaataaagcatatagggcaaatatagttaaatcaggtaaaatcggatgaaactccaatactaccctaatcggcaaccaaaaggcatgctatagattgatattctaagcacgacttaatagatcaaactaaactgatacagcattaagtatgaaaagaagaacaatatctagacaatcaagccgttggaagtttcatagagtggtagatatcttatataatctaaatcaacgtcgcaatctaacctaatcggctgccctctaccgacagatgttagccgattgtagattaaatagcggtattgccggagattatgtaagatatatgataactcgacgaattacagaaacgagatcagagtatcataaagatggaagcactaatcccgagaatacaagtcgtcataacaagttttaccttttgttgaagatcgaaaccgatgcagttcaacccgaaatcaagaactcgtcgaaataaaactaaagcaaaaagggtggcgatgcgccgaaattgtattgagcgtgtgtgtgttcgtcccaagttacatagggctcgggtctatttatacccgagaattacaagatacgtccataacggacacgactattatctctaacaaactctaagataccataagtctttgcggcagagtcttgcccaaacatatctctaaggaaattacttaaaacatcttaattaatagatacaattgcctcctcaggactctatccatgtgcggcaatcaccttgaagcacctcaactcaacccgatgatgtgcaccgagtcgtattcttggaatcagctgtatcggctagccctgtctgactcgaactctgccgatcctgaccgtagccgattcagattgtagccgatttttgctctgtttccacaacgatcttcgtcttcgatttcgcttcgatctaatattcttttccgatgctgatattaccaaatttggtcgttaacatgtggtcccaagggtattttgaacatttcacgctgtcggagaatgaactcctccaccagggaaccgtgaggccccctttgtgagttcggccaggggcaacgggtgagattcgagggcttggtgagcagagctgtgtgatcttaagggggttaggccccccaagacgatgaaacaaaagaggtttatacaggttcgggcgctgagaagcgtaataccctactcctgtgcatgattgattgaatgtagaacacaagtgcttggggttgcgagacccaagtgccagttcgctccgaagtcccccctccaccactaggcttagacctccttttatacctcaaggggttaccacatgggcccaacaacctaacctaactccggtggagaagtattataatctttccattaaatgcatgtcttgtctcttgacttgggaagccaagcgcacgtcgtcttgatgatggggcctgtcaaatcttgccgcctgacatggggggtgcccctgtcagtcaccatttaatgggtgaagacttctaggctcctattacaccgggaaacgggagccttgctttgacca

SEQ ID NO: 77232 - DNA, 671 bp, Oryza sativa
atgatattttgaataaccacatctgcatctggttgggaagtcattcatgatatggattgtatggttttaaataaatcacttatggtatgtaacttaggatcattagcaagtaaaggcaagttctccctaatcaattgaagcgcctcaaccattttttttttcaaaatatctttagatctggcttgtaaaaagtctgtctcttgccattttagtatatactcagatgctttcatttaggatgaacctttacatgttcaaaagtctatcatttcatccattacagcctagaaaagtaacttgttgtccagtccatatacttatttatgctagctttctctggttcatctagccgaggcatagataaattagcatgggattcttcaggagagcgcttggcattatcattcaaagatggtaatgaaatgtatcatggccttgttgctgtctatgatgtgaggagatctccacttgtctcagtttcactagtgtaagtgcagtcctctaatttaccatgttatcttggtcatgaacattgaatcttgataattttggaccattgtctgacgaatttccaatgtgcatatacagtggattcataagaggacctggagatggagcaaagccacttgcatttgccttccatagcaaatttaagcaaggaccattgcttt

SEQ ID NO: 77233 - DNA, 645 bp, Oryza sativa
atagggcgaattcgagctcggtacccccaatcccacagcctagctagctgtggtgttggtatagtggcttgtgtgtgaaaaacacccgagagacagagagattttcatccatcgatcgatcgccatgccgcctcaggagttgcatggcgatgatcatggccgccaccaccaccaccagacacccgctggcagcggcgggggcggcgccggtgacggtcaccaccgcgacttcagttctccaccttcaaccacttcttcttcttcttcttcttcttcttcttcttctaccaattctcccaccgccaccgccgcgtcgtcctcttccaccaacacctccggcgccgccatcgtccaccccactacctcaagtcacccctccgtcgcctccggccaccactccgccgccaactcttaccctcttgtcctcaaggtgagtagacaagtacacatttgtgtatatatacatatatactactctgtcaaaaaaaatgaattcctagttacgaatctaggttgatctttttttgggacggaggggtatgtatgtatgtacgtacgtacgtacttgtagagctacgtgcatgagcatgttgacatatgtgcatgagggagggtggtgatgagacgtgaccatgcttttttttt

SEQ ID NO: 77234 - DNA, 653 bp, Oryza sativa
ataactacttgtctcgtgggcaaacagaaggttttcatgacaaacctacaaagaggtgtcgcactctcacagcggcggcggatgatttacggcgtacatcgacaaagatagactgaaactagggtaaagtaaaaaacatggctaaaagtaaagataaaagaaaaagcgattcaagtatattatgtgttcgggggttacaattgaaccggccttgtctcttaaataggggttgatcttgccctctacaggccctcctccacgtccaactcgagctagaaaccaatggaatcctgaaacatgccttcccgagcaaggaaacccgagacccgacaaaaacggcgtctgactcgaactcccgccggtctgaccggccctctggtgtcggtctgaccggcccacatatagcggtcagaccggccctctctggaggaaatcggcagagccccaaactttggcaatttttcctatttcgatcctaggtactaaatttgggtgtaagcaattattttaagtaaatatgggtgtgtttagttggtggaaaagtttggaagtttagggaaagttgaaagtttatgtgtgtagaaaagtttttggatgtgatgtgatgtgatggaaagttggaaggttggataaaaagtttggaactaaacaag

SEQ ID NO: 77235 - DNA, 660 bp, Oryza sativa
tctctcctctctctctctcactgctgctctatcttctcctctctttgtgtgaggctggggccgaatgaggtggtcaatttcgttttgggctaaaatttcagaaattttggtgcaccgaattttttgaaaattttcattctgttatccgaaattatttgaaaatttaataaaatttgattgaattttaataaactttgaccaaattaaaaaaaaccaaaaatttcgacggatattatttgaatgccggtagggtgcgaaattacgcaaattgacaaccctgaccagcctaaactgctgtcgcctccccctgcttctcgtctgactcgtcgctggccggcatcaggccatcccctcctggtgctgctgtaaacggcatcatacttgattgagtcaatggggctgattcttaacaaataccgatcgagtagccaatcttgatgctatcgatttgtatatgactcaatcagtgacatgacgacaggctaattaatttgatgtaaattcaattacatttaacagtgtgttgtaaaaatgagattattatatatacatataaattggtttatggaactttgcctgcatagatatacttgtactgatttcaggcgatcgtacgtgcgacaattgcgccggctgcgtgtgtgcttctcgccgcgactc

SEQ ID NO: 77236 - DNA, 2202 bp, Oryza sativa
atagaagcccttctctaaaaaaaatttagaagccggctaagtttctaaaaaaggcggcatatatccgttaaaaaggcatttaaatccagttggatgtagttccctgtttctgtttgatatgctaagttcctaattttaaaaaggcattcaagttcctaaaaaaggctgcatatatccatttaaaaggtattcaaatccaattctgtttgatatgctaagttcctaattttaaaaaggcatctagaagctgggtaaaaaatacccttctctagaaaaaatggttcttcttactgacaggttagaaaatacacttctctaaaaaaaattggttattctactgaccgaaaatacccttctcagaaaaaaaaaggtttttcttactgagcgtgcaaaatccgattatagctgatattatgatgactcatgtgttataccttatgcagcagacaacaattttggaaaatcaatttgggttaccttcacttgttgataaagccacagctaacacaacaaaatcttgtggcatgtgcgtcatcttccatgacacccgatgaaataggagaggggaaaaacaatccagatgaggtaatgccattggcatccatcgcttgtttattttagaaatctatgtaatgtgagtgctttgtgttatctgctgcttgcatagcttgattgtagttttgtgaatttcacaggtgtttgtatgtatatgtggagagaagcttttattccatacaaacttcaatacaacggcagtaaaagaacttgtcgtatttgctctccagaggaggaacatcaagtattgtgatatttatgtaacatggtgcggaaaagttctgaaaggagatgagatcttgagctccatacctatccacacgaatacgcatattcatgtgacacccagactgaggggtggagagtacgtaccgcgtaacttatctatgtatatgtattttatcacttcctactttagaggtgtaacaagtgttcatttgcaggttaattccaatggaatatgagcgtatggatgaacttattgaccgtgcggtccgtgacaataataatgaccttttctattatgtgaaccttcccccagaattgataaacccttataaggatacatgggtaacttttctaagtgatttctcgagatatatcatacaccaactattggtatgtgtttcccgtgatggtcaccagcggaacattacttggtatggtacttttgatctcggggacatactgattcaagcgggcatgttaggatcagcccccatatcgtcgaaaatacatacacccctattggtggtagacttgattatcttaagctagtttcaattctaaaggataaattcgtcgataatttacaaggttcttcctccccttgccatctgaacaattaactttctgtattgtgcactacttcccatgaaacttatggaagatccgatctattcattacattttttataaaccatccgtgcttgttatcatgtgaagaaagagttgcacgataccttcaatatgatcatatgattacaaatcttgtgcaacgcgatcttcgcaaatttaagcaatatttgaatgatacttttggagatcctccttcttggatcgctgatatcagctgggttcctgacatgtggaagacatacaattatagtcctaataacaactcaacgttatggaccccacgatatactttggatctaaacagttgctcacattttgccaggaatttcttgaaccatttcggtcgtgaggttagtctttttttaattattattttaacttttctatatgaaccggtttaggcttttgtttgagcttagacttttaagcaactttttggctcatgtgatttatacaccaatattataggctcttatatctgccagttgtaaaaccaacactgatgaccatcattaattggtgctgctttgtaggtgacggctgccaatctagcacttatgctaggttagcagccaacacttagggtttatttactagtgcttttaagggtcctatcttcacttcacataaactaaaaattactataacttagcttttagcttaacaatataagagtagcttatggtttattggttttaaaaaagccaaatgaaaaaaaaaactaaaaaactgttgtttgccttagattttttagattataagcaggcgtaagcctataaataaaaaaaa

SEQ ID NO: 77237 - DNA, 563 bp, Oryza sativa
gcagtggcggtggcaactccacacatggtgataagcagtcgtgcggaaggcactccccaaaaacctgatcacccgcctacccggtgcagatctcaggcaaaggtgtggtttcggaggcactgctccttccaatctctcgtgcgcgtaagagatcagaagcgaggaagcgagagcaactcaggcgcggagaaggagaaactaactccgggaaagaagcgatgatatcggatcggactcgcggcctccttatctatcaggagaaagaacgtgaaagcgctgttgcggagggaatcgtgggaacgtgggttagtggctgcaaaagccagccacgccctcgccctcgcccacggcccggcccggcgcgcgcgcgtgcgcgcgtgtggcattccgacccccacctcaactggtcaacagggagcctccaataactccctatttaggttgagatatttctcgcttaaatcctgaggtggtattattatcctcaacacttattatgggcctttgagatttaatattataagttgggcctagcccaattattctagcaatccccgccaaat

SEQ ID NO: 77238 - DNA, 6344 bp, Oryza sativa
cacgtggcgcctagaacggccttctccctttagtctcggccagggagtggccgccgccctacctcgagcccaacccccctcgggggagggccacgtggcattggagggcagcctcctccatccagtctctgcgaaggagtggccgtcgtcctacctcgggcctgactcccctcgggggagggccacgtggcatcggggggcagcctcctccgactagtctttggggaaggagtggccaccaccccacctcgggccttactcccctcgggggagggccacgtggtatcgggggggggggggtagcctcctccctctaaacttgtacccccgggtccatatcatcgacagtagcccccggcgttagtcctgaccaaaaccttccccaggtggtcaaggttgacggcactttcctagtttgatgatttgtgggcccgatctcttattctttctttgctgacactaggacccatgcgcctttttcgcctagcctgagggcgactcgctagcccgtactttaggctgtaaacttattttctgtatatatttagcaaacgttgttatattctctcgggcccgtgaccttacgccgcgtacctcgcttgcccctgccatttgttaacctctgttcatgttctacttcatctattcaaacgattattttcgcgagtatgaggactgaacttttcatagccagcaatcttcacccgtgatcaagctaagctgggcgctgtagccagccggcggggccaaagccagccgctacggaagagctagcacagagggccccaggcgtcgacagtactcagagctcgacgcagggctaggatagagctaggaatcgtagcccccgcactttaagcaaagagttgtttgaatggatgaagcgaatacaaactttttgttaccaagggaggcaaaccggcgcgcgacacataggtaccgcgagaccgcgaggaagagatgggcgagagataaatataatcaataataattttatgcaaacgattatcttcgcgcgagtgtgaggactgaactttctatagccagcaatcttcgcctacgatcaagcgaagctgagcgtcataaccagccgacggggccaaagccagccgctacggaagagatagcacagggggcctcgggcgtcgacggtacccagagctcgacgcagggctaggatagagctaggaatcgtagcccccacacttatagcaaagaattgcttgtatgaataaagcaaacacaaacctttagctcgaagagggccccccaccatgggttccgaaccatcttgggaagcctgtgaccacttagcaaacgaggtcagatttccacgagcctgtgtccccacgctacatattctgtttgctctttcctttcggtggcctccttccaatctcttttccttctacatggacgattactttcacacgagtgtgagagccgaaaactctagagccaacaatccccgtccacagttgagccaggccgggtaccgtagccagccggcgggaccaaagccagccgctacggaagagccaacacagggggtcccgggcatcgacggcacccgaggctcaacttaaggctaggataaggctagaaaacttagcccccacacttagcgaagaatcgttcatgtagatgggagagaggttgggctcttaccaccgagggagcaaataaatgcgcaacacgcgggcgtcgcagggccatgagaatagaatgggggaaataaatataagatttcaagctaatgaattgaaaaattgaaaatacttgaagcttgaaaggacgatcagttgagcctggccgggcaccgtagctagccggcgggaccaaagccagccgctacagaagagccagcacagggggtcccgggcttcgacggcacccggagctcaaaattgcaagagtcctcccaggagtgaatcgaggcggcagcaggttcatgggccaaccccacgcttggcccctgagggccatggggaagacgttcgccatgacccggtcgtcaccccccgcggcctctatgatcgccgtgcagatctggagggactcggaggggtcggcgccatcgtcgtacttctcggtgaggcagggctggagctttgggggccctcggacatttcgaagactcgccacaaagacttggtagccaagcttacctggtggagatgcggggagccttgccccctgcctggggtggcgcgacactcctgaggatgctgcgccttcccctgtagcggcggcacgacactcaccacgccgacgctcgaaagaacctaaaaaatcacgaatgcgccccctaccaggcgcgccagatgtcggagaatgaattcctccaccagggaaccgtgaggcccccctttgtgagttcggccggggtcagcgggtgagattcgagggcttggtgagcggagctgtgtgatcttgagggggttagccccccccccagacgatgagacaaaagaggtttatacaggttcggaccgctgagaagcgtaataccctactcatgtgcatgattgattgaatgtagaacacaagtgcttggggttgtgagacccaagcaccagttcgctccgaagtcccccctccaccactaggcctggacctccttttatacctcaaggggttaccacatgggcccaacaacctaacctagttgcggtggagaagtattataatctttgcatcaaatgcatgtcttgtctcttgacttgggaagccaagcacacatcgtcttgatgatggggcctgtcaaatcttgccgcctgacacggggggtgcccctgtcagtcaccatttaatgggtgaagacttctaggctcctattacaccgggaaacgggagccttgctttgaccagagcgggaggaccgactccggctgggataagaggatgagaacctctcaccattactatttgatgggacatgtcaggctgcacgccgcctgacacacgagcagcgcacaggcgcactagccagtcccatcggtcattcgaccggtcacagaccggttgagtgcactgcacgccgcattaaatgcggcgtggcgcgaccgctcgggacgccataaatgtgggtaggtgggcacctggaggcggacacctaacccaccgtacgtggtgacctagagagggggtcgggggagcccgacccctagtcacgggagggggcggccgccacccgacctcgggcccgatcccctctcgtggggagccacgtggcgcctggggcggccttttccctctagtctcggccagggagtggccgccgccctacctcgggcccgacccccctcgggggagggccacgtggcattggagggcagcctcctccatccagtctctgggaatgagtggccgccgtcctacctcggacctgactcccctcgggggagggccacgtggcatcggggggcagcctcctccgactagtttttggggaaggagtggccgccaccccacctcgggcctgactcccctcggaggagggccacgtggtatcggggggcagcctccttcctctaaacctgataccccgggcccatatcaccgacacacgcaatttctctctccccttcaaccggaaattattattttagtgtggtatcggggtatccgctggcaaataaccttgttttgagagtgtttttctccaaagtgacttcgggtggtgtcctcaagttaaaaccacgaagtcgcgattctctgtagtaaaatttatctatatgtagtggagtgcagtacagtacaacaacttcaatggcaaaatttgcctacacgaagtcgcattgaatcaatgcgcccgtgcgtacatgtgggctgtggcttcaatgcgccaactcggatattcgcagccatgtctgcatctgtcgatcccttgtcaagagccacgaatcacaacgaagtttcgtgttcctgatgctatcaaagacaatgaatcgtggtattaatggattgaccgtttcttagactgaaatgattgcttgagacacgccataacgtggctctgattgtgaatggcctaatctctagactctgtacttatttatggtattgggcctcgaggttcatcaaccacttgcctgatgaacgtgtgttttactagtagttctaattgtaacccgtagatcctcttcctctaaacgaaaagctccttaagaaactccctaacacttgggtgcatgtaccgcaagtccagaactaaacaaaaatgacgggggatagtgcacgatttgtcaccttcctctaagcctgacaaaaagttctgcataccagataaatcagctaaacaattagataccccaaatctcaaacgcagttgatgatgaggtgaaaacgagagagattctcactgtacatcagtacatcctgccgagaatcttgacagtaaaatgtatggctgcgaagcccgaaggaggtaataacaaaactagtaatcccaacaaggccctgacgcctgacttttcattgagccgtggtctccgcggtgaaagcgacgactccttttggtatggcaacattcttacacccctatggcgacatcctttgtagcaagtctgcaggagtgtgtggtctcgcactctggcctcggcctgtacaacgtatcatttatctcccttttttttagagcaaatcgaatcctttttttcctgcccacagattcgcacagctaaaagcgaaagatgatgtataaattacttagtacgaaactctgtctgtcatttggaaatactacttttttctttctttctctcgctctatctgcaattcctgcatttatcaaactgcctaacctctttacgtgcagagaaaaagaaaatgccccccacgtgatcacatcctgcactctatattgacggcattatatcaaacatcctgtacttcgttgtcatcgtgcgacttcttcgcgttgtgagttgtgacccgtgaagaccgctatatatacacacgctactagcccctgttgcattgtatacacatattcattgcctcattggtactttggtagctatgggctccctacccgccgccgacaagccgttgccggcgctccggtaccctccggctcgccgcgacgacgacattgtcgacgactaccatggagttaccgtgccggacccctacagatggtgagtgtcttgtcgacggctgtttccgttcctctgtaatcgattctgtcctgttttgagaggcactctgtttgttacgttatgttatgcacatctgctttttctgaattttaccctttttacccggcttgaaccatttctctgttcgtgcaacatgaaaaaacatagttcctaaattcatggaaagaagtactgcttcaggataagagtgttagaattcctgaggttcagtttttttttaatctcatttcttaataaacttcggccggcttagggcctggcgaaacagttttttttatataaaaatattcattagattattgacatgtattatctactttattgtaggataaattaaatattttttataaacaagttgtctaaataatacttcctccgtttcactatgtaaatcttttttttttgcggggcactatatatgtctaaatttattaacgttaatacgaatgtgaaaaatgttagaatgatttacattattaaacggagggagtacagtagaagagattttcttttgaaaagaatgtaagtattttagcatatggtgtgcagtaagaatgtaagacgcattcccttgtataccgcagtcaaaacacttggtaaatcccagaatgattgcgtttggaataccactatatagtgcagacgaaatgcaaatcgaagcagagttgaacacttgaacacgattcttcccgtacgttctcagtccatccgatcgaaacaaagcatgagtaattttgttcttattattgttggaccgtgcgtggttgatgatcgctgatgtattgtaaaattgaccgcgagtgaaggatggaggagctggagtcggaggaggtgaaggggttcgtggacgcgcaggcggccgtggccgaggcggtgctctccacctgcgacgaccaccgcgtccgcctgcgcgggcagctcaccgcgctcttcgaccacccgcgctaccgcgccccgttcaagcgcgccggcagctacttctacctccacaaccccggcctccagcctcacagcgccctctacgtccaggtcaatcaaagccccccacgcgaatctcgaggccacccagcagagtccgagagagacgctagctttctgcaatctgaaccgtcgcttttgttgttggagttgttgcagcacgggctggggggcggggaggaacctgacgtgttgctggaccca

SEQ ID NO: 77239 - DNA, 2457 bp, Oryza sativa
agcatgatacaatatgacaatagcatattactgcaggaagtccatcttaacgtcagtgacatcgagttgcagtatctcagctctgcagcttaacatgacgccaacactgcaagagcagcaaggtcgttaatatatatgatatgatttaaaggaacatggcgccaatacagcaagagcagcaaggccatgaacatattatgaatttaaaaggtcggttaaaagggcttagataagaaaatatgaggaattgaaaattcaggctaggtttttttttgaaacgaaccttgggtgtgtgcgtccaagatctccgtgcacaaactcctttatgtatgtcccagcctgtatggacaccaaggttgattaaaccggagggagcaaactacagaatataaatgcttttgatgaattgccttatgacggattcacaaaagcatttaagaattgcaatatttttacaagttgatctgacatacaaaaccataatatacagtgaagaagaccacattcattcagcgaaaaataataacccaggcaatcacaaaagatagaactgacgggaaggacaaaattgcaatgcttacttgagtgcatagatgcaacaggtaatagtttgacccgccagaaattttttcaatctccatcctgacagatggttttctgtttctcagatttatggaacataaaatggatttgacaaagctgaaatcagtctcaactcaccagtgtataatccgttttctctctaatggacttctacgatgtaagactcttattggcgtcttttgtacaatttcctacacagcaagcaagagttactatgttcacatagtatccaaataccttagaacaacaaagaaaatagaaaatcaatgaccttagctaagatccaaacctattctttccaaatatgaaatatattagtcacaaataagcatgatacatataagactcagatttattcggaaacagcatgtggacattaaggcagagaaggtcttactggataaacatttgaggccaaaggttatgactgtaatggccactggcagtttaaaatttacaagaaatcatccattatttcctgtgatcgcccatacagtatttttctactgttgtagacttattctgcacaacccgtgttctggttctaatttattagatcaggacaatcttatgggatatggcagcacgttgctaggtgtgaaaagaaaatgaaaaaaaaaacaaccaaagaacatgatcaaaagtcaaaacaacactctgcaggtctttagtagaaagaaaatatgttataccatatctttgataagagaaatattatgtaggtcatcatccgtcagagggcgagacgtccatatgagggcagcatactgcttctgcacacgtatagtagaattaagcactgacaatcagcaaaaggttatcacctttcggcaacaaagttatttatggcttcagacaacaatgcaataagtatgaaacatatcatgttaaatacaataacaaactttgatgctatcgtttcagtaaagtgatatatcatcagtggtagagtacctgcttctctgcttctccttcccgcatcattgtccatatttcactgcctaccagcttgagatttctaaccctgacctataaaatgctgaagcataagcacatcatatctaatccaagtgcgatgttgataccctttactgtgttcttacatgtttcttttcagagtcattaatcttatctgctatttgttgaacttcagtagcagatggaatagatcgcacattcaagacttcaactaagaatggacgaccagatccaagcatccgaacctgcatatatggttcattcagcatagaaataacaacagatactctgatgaaaaaaatagcaaaagacacaactcaaaaccatgggattacatcaatatcttctcttccagcagcatggaacttatagccatcacctttgcagatggcacggacattctccccaattatctcctacaaaggggtatggggatgttcagttgtacttttatttcttgggttgagacagcatataaggtattgtgtcttacctcaactgatgcttcccccattctctcatcatcaattatccaacatgactggctgacattccttgaaagctgataatgaggaacgttgtcatgagggaaacaactcagttgaatagcacagcatcaattaaagtgcaaacatgcaaagaaacctttagtttgcttctatgcactgagtatgaggaaacacttccaagtggcattcctaatggtaataatccattacagaagacactgctgcaacaaaaatatttttctgttgcctaacttaaggttgtcctatgattatacagaactacatagttgttccaagtacgtaattaggagattagcaactacaaaaaggattactgtagtgttgctgacatactgatgggctgcag

SEQ ID NO: 77240 - DNA, 10415 bp, Oryza sativa
atgcatctgattcacttaatatttgtttatcatcatctgttgagccccttttactgcttccatctcttgattctgttgagacatcagacaaaacaataaaataaaatgttgaaaaatgaccgcccatcaacaatgcagtctttcttcattaatttctatacctgtttttcttttacgaccacggtcatttggcagaagccttagaagcttttgtgaaccttcatcatgagtataagttaagcgaattcgaaatgaattattaccatgtttcacattctgcacgaaattagtcaaccgttttgagataagtaaacaagcaatgcttgatttcaggagatattatcagaaaaaggcatttaccatttgtttttctactgacggtactagcaatattctcaaggcctccttcactgacattgtctgttgagaaaatattttttcatcgaaccaatttgcactgccatatttctctttcatatataacctattaaagacacaaatgccagcacgttatgaaaatgccagtgcagtgtcatcatagatttaatataagcacacaacagaaagttccatctgtggttgagaacaaacacagtaaattgttgaagtataattattatccatcaagactgaatatacttcatttctctgaattttttgctaattaaaaaaatgtaaatacctttcacttacaaatggttgcattatatatcaccacttacataattttagcttttaaaaatgattaatatgtggcacccccttcagtcacaaaccaattcatggtgctgtataaaaaagtgaggcaaaaattcttaggtgcagatggttacctaatggcacgatcattagctgctataactgcaggcagtgaaatttctagggagaactcatcgacttggtgaccctctctctggactgcttcagatataattgaagtaacattatcgataggagaaacactacggagtggttctacaccatcatcttgatagcaggtgggcagtaacactccaaagcaaatagagcagtacgcctcatcttttgacaaacatgaacaagacccactttttgcggaatcgtcatgctcttcaagaaacgaatgcagaactgatgccgtaagagaaaggcatggtgctgcataactaaaggctccaaagaaccgaaagatgcaccgcacacagacctgcaaatattgtgcaaaaatgttgacaaatttctccgtgtgtgaaactgaaaaatcattgggttcagcatggcatcgaaatgttcattcagtaaaggggaggaaatggatcccacaacataatcgtagtaatacacgaacaatacgtaacacccagtacgctatccaaaaatatttccgtaataggtgaaatcggaattgggggaagttgaacatggattggatagtgaaaagtgtgcagcagagggcatgactgagaagacgaaccccgacggagaggaggtggtggatggcgtggagcggtgggaaggaggacgccgctgcgcgttcgaggatgctcctcgcctccgcatccacctccgctgcggccgccatggtcctcgacgcggttgattaaaccctagttaatcccctctagttcagactagtcctatggagagagagacctccttccttcatctgaacttgggccacctgatttaacactaatctcaaagcaaacaaacctctcaaaatttcacccttcttcttcccccctccttgctgctcgccgcctaccggcggccaccagcaccggtcgtaaaggtcagagcagagcgaggagaagggtgcattcaacacaacagcgaggctcgcagtccgcccatcgccgttcctgctgcggttgggcgtgagaacaccgtgatcctgccgcggccgggaacggaccggtgcagatcccaccgtaatggagcggaaatcgccgccgatgcctcggccgtcgggggcgccgagccgctcgccgccgcgtcgccgtccacggtggttgtcggcctcgaggcgaacagtggcgggctccgcagagagaagctttgcgccgtagaggagaacagagaggtacgctgctctacgatttgtgctaaggcacgtgtcacacagatgttcaatgttcttcagagatcaggtgaagggcgggccaagatcttcagagtaattcttttcttattagtgataaaacgatctgcgatcaattaacttgccaatgttgttcataaccaatcctgacaaaaagacaggtacgtgaagaatctcgcacgacaagcacgccgatgtgcgaaacctgctgaattgcactctatataatacaccatctgtttttaatagatgacaccgttaacttttagacatatttaaccattcgtcttatttaaaattttcatgtaaatgtatatataagctttaaattatgcttaaaatacattaagtcataaaacaactctcaacaaaataaattataattatgtaaatttttcgaataaaacgaatgatcaaacgtacgacaaaaagctaacggtgtcatttattaaaaacggagatagtaccgtgagacaccaccacttattagtaccagcactaacactttgccaatccaagcacacgtacgatgtgcccttctacggccgcagctccgccagctcgtgcacgttcatcgggtggacgaacgccccggggtcgaagaagagctcgcgcgcgaagacgttcgacgcggcggccgtcgggtggaagttgtcccagaagaggtaactcccccgatccaggcacagcggcgccgtcccgttgcacccgccaacgccgccgccgcagcacggcctgtccagcaccgtaaaatctgcagaaaaatcgctacaccgtcagggaccctgcaacgttttcgtatgcccagccactggtgcagcgagatgagaggacgtactcgcgccaggtaggaccgtgccgttgaggacgagctcggccatgccgaccgagtcgccgagggagtagtgcatgccgggcaggtcggcagcgaggccgcgcagcatcgagcccagcatcgggtacagctgcctggagaggccgttcgccgcgcgggagcagccgtggaagtcgaggtcgttcgtgtcgtgcgcgaccgccctctgcgacgggcagcaccccaccagcgacgggctcaccacgctgaatttcctcgccccggcaccgtacaggtcctgcagccaccgtttctcatcttgttcagatttcttgcataacttttagagggttcgttttggagcattggatatacagctctgcaccttgaggtggcccttgtaggaggcgacgaggctctgcaagaattcggtgtcgttgcgggtggtgttcgacgggaagtcggtgtactcgaataggtcgttgctgccggtgttgatgaagatgagggatctcgagatgagatcggccgtcccgttccccatcttctgaacggccgacgtgaagctctgcacctgggcactcatgttgaacacttccgtgcactgctcagacaaaagccatgtcagtgtgacacacaccaacaattaagcggacaaaaaaaagacgagtcagtgcacgtaccactttccaacccgtgctatctatcagccctgatcctcctgacgcgaagttgatacctttgctcatctgtgaaatgatggtcacgtccggcagggagaggtacggtggcgggctcttgtcgaagccaagtttttgagctgctcatcgatgcaacgatcaaaccgcccggtcagtgacattatctccaaatcttactagggaatgctagaaaataaaagcaaacgtttcttctcgatttcagctacataccgagctggtcggccaagttgtatccattgctgaaccgcccggtcggcgactggaacgggtagtcgacgccgtacctcgggtagtttgccttgcagttggccttgcagttcgccaggaagttgttgttgccgacgtccaccgtggagtccccgaacacgaacatggccggcaccgcgggctcctcggcgagcccgcgccgcgcgagctcgagcaagcacagcgccgccacgagcgcgaatgctccgcggcggctggccatcacagcgatcgattctctatgactctcgctgtgcttcttcactgcgatggcgcgcggccgacttggcagtgtagacttgcagagctcgtcaacgtgcacttatatatagcatgcgtggcgaagaacgtgacaagagaagagatcgaaagatcgtgtgtcagcaatgcatgaactgggacgagcctgaacagcagcaggccaatgtcactatcttcgaatccctcgccgcggttaataacaccaaaggatatcctccttgtaccttaatgcttcgtgttccttgatcacgtcgacgattaaaaaaaaaaggcaacgaagcaatgcaacttcaacttgccaatttgacattgtggctgtgaaaagagagcgcatatctggactgaaacgtgctgtgccagcgcaaggcagaatgtcagagtacgggattatggtttggattttcagtcccgtaaatccgttttccgttgcaaactagcgacgctacgtacatcccgtcggtataggacaatataaatccgttttcagtacgtaggcacttccgcatcgcaaaagcatagaatatatcagcgacgaacaggacacaatcgacatcagtatttcatacgcatctaaatacgtacgctactagttaagactaaacaattagaggaatcgcctgttcatgttaggtatactgaatccagcagttcatgttagcctgttaggtataccaatcgactaatccagcaatggtcaattaaaaccgagggaataagctagatgattatgactttttatataaaaaaacactttcagtaattattactccactgaaataattggttaaatatattgactttcttatattattagaaaagatacactgatttcataattcataagcatttgttggtccacttgaaataaatagcaaatttcgctatacctggtggctggctgctcatatgcatacatttcacatcgtagactattgtccgcatccatggtgttttttcatttgcgtagacgagcacatgagcatcgctatccgatgcggagaagcgtgtggaaagagatcgattaagaaaccggatcttcgcttcgaacttcatgttcggcagcaacagacgggcatgctgcattaactgttgatactaactgaaggcgtctgttcactgcagacagcatcacggaatctggaattgatctggacggcgaccataccatgctcgcttgggcaagtggacgacaaatgtacacgctgacatgcacgtacggctcatgtcaacgaagttcgaaacctggttctgtttcaggtggttggcctgtttccagtgtccaagcgcccgcaaaactacaccactacagaagtacagatcggttctctgtaccgctgtacgtgccagcgatttgagaaaacaaggaactagcttactagcgtaacttccggtccgatggcagattggcaggccgcggcaggcaccagagtgagaaacacgaattacagatgagtaattgcgacgattacgcaagtgacctgggccaaaacttgggtaaatccctcctggcccaactacagtagcccgcccattttcagactactcagactaatagtaaagggaggcagaatcgacttttttccgagtccaatcaagttgatgacgctgcacgttactatgacttttttccgagtaggtataatcaggatgatttttttaaaaaacaaataagcaaaaacacttaacaataactaatttataaataagctgaagtgcatatttactggagaatgataattgtgcaatgcatggacggttgatataaaaaacgggagagatctcaacttttattttttagcttgccacatgttgagcttggttgtataataactagatagaaagaaaagaatagcgctgttaaatcttgatttcgggggatttgcaaattaaacctggcaatgtgcattggcgagtaagaaaaggcatataggctacactttggtcccaccccttgtttatatggagttcatttacgccttacaaactgaactcacgctaaataaacccaaccagccaaacttgtgatatggccgagtaaaactttgatgcatttgcgtatacggtatatatacctggccaaacttgtcatggccgagtaactcctggtgttgtgttagggtcgttgacaagcaccagccggtttgtcaactagtaccgcgacagggttcggcttctgccgctcgcgttggtggcgcggccgcagcggagcgcgttgctcgggatggggagctcgtcgcggaacgagtgcgacggcgtgtacacgcggaggtagaactgctggccctgatacctgcgcgcccagtcctccgacctgaggttccacatccccacattgtccagcgccaccaacaccgccgtccacgccctcgggtacacctgcacagcgccatcaagcgagcaatttagccagtccgcaattcgttttcgtgtatatccgcactgctcggcgcccgcgtcgagtgaaacgtggctgcgtgtgttacctgaaccgtgcaccgggagactgcgtcgacgaggttgtagctcttcctgctctgctcgctccacactcccctgtccatcctgcgacaatgccaaaatcagcgaacagatgagaccagatggtgcgggctgcattagtcaggaggcatgtaacgtgggccgtacccaactacgaacaagctgtagccgtcgaggtgccagatctggacgctgtcctcgctgttctcgaacacgatctcgaggaatgaccggtagtcggagtccatcacggccgcctcgctccgcggagccgccgcggcgcccgcgggcggcgcgtccgggatgccgccgagccggaacacgtcgctgatcctgtagtagtcggccagcttgagcggcgtgtcggcctccacgaacgacacgccgttcacggcgtaccgctgcttgccggcgacgcgccccgccgagttggcgagccggattgtgcgtgtcacgttgatcgagccgtagtggtacgagccctgcgggttcggccgtggcccgctcgccgtcaggttcgtcctgggattgggaaaacatcaaaagaaacccaccggtcagtaccagcatctgccgtccatcgcgagaaacggacggtcaggatgaggcgatgcggcgaacctgatggagcgagcctggtcgagcgagaagtcgatgtcgtcggcgaggccagccggtggcggcggtgaggagatggtggcgctcgagccggcgtagcgcaggacggcggacgagttgagtgcacgcttggcgaagcgggtggagacggtgatttggtagacgccgggcgggcggttggccgtgaacagcacggacagcgactggccggcgtggacgtagagggagctgtaggtgttctgcaccgtgtgcgtgccctccacctcgaccagcgtcatgttgtggtcttggatcctcaaattgagcgtgctctgcaggccgacgttggagacgcgcaatctgtacgtcttccctgcaaaaagaaaaaaaaaagtacacattacccgtgcttgaaaatctcacggtatgatcagattggtcaaggtcactcgaaaatagttgtgttctacgtaaaggcaaaaggcctcaccttgctcaacggtgaagcttgcgccatttggacctttgccgttaatcaggatgccatcaggggaaggcagctgctttccactgtccagcatggcttgcagagcctaagcagcaacagcaaaacaatcacttagtacaaggatccatctactgttgatgaaattagtgtaactgcaatgccatgccttgtggctggtcttgtaccagtcgccgatcagcatggtgtactcgccggccggcggatcgaaggggacggggatcagcgggcggctgcggatgcggatggcgccaaagccgccggcggccttgtggaaggcgagcgacgggaagtagaagaagctgccgatctggtccttggcctgcatttggtaggtgaagttctggcccggcgggatcgggcagttcgtgccggacacgccgtcctgccacgagttcttcctgtgctgaagcccgttcctgcaattgtttgtgactttgcatttttgatttttgtagttacggtaaagaatcgatgtaattgtgagggatggcatgtttgaaataatgcacatatgcgtgatctaagattgtatttcaggaccgaaaataaacgtcggaggtgatctaaaactagcatacataacaaaaacggaaacaaagtggaaacgtatgccaacaaggctgtgtgtagattcaaattttggatccaaacttccaactttttccatcacatcaacctgtcatacacacacaatttttcagtcacatcgtaccaattttaacccaaacttccaactttggaaggaactaaacacagcctaaggcaataactaaactctctctctaagtttgtggtgtattagatgcacggacgcgactacaaaagctagctaatcatgtaatcaacctaatctgcacgcaaaatgcgttccaaaacaaacttccacgttttgggttccccatgacaaatctagcctagttgatgtttagcagtatattcaatcaaaccaaagataagttcatctacagaatagtgcacataatttgtacaaactaatgatgaaaatgagcaagaacgcagattgactgggtgcaacgcttgagagcgtttctgtgtaaagtgaacttgccatgacagaagaaacggctccgacaaacggttgtgcacgttgacgatcaagttatcattcgtctggcagtcaatctccggccccggaaattgcccattgatcagaataccctacatgaagaaaaaaacacacacaaacaagtactaaaagaattagagaaacagcgtacacatcaaccctgaccaaagatgaacagcagaacagatccatcaaaatctacacctgctgctggacgccgagaggattgatgttcccagtagtaacctcccaatcgaaaaatctatacggatcttctgcccgtgcggaggagacgaagacgaacatgcagacgcagacagcggccagggctcccatgcttcgccgtgacgacatgacgccggtcgacgctagctgccgggagacggtggtacggcggtcaggcggcggagatcgatagcgcgcgcggcgcctgctgtggactctgctccgggtcccgtacgtcgcacattttatagatgagatctactgggacgcaaccgcaacagcatcgatgtacgtgaaaaaaatcatcgttattgagtttaggcagggtggtttagtttaggaggaattttaattctgttacaaaagagataagatattacaaggggattggtaacagaatttgtggtatgtctatggagcgatggacggtcgtaaaattcgtggtgtttctgttcatcttagctgatgcctttggggatagacgaacttccaagttccaatgtcttatctgccctttgtttgtccggttttgttcatgtccttatattttcaacgcggaacagttttatggatatctcttctacatgtccagcattgatacgacctaaattaaactggtccggaataagttttgtgacaaagttgtgattaatttacagaccgcgcgtgtactcatatgtatgcgtaaaggaaaggaacacgtacgtttgtgctcattgttgactgcattacaaggcagtattaccaccgatctcaacttggaaggcaaggttaaaaaaaaatacaagacagttgtagccaccgatcaactggtaaatttacaaggcaaattttgaatccgtatttgccagcaacgcggactatcatagctagtatttttgacttgaaagaaaaactggtaaaactcttgggcacttcaccatgagatcgtccaaatgggccggagctgcaccgcaaaagcagcccacgggctacaaagcacgcgcgtcactcgctctcgcggcaaagcctctctccctccccctctcgctgtccggtgggcccaggtcgtccccacacgacagcgctccgcctctccttcccgactccaccgaccccccgccgagctttctcgcctcccgcgaagtcgccaccgcgcgctgctcgtccgtcgtcgccgctgcatccgcctcctcctcgtcctccctacggccgtagggtgcggcggcggagggggcgacgatgccacgctgcggagccggaggtccctgcgtgtggatccgggccctatcccagccgcaacgccacggtgcgcgctaccgttgtttggttcgattttggctgtggttccgatttcgctgtgggtcttaccgatt

SEQ ID NO: 77241 - DNA, 4107 bp, Oryza sativa
tgctgctgcacgcgctgttcatcggcgccgtcttcctgctcgatccgacgctccagaggcaaatccacgaggccaagtggtacgagtacgccccccccccccccccccttgaaatttctccgaaatgtttccgtcggagttcgtgttattggtttctgtttgagctatatggagtcgatttgctcctagcttcgggtggcaactagggctctttacatgggcaacatttcgtcgggtcgtaattggcaattggcttgtgtcaggtcgcagcctgctttagttgagagcaagcatggtttttatgtatgccttctatctgcaatgccgtctgtgaggatgatgtcgtgaaattactgggctgagagccttccagcatgttataatagtgtaaattgtatttaagtttgatatagaaaaagaaggattgcgtgacatgtttggacaattagcatggtgtcccgcaaatggtgacatgggggctaagggcatattgcttggcactcatttgtttcgttcatcctattcaacacctgaattaatagaagttttaaatggaacaacatgattgccgtatgattttcaccaaatatgttgtctaaaatttgtagtttactatggacatgccagggtaaatctgcttcgaacaatgctgcagtagcattatatcatgaactttataataatattaatggataaagcggcatgttattgaccttgaaaactaaaaacaacatattttgttacttagataacaattcgatattccaaactaagatagtataagccataaagcataccgcatacacctgatggaaactgatggtttttgtttgtaatttagagattgttgtctcagatgttctagtgcacattttatgacttggacaaagtgaccttcataggaactgaataactatgctactagaacataagtgaattataaatgcctattgatcaataattcaatagatacaatgtgttgctcccttccttccttatcaagctaccaaggtattatcggaaccacaaatcactttttactgttaaaagttgatgaaaaacgtgtttatttaaaatattatatagtccatagaccatgtgcatatttctttgttcatcttgttgtccttgagctatatgtgaaaatagagcatcggatcaaaagttgtgcctatatttaaaaaagggaacatgtatgtttaacaaccagtgctgacatgatgatggcatcagcagacctttgcccctttcctataatccacatgcacgtacttcttcttctagcaggtccacgtgtatgtgctcagttctcatgagacccgtgttagccagcttttgaagttttaaaaaccagcagttatgctttattgacacatattttcaatgagggtccactgaatcaatggccagatgtttttttttccttttttgtgagaattcgtgattcttctctcttttcttagcacttctaaaaggcctttgaccaactcttatatgtaatatgtagtttttttttctatttttatcttagcacctctaaaaggcctttcactaactattgtatattatatatactacagctgaatgtcagctgatgctgtccagcctatttggaaactgaaaacactattgtgtcatttctctgtttatatgtatatctagaagaaattccatcacccctctatttaatcttattctacaatctgctttgatggcaggtacataattctatatgggttgctggttttacttaccttggtacaatacctatatacagccacttcttctccagggtaattgatccttgcggatgttgaagttttccctagatgatgacacttatacgttgcgtttacttgactcttgtgctgttagatatttacctgatatgttgacagctggctcaaggatgcatgcaacctttattaatacaacaactctctcaaagtaatgtcttactttatgttgttttgccttatgatatatatgtattttaagtgctgagcctgagtatcgtacaccacttatttatgctaaattaaatgcctttgtgattaagaaaaggcaggccaattccaaaagtggaagcttaaactctgccatgagtcgcagcaaaatagatcagcaaaatccacaatccactacagctttgttactacagcagacgatggatctatatcctcctgggacatccaccaggtacacctgtttatgtttggaatttatgctgctgaagtgtaatattcaatatcttttgtcatgtaatttctgtcctgtgatacagttgtatgcctccattttattttagggatttcacatgctcttactgccggctcatccaggtatctttggttttccaaatttggcatccagagatagtattaactgaatacagtgctccaaaaatatacaaaaacaaagataatttgacttgacataatgtaggtctttcaaggatgtaacaaactaacaatctgcattttgtaggaggtatgcttattatggtgattagtcttgtgttatgccaatgtactgaatgacaggaccagtgtatcttagattatggcatgtgccaatcgccctattttttttgtatctactaagttgaatgttggtctgccaatgtatgacatgaccagttatgactactagcatcctttctcatcagtgtgtccagtcttaagaccccttatgctttccaaagtccaaacgataatgagagtttctctggcttgatttttgagaagtcataaccatcaccagtcacaatctatctaattagaaaaaggtagacactatctgaaaaagagagaaggacacactgaacttcttttccttcatgaacacaccgtgctatgctcgttgttcttctcaattaactttgtaactgctcacatttgtatgcattatccatattttttagttactacaaatttcattcatactagcgtgtctgaagttttttgtcctgtctactaccttttgcagcctccacgcaccaagcactgtcatgactgtgataaatgtgtcctccaatttgatcatcattgtgtttggcttggaacatgcattgctaaaaggaactactgcagattttggtgagttctgaatttatatattgtgcagcttagtttgaacatatgcttctcaggtgcagcataatatcctgtgtggtgtatgtcatgcaatctctacataagcacccgagtgtcctgcttcagttaacatgtgtttattgtgagaaatcaattatttgtgtgctcatccatccattatttctttaggtagtcaatttgtgtcttgtcttaatttttgtactccaagtctctgtggcagaactgtagatcgagaaaacctgtatgaagataccaggttataacggttatatgccttttgcctaattatcaaaccatgccctcacactttcttcatcttgattcttatcaaggatttatttggctgcaattaactgtgcacggaagctgtgctaaatcattgccatgcctttcctttaatattgatctagtaggaattagcaggactgtgtgttcccagcaattcattcaacctatacctcccatcttccatagtccagaattctagaagtctgatgcttgttattgtgttacattttcttgaggaggttggtcagggatcatgttagtcttaattcttaggcatcctaaatggaaaaaaaaaaggagctaacatgcctcattgaaatgtacatataacaatctaatgttgttctattatatgactcatcgaaagtcttggcagctatcctcaggacatattaatgtttttcaggtggtacatattcgaacaaacagttttaactgtctggactgttgctttctacattcagttcttttatttgggcatcgttgtatcctggtatgtattttaccccttttagaccctatatgcacaaagatttttcagttgtgccttttagttggtctccagtttgattcgccagacatctcatctgagtatattggttatttttcatggacaggtggaagtttgctattggtattgtacttttggtagcattgatattaatcctcgtggtcctgctgcccttgttgatattccatgcgt

SEQ ID NO: 77242 - DNA, 1574 bp, Oryza sativa
  unsure (1)..(1574): unsure at all n locations
acttgactgtgattgtagatggcaatatggaatcacatggataatgcatttcttcatattccaaaaaaacatcaatgcataccaaatacctgaatctgaagacagcttgagtacatgactattattattatgtcattgcagttttcatagtttcaaagtttcccacaggcaactgtaccacaaactttgacaatgaggtagcaactattgttaatgttttaaatatgttcaaatactatcttttttgttttttcgttttttgactagcaaagttcagccactaccaactgctctcttcaatccacgtaagtccacagatttgatcagccatttgtcaggtttaacttccaagttggttctagcccctgtcaatcattctaacattcttggacttncatagtagatggcatatggaacatgggacattagaagagtggacatcaacttgtctacatttctaattgtgtcacatgctcattgtatgactgcaaaagggccttctgaaatgaatagaaccatctgcggtctctgaacttaaaattggaatgttctaaaggtcagcaaggagctttatgattacctacacaatttgcaccatggatacacattttgtggcaagaatcgtttttgagacaagctgaagactgataagaacaatatatgtcatcagagtcttgacaagctagaagaaaaaacgctagacattcggcaggagacgtactgaatttatatgcagaaaagcaaccgacagtaagttcatacggtctcagtctcacagatcatgcgcatgtggttagaaataggccaatcttgtacaagtggaatactggaatatgatgaaacacctatcatttaggaaggttcagggaataaatatcaaacaaatatgtttcttttacatgattcctgtaactaatgcatacatggtgttttcgtgttcatgtctagaaacaaagatactttagtcttggaaaatatacaaattttgatgatattcagccagagataagctaatccgctgcgcctcaaaacacaaagggggttcggagttttagactccgagcccccttgggtctctgggctaccgtcggataaggcttgtgtggcccagattgagtggatccactccacagcgtgaggtgtcagcgacttgtttgggccgtcgtgttgcttgctggacctcaagcccagcacggacacatgtgtaggcccaacctcacacttcattgcgtttaggtgtgatcaagatttgacttcctgtgatggcatatgatctgtatactttccatttggtaataactattttttaataataattactccctccgtttcaggttataatacgttttgactttggtcaaagtcaaatttgaaataagtttgactaagtttatagacaaatatagtaatatttataatactaaacttgaatatattttcataataattttttcttggattgaaaatgtaactccctccgtttctaaatatttgacaccgtcaactttttggcacatgtttgaccattcgtttaattcaaaatttttgtgaaatatgtaaaactatatgcatac

SEQ ID NO: 77243 - DNA, 826 bp, Oryza sativa
tattaatttgattttatcacactgaacacatgataaagcacgaaaatttaataggttacatatgcatgcttataataactaacaatttgactaaaatgatttgctaattactattaaatggttatatattatgatgaataaaagttttatgattatatttataacgctacacacactcgatgatataacggagggagtatatttgaatacctataaattttcataaaaaaacaagtggtcaaaatttaaacttgaatagtgttattaccaattattcgaaaacggagtgactatatatcatatatatgtatggaaaacggctcaacaacatcctaagcatgaaagcatccaaattttgctcggttacacatcaagtgatattataacatgtcattaataaagggcattatgcaactaatatcattttcaagctgggatgaaacttggtgtgatgggtcacgacctccttgtgcatgttaattttgtctctatataatcgagcaaagattatcttttttgagctaagaaagttccatgtcttatcgtttgacgcacagcagataccaacaagagttggagctccaaaacgacggcatgcatgttctgaaaggccatactacttttgattttgtgaggattcatctcacatgcacgcactagtttaaaaaaaaaattgaaacgaacatgtgtatgtgaaacacatgggttaatatatttcatcaaccttgaattttgaagtagaagaaaatggagttagatgatgtcaaactgcatgtgatctgtgccctgctttgtctcgacagtcaacaccaggagctgagctgtg

SEQ ID NO: 77244 - DNA, 586 bp, Oryza sativa
ggacattggtaagcagtgactcctttaagcatccaaggcccccaaaagcttatgaggagtcaaacttctccactgtataaaaaacgacgcaactttgtgaggcaagtatagaacattcgacattagtttactattaacacacccaatcgtttcttgttagtcaaatggaccagaaacctgcaacaaacaaatacaacatataaacgttacaacataagatttattaagtcaactctatgtaagggcactctgtcctattggaacatttctctgaagcaacaccatataaaaccttgccacacttttatatgcaaaatgatatatcggacccacgtcacgatggaggaatcatgccataagcgtggcacaaactaaatagacaccttgcctaatctaagctatgacatggtgagataaactttggtagtgaaccaaataagctacttttttaaatccataaaactttggtagtgaaccaaataactctgtataagatacttttttaaatccataaaatttatggtataggagtattagctaaagtaagtactttatatttttgggggatcctctagagtcgacctgc

SEQ ID NO: 77245 - DNA, 687 bp, Oryza sativa
agcttaaaatatgtcttaccaagccagcagttgagcatgatcacacgggttcaattttaaaagtgcatggtataatgagaacgagatgctgcattaggtgtccattttagagcaaaaggaaggattatgagagaagttgggaaaactaaatgatttccttggaagatagctaaacttaatttcaataggtggttacacgtacttgaattcattctatcaatcttgtatggatgtatgtaaactctaacaagttctcatgacccctgtggggctccttcacactccacaagttggcttctctgattatgccagtgaacaatttcatcacctatttgattgcttgtgtttgtcatgattcagcatgcacagcgcgtaggttaaatggtcatcatactgtacttattgagatctgtcatagggctcctcagttcttttgtttttgtatgcagggtccaagatgtgtgcttgctggagaccatcttcaacttcctccgactatccaaagtgctgaggctgagaagaaggggatgggaaagacactctttgaacgccttactgaagcttatggagatcaaattacatccatgctcactatccagtacagaatgcatgagctcataatgaattggtcatctaaagaactttataataacaaggtgcacttcggggatcctctagagtcgacct

SEQ ID NO: 77246 - DNA, 952 bp, Oryza sativa
cgcaatctggtcacgtggaggcataataagagagatcatgcttgtgccatttcctctagctgactccagagccttgattagcttcttaatcttccagatctcaatgttcctatcagtttcatggctgtcagacatcttgacagagcttggatgactggctcacctgtacaatgccaaaacacagggatataagggatttgaagggaacattaaccagacagttcactcaagaaaaacttgcaaacagattaaaaaaaaacacagaacaaagacaagtcatattattgttatatagtacattcaactttcttgttgacacaagctctgttcatgataccaaattggacatggacatgctaaataagaaatgatacctgtctcctgtacaaattaatcaataatgagactgatttcttcaaagcagcatgctctattactttatacgtaacacagtgaaagaacaagaaaaacaaccaccgtttatcttactaaatatctcacaacaaaatttcggcagcaaaggtactatcaaataaccacaacactcagcagacaaggttaaaattaaaccacaacactcagcagacaaggttaatattgcccaatgggtggcaaattttggtttggtttaggaaaaggtaggttacgaaatgtgaaaaaggttttcatttgcatatactcaaatgatttttgcagctaacatgaaacaatcatgaacacatacgatgttatcactaggttacaggtacttggtaacattttttatgtgggacaaacatactgaaataaaataaagcatggagttaacccccaagacaaatgaaggacctgcatagccatgtaaaattttcagaatcggaatgtcacccagataaaataataaaaccaacataaaatctaaattatatccaagaaacagaatttagtttcaataatcacaaaaccgaaatag

SEQ ID NO: 77247 - DNA, 645 bp, Oryza sativa
cacgaaagggttaagcattagtgtctttgtgaaagatgcatctcgcctattctatccatgtcacaatctgcctactgatctcaccatggcctaacatgacatgaccaatgatgctacatcactgtttctttaaaaatatatttttggcaacagactgtatcactggctattcacaaaagtatatgtaccaacaaattaaaagttacataacaaaaagaaaacgtccatgtttcatcgcatagtgatactccagtccagtcacttgcacccacagtcccaggatctcagctctagaaacttaacatcaaccaatagaagcttatttggaacaaacacagcattgccatgtaatcatcggacttatggtgcacaaattatccttgttggaacgcattacatccagaaaatttgattatgaaagtaaccccccaccaaaaatataattgaatgtgacaatggaggtcaaaatgcaggacaagtataggagccttctctatcagttcacatcaaaattaaaggaaaaggtgtcatgttgggggattggagagggagagagattccctggtatgctaggcatgtctcccatatttgttaggtgagcaatacgacaattgcttatgcctgaaatttcgagaaccttcaggt

SEQ ID NO: 77248 - DNA, 648 bp, Oryza sativa
caatccctagtttctgcatctaaatctacctagccaaagagattctgcatctaaatctacctagccatagagatgagggaggtaaaatagacttattaccaccatataatgtacagcccaaagagatgagggagacaaattagacttattgaaggacaagcacggtggactagtcatgccttcaagccggcacggcacagtccgagcctaggccataggtacagcctgtggacagacacggcagggcacaacgagttggtcgggccgtgccttggttgtgccctagcagagccatgccagacggtctatttggccatctatagttggagctccatcacctgcaacttgtgtggtgacctgctctcttctcacctcctcaccaagctggaggccgagtggccgatgtcccacgactcgtaggtgtacttgtggttgacgtactaaaaaaatcgtgtttgatctcagattatagtctcagagcaatgatcaaataaaaatcatgttaacagattgaatcttcaatttcccactcaaaattgggattcttgattttttttcctttctaatttaattctttcttgtttgcagcccatttaatttgtccattatttccacctcaaccaagtccagctgatgagtctttttcct

SEQ ID NO: 77249 - DNA, 1706 bp, Oryza sativa
  unsure (1)..(1706): unsure at all n locations
cgagccaaaccagcggggaactcgccgccgggggcgcagtccgggggatcaacggcgacggcggcgctagagatcagaggacacaacagctaggttagacgggagattattgacattggattaaccaattcaattaagaaggaaaccggattatcggcgacgcgagggcgacaatggcggggacgacgacggcagcggtgcggcagctcgggcggcagcgcgtcagcgggctagggcggcgcacaactaggagaggaaaaagaaagaaaaacagggggaaaacacttatataggggtggataggattaggaaaggaggagtcctagagggagtaggactaggagggagggagggagaccgactcggcaaggggtggggaggcgcgcatggcaggggggaaggtggctcggccggctggggagagggggagggaaaaaggaaaaatgagggtagtaggactttcccgaaaaggaaaaacaatgtggtgccattttagtaaaggaaaggaaacggtcccatgaactgacgcagatacggttcgtcaagcaaaacaaaaccgctgactgagaggggagtgaattgggcacaattcacgaccaaaggcaaaggaaatataattaacttgccacttttaacttagcaacattgcccccggtgatctgatatttactctttaagtcctgttaagagcaaagagattttgaaaaaaattctcccagacaattctgattattaaatgcattgttaactggggttttctcctggttaaccaaagcaaattcttgaagccatttattagtgatttggaacctaagggaagagaaaactccgggtgtgatagacagtcaagcgatagacatagggttgtcaacgagccgagctcgagcgtgcttgtctgtgtaagctcgagctcagtagagactcgagccgagctcgaactgagcctcatcattctccgagcttagaggtaagcttgtactcggctcgtccaagcctcgagctttcacgagcttgagaggtataataggttgaaaacaaaaaattgtgcacaaaactaatggttctagtactaagaagttgtgccatgcacacctttatgggaagaagtattagttgttggtaacagagcattgatggcgatgtagaaaacttcacaccatagtagtatagctgcacaggcttttgtagggcagtagtataggctatatggtactgtgctacagtagtataggatagtagtaggtactagtagcacttgagcatacatgaggctttgttgtgacgtgtgttaggtagcatagcatttagacaaataaaaaaaatttaagccaagtagcagaagggtctataggactaatgctaccatgcatgagtgctgatctcgacgagctattcaagctcggctcggtgaggcttgcgaatcttacagaagggcttcggggncctttcggggggccctttccgggttttgggggtttggggggaaaaaaaaaaaaggggccccccctttttttctttggggggggaagttgagctttggttgagccaagctcgaacagtttgtgagcttcgagcttttttgacagccttagataaacattctatttcctgtgatcatttggccaaaagaaatacatgcctatagaaaccctatttcctttgcagcttgtatttggagaggcatattttgtgaaaaatgtttgttt

SEQ ID NO: 77250 - DNA, 2289 bp, Oryza sativa
  unsure (1)..(2289): unsure at all n locations
cgcgattgtacgttnnnnnnnnnnnnnnnnnnnnnnnnnnnnnnnnnnnnnnnnnnnnnnnnnnnnnnnnnnnnnnnnnnnntgaatctttatctttatctttatatactactttaaaaatccgtagtggtgatgttaaagccagcgtaaacataaccgcgcctccccctctcacgcgcccacaccgacgcatcgctccgctgcccctcccgccacaagccgcccacaccgccgcccatccacgatccttaatcaccgtatggttccgccccgatccaagcccccaccaacgctgctgcactacggtgctcactgatgacgacctcctccacctcagcttccccaccaccctcgtctccaggcgctggctccgtcactcctccaacctggctttcctctgctgtttccgcgcccgcaacccaccccgcctcctcggcttctaccacacggcacgccaggatgagcagccagccccagccgtcgaagctcgccgacgtgctccgccaccgcggcagattcacgtttggcggtgcgtccagcgctaacgactccgtcgtgatcttcgactgccgctcacagctccaagccacacactgcgcagcccccctctctcgctcaccggccgcgtcgctccattcgtccagcctcaaacaacgccttcatcaggctttgcaacaacctccacctgcaattaacggttcgttcagtctctgctcctctccagttcactccttttctatattaagcgctatggatgcatgtattgtaatgtgcccagtaggtttttgttaaatgccgttgagggatggatggattggtaatatcatataggtgcaatggtgaaggtaatttggttctcaaaaaaaaagttactgtccctcttcgcagtgcgccactgtcatctttgactctcttgccatttgcttatcgaagaacttgcacagggagaggacattgtattaattgttccctgctatttgttgttgcatcttgtcctagtgacaaacgtgcaacttgacctgaagattttttctatggtcatcaatgatgctcgttacaatcgctctcattactgcgacaacagaagctatttgatccttagtgccaactccctgagatgcctctcattcctatcatgtagttctatccttgctagtatgggagtgcacatactgttgtaatccacgagcttgaccaacactttgtctagttctgaaacaagagtcgagtatatggaggcacatatatagatcatgaaccatattattattatgttcccctcaaaaaattattattattacgttcatcataccacaacaagtacaaagatgtgaggacaaaccaacagaaaataaattggaacatacatttacctagaatggaagaacatgagacatgaatgcatatacatccatgcttgtctttttttttgttgagggaaaatccatgcttatgttttagatatatatgaaaataaatgaagtgaaaggcacatctggtgtgtgctgatattgttttgtatacatgactccaacctattaactagtgttgaaaactagctagaactcataactataacacatatgtacatttgaataaaaatctcgcggaattcatgttgtagtccatctaattggcttgggtacattaagagtgcttgtgttgtcttgtcttccatgtagagaaaactacagtgctcgccaagtttgtacattcacatccattactttacatgaagacatatgatattcctttgagtaaacttcacttaatcctatgtattgtgttctaagctgcacaaaaccaaaagtctaaaaccatagaggttttagcacatgacacttaacccgacatattatggctgtaaagtctcacaaaaccacactattgatctttttgactttgttctaactaacgcatttgcataaattattttttcaacttgtaccataatcgataaatatggttttatgaaatttgctatttttttctattggggatgccttttgcatatgcaagctaacagttatatagtacactcatatttcaatttgagttgaatatcgttttattttcttgttgaaacatacatttccttgaaaaatcatgtattccacctagtatatatttccttcaaaaaacaatgtaatcctgttgaatggtggcgttgggcagttgggccttcgttagaacaagttggatggctgttctttgaactttcgtccccaaataacattgggtaccgagctagaattcggcctgtatgcatcnggtngtcaatcaatccat

SEQ ID NO: 77251 - DNA, 45975 bp, Oryza sativa
ctgggatgctatatgagggggtaaatggcagcaatgggtgaagtagtgcttgggaaataatgtgaggcagccatataggtgatgacgacgactatattttgttgaaaaaataaaggccatcagaccctgcttttcattgatagtcacaatggtttttactaggataccaggctaccaactaccgcaagagtttgtaagcacaaattgagcctgttaagtaaccttgatggactgtggctgcagctataccaacagtaactacaacaatagcggtacatgagtgctattaccgttaaggctatgttcggtatccccttttcctaacacctctccctcgttttttgcgcgcatgcttttcaaactgctaaacggttcgttttgtaaaaagtttctatatgaaagttgcttaaaaaaaatcaaaataatctattttttttaaaaaaatagctagtacttaattaatcacgtgctaatggatcgctccgtttccgtgattactgatccagatgggaacaaggttgtgcgaacacagcctaagggcctgtttggggagctttagattataagaagcatctgtttggtagtcagcttctgagaatctggaaaagctctgaaacccagcttctccagcttctggcttcttagttcatttttcagaatctgtaactacaaattctcagaatctgtaactacagattctcagaagctgtggactgtttggggcagcttctagcagaagcagcttttggaaaaagctacaactgggacaagctcccctaaactgggcctaagtgcagttgcagcaacaggaggtaccgagtagccccatcaactggccacaccctagccaaccaagtgaaacatcattactagaacctatggttaaactaatactgattacaagtcatacggcgcatattagcaataaaaaaatttataagtaaaacttttatatgagtcctaaacgatttaacagctcacattggaaaacaaaatgggatgaaaagaattcaaaatcaacatcagaacgaggttttaaattttaattctaagcagctgttataggctgtagggcaaattattgcagctctaaactatggcagaaccatctctagaaatacttagccaaaactccaagggatgactgcttgacgtttgtttctggacattactgttgccacggaagttgcagtctagaattgacacatcattctcctggctaacaggctcgggcttcctagctctatgacttgtaattgtcacttaggataaatccattgcgaagacacctgacggccgtcggcctaaacattagctgtacaggctatatgacacgtatatatgctcgtatcctataggtcgctagctatattgatgcaatttgcaaacctatcttgcacggaggatactagaagcacctgcaagaatgatgacgtagattcctgctattgtttgttttatcaacccatcgatacactatctgacagagtaaatttctgcagagattatctactcattaccgcacaaggatatctcgttcgatcattccaattcccaggtgcctatcattaccaaccaccgttccatcatatctactccttcagtcccataatataagggattttgagtttttattcgtaacgtttgaccatttgtcttattcaaattcttttttgcaaatataaaaaacaaaaagttgtggttaaagtactatagataataaagtaagtcacaaataaaataaataataatttcaaaatattttgaataaaacgagtagtcaaacgttgcaagcaaaaactcaaaattccttatattatgggacggagggagtaggttttttgaggagtatgtatggtggctccattgtagattttttttttggttgttgttgttgcaatggttccatcaaactagtatgggagtgtaatatttgtaaacacaaggctgatcgagcagcactcggttgaggtctgaaacaagttgaaatgtggagggatgcatatacatggatcacaaaccatttttttaaagtaaatttcagaaaactgcaactttaatgacaaaattatcagtttattgcaatattagcggcatgtttcagtttgctgcaataatagcgtgggaattatcacaaaactataacttttacgtcatatggtgctacatttgtcatctatatgtactgtagcaacatataacgtaaaagttacggtttagtgataaattctcacgctattgttacagtaaactgaagcatgtcgctaatgttgcagcaaactgatagttttgtcacgaaagttgcagttttctgaaatttactttttctttttacatatcttaacatggaaatatgcgaggatatagacataaattttcatatacaaaattttactagactggtagggggacaaggcacattaaagttccacgcatatatatacaccaacacaagattttcttttggatatgtataaaaataaattgatcaagaagcatgtttggcagttaaactatggatatatgatttcaccaatcaacttttaaccataaatattttaaattgctatccacaattagcattgtttttgtaggatccaatcacaagaattaagctaaccagaggggggtgaatggttggtatatctaaaaaccgaaaaacttttagcggaaataaaagttaccctcgaaatcgacggaagtcggtctgaccgagattgatctgccggtctgaccgagtggatgctgccggtctgaccggtgttgaatctccggtctgaccgccgaagtcgcctgccgcgcctgccgccgctgccggtctgaccgccgtgctcccgccagtctgaccgccgccttgccgccggtctgaccgcctgtgagttgccggttagaccgccgaaacccggtgaaacacaaatcgaagaactctcaaagtagatgacaactttattgcttctctctgtgtttacaaagtgcaacaacagcactccttacaaaaatctcgactaaactcgaaaccctaactaaactagcaactcaattgctctcaaaagcaatacaaaagcgataccggaaagcctcacgctccccctctatttatacatgacgtaggcagcctaaagccacgaaccaaactcatactaagagtcctaaacaccttaggaaaccctctggtacaagaaacaaactttacataaccaatcataccaaatttgaactccttccaaattcgactctgcatcccatacgcacacaatacctccattgtatgccatatggaatctccatcaaccacgtgcatcaactctagtcttagtatccctcatgatatctgaccaccacggacatcgtcttaccaccaaaccgactcccggtccatcaccgcaaatactctcccgaggcatcgagtcacctacgcatgaaacaaacaaagaaactatattccgagatcaagctatccccaacttgactcattgttaacaaacaacagtattacatatgtatagtatccatctagaagccataactctgaaacaatcacggatatctaaagaaacaacccgaaaccaaaaccgacacagcgtcggccggtcagatagcgggccggccggtccgaccgcacacatagcgccggtctgaccagcaacctccgcccggtcgtaccggacacataaaataacagtgaatccgatcatcacctgaaaattgattatctccaaaaccacttcgacgataatctccaaatatcaaaaccaataatcacagaataagaatcaaaacacactttgatcttacagttttgataagattttcaggcttacatattttatttaagttatttgtttgtcaagcgtgcatgcattaaaaggtcacgctgatggttcatacgcatccttgcaatgaaaaaaaaaaagacactcacgaagtttgtaaatacatgtaatttataatattggtttatggcatttttgtggcatgaaccatttgccacattttaaatgcgcacatggttttaacatgaatccactatttagtactccgttactcgtagatttacacgtcacttgtaaaatcaaatcatactgtgaggcatttccacacttgtaacctcgaactcagtggaaatgcctaacaaagcaggtattcggtgcagaggctgtaacaaacgcctaacgaagcagaagtctgtcacaaactcctaacaaaagcagagtctgaggttccactgagttgaaggtcataaaaaataacatcaaattaagcactatcccttacaaacttactgggagtagataacaaatttatgatattttaagattaccttgcattaatttttcttaactgttggtgatataccctagaggcaatcatagagatgattgtatcacataatatgtttacatatttattcgacattgttccttgaaatagataactaattattagttaatgaatatgtgattctttcatgagactctttatgtttaatgaatatgtgattctttcatgagactctttatgttgtatgttgctatttctaaatgatccctaatcaaatatcatatgtggaacaaacatgtttagttgatcagtatatgtattaattgattatcatgtctcatggatcatggtatagagataccaaattaataatgtggacatatgttggggaacatgttgttggatagacccaacatgagacactgcaagagtcatatgcgttgtatcatcagtaatttcatttagtgttggtattgaatccttggacctgagattatcatggttcccaacatgtgtagtagcttgcttagggattgctaaacgctactccgtaattgggtagttataaaagtagttttcgggtatgctatgaaacatgtagtgggatatgaataatcaagatgggatttgcccctcctatggagagatatatctgggcccctcgatgttatagattatggaagtgcatggccatgccaaaggtgattgaggagtcaatcacaagttatataatctatcacaagttcgagtgaatgattaatctattagaggatggcacatatctagccttaagcttaatccatgtcgtgaggcagaggggttcatacaagtatacactagaggttcaaccgatatgatctttgtgtatgctcggtcggtcaatacgttccgctaggggccactgttgacacgtggaccgaaaaggaattttcgggttacaaccgagtgtacatgaaactgcagggtcccacgtttaaagggccggaataaggggattggatggagacccaatatgagcttaactcggatagggatccgaataggagtcctacgggcgttgaaggcccgaatcatgtatcctatatattcgtaaggggtgtgaccggcggaggcattgcatcacgcgaggaaccctagccaccactcccctccccgagcaaaaccctagcagtgcatgggtgctagcatatctgcgcgtggcgtttcgtccctgtacatgtagataccggcagaggcgcgctgctttgcggtgctgatcggcgtgggagtacggcgaggagaacgcacgaggaggagaagatcgagccggtgcgatcaactacttcctctacatcgacgcgctacatcacgaaggttccttcgccttcttagcgctttctttcgctgcgcaacgcatcgagtggtaaccatctatgatataacactttgcatggtttctggtttacgtggtagaaaatgttaatttatgctatcgtagcctacgcatatcccaatataccttgcattaatttttctcaactgtaagaaacattttcacatcttccatatatcccgaatccgtagctagacaaatccactaaaaaggtgcgtactatgcaaatgtgcagttgacagggtggtgctccgattccatgggttgatccccaagtgccagaggcccagagctattgacattcagtaagaaaaagagctaattgcgttccccaagaatggacatttggaagatatatgtaagacgtggaaatgtttccacatcttccatacatcttacatcgttccacactattgtgatttctgaaagacatttcagttaacagtacttcataatcttaagagttaagagctccattatggtgctctttactggtagtattctgctagtagtataaacaatctaagctatcgatttagaagcaggttataaacgtattttatctctctataccaggggcatttcatcattgacatatttcttccaaaatatctgattagatctatacggtgcctaaagagatttcatttgttgggacctcccaccgatgtatcagccatcactgtagtgtgcaaaaatatggcttgtgatgaagaaaacaaaacatatggatataagaatgaagccctcctcctctctcataacccacttaattaaggagatcctttgtttctcaatgctctgttcccgtttcagtttgagacattctgaatgcaccccaagtgtgcgccgccctgctgaaacaagctgtcatcttgccgttgcggcgtcgtctttttgattcatctgatcgggaacgagacatgcctcgccccacttgtgaattttgaaccggagggacaaatattttgattctccatatacccttctctattggactattgcacccttgctagtttctactaccactaatgaaggtgatagtataaatagagctagttcatcggatagaaaaaggtctacgatatagattaatatctactaatagcacaatagccaagcccccttcttaaacactcggtaaatacccaaatacattttacacttcaatccatttcagtatttcaatctatttcaggccccttttgattcaaaggaaattcgtaggaatcttagaggatttcatttctataggaatttctcctatatagccctttgaatcaaagtaatgaatcctatggaatcctataaaattcctatggaatacctaatgccatgcatgtttttagaggaaaattaacattaggttctacttcatggaaacttttctttgagtctttatctctcctctaaatcctatctttttcctacggtccaatcaaacgctcattcctgtgtttttcaatcatctattttacacaattacacttacaaccgtatcaaaatcctatgtttttcttattcctgcgtttactcaatcctgcaattcaaagaagccctcagtcttctagcagtgggccctcagtcttctagcagtgggattgggtgctcatggagcttgtattcacggacactcaacatccttcaaagtgcaattgtttaatgctgtcatccgccaactttggcagaaatatacatgaccaaatcattgtaattaaccaatgttacaaaaactaaatatttgagagaaaaggaaaaggaaaaggtttatagtgttcgcgaaaaaacattctaagcacaggcaccaaattaatagcatatgcttttccaaaacaaaatagtagaaaattattgtggaaagccaagatgctgccagagtgccagtagcaaaatgtgactccaatgcaaaccaaagccatacatgtggttactcatatcggtagtgcactatcggtagggcactaagattcaaccctactcgtcagaacaattaacttcctgatgcatcatcttcctgtattttggattacttggattacagttcgagtgctgaaaagatgaacagctacaagggaactcacaatattatattgtatcatttgtcgcaaatttctcatggatctgagattagtcatatgttgatctttgcttgcaaactccatgaagtaatgaaggtgcagcaatacatatagacggcgtaaacgaagtagtaaagctgttgcaatatatgtagacagcgaagtagtaggtaagttataaagatggcgagcaatggtatatactactaccaccatttcaaaatgtttgacgccgttgacttttttaaaaatgtttgaccgttcgtcttattcaaaaaatttaagtaattgtaattctttttctatcatttgatttattggtaaatatacttttatgtatacatatagttttacatatatcacaaaagtttttgaataagacgaacggttaaacatgtttaaaaaagtcaacggtgtcaaacatttagggaaggaggtagtatatattatgactttcagtctttcaatacatgcagatcatacgaaaaaatgaaatatttttttagtgaaataaaacattattgtgtttcatggggcatgaattactaaggaacaacaaatagattttattgctttatcagagacggttaacaacgatcttacatcttctgcccttaaaaatctttatgcttgaagagattttttttttctgcattgtaaacctcctacggagcgatctggtggtatgtgattaatttagaaacttttcatattggtttaattgatgagggtgatttttatataaagtttcatatttgtaataaattaaataagtttaaatgagctttagattttgtgtatgattggcacaaaatgaatctaaggaacaattttttactgaattagttcatatgtgtagtcatgaaaccttaccaattattattggtggtgactttaatatattacgcagctctgcggaaaagaataatgataattttgataatagatgacattttctttttagtgctattattgatgatcttagtcttagagatctatcaatgtcttgtaaaaattataattgggcaaataaattaccaatgtcaacttatggaaaattagatagagatgtctcggatcatgctcctttactcttaaatacaaattcatcttctatttgtaatagtcatcaaaacttatcttctgtttgtaatagtcaacaaaactttaattttgagttagatcggttattaagagatggttttgtagatatggttcaggaaatctggtcaaatgttgttagataaaaaagttaaatctggtcaaaggaaaagaaggacttgctgaaaatttagattttgttagataaaaaaagttgaattaactctattgagtgaggatgagattgatacaagacgttttttaggaatatgttagctagtttgcttagagaagaggaaattaaaaggtatcagcgagctaagactaaagatattttggaaggtgactcaaatacctaatattttgcttagagaagagctttttttgtcttcgtgaagcttcttcttaaactttgtatgaaagccagataagtgatatcccccaagtgtctcaattagaaaacaattctttagtagatgaatttacggaaaatgaaattaaagatgcaatttctcaaatggaacataataaagctacgggtccagatggattttctgctaagttttatcaagtgttttggaatgttatcaaacctggtttggtagatttatttaaggattttcatagaagtctaaatctttaatcactcaactttggtactattattttacttcctaagtgcaaggaggctattaagattcaacaatataggcctatttgcttacttaatgccaattttaaaatttttactaaagttgctacaaatacaatttctggagtagctcagaaagttattagtcctacataaataccatttatacctgggagaaacattacgaaaggggttgttatcctccatgaaacagttcatgaattacatcagaaaaaaaatgaatggtaagtttttaagattgattttgagaaagcctatgataaagtggaatggtcttcctggtcaaaaaaaaaaaagtggaatggtcttatgttcaacaaactttgagaatgatgggttttttgcaaaaatggtgtgattggattgcttctttcattcaagggggtcatattggtattaaagtaaataatcaagtgggggcaatttttcaaactcttgtacatttggtggatgattgtttatctattttacaatatactgatggtactattatttttcatgagcatgatttagagaaagcgaagaatatgaagttgttactaactgcttttgaaaaattatctggcctaaatataaattttcacaagagtgaattattttgctttggtcagttaaaagaatgttatgagcactattcaaatattttcggatgtaaaataggagagtttcatgttagatatcttggtatcgctatgcattataaaatgcttagtaataattattggttaacaattgagcaaagaattgagaacaaaaacaaacgagttggaaaggtaaacatatgtctgttggacagagatttgttttgattaattttgtgttatcaagtttagttatgtttatgatatctaagtctaagaggttcttcaacaaattaattttgatagatcccgcttcttttggcacggtgatgagcataaaaaaaagaaatatagactgactagatcggacattataagtcagccaaaagatcagggtggacttggtatcaatatttagaaatccaaaaccagtgtttattgagcaaatgattgtttaaattaataaatgaacaaggtgtgtggcaagacttgttgaataggaaatatcttagtagtaaatcaataatctaggtcgaaagaaaacaaggggattcccattttttgtctggtcttatgaaggttaagagtttatttctaagtatggattcctggataattaataatcgtgagcaagtcagattctgggaggataagtggttagggaatttttctttaaatgacaaatacccgtcgttgtattctatagttagaaggaaaagttcttcaattgcaagtgcgctatgcgttctgttccgctcaatgttttcttcatgagagctttagttgatcagaatttggtcaactggcataatttgtgtgcttcaattgtgcatattaattgaacagtggaggatgatatatttagattgaactttcatcaaaatagtcattttttttgttagatcaatgtatttagccataattaataatgggtatatagagaggaataagatcatttggaagcttacgatgcccttaagattaaaatttttatatggtatttccttaaaggaattgtgttaacaaatgataattcggcaaagaggaattagaatggtagtttgagatgttttttttatgaaaaatgaaaaaatttaccatcttttcctatattgtcatttttctagatttctttggagatcaattcaattatcatttggttatacccaccacatagtgtttctcatatgtttgggaattggctggtgggtgttaataaaaagttaagaaacctattcctgtaggtgcttccaccgtatgttgggttctttggtttattagaaatgatatagtttttgataaaactccatcaaaatcttatttgcagttacttttcaaggcaacaaattagcttcgggtatgaactcatctacaacggcatgatgatgatatcaagctaataaatgatgcaagtcaaaacttgagtcaatgattatgcacctttttgccaacttcgaatggagattctcgaatagaattcagtaattcagcgttcttttatcttgtgttggtgtcttttagtttatgttttctttatatcatgtcagtgtgttttgaatttgtttatgtgtggactgtgtaatcattagctttagctcgttgaccaaatgacggaatgttattccattatttaaagaaatggtgcatggagtatattgagcccaaagagtaagttttgacgggtacagtaggaaaacacacaaatgcacaaaaagggacggcaccatatgtaccggaaaatccaaaactaacatatataatgcttttccagtctgaacgcgcgtcgacgaagcaccatttgggaaaacgacacctacgtgaggacataggtgctggaaaaactgacacctataagtttgtcatgttatatatgcattttaaaataaagtgtcacatataataaatttaggtgttgtttttttaaaaaaaaacaaaacatatatagatgaacagaccaagccaagctactcattgggctcatccttatctcctcctcctcctcctcctcctcctccctctcgagacttcttctactctctatctgtatgtgtgtgtgtgtctctctctctagctcgcgcatcggtgctcgaccctcaacagcgctcgctcctcagccaccttttattcaacggaagcccccctctctaaacattccttccacctgctagatgcggcagtggctggcgaagatggtgtctcagcagaagaagggaggtgcgatgacggaggaggtggctacagctaccggcgtggtggtgggagaccgccggatctagcagcctggaggtcgagggccaccagatctagatgactccgaccttcatggtgatggtttgggaggtatgatggtgttggcgggttggagctgcgacaccatcagcggctggcggatgcgcatcttcccctccctcattcaattcttgtgattattgatgtttattcatgttatctagggtcttcatcttgaggatctggatgtgttgtttgtttggagtttattgattgtagttaatgtgttcatggatttggggcattattttgggtgatttgaggcatcatttgggatccggggtatttcaaggatatgcaaccttgatgtatcagcttgaatgcaccgagccgatttttttaagctcgtgtgcacctcaaaggtgtcatttgtgaaactggcaccaataaccagggttcatcagcgccgcatcggtcatgcgttttctataatagtgagagtcttttgtctataaatgaatgcacattttaactttcttaaaaaaaaggtgaagtacacagtctctaaagttgtacggtgtgtcatggcatgttacacttactacaatacatagtaggtgccaccatggtacgctacgtccacgcacaaagcgagttggggcctgtttgaacctgtataatattcagaataataagtttgaggattcgaaaaatacattttgagattatatggacgacacaatacaagcttaattgatccaataagagtacctaatttcccggaaaaaaaacaataagagtacctaattatcatagtttcacatttaatttttgtgctgttcgttacaagggaacatcatatattatattgttcattcataacgtatcctggttctaataatatcataaccccaaagagaaaaaaaatgatacgagaaggacctgatcagcaatatttttttctgtattttcgtaatgctaagttcctttccataaaaaaaatctctaaaccatgttcggctaatccccgtgagagagggattagagaggattattttcatgcctaaataggtataaaatcatttctctctaaatccttctcaatcatcttttggatggtattaaccgaacaaggcctaaggagttttatggatttttctgaatgtttattaacttagtgtgaaccaacgaataggcctgagcaattgcattacatattgctaagtacaaaaataattaaatttgagattgtacaaatatattgtacactgtaacgtatacaaatacgtactgtataattgcataagcaaagcaacatgcacatttgtagagaccacaagctagatatataggccaacagtagcagatccagaaaatcgattcattggtgtcataacgtgtctatcggtgtcatagtatgctaattatgcttagaatatgatgctataatatatgaataagtagttttgctataggttttaccgaaagtcatcggtgtcgcctgacaccgatgactatactgtagatccgcccctgtaggccaatataatccgaacgaagtaaaatatggagctattcaattcgagtacaagacgaaccctgaatcatcacacgctgagcacgcacctatacatagatttggcttcagagttcagacgattcagtaacacacactagaatgcaaaaatctgcataaacgctcacgaaacgttgctacattagtactatagtactaccggcatcggtagatcttcaagcaacccctctgcggcaagttggacctccctggcacgcacgaccgagcgcacacgggctgattcggaatgaagcctttgtaggtgaggccgttcggcgccgccgcggccatgctgccggccgtgagcacggccgccattgccaccaccaccgccaccgccacgccgaagacaaagcggatggcaacgcggaagcggccaatctgccgctccggcgccattgatggatatcaaaccggtcattctggtgcagactagatgtctagattcttggttatttatgcgatgatgggcagcggttggtgggaagagggtggccaacagtattgctatggtatgtacatgcttatcatttacttcctccgtcctgtaaaagccaatataatattggatgtgacgtattttagtactataaaatggatatatatatgtctagatttattgtatcagaacgtgtcatatataattttagattcgtttttttagacagagggagtgctggtcactgagttcatggaagcttgcgttgctacgtacgagagggtgttcagggtgcgtagcgcaatgtttgccatcatcccaatcatgttgtacggctagttgactagttttgttttgccttatgtttggtgcttgcaggagacaagagaggccctcgtgatcaacagtacacaacttgacagcttggctcggctgctttggtcggtgagctgctgagatatgtgggtttacatcgtccggttggaaatatttgatggttgtgataacatttggctaaagtcttcaaatatttgatggttgtgataacatttggctaaagtcttctagaccatcaataattttgcaaacgtctagtaaaaaagatacggtatggatatatatgttccaaagaatactattaattataatgttatagcataataattgatgttttgaatattcgaccaaatcgtgtgaaatggactcctcttggcattagtagaagtaacgttaagagttccgaagctagatcgcattgatatggtgtatcataatgcatgcatgatatgtgctgttgggaaattttgacctagccagtagcatataaacagggccagcccaggggggtcgagcggtacgaccgctttggccccccaaatcgcaggggccctcacccaacaccaccccccctccccccgcccccgccccacccaggcctagcatcaaggcgaacagacgcgccgtgcgcagaagccggaagcggaaggcgaacaaaatgcgatcccgcgattgccgccgctcttctaatcttttcctcctcacggcaccaaaatcgcgcggcgcaatggcgcaaggccacgcatcggcgcgccggtggccggcttcccctttttcttccgctgctccgtacgacggtcgacggcagtagggtacgaggtgcagtgcagctgtgactccgtgagcgcctggcggatgcagccgctgccgcctgccacctcttgaatcttgattcaggtattactattagctaggatcctatgtgcctgtgcatttacatggtagcagctggattagcttcgtctggttcagttatgtatagtcgtcagattaaagaatttgctatacaagctttggctgttaaccgatcgtcaaataaaaaattgaaatttactattgtgatttttatctattaatatgtaaataagcatttattgatgtatagtcgtatgttaggtttattcagttgttccaatagttagacatgacgaagacactagtgtgtatttctgactcacttgcggtgtgcatctagacgcttgtgatcaactaattggtacgattttaaattttgatttgtaattttgatttgtaattttgttatgtaatttatatgagttaaactactatattttttttgaattatcaggccatgtcgtcgagaaagtatgcaacgggtagtgagagaaaagggaaaaaaagaaaagggtggatgatatgatagaatcgcagaagaaacttttaaggtaacatgtgcattattgtctatttaaatattatttctaaatattgggggggcgccacccaaaaaaaaaattttttttttttttttaaaaaaaaaaaaattttggggtttttttaaattaaaggttatttaaatttcaagtatatgtaactattgataatagtatggtaagggtctctaaatttagtttcccaccaggaccctaaaaagtcaggaccggccctgcatgtaaaccaggagatcacatatggtcgttctcacccattacatgtgggatccacatatcagtttccataattacaaattacatgtattggtcggtataaccaacgccttccaatacaggtggtgtcgctctgtcatcatcttctcctcgagacactaaaccgatatagcatatatctctggactactaaattggtggttttgtatggtggtcatgttgactatttgacttgatgttcattccttgtgacgtctacatgacaattaggtgatattagaagaaaactaaaacatagaaaactcaaatggacctgcatatcaatcggtaaaaagaattgaaaacgtgggctcatatattagtctgccctcaagtgtgctcgcttgcgctgcatgcctctcccgccggcgttggcgtcgatgtccctgcggccagccacagcggttccagtggttcacgcggagttcctccactcgctcatcgcctccaagggctgcgcacttgcgcacccatcgttatccgcctcactcaccctctctcgttgtgttttgctcgatcgtacgggggttcatggcgatcgctcgagtgttggattgagccagacggggatcgagtcagtcggtggtcatggaggaatgcacgccgcattacttggcacgtggtggggttcacgtgagccacacactgagtgcacccacaagggctgactgcactgtagagaggatgacccttgtcaccaccgtcatgtacgaggctgctccaccactgcctcactcgccaccagcgtctcccgccgcgtgcaatacaagaagaaacatcgaacggtcatataaggtaagacccactaccgatttaacctatccttcccacaatctaatccactcatttctcctcccacgatcttattctctcatttctcctcactatttttgcatttgtaggaaacacaatgacaccgtcgaagaaagctggtggagcaccgtagccagcaatcaccaaaacacagaggggaggaggtcggcagcggccatgcggacggcgacgagacaacgtgacgcaaagagggaggaggacgttggcgatcatgctggtgttggcggaggaggtcactggccacgcggatgacagcggggcagcgcaacacaaaaaggggggaggatgccggcgaccacgctagtgaccatgaagcaagatgatgtgaaagggaggaccggacgagggttggacctctgctgccgacatgaagagcgtgatgtgtagaaggagatgttagaccagatgccgacgcaactagccctggcaaggtcacccgactgatatcgctgcttgcccttgtcctcatgtacacaatcagcttgcttatctctcccatactggtcgtttgtttcccgtggccgaaatagaagaagacagaggtaggttttgttagagaattttagtggtattgtagcctatttgtaattttgttgtactttattgtattaatcaataaaggtgtttcattctattttgactcaatgttgaatccattgatctcttggtgttgcactcagtatgttagaatattacattccgttgaaacaatcttggttaagggttggaacatttttatctgttcgtgaaacatccgtaatattttcgttgaaacaatttttatcgacagcaccgtccaacaatttacaccaatttggacgtgtgatacatagcagtccccaagtgaaactgaccaccagttgaaaggtatacaaagtgaacttattcatctaaaagaccgcagagatgggccgtgggccgtggcctgcgaaacgcagcgttcaggcccatgagcatttattttttaaaaaaatatttcacaacaaaaaagagaacggataaaatccatcgaaaaaaaaaactttcctacgcatcctctcctatctccatccacggcgagcactcatccaaaccgtccatccacgcgcacagtacacacacatagttatcgtctctccccccgatgagtcaccacccgtgtcttcgagaaacgcctcgcccgacaccgtacgtggcgccaccgccgcgcctgccgcctggacacgtccggctcctctccacgccgcgctggccaccgtccaccggctcccgcacacgtctccctgtctccctccacccatgccgtggcaatcgagctcatctcctcgcctcctccggcttataaatggcggccaccaccttcacctgcttgcacaccacagcaagagctaagtgagctagccactgatcagaagaacacctcgatctccgagagttttttttcagctttagcttaagcaggatggagcaccaggggcagcacggccacgtgaccagccgcgtcgacgagtacggcaacccggtcggcaccggcgccggacacggccagatgggcaccgccggcatggggacgcacggcaccaccggcggcatgggaacgcacggcaccaccggcggcatggggacgcacggcaccaccggcaccggcggcggccagttccagccgatgagggaggagcacaagaccggcggcgtcctgcaacgctccggcagctccagctcaagctcggtacaaacattttgcccccaattctttacccccccagtaaaaccttgcgtacaaattcgttgaaaaattttaatgtctttgtgacagtctgaggatgatggaatgggagggaggaggaagaaggggatcaaggagaagatcaaggagaagctccccggcggcaacaagggcgagcagcagcatgccatgggcggcaccggcggcgcctacgggcagcagggccacggcaccgggatgaccaccggcaccaccggcgcacacggcaccaccaccaccgacaccggcgagaagaagggcatcatggacaagatcaaggagaagctgcccggccagcactgagctcgacacaccaccacaccatgtgtctgcgccgccggcgacggccgccacgtcaccttcctgaataataagatgagctagccgagcgcaataaaaggaaaaaaaaaatgttactgtcgtgtgatgagtgtgaatgtgtgatggcgttctccagtacggaccgtgtctgcgtgttgtttgtactgtgaaagtacgctgtgtatgtacgtcgtatgtgtacaattccgctttgttgaaatacgtataaatatatactgtgtgtacattatacggtgtatatctcatcgtgcatatgtacacaacgttttggtgatcgttataatgttcatttttttccttattctgatcaatctggatcataggctcgagaaattgctatagatcaacggccggaaattgcagaacaagaaagtgatcctattgagtattagaaatgattgatcgttactaccttataagaagggccccggacttttgttctcgaataagtaaaaaaaaaacgaaatgattgcgcgtcatcccgatagaagggcaaatactccgtaattgtcctcgccgtaaccttaaaaaaaggcactcactgtggaatgaatgtacaaaattagtttattatagcatccaaagtttcgagtcttccccggtcggctatctttcctaaaaaatcataacttgcatatgcatttaaaacaaaatcaatctgttcaaattgaagacatgaattcaggtaagcatgtttaaccataaaaggatattgcatcgcgcgttgagcacaggtacgatcggtctatccctttctatatttgatgagtaattttacccttttctaaggaggtaccactttttcctttttttatacctctcgatatatatttaataaggaggtaccattttttctattataaatttgatatctcttaatatattaatatatatttgatgttctattataaatttgatatctctcgatatatatttaataaggaggtaccattttttctattataaatttgatacctcttaatatattaatatatatttgatgagtaattttaccgttacgaggaggtaccaaattttttattactagaaaaaatatccattgtaacgggtgaagcctattttatcttattattgttatttggtttagaaaaaaatatccattgtaactggtgaagtatattttatcttattattgttatatggtttattattattatatggtttagttaagatgcgatttactgtagcagttcgcttgggatatatttttagaaaatcatgagctacagttaagagtccgatcatctcaaattagcatacgagtttttttaaacatatttcttatatgatttcttatgtattatcaaagtgaatgctcttaaaaaccgactcaaatatggagatatatttccaaaagcaaatgaacttaaaaactgacttatacacggatgacgtaccaaaataccggcaaaagcatcttcaatttttatatttatagtagtagagatagagaagagatatagattaccgactcaaatacgaatatgtatttccaaatggaaacgaacttaaaaaccgactcatacacggatgacgtatcaaaataccagcaaaaacatttttaatttttataatagtagagaagagatatagactaaaacaaaaacataaaattaaaaccaactcaaatatggatgacgaatcacagaaacatctttaatttttataatcgactcaaacatagatgacggactgcataaacattttcaatttttataatagtagagataaatttgatacccctcggtaccgagattttatgaggtatcaaattttggtatctcatgttaccaatggtacctcttcacgctagaattgctcattttttattggtttttgctagacttgatccgtttcccgttttgtagattttgtcgttttgttaccatcatgcacatatgtggtcctagactagagagtgtaaaggaacggcctaatatcttttctcttttttttatttttatgacatttttctaatctggtttaaaaattttatgcatagagtttctatacctaataatttctatttaagaactagggtagccctcgtattcgtgtaggcatgcatattagtttgtcttgtaaataggtttaacaaaataaatccaaattaaatgaggcatttttcctttttaactgaatgttttctcttgtaaataggcttaacaaaaataaatccaaattaaatgaggcatttttcgtttttaactgaatgttcatcgtcactcttttttaaatctcttcgagaaacttttattgctattcctctctttaattgattaatgcatggatgtgaattaataaaaatagcaaagttctttaaaattatattttttttattttgaatttagtgagtgagtgattttaatttcattttttttatttttttataaatttattttgtgggatttcaaaattgtattgtgttgtgttgtatttttgttcttcttttaaaacttattttattatttcgaatttcaaatatttatatatattctacatggactcttattatatttttatttacaattttagtgaagattttattttatcttttaatgcttcttttaatttttttctgaaattaattacaaattcctcgtagtagatctaccatcgttgtttacctccgaaattttagatagtaaatagctcagcgctgaattgaatggcgttgactccttctgacctggccaatttttgctagctcggatgaaatatcagcgttaatatgtatggcgctaaaacgttacacctctgagtcaacggcctatttttataataagtttttggcatggtctattcttaaaataagttttctcaaagggtcaatttgtcaaaattacggtattcatctcacagataatctcgctgacatcctcatcgctgagcctctttcaatgcattggctatgatgtgatgaagcatagcacggagataaagtcgtcttctggtctttgtcgaacacgctgaacgcctccatcgaggagtccttgtccttttatctaatcatcgaatgcgccattagggccacaaactctgatggaaatcgatgttgccactgtcgtcggtgtccaccttgttgatcatgtcctgcagcctcgcctccgccggattctggccgtggcagagctcgacaatggagatgaagccggcttctggtttttgttgaagacatggaaccattcctgcagctcttcctcggagtccttggccatctaatcatcttgaatgctattaggctcaggaactctcctagaagccgatgttgccggcatccgcttccactttgctaatcgtccagatctgcctccgtcgggttctatcctagagtacctaacatggtttcgaggtctttgctggtggtagaacctggactatggactcaaatatttaaattcggctattgcttttaaaatacaaattttgttctcaaatttattacagtgtcacgtgtagcttaggagcgtttgcaggattttatgtcttaaattgttgagctaattataaataaaataatggtccatacatgcatattcataattgaatatacaacttaaaacatatgggacttaatttaaatggagggcactacgcgtcgggcgcccgatcttgggtgggaaaaatcggacgctcacgtcagctgacgtcagcacgcatgcatgcatgcatgcaaaactattttaactattttttcttttaaattattttaaccaaattataatccgattgcaccattaaattcgttgcaattaaatctttaaaacaagactgcacatggatatattccgatgaaaatttttttagcttattattgaattatttttaaatatttcacgttgtttcaccaagtatatcagaattgtttcactaagtagatcgaaaatgtttcaatcgtttaaatcgaccgttgtttcaccttatataaaaacaatgttttagcaaatagcgaaaaaatgcttgaattcactacaacatttaatctatatatatttaaacatcacgagtacactaggtgaaacatttttggtgcaacaaaggatgaaacagattttcttaatagagggtttccataatatgtgtgtgatttgttgaaaaaaaagtttcaattcactgcaacattttattcatacatagtgaaacattatgagtgcactaggtgaaacatttttagtgaaacaaaaaataaaacgaattcccttaatagagtgtttccaaaatatgtgggtgatttgttgcaatggagtatgtggtggagacacgtggcagggggtaggggcactggtggggcccaggaggcagagcccgtcgcggggggagggagcgcccaatttttctccctcccccgagcgaccgacgcaaaggattattgaatttaaattttgattgtttctttgtttgagtttatcctagaaaattagaaggaaaagagaggcagaggccggtacgtatgtgtgttcaattcttcatcgcacggggattgatgtgcctgataggatggggtactttgggttactttgagtttctatttaaatagatttaatctaatagtataaaattataggaccatttatttaactgaaaatcaatgattatatcaataacctttttgcttcttgtaacttataggacttgctctaatttattagtgtgccaaatgacggcttaagagcgtttaaataaagtttaataaactttgtataataaatataatatatgattgttaatagacttaacgttttgttttttctaatattttttctatagaaaattatttaaaaaattcatactgatctatttttatatgttaactaatacataattaattatatgctaatctatctcatcgatttacgtgccatgtgccagaagatatacgtttctaacttatggtctgtttagttcgcgaaatgaaaattttttagctatcacatcggatgtttgatcggatgtcagaagagattttcggacacgaataaaaaatcgcctgaaaaccacgggacgaatctttttagcctaattaattcgtcattagtacatgtgggttactgtagcacttatagctaatcatgaacgaattaggctcaaaagattcttctcgcgatttctcttctaactgtgcaattagtttttttaatttaagtatgtatttaatgttctatgtattaaagatttgtgcaatggttttgagaaaaaaattttgggaactttaaacctggcctcagtcatacctcaaaacacatccttgtcgacgagtcgtcgtccttccccgatgcggcgatagtccaccgggcatccgtgaactccgtatcatcacgatcgctcgttcccccaccggccacaacagatatcgaacacgtgcatgtcttcttatccatctctatccatctgcatggatatgatggtatgcatgcagcacgcgcggtcatctcccccacacagataacaaagtgtccagaagaacccaacggaaacacagtacgtggcagcaggttgccgcgtggcaccaccgacacaacgcgctactgcaggcagctcgtacacgtccctcctccgcctttattccctcgatattgccagctccgcctcccggctcacccatgcgtcacacgtacccccatcttccacggcctccttcctgatgaccaaattaagcttccatttttttttaactccagtagagagatcacacgtacacaacccacagtctcgccgcggtataaatggcagggcaccccggccagctgctttgctgcatcgatcgacggctttgacacaagtcatcttactgatagcaacaacactagctggaacacttgggtacacgagttcagggatctagccagagctaattaagcggagagttattagcttttaatttgcttgagaggatggacaactaccaggggcagcacggctacggcgccgaccgcgtcgacgtgtacggcaacccggtcggcgccggccagtacggcggcggcgccaccgcgcccggcggaggccacggagcgatggggatgggaggtcatgccggcgccggcgccggcggccagttccagccggcgagggaggaccacaagaccggcggcatcctccaccgctccggcagctcaagctccagctcggtacgttcactgtcgtccattcataaatctaattaatcgcctcgcttctgaattcctttatttaatttgagttgtactcgtgtgcgtttgtgcagtcgtctgaggacgacgggatgggagggaggaggaagaagggaatcaaggagaagatcaaggagaagctgcccggcggcaacaagggcaacaaccaccagcagcagcagatgatggggaacactggcggcgcgtacgggcagcagggccacgccgggatgaccggcgccggcaccggcgtgcacggtgcggagtacggcaacgccggcgagaagaagggattcatggacaagatcaaggagaagctgcccggccagcactaaattaataagcttatataattgacagccggggcaacacgtcgtcatgtgtgtagtagtatctatcgttttaatctgcggaataaatgacgtgcactgcagtgtatagcgtcctcgaagagaatagtactactgtttgggcgttcgcacgtgttgggttgtacctatagcttgtgatgccattgcaagctttgtatggtgtgtgtgtacacaggtttttagtgaagtgtgtgactttgttttggaattttcatgtgaatttcgtaatattctacggtacgccatgcttcgagtcatcctttttgattggaactcccatgtgtaagtgtttcttgattataagattaatttggagcctatcactgtgctctctactactcttttctggtagtagaaattaagcaaaatgaactgtcgatttcgtctgattagatcatttgtactatctcttatactaacccaattagcaataacatgggtattattggaaaaggaaagtagtagaaatatggagggtattattgaaaaaagaaaatacgaaagggtataatcgctatttcgttatttatgtagtaactaaacctttttccctctctttttgcttttccgatgattttgcgatgaaatatgagtgatgctaaccatcatagaatcatagtgccaacacatctaccatagtttacacgaagctaaatctgtcgggagatctcgtcgatccctctcgataaggatctcgtcggtatcgcggctttatatgttctctttgtactctcatataaactggattagtgctattaccttacgtgggatctgaaccaatataatatctatttttctcggttttgatgtcgtatcgtgtagatcctcgtatcaacgtatctcaatacttttttatccggtctacggctatcccccgtcgacaagtaaataacaccagaccattgtactaatagcaccagaacatcgctctaagatttcttaacattctggatagaagttttcatatttttcacacattgattataattattgaatgtattcttattgtttcactatttttttaagggttgtatttggtattattcggttttaagtagtatctactttttatgtaaatattgcatggtatttttatgagctttatatttgttatgttttagtgattactatttgtttcgatttttacggagagaggtaaagagaatggaaggatgcatgtagctcagtcaagagcacgcatgatataattactgcttgttgtatttgggtatatccagttttaagtagtatgtagttcgtatgtacatattgcatgatatttttatgatctttatatttgttatgttttacggagaaagggaggtggagagaatggaagggtgcatataggtaatataagggcacgcatgatacaatagctgcttgcgaacgcagcagcgtacgtgtccaaccgtagtcatatctcgttttacaagaccatttctaccatatcatggttgatccgtatattttaatcaagatgttatttagatcaatcgaacttataaatcgcacagttaggttctaaatatatccatgatcctgatttaatgtgtcacatgtagtctaactcgtctttgatagatctaaggaccacgtgcacgtcttcacagtagtaaactcgtttgcatttaacccctccaaagctcacaatggcgaaaaaaattactcttagccccattgctctattttttttcagggagggtgtgaattttactggctaaatagagtgattacaatcccgtgggacaagatcatgaatacaagttggagcatcaagtcttcacaccgcattatgtctagtccttctggctaaccgagctagttcatgaggcactctattatcccatcttccaacatgatttagacagatcttaggaagtaaaccaacaaaactcttcgctttcaccaacaaggcacaccatctcgatttattttgcccaaggggcatgagtttaatcacttctgtgcaatcggtttcaaggacccacatgcacgtctccgcagtagtaaactcgtttgtatttaaccccttcaagttcacagtggcgaaaaaattacacttagccgctatgctctcaattcttgccaagccaacttctctctactctactctctctctctctctatcttttcctctattgaattagggagggaaagcgatagcaacgtaaaatccggtggggggggtagagagagggcacaaagagcaatgaagaggagggaggcgggcataatgggaaaaaaattctatccggcagtgccgcaccaagcctctcgtgcggcaccgcgcgaactagcgatgcgtgtccagctatcgcccgcgcgagccgcgtctattgcgatttcgttggagccgagccgatgcctatcgcgacgagtccaagccgcaagcccgcaccttgaagtcgaatcgtcgctctcatctgccgcttcgtgcgcccaccgcttgtttcatcagagcgacctatgatcttccttctttcttgttcataacaattgatcgatctagtgtgtttccttgcctgctgcaccgacgatcgagccatgtttgccgtctctgcttgacgattccgctcagagcatggacgaccctgccgtgcagccggccataggcggcaggacctcgtcgcatcccgtgctacgatcaaccctaacaccggagtcagatggcatcgtcgaaatctcaatgttggagccgtgttctgctgatgcaattgcccttcctttatcctcaattcctaccatcgagccaatggaagatgcttcaatgggttcagcagagccgatggaagatgcttcgataggttcagcaaccacaatagctccaacagaggtaaatagctccgaacaaactttcttgttcacaacaatctgatatattatcggtatatgtaattcgttcaaaattttcttattatactgttggtggataacatgaatggtcaatctgtaatagtacctcaagttggaatgtctttcaaatcagaaaatgatgcgtatgatatgtacaactcatatgccaggaaaattggttttagtattagaaagagcaccacaagattgagaccagtcaagactatataccagaagcatatagtttgcagtaaccaaggagaacgaggaaagcactcatcacatgtcacttcaaaagaaaatgctactacaaggacgtgttgcaatgctcgtgttcaattcagtataagtcgtgagggaatttggacagtgcaaaaggttgtcctcgagcacaatcactatcttgctagtccaaataagaaacacatgttgaggtcccaacgtgatagaggcggataaacttctaatcagtcaaatacgagaagctggaatacaaccagcccaagtgtatgagtttttcaagcaatggtatggaggagctgagaatgttccattctcgcggatggattgcaataatttgattggccgtgagcagaagaagtacttgccatccaatgatgcacaaacgctactggagtatttgaaaaacaagcagttagaggatcctactttttttatgccatacaagtagatcaggaggatggtcggatagctaatttcttttgggcagatggtcaagctatcatggattatgcatgctttggtgatgctatgtcatttgacaccacatttcagactaaaaagtttgaaatgccttttgctcccctccttggaaccaaccatcataagcagacaattatttttggggctgcactgttgtatagtgaaatgattgaatcatttgtttggcttttcaacacatttctaacagcaatgtcaggcaagcatcctagcacaattttcacagatcaatgtgctgccatggcagcagcagtaaggatagtatttcgaaacacaaggcaccgtctttgtatatggcacatttatcagaatgctgctaaacatcttagtcatgtaattgctgaccatcctcaatttcttgctgattttaagagttgtgtttacgaagaaaggtctgaggcatacttcgacaagaaatggaatgagttgttgagtagttataagcttgaggagaactcatggttgtagaacctatataagttgcgggttcattgggctgctgtctttcgtgattcttttactgctgatatgacctctactcaaaggagtgaaggtatgaacaatgttttcaagaaaaggtttcgtagaaagctttccctatctaaactcctagaagaatgcgacaagtgtgcaatgagtcttcgtgataatgagttggatgcagactacaaatcacgacactctacccctgtcacttatattcgagatttaccaatgctgaagactgcagctgagttgtatacaagaaggctttattcagaatttgaggaacactttaaagagcagttttctttctcatgtaaattcctgaaatctgaagggtcaatcatgacttataaggtgatgcctatggaattccaggaacaaaacaataacatgttcttgtcacatgtatgaatgcattggtatgtacaagcatttttcaattgcactatagttcacaatatattttgcttaaagtatttctacatgtttgacaggtatattgtgcaagcatgctctccgagtctttaatatcaatgaggttttcatctttccgaatctttaatatcaatgaggttttcatcttgccaactcagtatgtactaaatagatggacaaaatatgcaaaaagaggtttttattttgagaagaaacaaataagtgacaatgaaactttgagaacgcatgcagcgcgcatctctcggaaggcgacatctgttgcacagtatcaaaaagaacttcttgatgatatggaaaaagctatagacaagttggacctagaagcagataattcactgagcaaaatacacaccaaaacttatgaggtttctgaaagttctaatggatgtgttggagacatattaaaaggtaaagtatcaatcagagttcctcaggtcataaaaggtccaaagaataaaagatcaaaaactgtacttctaaagaagaaagggaagaaaggaaatgctgctaagaaaaaaggtagtgcttctcacttaaaaatatttttttacatctctcttgttagctagtaatattgattcccttttatatttgtaatctaaaggagaagatccaaagaaatcaacagacaatggagaaatgattcaagatccagatgaattgattgtaagattaatgatctggctttccttccaataattcatttagctgcacttggcctgaataatttcatttttttattagggctcttttgatgcaaacattgatgataatatgcatgaagatttttcaactatggttgctcctccgatccatggagaatatacaagtcttttgtttggactagatcaagatgccatggctgctcggaagttacattttgattaaataggaaattatggaacatgtaaggtgtagtcgtgctttggcaattatttattgacatgagactgtagttttgctgtgccagcagcctagaccttctttgtctctgcatctggatacccttttagcagcctgctgagagccttggtgctccttgtgattggtttgaaagctggaattctggaaaccccagcagtttgtattttccttttcccttttgtttctttaagtactgtatgaactcttatgctttcaagtaaaagctggaaggggtaaccgtcttttgtctaaaaaaacaagactgtagtttgccattccactgttttggaggtttataataagatgttgggctttattttgtggagatttcctatgttttggagatttataaccagatggatgcaaatcttgatgaaatctggaaatatgtattcatatgagatcactgtatccaatctgataagtagaaattacaatgtgctcattgacaactgtttacaacaccatatattcacagcatgcaagaccatttggtccagatttcagaagaaaaagacaaccaaaacaatgcccttcaggagtagtacaaggctataagctaatttagctatattggccatatgcacttcaagttccttatctgcagtggacactggacagactatcagagtctccagctcctcctttggcgctgctaccttccatttctcttttcctggagagataacagatgtgtagtaagtcactgttcgcagtaatattcagcaaattagcactgcaattttgaagagctttagtgaaacaacaaatattcagaaatagctccatctcccaagtggacaaaatatttgcagaaggttcagatagtgagtaatatgattatgtcgacagaaaacttctacaatttccagttgtgctagattattaagaaacactaattttacatccttcatgaacaccaatccgtacatgagagaaaactacgctaatgcatttaatcattccaaattttcaatcaagcaattagaatcgaattgcatattttcaaaaaacataccttcttgctggcctgcagctgctactgctccctgtagacctgctcactcctgcggcgctgctgctgctcggctgctcctgctcacgcgcagcgagctcccgcgccgccgccggactcctgctgcactgctgctccggctcacgtgctcccgcggcgccacgctgccaccggcctgctgctcgcggctcgcgcggccgctctgacgctccgttgtccgcctgcctgtcggctgccgcctcgcggccttgcgccaacgcgccgtcgcccgctgtaggggggactcaactccgaggagcagcagggcccttatagtgcgccgccaccgtttcagaagcaacagcagcagccgccgccggccgttgccatagcagatgagagcgacgattcgacttcaaggtgcgggcctgcggcttggactcggcgcgataggcgtcggctcggctccaacgaaatcgcgatagaccggcttgcgcgggcggcagctggacacgcgtcaccagctcgcgcggtgccgcacgagaggcttggtacggcactgccgcatagatttttttccggcataatgtggtgtcctaatttttataatcaccatcaaagcttgtagtagtaggctggaaacacctatagtatgggtgtcattactttaataattattattatgatcactgttctagagagtcgaagtaatgtaatcgatttgggagtaccgtatgtaagaaactaattaaatacagatttgttaccatggtgggttaggtaggggcagaatataaacgctttataagatgttcttttgattttgataaggttaaaatttgaagattttaaccatggatcagtacacatccaaatataatttacaaatagaaatttataagagttatagacataactttatattccccgtaattattgatttcataccggtgacaatatattttaagccaaaataagggttacaaaaggtgaactgtgggagcatgtgccgttttctaattctagatagagcccgaggtaaacacatacgtggcggccggtggccgcatggcgtcaccgacccggcgcgctacacgcacacgtccttgctccgcctttattcccttctacgcaccagctccgcctcctggctcaccccatgcacgtacacgtacccccctcttccgtacccttcctgacctacacttcggtttttttatgtacttctccaacctccaagatcagtataaatggcacgtacgctacccttctgttcccctgcatcgatcacaagacacaagatttttcactgatagaatagcaacacttgggtgagagatcagacgcgtgtttgagaagatggagaactaccaggggcagcacggctacggcgccgaccgcgtcgacgtgtacggcaacccggtcgccggccagtacggcggcggcgccaccgctcccggcggaggccatggcgtgatgggaatgggagggcatcacgccggcgccggcgggcagttccagccggtgaaggaggagcacaagaccggcggcatcctccaccgctccggcagctcaagctccagctcggtacgttcactgtcgtccattcataaatctaattaatcgcctcgcttctgaattcctttatttaatttgagttgtactcgtgtgcgtttgtgcagtcgtctgaggacgacgggatgggagggaggaggaagaagggaatcaaggagaagatcaaggagaagctccccggcggcaacaagggcaacaaccagcagcagcagcagatgatggggaacaccggcggcgcgtacgggcagcaggggcacgccgggatgaccggcgccggcaccggcaccggcgtgcacggtgcggagtacggcaacaccggcgagaagaagggcttcatggacaagatcaaggaaaagcttcccggccagcactaaataagctcgaccgggtcgtcaccaaatatgtcgtgatgtacgtgcagttttatatgttgttgaataaactagcgtgaaatgcgagtgatggtgtcttctgccttgggacggatgacacattgtctgttgtgttctcgcgtccgtgtcggttttacccttgaaatgtaatatggtgtgtgtacacactaaggttttattgaagtgtgactttgtgcttgtgttatttggccgtacgtctgtggtgcttgaaagtagtttttcttccattgaaatttctaagagtacttgactctacaacttttctttgaggggtacttaactgtacaactagagatgagtaatttggccgtttcctcgcagttagattcggccagtggcccgagttgattcgttaaggagggacagttaactttgagtgcaaacattcagggaagcggaaacatggagcgcttattcagagcattggattagagatgagaatgagaatgaaaaagggtgataatagaactggttgggagggatgctccagcaggcctcacaaatcgtacacgacaatgtgtattaaaccaaagcgtccaaattcaaataaaaacactatgctaagattttgttaatagtgtggtaaatgaaggcattcaggatagctcataacactgtgtagggtcggattgtaatcaaacaggagaaggtatctgagaaaccgcattttcaggtgccctgtttggatgcttggcctgtgtggcgcagccagagccccatgggcttctttagttgccgaaaaatcatgggcttctttagttgcccagaaattttcgcccctcatgttacatcgaatatacggattcacatttaaaacattaaatatagtctaataataaaataaattacagattttgtcagggaatacgtacggattcacatttaaaatattaaatgtagtgtaataataaaataaattacagatttcaccaggaaatacaagacgaatttattaaacctaattaattcatcattaataaatgtttaccgtagcattatattgttaaatcgtaacgcaattaggcttaaaagatccgtctcgtaattttcccgtgaactatgtaattggtttttttctacatttaaaacttcctacatacatgtgtccaaatttttaatgcgacatcgtcaaattttgtttggaaactgttgcgtgctgccgtagccacagctgcagaaccacctacgatctcctctctggaaaagcgactctagggtgaaaaagaacttctctccggccccttcatttgaatgtgcggtgacattcaggtcgctgccttgagttgaggcggttcggcttcttctcgctgttttagttccaacttttttcttcaaactttcaactttttcatcgcatcaaaatttttctttttttgataatgtaaatgtgttatatctccagcctctgcccgtaggcacacagccaaaaaattcagacgtgaacagaaaagttaaaaaaggcgagatgggacaaactcccaacttctgccgatgatatgatctactaaaataatattttttttcaaaatcacgtagattctattatgaaattctgtaggtactacgccatccaaaatggaataaaagttcattggctactaattccaagcgtgtagcaccattgcgcatagtatcctgttgttcctgtgaaagcatcatacaccaagagtggagccaattggaacacatgaagataatctgcatgatggtaggcatttttttatggttaaaaactatatcattacggcaacgccaaattgaccaacataaagcactagctccaaacaaaatcatttttttgtaggtctaggcactccccttagccagtcaccaaaaatatcttttgcattgtggggaggggggatgttgaaggcaaagaagacacatcgccaagcaaaacgtgcaacatgacagtcaaagaaaagatgttggatggtctcttgtgtgttacaaaaacaacattgcttgtttcccctccaatttctctttatgagattatcttttgtcaagattactttttttgaagaaaccacataaatactttgatttttagtagtacctttacctcccataagatcctcttgtggattcttatattggaattgatgatcgcattatacatggatttgaccgaaaaatggccatttttatgtagcgaccaaataaagcaatccttttcatttgacagggttatgttagctagtcgagagattagatcgttccactcaactaactttggtcctacaattgatcgtcagaatgaaacattcaacggtgttgtgctcataacctctgccaaagtagaatgtctttttcggaccacattgtacagaaaaggatattgatatttgagaggttgcaagcccaaccatgtgtcttcccaaaatcttatttccatcccattaccaggtttaaaacatccatactgaaaaaattgatcttttactttcattaggccagcccaaaattgggatgttcctggtttgtgtgacatgtgggagaggggtttaccccttaagtacttgttgcgcaaaaggttttgccataggccatcaccattaagaagcttgaatagccatttgctcaacaaacatctattcatgatatcaagatttaggacacccagtccaccttgatcttttggccagcatatataatcccattttgttaacctatatttctttttctagctatcactgctccagaaaaagctcgatcggtagtaatccagtctttgaagtacacctcgaggtatttcaaaaaaaagataacatgaacatgggaagactcgaaagaaccgagttaagaagaaccaatctcccaccataggagctgtttttgcccttccatgtgctaagttttctttgaaacctatcctccacacatttccaatcagaatttctaagttttcgatagtgtatggggattcctaagtatttgaatggaaaggaaccaaagttacaaccaaacagttgtctatattggtcctccatttccttggctcccccaaagaagaaaatttcacttttatgaaagtttattttcagccccgagagatgttcaaacacacaaagaatggctttcatgttttttgcttgttcaaaatcatgttcaagaaatattattgtattgtcggcatattggagaatggacaaaccatcatccactaagtgtggaattacccctctaatttggccatcgactttggctctttcaataagaatggctaacatatcagccactatgttaaaaagaattggggacattggatccccttgtctcaagcctttgcatgtccggaaatttttttctacattatcattgactttgacacttacagttcctccttcaacccagttggaaatccaattgcaccacgattgtgaaaaccctttcattcgtaatgtctgctgaaggaactgccatttaactttgtcataagccttttcaaagtcaattttgaatatgataccatccattttctttgtgtgtaactcatggatagtctcatgcaaaatcaccaccccttccatgatatttctatttggcaaaaacgctgtttgggttgggcgaatgactttgtgagcaaccgttgtaatcctattagtgccaacttttgtaaaaattttaaagctgacattcagtaggcaaataggcctatattgttgaattttgatttgcatcagccttttttggcagtagcacgatgatcctaaagtttaggttataaagggataatgtccctttatgaaattctctaaatagagccatgagatcattcttaacaatctcccaaaagacctgataaaactctgcaggaaagccatctggacctggggaggagttatgatccatttgaaaaattgcctttttgacttccttttctgaaaattcaatagtaaggatgtcattttccaagtcggacacttgaggaatatcatcagtccatccctctatcatggatacatgattatgatctggaggaccaaataatcctttataataattggtaatgtattctttgagattcccctcacccgttattatagtgtcctcttgttccaactggaaaatcatctgcttacaatgtttaccattggctatcaagtgataatatttagtattactatcccccttggagtaaatgatttgtcttagatcgctggtaccaatacaactcttcctcccttaacagttttgccaaatcatttttggcctgcttcaacgaagctaactctgtgttggagagagttatgtgttcggcttttttgtttagtgtgtcaattaaagctaaaagctttattttttgttttttatatgtgccacttaaacttcgcgcccaacctcttaaatgttgcctaaggtggacgatcttgtgtttccaacgttccataggattctttcccttgtttacgctttgccactctttggctaccatctcaaagaatccatcccgctctagccagcctaattcaaaacgaaatggcggctgattgccgaaatgtgcatgcgagccggatctcagtataattggagagtggtctgaaatggctcgaggtaaggcttgacacgtaactaaaggatatttttgctcccagtcagtgttcattaacactctatccaacttctcataagttggattttcgaggttattggcccaggtgaattgtctccccgaaagatcaatctctctcaaattgagactattgatgaccgcattaaaaagaaaaggccaacgagggtcaaaagaattattattcttttcttcgggtgatctaatgatattaaagtccccctaccaatagagggtatgactccttaccacaagtctgagctagttccgtcaaaaattgttcttttaactcgggttgagcaacaccatatactgccattaaaacccatttgaaaccatcctctttatttcttagaagaaacttcacatagaagtccccttctgaaatttcacctatatcaaaaacatttaaatttactcctaaaagtattcctcctgattgcttgataggaggtttctcatgccaaagaaaatcttttccaccacaaaggtttttaagatttgaagggggtgaatgatggttttctagtctcaagaatagcaataaaatccaaattttgctccttaacacattcagatataaatctaaatttagatgcatcaccaaagccacaactattccaaaatattcctttcatttcttaaacttattagctttcttttttgaccagtcaaaagaggacataccactttatgtttgattttggtcaaaatcttcctcatttgaggtatggcctgagatacataaatttttaactttttatttaatcattctaattttcaacaaaacttttaattttggttaaacacacccttaagttgattgtttctcgtggtcaagtctaatcatctatttttttcccattttttcctgggctggccggagtccggcaaccatgtcccggcgacggtgtagctgcgttgtggttgcacactgttgcatgttcaggacgcccatcgacgcagcgatttgagtggaggaagtaatcaaatttagccagaaaacttatcaaaaaccgatttataaaatttaggcattgtttagtttctaaattttttttcacaaaaatatcacattgaatctttagacatatgtatggagcactaaatatacataaaatgaaaaactaattgcacagtttgcatgaaaatcacgagacgaatcttttgagcctaattagaccatgattagccataagtgctacagtaacccacgtgtgctaacgacggattaattaggcttaataaattcgtcggtttctaggtaagttttgaaattagtttttttatacgtgttccttccaatatctgattaattatccgatatgacacacatgaactttcttttcgcgaaataaatggaggaagtacgtttctagtgtttccagaaaaagtactagtttgacttgtcaacatgaagtaagtatcaacgaaactagtggttgcaatgccgtcgacgcttagaaaaagtactactagacgcagaataaaggagggaacgtccggaaatccacgtcgcactcctggacacttgaatcagtggcaaccatcgtttctattattgtaatccagatcccacacactattaattactcgtacatcatattatctatccattacttccgttgtgtctcatcccttccagagaattcgcatgctgaccgtgtacgtacgtggcgccgcgctgatcgacatgcatcctctcgctgatcatgctcgatcagcattgtttagctttacgcccacctggatcacaatgtgccgtgctgtcctcgtctctgacatgatccggttgcaatattttatccctcgccggagcagcataaatacccagcaaaaccttgcagtaatcggaatccattcagtgccaatcaggtaatcagtgtgagagtcttttcaaagcgaaggagcaaattagcttttgtgttgtagatcgagcaggctaggtatagcgagaatggagtaccaggggcagcatggtggccacgccagcagccgcgccgacgagcacggcaaccctgcagtgaccaccggaaacgcacccaccgggatgggcgccggccacatccaggagccggcgagggaggacaagaagaccgacggcgtcctccgccgctccggcagctccagctccagctcatccgtacgtcgtcttcctcccaagtttattgtattttttcggtttgatttcagaactgttcggattgtagccacttttatccatttcaatatttgatagtgtcaaattttgacatattttggtactaccaaattttaataatcttggttgtatttagtttaatatcttaccaaaagataatagaattttaatttaagaatgaaaaattctaaaattaccaaagtttggcaggatagcattagcacgaaggtatttggtttagtgtctttccaaaatttaacaatgctaaaattttatatggttaaaattggtaataaagtgaacaaacctttcgtactcatggtctgaataatgaaacatatatactgccaattgctgaccaatttgcagtctgaggacgatgggatgggaggaaggaggaagaaggggatcaaggagaagatcaaggagaagctccccggcggcaacaagggcaacaaccagcagcagcagcaggagcacaccacaacaacgaccggcggcgcgtacgggccgcagggccacgataccaagatcgccaccggcgcacacggcggcaccgccgccaccaccgcggacgccggcggcgagaagaagggcatcgtggacaagatcaaggagaagctccccggccagcactgagctgctgcatgccatgtgtgtgatcggtgtttcgatccgacgatcgacttcgatcacaaacaacgaaggatctccctcctgaagaataataatattgtgtgtccttgtatatctgtgtgtgtgttccgggtaaacaataaagtcgtgatgcagccacggcatgtgtgcgtacgtgtacgtagcactgtatgtaagtgcgcgtgtggtatatggcgtgttggttaattttcgtatattatttggctcaaattatatattttaaacatctatgtgaaatctgtttatcgtgacaaacggggctacctatagatttctagtttcgaatctagaacatttttcaatcaatgaatgtagcctattttaaatgaaaaaaaaacaatcatgtcaaaaatcatcaatctagagaaagaaacggttgtcaaatttggttgtcaaatttagttttgttgacggagtgtaaatgagtgtaactataaattgaaaatatataataacacgaatcttggtgtaagatctcgtagacgaaaaattaagagataaaaacgtagaaatttatcgcaagtgaaacagaaaaaccgcttacatattaagcagcacctccccgtgatcgtaaaatactactcctttctcataaaaaccaggactgaaatgcttcctatccctccgtttcatattataggactttctagcattgcccacattcactttaaaggaataaattcactttaaatctctcatttatcgaagagtctaaattagtccataaacgttactaccagatataatgcgtctttaagtcctaaaattagtataaataaggtcttaaaatagtttggacagtggtttcgattgacatggcgcttacgtcacaataacgtgacacttaaaatcataaaaaaacagtgtgacccacatgtcaatgagtgttatgttaaaaataaaaaaaattgcactggggacccatatcacccccttcccctcttctctcccttcctcataaatctttctttacttgtcatctacgatgcactccgattctgtggcactgacggtattgatgagaggcagggcgtcagcatgggaggggggggggagttgctagtggcgcacggggccacaggacgtaggtggcggcggtgtggacaagtgtgtcatcatcggcggaggagagtgttggcagcgcgggagcatttcctgtggccgcgtgcctcattcccatttcttccccccgcgcccgtgtcggagttgtaggtggacaacgatggcgcgggggagcatttcctcactcccgctcgccggctggctagatccttctcgtgtgctcagccgtctgatgagcttctcgtcctgcgcgtcgggcgccgactaagtcctcctcgcatggatgactcctttcgtctttgtcctagtgctgcggcacgctgagcaggccatgttctcagagaaacaatggtaataaaatgtggtctaaagtgagatttactcatttaaaaacaaaacttcacaaattgacgtaatactactgatttacatatacaacttctaagaatattgaatgatatttgtttggtggtgtgcacagtgtgtgcaagtgaaggcttcattgtatagaatacttctatttgacattaataactccacaaattgttcataatgtcctatgatgatcatcattatcatcattaattactattattattattattatcattattttctgaacaatttaaattatagtagagttgtcctcctcccacactatcgttgatcccccacggcccacactaagaaaataaccttttccctattgatcactaaaaaaaccattgttttacgcgaaaatcaatcctcagaaaaaatggatacaaaaaactgaaccccataatttccgaaccaatatcatacagtatgaaactagccacaactcattttctcaaggattaatctcaacaacctgaagtcatatttcaatttgggttttgtcctactcagcacgaagattttctagcagtattgtcttactcaatctcatctctgaattgactacacgagtcctaaaccaccaaattacaagatcccaccgaataaaccaacttgcaaaatcttgtccaagaaaatgtaaggcgctgtcatttgagtcaaaatgagcagttgaatcgatgcactgaacaataaaacaaatgagcagtgagtgattaatcacctcaaacaaattcaataccaagtacacgttgttgaggcagtgagctggacggagtggcagagaacggcgatgatgcagatgaggtgaacgacgacggccgcggcagcaccaaggacggccggccggccggcaatgccctcaacggaggaccggcggcgccctagatcaacaggatgccgcagcctggacggaggtggtggcggaggcggagcaggacgacgtcttcgaccgaagcagctggggaacccgcagccccacaccctagaatagcggcacccaggcgaggattccaagcgcggcgttgtggcgagtggggagaaaaagaagacgacagtgtgagtgtggagtggggaaaaaaaagcgcggatgaagaaaaaaaaatggcgcgaggctgccgagattggcgcgaggctgctgagtttcccaaaacctgattcggattgacaccgtttttgggcaagagttaattttaggttcactttgggctatctgttggagggcttcttttttttttcaaattaccaaaatttgtcttttgggaatccttttggccttatcttggagatgctcttacaacgcacgggcttggcacactaaggagttttacgtactaaggagagagagcaaaaatctgaaaacgcttggttaaacgcaagagctactccctcttttacatatatatatatatatatatatatatatatatatatatatatatatatatatatatatatatatatatatatatatatatatatatatatgttaaatgtgggcaatattaaaaagtcttataatatgaaacggaggaagtagtacatacgtggcaaatggcagattccctctagcgcactatataaaccaatcaccgagatagaggtagatgcactcgagcactgttctctttctcttcctcggacaaaaccctctctattcctgagctacccactatttctccagttctgttcacctgcgcgcacgggtgacaggatgagcagcaggccttcggaactccatccgcttgcgtacctgtacgggtaggcgggcgatcaaattttcgtggagcgtctcggcgtgactacattgcgactcttctttctctgcatcgcgatggcttccattggagagaacagtggcatagcaggtgctggagggaacggcggcgtttcaggagaaggagggaacggcagtgctccaggagataacaccaacggaggcaatactaatgcctcaacctcctctgcaccattttcctggtatatagctctatctctaattgatgttctttcagttatttatatgttcatcgtgctatcctcaggattacaatcctatgtgaatgttgatgatgtttgtgcttatgttgccaaaagcatgctattgtgaatgtcatgtttattatcttgttattatgccgaattatggccaaatttccaacattatatattctgtcttgatccaacaaatgcaatggcgcctagcctggcaaagatggaggcctgcttgaggcatgacactggctggcctagtggataactatgtcgaagcccattagcttagaagcagcgtttggaggcagcggtcgcctccctcactacatttccctctccctgatggctagcttgccgggtcaagctaactggaggccgaggaacacgggaccggccgcctccaaccccaccaccccacatatctctgctgccaattgccccctcaatgtccatgccaagaagaagctctcaatcgcctacaccactctcaggggctgccacaagctccccatgcccagacctggccactcgatgttcggggccaccatgagcttgggcgtggtggcatctggccagtgtggcttgaaggagatgatggatgcagcagcaacttgagggagatcaatgacaacgccgttgtctctgctgggacggcagtggtgaatccaatatggtgttggtgttcttgttctgttgaatgtgtagcttttgtccatggcagcacgattttgatctgtgatgtgggtgttccagtagtgttgatgatatttgctggataattgaatgaatgtgaatagcttgttcttggtctgtgttgaccgtccgtagcgaacagtttcgaccgtcaatattaccaaaatagaggaagactagttatgccttgcgatgcata

SEQ ID NO: 77252 - DNA, 10528 bp, Oryza sativa
cccccgcccggtagcccgaagacaagtattctcgatcttataacgcaatataattatgagtggttggacaagaaccagcaggtcatcgacagcttccccggcgccaacacgtggtggaaccagctcaaggacaagcgggaattgaaagcacaagctggtgttcgtgttccacaagcgccaccgtgagctcatgcagagcccctacctgcgcgacataatcctgcgggggcacgagccaggaaccaagagccggctcagctgagagataggtggctcttcaccaactgtggcagtggtggtaatacgatgtggtcctgtggagccacatcccgtggaaacatgcacccagccacgttcgttccacactcgccatggaccccgccaagaaggatgagatcaagcacgtacgttgtttcgggaggggaagaaatagcacttcgacgttggaagcgtggcttcctgctgtacggtccatccggcagaaagtgcagcatgatctcggctgtatcccactccctcggctacgacgtctgtagcatgtttagttctaaaacaaaacattttcacgctgtcatatcgaatatttagacatatgtacagagtattaaatatataaaataaaaaaataattacacagattacgtgtaaattgcgagacgaatcttttaagcataattgcgccatgatttgacaatgtggtgctacggtaaacatttactaataacggattaattaggcttaataaattcgtatcacagtttcctggcggaatctgtaatttattttgttattatactacgtttaatactttaaatgtgtatccgtatatccgatgtgataactaaacccaaaaaattttcccaactaagggggtgttaagatccaagggtgtgtaaagttttgtcgtgccacatcgggtattatataaagtgttgcatagggtgttcgggcacttataaaaaaaaactaattgctgtaggatcacattgtcaaatcatggagcaattaatccgtcattagcaaataaatttattaagcctaattaatccgtcattagcaaatgtttactgtaggaccacattcgcaaattattcgcaaattagtcgcaacctatgcagatagttattttttagcttatatttaatacttcatacaggtgttcaaacaagaaccgggaataaagaggtttttttgtcccagtttattactccaacgggattaagtgatctttagggctggttttccctctgacagggcgtgtcagactcctgtcggggggctggggaactaaccccatccgggactaaagatcatctctttagtcccggagatctttagtcccggttggtgacccaactatatatatcctttcttcctcctccagcccaagtcattgctgcaaaatggagctttgagggagggaggtgctgccaaaatttttaataaatttttttgttgataatatacaaatcggaggaatcgagaaggttagcaacttcattatctaatgatgtgtgtttagcatgttacatttatggctttgtttgtattcaatattttctccaacaaggtatatgggtgggaaatgatgagagagaaaacttgttgagggaaaattaggttaaaataatttggataaatatgttatagaaaagttgactgttatcgaaacgacaaccgcatacgttgaaagacgtggttactaaacagtggatggaaaagaagtaaagtgtattaatttgagaatttttacttgagatccccctattacatggccctacgggggctatttatagcccccattacaggtcttactactagggctttagttatacaggggaatttacatggttgcccttatgaaagggacatttacatgggtacatagcgtaattgcggtccatgggcccttagcgagccgacaggttattgtcgacccaattaacccttgggcttgatgggccaggacagattcttcggccctcccggggccgaacctgctacggcgaagtcgtcccccttcggcatatgctcttcgccttgcgcaattcgcccaggaggcctctagcttggctgctctttgctccatagtttttgacatggggagggttcgcctcgactaaccctgacgtctcgggcttgaatcctcatcggtcgcatgttttcggcaggtttggtcgaagggtctcatgccatatcgccaacattgacaaaggaaaaaatataaacaactattgaaaaacaatgaaggtatgtttggaaatttaaaaataatgaaaaaatggatactttgtggaattattgtataattattatatgattatttgtacaaaataattgaaaactaagttaattggaaaatagtttaaattattgtatgattatttaatgattttaaggatgatgttttaaattattgtatgattatttaatgagtttgtctttcgtggatttttttttaagatttcaggtagatggatcggcaatggatgtacgcggactggcagtcgaaagagtttattaacgacgtgcattactttttgagtgtggccaatgataacaagcgtaacggttttatatgttgtccatgcgataagtgaaaaaaccagaaggagtattccactgcacgaactattcattcccacctgtttcagtgggggttcatgcgtagctacaattgttgaaccttgcacggagagctaggggttgcaatggaagaagatgaagtagaagacgagaacattccggacggggctttgtactagggatttgaagaaaacacaatgggcgaggcagacgtagatgttgaagataatgacggtgcagatgatcttggtcaaatgttgcgggacatacctgaggactgcgaaagtgaaaaggaggtgcaataactagagctcatgttagcggaccacagaacgtcgttgtacccaggttgtgagcagggccacaaaaatttgggtaccacgctgtaattcttgcaatggaaggctaaaaatggtatgagtgacaaggcattttctgagttattggagctcgtaaagaacattcttccggaggggaacgaattgcccgaaacaacgtacgaagctatgaaggccatctgccctctaggactggaagttcagaagatacacatgtccgaacgattgtatcctctatcgcggtgaggtgcacgaaaacctgaaagcatgccctgtttgcaaagcactacgatacaagattagacgagatgatcgaggcgatgttgaaggacagcctttgaagaagagagtttctgctaaggtgatgtggtatttccctataataccatggctgaagcggttttttgggtataaatcacatgctagaatgatgcggtggcacgtagaagaatgtaaacaagacgggatgctgagacaccccgtcgacgggtcgcagtggctaaatatcgacagaacatttaacgacttcggagagaatgcatgaaacgtgaggttcggtttaagtacggaaggaatgaatccgtttggagagatgagcagcggccatagcacttggccggtcactgtgtgcatctactatctcccaccttggctatgcatgaagcggaagtacatcataatgtcgattattattcaaggcctgaaacaacctggtaacgacattgatgtgtaccttagaccattggttgaagatctgaaagtgttgtgcaggaaagagggcgtcctcgtgtgggataaggacaaataggagcaatttaacctacgagcgttgctatttattaccattaatgattggcctgcacttagtaacctatccggacagtcaaacaaggggtacaaggtttgcactcactgtatggatgaaaccgaaaatacgtatctgaagcattgctggaaggttgtgtacatgggccatcgtcgattccttgttgcaaaccaccgtgtacggaagaaaggcaggcacttcgaacagaaggcaaaccaccgtactaagcctaaacatcacaacatgaaagcagtgtttgatatggtgaaagatctgtaagtaatatttggaacggggcctagaagccaacctatatagagcgaagatggtcacgcggtgatgtggaagaagaactctattttttgggagttaccctattgggatgtcttagacgtctgccacgcaatcgacatgatgcacctcactgagaacctttgcgtaaacctgctgggctacttaggtgtatatgggaaatccaaagatacacttgaagcacgtaatgatcttaagcatatggaacaacgcgagagccttcatccggaaccaactgagaaaggaccatagccctcaattgttgcgtggctgcgggctgaagggtcaaacgacccgagaccctcacggtcgtggttgtaggatcacacaggaccaaacaaacctaccagaggggttgaatagtagggaaaaccaaaaacccaaaaatcttatgtggaattaaagattaccctcaaacggagttgataacgaagccctgtcgccgtcggtcgaaccacccactcgccgccggtcagaccgtcgtatcgtagccccgccggtcacaacgctgctatcccaccggtcagaccacacacacacctgcggttagaccgtcgggacccagaaacactggtagatgacaaactcgaagatgtagattgaaactttttgactttattgcatcaactagtgtttacaaagtgcaccaacagcactccttaccaaaatctcgaattaaactcgaaaccctaactttctcgcaactctaatatctgtaaaaccgatactgggaggcctcaccctccctatctttttatacatgaggtaggctgtgcaaagcccacgaatctaacacaacttacgactcctaactcacgtaggaaaccctctcttgcaagtatccaacttatctcttgccttatctcaaacaatcttcccgaattcggactcccttccaaattcgactcctctttccatatgtacacaaatcctcttgtataccatatggatttcttcatcaccacatgcattgtcctctagcctttagtatcccgcatgatctcttaatccctggacatcaacttctcccaatttgactccgatctatcaccggtaacactctcccgaggtctcaagcaacaactgcacatgcaacaaccaagaaaccatattccgagcccaagttagtcccaacttgactcacattagtataacaacaatattcatatgcatagaaaccatttagaagccaaatccccgaaggaaacatccaaatccaacaaaacaacccgaaaccgaacatgatcaggatcctgccggtcagaccgtcgggccggccggtctgaccgccgcaacacctgtggtctgaccggcggcacacgaccggtctgaccgccaaggtcaaccgaaactgcacacttcataaaatcaatcgtcttataaaatctctaaattaacattagcaaaccatcaatattttcttcacaaaatctaaattaactcctttattttatagtggtgtcctcgatgcatatgtgtctcgtccaggcacgcggttgacgcgcaccatcggtggtgccggggctctcaacgcacgccggaaaagacggagccatctcccgaaacgagcgtcgcgccagggcacgtcaattcgcgcgccaatccatctctcgaaccgaccgttgtgccaaggttccccggtgccgcatcacgtgcgccgtgcgttagggccccacctgccgtcgatggtgagggcaaagatagcagccgccgccgtccctcagactaggacaccccactaatccaaaggaaaccctaaaaaatccctcaatgtcgagctggaccacaaatgaattagatgggcctcaccatcacgcggtgactggtggctgtgtgtgagatggtttgggctctgtttaatcagactatgttgtgtttcattatcagctcggaataagtacacttgagatcccttaacttatcaacaaatccgattttcgtccttcaaccgaaaaaccagatacaacgggtccctcaactatcaaaaccggtgcaaagcaggtccctcagcggttttgatagtggttttggccgatgtggcatctacgtgtcctgtttgcgtcctacgtggcggtgacgtggcactggaaggaaaatataaaaattaaaaacaaaaacaaaaatatgaggtccacatatcagttagacaaaaggaaaaaagagtggacccacctgtcagtgggtcctaccatcctctctatccacaaacgattggacgacgggagactgggagagggagcgaccgacgcctcttgtctctccctcccggcatccatcctcgccggccggcgagcgcgcacggagagggaaaaaggcgccggccggcgagtggggcggagacggcagctggcccccgcccactgcgcacttcttcggcggtctgcgacacggagctagggttgcgggagtcggagggtggcggcgccatcatcctgctcgaacaatcggagagacggcaacgacgaacagtgttcatgcaacagtgtgattacctggccggcgacgaactcagtgacgatgcggctgccgccgaggacgagggtattggagacgttgacgccatgctcggcggtggcgtccgtggactggtcatgtccgatgacgcccatctcctcgttacgactcgccgcggactccatggcggcggccgggccgcccttgaccgtcttccccaacacgaggttctccgcgcgccgactgcaagtcgccgcgtcccgcggcgcgatgggcttggccgcgaggcttctggtcaccggaaacacgtcgccataccagatcccttgctggctcatcctactacactctcaaagtagctagtactagtgtggtgagatcgtgtgtgcactgtgctgtgcatgagagagagatcttcaaggtcatatgcggcgcgcctcgctgcatgggtcgaacgggggacacgcagggtggccggcaatggcggggcgccgtgggtggggcactggggctcgacggcgacgggcggtcgcagcccgccgaagaggcgcgcagcaggcgggggccagctgccgtctccgccccactcgccggccggcgcctttttccctctccgtgcgcgctcgccggccggcgaggaaggatgcgggagggagagagaagaggcgtcggtcgctccctctcccagtctcccgtcgtccaatcgtccgtggatagagaggatggtgggacccactaacggtgggttcacttttttctttttgtctgactgacatgtgggccccacattttgtttttattttttagttttatattttccttccagtgccacgtcagcgccacgtaggacgaggaccaagtcaaaccggccacgtaggcgccacattagccaaaaccaccatcaaaaccgctgagggacctgctttgcaccggtttgatagttgagggacccattgtatctggttttccggttgaaggacgaaaatcggattcgttgacaagttaagggaccacaagtgaacttattccttatcagctcagaagtgatataatgcactgatccatcgtcttacaactaatgatgatatagaagcgtgaggtttgagctttaggttttgatttcagttagtggccattagcataaagacagagatacagataaatataaaaaatttccccatgtgaccatgtcaaagcatctagaataatggttgctgactaggaggaagaagcccaaagtttcctgtttggctgtttgccggatgctaggaattgggccatgctttcctagcctggtccaaggcggtggtcaggcacagcccgatttcaggccgtacataggccacgctcgtgcttgggactttggcgtgataggtcgccgcatagcacgttgttagcctaatcctaatagcccgccgagtcatgtaggccagctagagacatcgggcccgtttactttgatgtcattttcaactttaccaagttttggtaaagttataaaaaaaaaaattagctacatttagtttgttgtcaaattttggtaactatataaaaaatcctgctaaaatttagtaaggttttttttcgttagagtgaacagccccatcatatatatccgagttatgaggctcctggcccagattggggtgagtctagtacgcgactgctcgtgtcgagcaaacgcgtggacgctacctatttcttccgtgcgtatctgaacctgctcacaaaactctactccagcccacaacatagtccacgtatatgcaaaattttcatgggcccactagcatatcccagccttttcctttctcatttagactaaaatccaacataaacaattctatttcatacatgtaactttatctgtataaactttacatatactagctttatgcatagtagttttatgtcttgttatatataaactttgcatatgcaaactttcaacatagattttttttcaaaaaagtatgagtgaattttaaacaataaaaaaaataagtccagcgaaaaaatatttaataaaacttctattgtacttaaatgggccaaagtagaataataatctttctacctataactttattaataaataatatactttccacatgataagtttatataagatataaaattctttctctaaataatagaaaaaaaattcaaacataatttttgctgatatgtttgaaaaatgagtacatattttgtgatcacaaaataaataacaaactagaagaaaaaataatttcacaaaagaaacaaaaaattaaaaataagataaagatctcaacttaaactatggcccacaaggcccatgtcgtatatctccagaatctaatcagttggtgatttgaaattaccacgacctggctagggttagtacacatatgtgatccggaaaagcggcattcgcgtgaacttgttccgggaacgttcacgcaatagctttttcgctcagattgtatatcggtctaagtacgagatgctacctctgagttttttatatttctttaaacaattatagaaacatatacatttgttttaaaatttatagaggtttattccgctctctagtacatagtgactacaacgctggaaggtggagggcccggcaggtatgagtttaggggaaccggatcctctgactttgcttgcaaagtcacggacgtgcagtcggggtccaaatcatagtagaaaaaaccggaccggaccggcggttcaacaggaaaaaaccggaaccagctccctgaccggctcggttccctcaaaggatcgttcacgcaatcgacccggtgtgaaccggctgaaccgggtggttttcgcgcgaaaccgctgaaccgggtgaccctaaaccggctggcttgtatatttcttatgagccttgtaagactggaggcccaacttgatttttatgcgagaaaaaatatggtgcaaaggtgggattctaccccaggctgttaggatagatgcaaaccttgccaaccactaggctaagttagctgttttgactagaagacaacacagaatatacttagccaataaaccgtggttcaaccagtgacccaccggttgaaccgatagaccggtgaaccaaacactccaccggatcaatgaccggtccggttttttctactatggtccaaatccaccgtctgttgcatctgacggtcctggcttgcatagcgagtcgcagcacgcatggccgtgcggactaccagtcacgaagcggcctagcggatgaactagctcgatcaacacaacacgtgaactagcagagggaaaataacaaaatcttcacaaattttgcgacataacagaacacaactgttctatcgtatccttgcttgttcgttccaaaagaaattgaagcatacgcgatcaggcaaaaaaaaaaaaagcaatcaattgtaatggagattcaatttctatcaccgatcaaataccgaaagaacttccaagctgcttaaccaagagaccacggtcaattggaagacgaggctggaattgatatgcctcatgccatacatgtacgcgcgcgtgtgtggatgtgtagaaggagaaggtgaaggtgaaggtgaaggtggaggcgacagaaaagggaacgagcacgatacgccagcatcggaggaaagagccgccacggcgccagcggcgctgcccttgccggaggactggaggaatagatcatcgtgcatttgtgctattgggccgaattaggtcgcagcccgcatggtagtgcatggcagaaccgttggatgcaacgaacggtggatttaaacccaactgcacgcttgtgactttgcaagcaaagtcagaggatccggttccgagtttggggctagcatgtcttatctctataaggtcttgtttggtttggagtctggagggaattgaataggatttgagggattgagagagaataattccataccacaataggtgtggaataaatcccttccaacccctccctcatggggattaaacgaacaaggcctaacggaagaga

SEQ ID NO: 77253 - DNA, 649 bp, Oryza sativa
acttggactctgggttcaccaactagaaatttctagttcataaattccatgtacaattaagacaaacaaatttcataggatgaagatttgactgatactgtaattctgcatttaggaattcagagatcattgaagcaattttagtccacagaactgaaatatttttataggatgtgttccacgcagatatatgatacctggggaaacacaatgatcaaggacctggaagccgagcatgacaaatggtgtatatctgcatctaaaacctcattaatactaggatctgattgagtttaaaaaatgcagtagatctcaccaacttcaacttgctctagtggcactcggaattcttgctccctatagctagtcctctcttccccatgaaagctagctttaatcttaattaaaaaccagttctccatgaatagctgtcttaataaataaaagcaagaaatatctcgaggattctagtggtattaactatcgccagcatatgttcatctctacttttctaaggaaactaaattaactcgcataatttgattatatttgcctgtcacatatgactcatatgcataatctacccatattgccagttggaatatctgtacctgaagaaatcaaatgttgttaggtggcaccatcgatt

SEQ ID NO: 77254 - DNA, 1209 bp, Oryza sativa
aaaaaattaaaaagacaagtcacgtataaaatattaatcatgttttatcatctaacaacaacgaaaatacgaattataaaaaaatttcatataagacggacagtcaaagttggacacggaaatccagggtttgcctttttttaggacggagggagtatctatctatctatcatacctctatacctatatactaattggacactttctaggagctctcacgttaataaaaaaaatctagccatctattatattatattatattatattatattatattatattatattatattatatactaaaagtccattaaacttcctataaacactctcatgccgccacgtgggactcctacaaatgctcctaggccgccacgtgactctgttaaatctaaccgtcgattttcacttaaattgatggacctgatattttagacttaaatttttccgtgaacctccccttccatcgatccccggtttccctcctttttctgatcctatttttatgctattgtttcacccaaaaaaaagacatgcgagtacatacgtgagtatagcacgatcagataaaccggaaagaacatactcctgtacgtacgtaatacatgatcagagaaacaccggaagaacacatatatatacttacacgtagtaacatatagaaatagatgaaacataatactctataaatttacataaatatcaccatcaattttcatttaaattggtggactcaattgatgttttacaacattaggttagatgtcttaaagcccattaaacttccaaaaatgctcctaattcgccaaacgcttctaagttgtcatctgatgctctaataaattagtgaaattcttaaaattctaaaataacaaaacatattttcattaaatttggtgaacccattatttacaagcattagattaattttcaagaaaaaattcctttcctaaactcgggcctaccaaagagctttgtatgtataagttaatttttttttacaaaaacgaatatacgtatgtacgcctcctcttacttcaattcatttatccacccacctattccttctcctatgttcatgccttattagttagataagcaataatatcgtgttaaacaattaagcttcttaatcatacaactaatttctgatcagcgtaaatctttagattatttataactcaatttacagttgaagaccatatttcact

SEQ ID NO: 77255 - DNA, 1843 bp, Oryza sativa
taaaaactaaaacactacaactcgggaattattacaattatatgcatgcataatctcctctcttcaactctctcttcctctcctcactcatttaattcctttgtctcctaatttttaactaagtaaaaacagatcaataattagaaagccaaatgattataattctaaagttgaatcataattttaacttatttgaatttttattttatttataattaaatagataatttaatatccatgttacccatatttcactctatagacaccgttcctttgcatggtaaccaaatagaaaaaatacaaaccataatacaaaatgaaaatgagtactatattatcgtaaatcattgtacatcctctgaacgcacttaaggcgtcacatgttacgccttaaataaaaataaaactttacaaattggaagaaaaatcatctgaccatcagtttccacttaaataggtagatctattattttcaaccaatagatatacatttaagaatgtcttaagccgcaatatgttatgtcttaaaaattggaataaaaaaaatgtgataaaaaatatatcaacggtttcacttaaatcatttagataaaatagaaaaatccacgcctccacttcgccctcccccagaacatacgcacaacacgacactactcgtcacatcccttctccactctatcccttcctgtttatacagccaaaaataatcaaaatattaaaaaaatgcataaatttcaagctcatctgatttctaatctaaatattattgtatttataattagaataatgatttaaagatccataaagcctatattttgaactgtataaaatataaaataaagcaggtaatagaaaatatcaatagggactaaattaaactattttgagaaaacgtgatacgttcataaaaaaattggttcttacatttcactaaaattggaccaaccattgcatgttccattttcgtaacaattttaaaatgcttagacattaatggccttacatctatcctatattattgcattatgagtttctccacatatttttacatatataaaccgcactaaggttcgcagtatatagttctttgaaaagttatatttgttactactaaatttaaaattttggattcatgttaactaggtatattcttttgaaaaagatagtataggtcacaacgaagcgaggtatatgacatgtctctattaatttatatataagtatgtaacaactcgcatcaacttaaacctactaaaaggagaactacttgatggtacaaataaaacatatttattaaaaatatagttctttagaatttgttaaaaaaagaacaaaacaccttacttctaatttacagttgatttgttagacacgttttccaaacaaactaaatcgaacttccttatatataataaagagattgtagataattatttatatagatgtatcaaatttgatatattttagaacctaacaaatatcttggaaaaattatcaaagcaaaatattgaagaacagcggaggcctcacctgatgtgtcttattcaaataaaaaaataaaaaagtacttttaaacatgggaggtgtcaaccaattgatattctgtttatatatatatatatatatatatatatatatatatatatatatatatatatatatatatatatatatatatatttcaaacgcaatgtacaaatcaaggttggaaatttcagaaatttcgatcatttcggacccctcagatatgatattattttggccgaatttttttaacttttcatgaattttggtaatatttgttcaaattcaactaaactatgttttcaaaatttcagaaatt

SEQ ID NO: 77256 - DNA, 8577 bp, Oryza sativa
  unsure (1)..(8577): unsure at all n locations
cctagaatcaaaatctaacaaaaacaagttcaaattcagttcaacttgctttaaactagttagtaaagtagttaatacctaagtaattgaaaaagtttcatactcatttgaattgggtatatactcaatttcaacaatggtgcccgggcaccatggagcaccaaacaaatttaatatatatatatatatatatatatatatatatatatatatatatatatatatatatatatatatatatatatatatatatatatatatatatatatatatatgtattaaagtagttaacgttaatacctaaatatttgaaaaagtttcatactcatttgaattgggtatatagtaaatttcaatcatggtgcccgggcaccatggagcaccaaacaaatttaatatatatatatatatatatatatattatatatatatatatatgccattatgtactcccgggagtacatactccctccccagtattggatcacccgatggatccaataggacctgttgaactggattggaaaaactgccgtgtaaaaataaataaatatttaatttgaaaaaaaaaaccatgaatgtaggcgcattggatcggctagaatttagcggggttcaaattttgaaattaccggccacactccaatcaacgtgcagtatatttcctagctaagtatatgctgttattttctacacgaaagtatatactgttttttttgtaagaaacggtatgtactgattttctacacgaaagtttatattctttttcttgcagtatattcctatataagtatatgctgccatttcaaaataaaagtatgtactgtttttagtaagcaaaggtatatactgttttttattagtagtagcagtttataggcagctgccatatacttctttttcatgtatagaaatatatacggataaatatcccacatacgtgttttttatgacaatatatacttctttttctttacttagtactgtgcttcaccaacctagtataagtactgtgctacagttaagtccagtatatacagtactgtgcttcagttaagtccagtatatactatttcttaggtggtagcaatatatatactcttctttttaaggtggtagatatacctttctttaaggtgcaagtatatactattcttaagataattgcagtatataccatttttaacagtagcagtactcagtgttagtagcagtatatatgctatttttattacttgcttttaccctgccgcagaactcagtgttcgagctgcatgcacgtaatgatgatccaaaagtttcgtatattctcaaagatatatagttccaatagaactagcctcacagacatgagaacatgttcaagaacatgaattgaagtatatgctgaatttctgattgaaaaagaatgtacatccaaatcgcagtttgtaaaaactaggatccttccccttgcgcgtatatatatatatatatatatatatactatctccgctggtgccgttggattgcggcgttgagtcgacatgttctgccgacggccggccggataccatctgcaagcaacaaaaagattaggggcttattcattcagggaactaaacaaatccatccaaaccaccatccagtatgtgcagtatgtgcagtacagcagtagccaagaaatgaaggagatgcacacattcactcatttagtaacaacttgcctacattttgcataagctagattgagatattagactccactgataagaatacacatctaaaacaaaaggcatacttattcaagcagtatatataggacatattttcagcaaagcgcccgtaccccattgacccagaattattagacaaactaacctgggcgtcatatactgatttcttcttacataggtcacatactgaattagaaatacactcgagatgttagcatgcaccgccatcttcagggatctgattggagttgatggttgtgggcatgttaattatcgcagtatcgtcagcctactgaatgtttgtacctgtgtaacgaaacaaaattagtatttttcattctgaactctaggattaatttttatctacatacgtacagagattaaaaggaagatggataagaaatagtgtatactcatctaactgtggatttgtgattcagaatttcatatataaactaaaaacagtacacaccaacaaaaattagaaagaacccctccattaaaaaaaatgagtatatactatcgtctaacaaagttcagtagaaagctccccatataaaaattcagtatatactatcgtctaacaaagagttcagtaagaaccctgccatagaaaaattcagtacataataacgtttaacagagttcagtaagtatccctccaaagaaacaatgagtatataccgtggaaaattcagtacatactaccatctatatttttttttggggggggggggggggctaaaacagcatttactatatccacccaaaaaaccatcatatgcactaaaggggaaatttagcatctgaaactgagagcgtacatgaaccgaactacacataatccctctctacaggcatacatatattcaatttcagccgactccagatcgattacttctgcttcagaaacataggctattgagagaggagccatcgctggaggaaggggacgagtcttcactggaggaaggaacgagctgctatctctgtaccgccgccagccaccccagtcgccgctgaatcactggtccgtcgccgcgccgccccccaaaaccccaattttcgggataagcagttcggcctcttacgagcaaaccccaaatttcgggataagcagttcggttttttaattagaaaaactaatcggatccaccgaggcaaacccgttatgatgagggagggagtataacatatctaatcgatcagatgaacggtggatgggagggggagtacgtactccctaggagtatagatccattttcatatatatatatatatatatatatatatatatatatatatatatatatatatatatatatatatataactactatacagcaccctaaggtgctacgtattaaacagcacctgatacagcctccagccccacccacccacgctcccaccaggtctatagtacgtagttaaaatttaactcaccgacgaccaatcttgatcccacccctgcgccccctcccctcactcctatagtccgagtaaattttttacttcatgctatccaacttcttagtagttctatatatatagttaaaatttaactcatcgacgatcaatctcaatcctacccctgcacccctacccccactccaataatccgagtaaatttttaactcgcgcaccaccaagagccacacccaccccaccctgtcaacgctcctacccaaacgatagtaatttttttactcacaccaatagttctatttataccatccataaccatctcaccgtatccaaacccccattcatactcccgtcctcttccatttttttcggatctgagaaattggggatagagcggcgacggtcgatgggtgactggtctgctcgtcggggcgatggcatggaggctgagctccgagtggtggcgaggagatccatcggtgaggggtggtgtcgtcatgcatccaggtaggagagggcgattggcgtcgggctgccctcctcttgaaggtgcccaatctgaaggccggcgccggtggtcattcttctttggagcccgtgagggtggcggcggccggctacgtcgtccatggcgtgcctcatggtcggttcagggagcacgcgagtaggtggccagcggcagtggtggccctgaaacaacgttcaagccggaaaggaggggaaggttgctttccaccttgtgcggcggcaacggtcttcaggcccggcgactagcttccaggccagcgtcgatgcgtatagggcaggagaccgatgtagacgttggttgctgcgccggatctggagggagcctagcgcatgcaccaccaccacgtacagcgtgcttctcgggtcatccgcatctctgttgtttctatcctcccgtggacgggggtttcgtttcatttttttctctttgttggttctgtagtttgttatgcacgggggattttttgtacgattgatatgcatatgattgattgtaatactccataatctaatattgactgtatgtgtcaaaatatgcgccataaaaggatagcgatactagtattttgatggcttaaaaattttcactcactttttttacggacagattgagtaagtatattactatgaacacactgagagtgatgtttaaaatatatggaagtaaaaacattactaaccctgataagtattatagggaaaaatatgtagtgcaaaccctatatataatgcaaacgtagaaaataccgttggatcgaaaaatagacgcccgatattcgtccatgtcaatatgagttaaaattttactcgcaaactgtgcagcaaaagaatccttgtgagttaataaattgctctggatattacgtttacagaagaaatattgattagttaaaaatttactatcatataccgaacaaaaatacccattagtaaagatttcaccaacggcaagaagattttttcactggaaggatcgcctgtcacgtgtatatttcatttaaacgtaccacggcaatcaacccctatgagtaattttttaacttcaattacgcccgctccaagtcaaatctcataatgagtaatttttttactcagttgtctgttgcgggggggggcagggtggtcgataatcacgtgtttctctcataaaccaaccactgtaactgatttgccccacggtaatttttttactctgtttgcacctgcaggatggggatggggtggcgggtctgtgctggggatgcgggctctcgctgagtggcgccacggtttagctggcgcgcatcgcctgtctcgccatgtataccttgataaaactaccatttatatatatactggttaaacaacgtaattttttcactgaggcagagacgtcgatttctttcctaagaaggcacaataattcttttactctgtgttcaggaggacaactcaattagaactgagaatagatgacagagatgagtaattttttaactctctataggagcggtgcaccacaggggagagaagtggaaagctgcaggtggacccaaaaaaccggaaaatcagggccggccacgattaaaatatcatcaaataacctttaaattaaaattttactcatcacaaaacactctatgttcaaacttactgcaccgatgtctatgggttattttttaactctaacctaagagtgtacgataacttgaaactacactacaagtgaaattttaacaagaaatattccatatgtggatttatttcacgagtaaattttttactcaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaatttaagtccctggatctaaacaccacctcaatctacatgcaggcaggggatggggaacgtggcagggggcggttagaagcgctagaaaattcgctggcaaaaaaaacggaaaacaaggacaggacgggcggaggcgcgccaggaaattggtggcgcgtgtgaccccatcccgccggtcaaacccacgtcaaacacgcacattcactccctccccgccaaccactttgatgttcacgtctcgcaggaattccgcagtaacatgacggtcatcgtgcagtaacaggataactttctcgcagtaacaacatcgaaaattagtcatgatatatctagttttgttaagcacttttttacaaacatcatggtacagacagattagaaaaatactatataatgtgagagatattgccctctaaagattgagatctacttttttttaagttctcgtctatctagaacggcgtagtaatgggacaatcaatgtgcggtaacacgactactttccacagtaataacattataaaagaatttttgtctcgatcatcatatagtaacaggactattgtctcgctgtaacgtcgttttaaagtattatggtgaaaacggttctaaaaaacaatatatgatgtgagagatattattgtttaaatattagaatcctaaaagtttacttgtattaagtttgctactatgtatctttgtatatatgtatctttgtccatacatagtatctttgctaaaagatactatgcatggtcacaagttaacacaagtgctaaaagtgtttttctttgtctatacaaatatacatagatacatagtagcaagcttagtacaggtaaacttttataattctaatatttaaacaataatatctctcacatcacatattatttattattttttagaaccgttttgactcactcaaatagaaatatcatttggagtgagagtcatattagtatctgaggggtaaattgagaaaaataataatttagggtgttaagtacatctaagaaatagtttaagtagtaaaaactgcatttaactagggtgttaagtacattgaagattgttgtatgatggctcattccttggcaacaactaacactgttgttccttggcattactcggctggacttgtctgatgtaatgccatgtgatcggaattcaaatgctggaattaaccgtgaaagagatggaaagaaatgctaccctgttagggttgcctgttgtatatcagttggaaggaagtgaacttcatttttcattaaatcctccaagcgatatctaagcaattactacttttaattactagatatctctccaagcaatctctaagcaattactacttttaattaccagacatgacgtctggtaattaaaagtagtaattgcttagagattgcttggaggatttaatgnaaaaatangaggttcacttccttccaactgatatacgacgaaccagaacatctagttggtaattaaaagtagtaattgcttagagatcgctcggaggatttaatgaaaaatgaagttcacttccttccaactgatatacgacaggcaaccctaaaagtgcagcatttctttccatctctttcacgattaattccagcatttgaattccgatcacatggcattacatcagacaagtccagccgagtaatgccaaggaacaacagtgttagttgttgccaagtgtcgaaacatgaattcggcaataataaaagggggtaacgcacgagacctaaaagtggatggatgcggagacaaggatttagacaggttcaggccctctcaatgagaggtaataccctactcctgtttggggatttgaatccgccgggtgtagtatagatctaacgatcatatatgctcatgcccttagagggccttctgcccaccttatataggatggggagcaggattacaagatagaaaccttaaccaatacggtatcggtttcctaaatctattttacaatattatcaaatcaggactttaggccgctccataatataaaaggaaacgtaataccatgccgtgtgggtatggggtacccataatctccacagtagcccctaagaccttcatgtcttgggtcatataaatgagaaacgcatggagaagcttcatagagatggacttctacactcgtttgattttgaatcatttgagacatgcgaatcttgtttacttggcaaaataacaaaggcacctttcacgggtcaaagtgaaagggcaagtgaactattgagactagtacatactgatgtatgtggaccaatgagctcaactgccagaggtggttttgggtactttattatctttaccgatgactttagtagatatggttatgtctacttaatgaggcataagtctgagtcctttgaaaagttcaaggaatttcataatgaggtacaaaatcatttggacaagacaatcaagtatctacgatctgatcgtggtggagagtactggagccttgaatttggtaatcatctaaaggagtgtggaattgttccacaactcactccgccaggaacgcctcagttgaatggggtgtctaaacggaggaatcgtacattgttggacatggtgcgatcaatgatgagccaaactgatctgccgctaagcttttggggttacgctctagagacagctgtgttcacagtaaacagggttccatcaaaatcaatggataagacaccatatgagatatggacagggaagcgtcccagtttgtctttcctaaagatttggggctgtgaggtttatgtaaaacgtttgcaatcggacaaactcacacctaaatctaaatcagata

SEQ ID NO: 77257 - DNA, 6550 bp, Oryza sativa
aatatatacaggtacaagaatacccaaatatgcagaaaaaccctttacaaataaaggaatataaaatctaaatatacatctaacacaccccctctcaaacttatggtgaatcaacaacactgagtttggagagatagaacgtgtgttgagctctagtttgtgccttggtaaagaaatcagctatctgcaactcggaaggcacatactgaagagcaatcacctgatcatgtacctaggtgcgtgtgtaagaagcatccacaccaatatgcttattaagctcatgcttgataggatcatgagcaatactaattagcacctgtactgtccgacaacaaagaggtcgaggaagtcacagaaacaccaagatcctcaagtaaccaatgtaaccaagtaacatctgctgggctatagctcgtaactcagcctctgcactagaatgagaaactgttgtttgtttcttagtcttccaagcaatgagggaaccaccaagaaaaacacaataagcagaaagagatttgcgattaaaggaatcactagcccatgcagcatcataatacacttgaagttgtaaagatgtggaccgagtaaagaaaagacaacgagagatagtcccacgaagataacgaagaacacgaagaagatgactatagtgaagttgggtgggagcataaacaaactgactcagaatatgcacagcataggaaatatcaggacgagtgacagcaagataaacaagactccctacgaaatggcgatagcgagtgggatcagctaatggcacaccagtagtggcagaaagatgaagattaagttccataggagtgtcaaccgtgcgttggtcagtaagagaagccctatccagaagatcctgaatatacttcgcttaggaaagataaaaacccttaggggtagaggaaacctcaatccctagaaaatagcgaagagaaccaagatcatacatcagaaaattgagcattgagacgtgccttaaccaaagcaataaaatcagcattatcgccagtgataatcatatcatcaacatagagaaaaagaatggtacgaccacgaggcgaagtatggacaaaaagtgcaggatcataagcactggccgagaaaccagctgcactgactacagaaggaaaccgttgaaaccaagcacgaggagcttgcttgagcccataaagagagcggcgaagacgacaaaccatacccttaggaaccgaatatcctaggggtggtcgcatgtaaacctcctcatgcaattcctcattgagaaaagcatttttaatatcaagctaggagatattccaatgacgagcagaggctactgcaagaagagttcgaacaatggtcatgtgagccacaggagcaaaagtctcatgatgaccatgctcttgttgaaaaccacgcgctacaagatgaactttatagcgttcaagagttccatcagagcgagtcttgaccttatagatccatttacaagtgataggacgaacatgagatggcaatggtacaagatcccaagtaccagtacgctcaagtgcagcaagctcttctgccatcacatgttgccattcttgatgaatatcaacatcttgatgagaactaggttcagcgagaatagtagcaacataagcatagcgaccatagcgatcctctggacaaatcgtaactaaattacgatcccgaagattgtatctcggaggagcaataggagaagcatcaacataaggctccataacacgagggcgacgactatagacttgagtaagaggaggcacataggaagatgcaagagtctcattagaagggtccactggaagaggctccactggagaggaagatactgaaagagggatgctagtacaaataggggcatcaggacaagtgaggaatgagagagaggtctcatgagaagatgtggaactaggacgcgaaaagaaaggacaagactcatcaaacgtaacatcccgagaaatcaacatccgacgccctacaggatcccaataatgataacccgtatgttccgcactttagccaagaaacacacactcaacagactgagcagtcaatttcgtatgctcacggggtgcaagaagcacatagcaagaactccgaaacatacgcaaattagagtagtcaggaggttgaccacaaagatgctcaagaggaagcctaccctaaagagcagaagaaggttggatgttgtcaagtatgtagctgtggaaacagcctcagcccaaaaatgaggaggaacagaagaagcaatcataagagctcgagcagtctcaaggagatgacgatgcttacgttccaccacaccatactgtgcatgagcaccagggcaagagagctgtggaagtgtaccctactcagaaagaaaactacgcagctcacgagaaaggtgctcaccagccgaatcagcacgaaacgttaggatgggtgtatcaaaatgagtatgaaccatgcgagcaaatgatttgtaaatagccaaaacctcggtgcgatgagacatgaaataaatccaagtatgatgagaaaaatcatctataaaaatgatatagtagcgattaccccctttcgaaacaaaaggggcaggtccccaaacatcagaatgaacaagatcaaaaggacgcttagatacagactcactagtaggatagggaagttggatctgttttccatgtttacaaccttgacattgatttaaggacacatcacccgacacagaccctaagagacctcgacgaactaaagacaatagacgagagccacaaagatggcccaaactatgatgacactgagtgaaggtccctgtagaggaggcagcagaagcaagaagactggaaagcgcagcggaaggaagacgaagccagtcaagctcccaaagacgctgagaatcatggtggcgagggccagtaccaactaggagacccgtgtgtcgatcctgaacacaacaagagtcagaatcaaaaataacacgacaaccatgatcagcaagctgtccagcagacatgagctgtatggtcaaatttggaacataggaaacagaacgaccactaaaagaagaaaatgaaagagttccacgaccaacaacagaaagaggggtaccatcggcaatttgaacagtaataaggactaaaggatgatatatagatgaaagacaagacttatcaggggtcatatggaaagaaacacaagaatcaagaatccacggaaaagtaccagaagcagatgaggatccctcattggaagtctgagaaccaggaacaatagaaccagtttgtgtagagggcaaagcaactgaaccagctgaacgtgtcgaagcagaagcagtgaggcgacgcaataatataaggatctcctgtgtattagaattgctagtactcttcttcttagaagagaaccacaagtatgcaatggccagcaatcttagaagccaattcctcggtaattttattttttttaaaaaaacttaatgtagataacatatctcaggttttgctcttactataattttcaactacgatgtcatcatcttccatgaatattacgttactgataaaattattatattgactatgtatatattaaggtctgagtacgtgttgatagtatgaataacagtaacccatgttaatagtatgaataacagtaacccatgcaacacatgttgatagtatgaataacaataaccgacgcatggagtgatgaggccgtagacatggattgcaatttcggatgaaaaatttcggttttgctagtggggtccggcaaaagtcaatgccggtcaaaaatttggacaaaaaatttttaaaaaaatttgctaataaggccctcactacccccacaaccctaaccctaacccattttttccccgacagcgccgctgagagacgaaaaccttaacctccggcgccaaatcctcctacgtgacgctgccacctccacacctcaatcacggtggcgctcgtcctacaggtggccgcggtggctcagctgctccctcgtagagtccacgtcatcagcgcattagccatccctgcccctcgggctcctggcggcggtgctcctcctgtagagggtggcattcagttgctcctggatccggtaacttggcgagagggttgtcgacgacgaggaggcagcggtatgtatcttggaatttcttgcctctccatccccattcttactgattcggtgtctcaactctcaattttcgacttcgccactgtctgattagttactctgctcttgtcctgttcttgaagtagtgtgcactgtgggcatgggagaagaaggtcctgcatatgctggcagtaggagatgcaggggtcatggttgccctggtccatcagccgccgccgcagctattagtgttggaatataaagtgaattgcctacctttcctcatcagcttaagcttttgggttaaactagtcagtgcatgcaacccacttctattccacgctagaggcttgagggggcctcgcgtgagggggagtgttggaatataaagtgaattgcccgcattttcctcatcagcttaagcttttgggttgaactggtcagtgcatgcaactcaataattggagctgatttcagcaggggaatgggaaggggagcagcagcagttgttggaagacgagcggaagatggaaggggaaggggatcagcagcagcagctgttggaagtggaacggagggcggcaatcctgagactggtattgggcgagggagaaacatagccccaccaggaggtaaatactttagtcattggacaattaatgagtatttggcaattattgattgatcgaatgttcaattatccttctgttgattgcaaaatgatttgtccccgaattttcggaattttcggctatatttcggatttttcggacaaaattttcaaatttaattcaaaaaatttcggatgaaaatttttgaaatttctgaaattttgtcgattgcagttatttcgcctcccctggcaaaatacacactttcgaaactgcaaaccctggccgtagatgcattgtcagcgcccacgtacatatccaccatcttcaccaatattcatcatgcatgcaaaacgtgaagcgaatatgaagagacaaccacaagcagcttaatcggaggtgttctgttgacctaggcctgcggaggtaattaactgggagactttcgagacctcagaaaccagaggaccacttcttcaagttcagatctatccaacgacaagctatagagtgcacatacatacatacatacatacatattaccttgggaatttgtatttatgaaccttgagattaatgaagcacatgttccctatgttttttgtttattttatgtacttagttatactggcaccccacacatatcgttgttatttttctgtgctaaacatttgtatattgtgtcattttagggtatgacttatgcaagcgtaagtgactaaacaaacacgaaaatcaggtaaaatagcaacacacaaaaaggagcctagctgaccattttccaccacacacaaaagcccagtcaccatgacatatatatccgaccggggcccttgtctagctttcttctgcgttaggttgttcctctttggcctcttccataggagatgttgcggaattcatcttggccctcttcatgatcagtgtttccactaaactttccaagcgttcatcagcatgtctcttccggttgtagcgcagcatgatgctatcacgatcgactggttcctcgtcgatctcgtcgagcagtggaccgatttcaccgttcctcggcatgagtttatcggccacgtctgccggagtggtgttggtctcgctcagcagtccctcaatttcactgaatagtgagtgctcggtgatgtttaggtagttcttggcgagcatcttgaaggcctcgaaccggcagtaggacatctcgatgtccatatccatccttccacgccgggtcagcgccgggtcgaggtggtcaacgtggttcgttgtaaacacgaagattcgttcactgccgcacgccgaccacagcccgtcgatgaagttgagcagccctgacagtgtcactttacttttgtcgtgattcttgtcggacagccctatcaccacatgtttgtcgtcgccgttggctgccttcttgcccttgcggttggttgtgagctcgacctcaatcgcatcgatgtcctcgataacgatgatggatttgtcggtcgtatcaaggaagagcttccgcaagtcggcattgtttaggacggatattaagtcgaggtcgtagacgtcgtagtcgaggaagttggccatagccccgatcatggtggtcttgcccgtgcccggtggcccgtgtagaaggtatccccgcttccacgccttgccgaccttggagtggtactccttccccttctggaatgctctgagatcgtccatgatctcaaccttcttggcaggttccatggcgagcaagtcgaatgtcgacgggggattgtacgggacattgctccacatgctcttaccgtatttgacgtggttggtgaacaatagct

SEQ ID NO: 77258 - DNA, 7298 bp, Oryza sativa
tccattcgtcgcacctacatcttttatccatctcatatgctttaatttctagttctattaccgattactctcccctcaagaaacgttttcaagtcttattttatttccaaacacggcccgtgatacctagatttttccatgagcaaataatctcatcaaccattgagaaaatggttgagcctaattaatcttctatgtatatgaactggtcgtgtataaacctatgctgcaaaacccataccatatgcaatctgcagcgtcacctgcacaacatccacatccatcaacagacgccgtcatgcccaaacaactttgccttacctccaactgcatggtccagatgcattgctccattacaatgtgcttgggttttcaagctgcctaggaaaacacaagtcgtcgacccacaccaacaatgtcatccatgggacccttccctcagcacacggaagcctaaaagcaacaatgaagtcaccacctagccacaatgatagaatcttggttgtgccgaggcagttgtttggcttgcaagatggcgttgtgagacctaaaatcaatcaaataatagcaaatcggtttctacttgaagagagaaagagcacatgaacaagaggaaattgaggataacaatgagcctaaaaaaagagctaatccagtcgaggacacaacttcagtttgtttttcgtcacattatatcgtcttcaaactaaacctctagaataggtgagtagacggttatttaacacgttttattcgtttgccattgtcgcaatcaccttttttacaccgttacaacttacaagtaggtcgtaagtatcttgctggcctacttaaaaatagtgtattttgctgatccatacaagtcatttccatctgtcatttgcgtactgcatggcccattcaagcgaaacgaacagtacaatgcgagcttgtcatctttctccaatgtgcagtgcaatatgtcaaaatgcacacgaggcttcacgcgtaaatatcaatgcgtccggtggttatggagacagacctgtgcattgcacgcactgattcgaaccctttcatcgatgtcaatttttcatacaattttacctttacaaccccattggggaattgtaatatgcatattcgctaggtcaaaaaaaatgcatattctgaatatgtagagtctaaagtagacacgggagaccaaaaaacaacaccgacccaggctaaggctgtcaatgatgctaccatgggagcgacagtgccacccctcccctctttctctccatctcccccctcttttctttctccttccatttttcccttttcctctctcttgattctctagatccggttgtgccttttcaaatccacctcgtcggtgatggtgatgagtctggtcggcggtggcactgcttcgtgcgtaggggtggatgtcgagctagctcagctcggctcagctcggtttagctcgttaggataacaagctagcttggctcggctcgttatcctaacgagctagaaaccaagctcggcttggttcgtctgcaagcttgagctagctcgtatagctcgtgagctttgggaacaagagagaaagcgaacaaggggaggagaggcgccgggggagcgacgacatccacagcggcgtcgggcgctggggaagagcggcgcgggcgacggcgtcggtcgttgcctcgctgggagagagcggtgcgggcagcagcgtccatggcggcgtcggtcgctgcctcgctgggggagagcggcgcggacggcgacatccacggtggcaccgggcgccgaggaagagcggcgcgagcgtcggcatccacggtggcgccgggcgccgaggaagagcggcgcgagcgtcggcatccacggtggcgccgggtgccggggaagagcagcgttcgcggctgcgtcgggcactgagggagagtggcacgggcggcggcggcgatcgctcggggagaacggcctgggtgggcagtgagcggctggcacgacgcgatggtgcctggtggtggaggcggactggcggcggagagatggagagtttgagacacagagtgaggactagggtttgctctaatgggcctactatccttgtgggctttgtgggttgcctgttgttgctgggttatgaaagctcgttaaggctcgcgagcagctcgcgagccggctcgagctggctcgtaatctctaataagctaaaatgccagctcggctcgttaagaaattcaaacgagccgagccgagcctgtcacgagccaagcgagctaacgagccacgagcttcctgtccacacctattcgtgcgagaaccaaacaagggctggagaggcgctcgggcgccgtgatgtgttgcgaatgtgatggaaggctggaagcatcagtacaggtgctgagcttgaaggtgatcgatctgccccgtctcaagcctgacttccttagggaccatgaatggtttggtggcaaggcaggatgccgcaacaagtgttggtgatgacggtagtaatggtggcctttctaccctctagaaggaggtcagctctgttgtgccgcatcggacggtctaccctacgtcctcagcaatgaaatggcgccttggcagcgacaacaaggtggtgtgtcgaagcggcaatgaaggctgtgggagtcagcggtggcgggttctcaatgttggctccttgaacacatgccgacaacacggtggatggatctggcctaatggccaaatcaccctctaggtgacaaaaggttgttgcaccaagatggcctaatagccaggattacgataggtaggttgtcaatgctggctacaaatggggcataacactagatctggggcctaagtgccactagatttgagatgtctatgctcaaacccattcatgtgcggcaagctgcgttggacgggcttcttctctagctgttaatagtgaaatttggtaagcccggagtagtcatcggcttagagtcagcatcggctttgaagtcctgagattagccgatgagagttgccaagtcgtcagttgtcggattcttgctatattcggttaaggaaattgatctactaaaggaatcttatccagaagagaccaagttcaaagagaatgcggcatggcaagttatgtattaattaggaatagtttgttagtttcctgttatctttagaaaagtgtgtttagtgtcctataaggactttatcttttccttttatctttaagaaagtttctttcttgtccgacaaggacttgtatcaactcatgggtataaatatgtatacccggggtctatgtaatctatcgttacgatcaatacaattcggcgcatcaccaccctttttacttctacttttgtttttacgttccggcggaacttggcatccgacgcggggctgcatcgtcttcgatctctggcgaagggataaatccaatgttccgccggtccaagcaattgtatcgtctacgtcggtgttgttcaaggttgcatcaggacattcaacctcttggattactctggtttggataatatatttgcttggctatttattatatgtctatgttaatctagtcctaacatctcaatttagctctatcggctgtttctcgctttagggtttctgccggtatcagctaattcgccttgctagattagattagcctaggcatctaccaccctgaaaatcagtcaacggcttaattgtctagatattatatttcttttcatacttagtgctgcatcagttaagttcgatctactaagtcatgcttagaactataatctctaacctgcttcttgattgccaataagagtttcatcggggtttcaaccgatgagttatctagacgttgcatcggcttacaaggattgcatacatattggatttagccgatcgcagtaaaatttaattgtttaatataatcttgtggattttatgacatcagacctccagtcgatgtatgctttaaccttcggatcagtgtttattatatattgtttctagtcgattggtttctactcgattatattgttattttattacatcagccgattgcctttatatcatcatctatattggacatatagccgatttcttaaaccctatcgctatcggctggtatcggcatcggctggaatcactacatcggcttgtcagccgatcggctgttttatctgctgtttatatatcttgtcagttgcaggatcaaactgactggcacgcccgtatctcatcaatctttggacctgcacaggagttaagcagatcttccaggccggtgtttttgattttttcgtcaacactagctctactggatggcatgggcaaggaaggcactagggatagaaattgttagatttggatcaattggattcgcccaatgacaggggcaaggtgacgaaagagctagtcagatgtgaatagaacatggatgaggggggtccaagagttcggactacatatcaatgtcgactcggtgcaatttttggtgtggtaggattcattaggcaacgaaaggtatgagccttcgagtattttcattttcctttttcttttgttgtttcttatttatgagatttaaaatataagtatttatttatcctttgtttgttctcgtggatatagatgctagatttttatctattagctaaacttgaaaataagtaatgagtatgaacaatagaagaaatacggtagtgcaatcatgttatgtactccctccgtttcacaatgtaagtcattctagtattttccacattcatattaatattaataaatctaatagatatatatgtctaaattcattaacatcaatataaatgtgaaaaatactagaatgacttacattatgaaacggaggaagtaggaagtaatatggtagaggacggcttatatttgagtaacatacggcatgcatttccttggtaaaatcaaataatactgaaacgccaagcgcgttttatttgtgagacctactattttttaaattttgtgactgtaatggttaagtatgttctaaacaccttaagttttttttaaaaaataaaatagttctcgaaaggatctttaattgataccggcacacagagctcctgattttgtaacaacttgttatttaaaaaaaatagatttcaaaggaaaaaatatataagagaagataaatttacgtgaaattctcgtaatttacgtgaaatactcgtattcgttgagaaaatattttgggtgtgtacggaagatgcaattaggaccttgcacgcaaaaagaaatagctcattagcatagattaattaagtattagatataaacattttaaaaaatattaatataactttttaaaaacaaatttcttataattttttttttaagaaaacaccggttatcatacagaaaacaagaaaacaagggaatagaagttgaaaaatgagagatcgtataaatttttctactattatatcgtgcatagctagcatagcaaattaaccagctgatttggcatgtatctaagctatttattatataccgttcaaaatcatttccttgtaaccggcaacgaccggtcttaggttggttacgttgtgtaacaaaaatactctatttcttctaattactgacgtgcaatctttttatttgtttatgaaagaaaattagaaaacaatttagtttaaaatctgaagcagttcggaatatatgagtgggaaatcactaaaggaagttttttttaatgaaacttgtacaacctactttctgcagagtactccaaatcataagaaggggtgggaccggattgggaggggagagagatcaggctcctctaccttcgaagatgtgtggacccgataaaccatggacccgcttgtccgtgacatagacacggtgtctttgaaggcagagaatctcagttcggatagtttttttcagacctttttatttttttaattttatttttccgaaaagtatttgcaaatctgaaccttttggccacaccagatcgtgactaaatcactttgtcacgtcacgcatagctggcgtggcaaaacaatcgttggttcaatttttagaaatatttttcggaatgtatattaataaaaataaaaagaattaggagggggaggagccctaatctgtggcgccgggctggccctgggcctaggcgagttgtgcgaccgcctaaggccagagtggagggggggccatcaccacctccaacccaacaggcccagtcacttggcaggaatcgagtattgagatcgagggcaacgcgcgatgtggcggtttgtgggtcctggcgctctctcttttctccctgaccgcgacggccgcaaccctcgatctgtcccttctctttgcagcgagacgacgagagaagacaagtcaagcataagtgcaaaaccagcagccaggtagtctccgcttcttgatcttgtttgcaaaaaaggctcactgcatctataatctatttactccaaaatttaggttatgattttcttcttcttttgatttacttacatggcaagtccactattttaggtgttagtacaatattacttgacaagcatttgtcgattaatttgctaaagaaactaaagaactttattgatttgcaaagaaagagaactagaagttcttttttacaatacacatcggatcttgttgtcttcaatttctatttatataagttattcagactactttatttctgtggtttttttattgtctaatatactatcaacattgtttatcaagaataaaatattatataacaatttacaactagttgatttattatttactatgttagtaatattgtttttgtcactttagagattagaccacagttacatattacaaataaaaaatatttaaccttaagggcctatgtcaccgagttcacgtagggcccttgaaattatagagctagccctacgaacgggcggcggagggggaaaaattggagtcggtgagaaagatggtgagcagcatgaagcttcctttggtggatggggaggagcagtcgtcctatgaccccatgggggaaaagttgaagatgatgagcggcaagattatttcggaggagcagcgtctagtggagttggagttggagttggaagatgaagaggaggtggaagatgaggagttggccgagctgataacggcgcgagacttccgtgtcagctgggaacatcgctttacccctcgctattccttcaacgacaccagtaagtaataaatcctcctccgccccgccgttttattctgcttccgtttctttctttacttcaacgcaatcaagattatttctgcgaatctatcta

SEQ ID NO: 77259 - DNA, 3944 bp, Oryza sativa
cagatccttttttctcccattctgaatccaagtaaatttcataaaactacaggtattttgcacaatttatcacaaaactacatatttaagagcttgtttcacaaaactacagatttaatgtctctgtttatcacaaaactacaggtactttgtataatctatcataaaactatatatttaagaactgtttcacaaaactatagatttattgtattcgtttatcacagaactacacatttagtgtcttcatttatcataaaactacggatttagtgtctccattattacaaaactacatattttgacaatgctaatacctgtagttttgtgataatgaagacactaaacttgtagttttgtgataaatgaatatattaaatctgtagttttgtgaaataaattcttaaatatgtagttttgtgaaatattgtgcaaagtgcatgtagttttgtgataaatgaatatattgaatttgtagttttatgaaacaagctcttaaatagatcatgcaaagtatatgtggttttatgaaatttactcatccaattatcgttccagaaggtagctttactcccgtcacccaacgtgatggtagctgccgccgcaaaaggttctttgttgattgtatcacaaggaacctccatttggcgaagggccctggcgaactcctgcagctccaaaaatgggtccacccaaatttcttggtttggctggcatacagtcgcccaatttaccaaactgtgtccaggggtgatattttctgggtcttaccctttccacaaaaaggctctcctaattctgtcaattttcttgatcaaccatttttgtacgtagaactgtgagatggtatgttgggattgagctcagagcagtcttgatatgttgttcatcttactcctcattctcatcaaggttaatgtctagtactccatatatgtgcttatccacattgtcacatcaatcatttaactaaaacttggatttttgagtcaaaaatgggacacaacaatagcatccacaatgctattatttgataataaatattactgctacttgactgcagcaaccgtatgtcccatgcgctatacggagggacctatcccaagatatgcttgctgtggtgataccttgcagatcttctctctccaagtgaaagaagcaaaaggtggtcttgactggccgctgcatgtgtatggcttggttgccaccagggactctgtagatcaaaggcgcaaccttcttttcaggtgcacaagggataattgtcaaattctcactccacaggtatctatcttgtaatttccttatacctttattgttttctcatttttcttttgcagcttgaagtgctcaacctatcatactagtagattactactgttctgtacacttgtttgtataaatatgttgtctttttggagttattagtgcattataggctggctgcacctaaactgtcaattgaaggcatgtttgcaatttttttccttaccactcttttttcacataattcattggtaaaaactaaaaactgagcatttgtttagttcccaaattttttttactcaaacgtctcatcgaatctttggatatatgcatggagcattaaatatagataaaaaaaactaattgcacggtttgcacggaaatcgcgagacgaatcttgtgagcctaattaatccatgattagccataagtgctcagtaacccacatgtgctaatgacggattaattaggcttaataaatcgtctcgcggtttctaggcgagttatgaaattagttttgtcattcatgtccgaaccccttccgacatccggtcaaacgtccaatgtgacacctaaaaattttcttttcgcgaactaaacacactgtgagttgatagaattggcaccactatgacctatacctatactccttttgaaataatccactcgtggtgttggcattgaatctgctgtgtcaactcttcctaccacagttttctataaatcaacctgtgatgatagttaatattatcaacagccaaacatagcagtattgccacatgtataaccaagatgagcactcactgttgcaaataaatgaatagcatattgcatgcaaaacataaattaggtttgtttattttaggcaatattatggcatactttcttttattggtagcaaagctattgcatttaccttgtctatggaaatagaagttttgtgatggaccgtctttaacatgggctcgtaggaaataactgcatggattggttgcatactggatccttattatacggagggaaccaagttttagtaataatcaattggttgtgatgcctgcaggattcacacctgctgttaacaggcccatctcgtgcagttgtggtaattgatccagtaacgtttgaagttgaactaaaggtaaaaggaaaaacagaggctgaggataaggtgttgagcctaagggtctttatgcaccacactgtgcatgctccgcagatgtttgtccagcaaacatggggagcttgagttgacatgtgctggacttgtagagcagttgaggccacaatggtgagtatccaagttagagaggggtcatggccagatcatatacgagggttggtcgtttgtcgtacgggcagcgtagagggaggggattttgtgctgcttgattctggagatggaagaatgcctattaacagctacgatggtggcattgagctttcaaggcgtcgtcgcacaacctcaatgtcgtcgttgcaagaggcagtgctgttttcaagcctcgccgtgccgggagtactagtcttgtatgggaccttgggttttgtaaggtggaagctactgtttgttggtcgctccacgcgaccttgaggcaaatgctctcgggcatgccttgatccatactaatcactttagcttgttttgatttttgagttaacgtacagctcggctgcatatgcttgcgtaattgtgtttttggcgtcatggtctgctcaaccccagccgtgttcaggactagtaccatgtaacatatatatgcttcaatgtcagaatccaacctttttaactttctgctgttttcttaatgaaggttagctgcctattcacttcactgaacgtacatgaagcgcagcagcagtttattaaccaaacacgtatagttagccagcagctacgttgaatcaaacaacagatcgaagaggaatcatccgttccgttccaccgccaaatccaatgtcatccaatcacttcaatttgcatctctcacatcaccatctcttacccttattcagaccgcaacacccttacatatatagcgtcaagtaatggaagcaaccacatacatacatcgttgcatacacatgcaggcctgcaggctgcagctaatccaatcccgaccaagaagcaaccggttcaattcattaacaccaattaacatatggatggatgcaatcagcaagatgcaaaatgaacaagatattttccccacaagcatctgggactggaagggacatgacatgcccacccttgttatcgtcaaatatcaatcttgacattatatcaagccttcatcttcaagttccactatttcgcaaaggaaaaaatatgaattacccccctaaactatcgtcgtcggccgaagttccctctgaaccaaaaaatcagacatcactcaccctaaacttttaataccggacgaattacccccctcgacccaatccggagcagttttgtcctacgtggcgcacacgtggcaacccagtcagcatttctttttttaaacacggtggggcctgcttgtcattctctcacctcgttttcctcttcccctcctacccctctccctctcgtgtcgttaggagagcggtgggcggtggctcgtcgtcaggagcggccgtgcggccggtcggcgcacacggcggcgggcgtgcgagggcgggcggtggacgcgcga

SEQ ID NO: 77260 - DNA, 2692 bp, Oryza sativa
ccaatgatgcgtgtcgggttcaatgtccaagaaacaattgaatcactaaataaaactcattacaccattctttcctgagatttgcattgattcgctgaagaatgtgttgttattgttatgcctttaacattaatggtcatccacgaggacaaaagaaatggctaccaaccattggaacgtttctgctttttttttgtttgatatattcatattttgacaataactattctgcacaagtggacacatagttgtatgattcacagctgatggttataaaataaattacaacgaaactaggatatatgtgattatttctgctgcgacaaaagttcggcctgcgtgataaaacgaccatgaaagccatagggaacacgggcaggcagctgcaccgctgcaacaatttccagttctggagacatggcatccatcaccacgaactggctctctccggtatcctctttgtgtgtatagcacaccacatatccattgtcctcattaccatccccattatcattgcttggcacgaaaaatggctccccaacaaagcacccggggccaaagtcacggcgtgcaaccgtgcagtcgtcagcaccaaccatggcaaagtcgagctttctgattccagagaacctgggtaacggtgcgcttacaccaaagtatccatagcggttgtatcgaccgacgtagccctgatgaattacaccaaactcaaggctctccagtgagagtgcagtgcgcaaaacggtaccagtgcggagattgatatgtatcatgtcaacctgaacttgcatgagttccatgttgccaagcatgtgtgacagataagttgttggttgacaccaatataatctcctctccattagcttcctcccaggcattagctgtatgtagcatattgaatcctgggaccttgaaccacctcatctctgactcgtcctcggcataccttggtagcacaccaatccgttgtaccattgcactatccaatcctatcagcgagccaccacgtagagccatgttcatcggacacatgacaagttgcgactcagggaagatggcataatgctccgtgattgcaaagtcatgtagcattgatggttgctgcaaggagaagatgggcacatcatcagccttgttgccagccttgtcaaaccaaatatacgtgagaaatggctagaacaagctataacggaacgcgaataactctccagtgactgggtccttcttgggatgcgctgtcattcctatcatgcggcgaccatcaaagtcacaacggtgctgcggtagggataatagtggctgggtagggacaagccatggcgacaatggctctgtccagcctgcaaacttttgtaacggatgggagcatggtattggtgcactcagctatatatatatggatcgccagtgaggtgtcgtacagtaagtttgttacgctatctctatagaatggtgtagattgaagccaatcatagcaaactatcagcaaggtttgcacttcagtaaacaccgaaatttcgagagtttcaattggttttttttccacgaaattatttaaatgtttaacaaattttgactgaatttgaataaattttcaccaacttcattaaaaaaatgagagtattcgaaaatttcggatgagatgtttgcttgtcaggggattcgaaatttccaaaatttcgaaccaagattttaaaacctgactatcaatatgttgacgaagagaaatttcattttaataatacaaatgagatataatatggtcttcatcattcactattgtagtgtcgcctttgcatttttggcaactagcaagagtcctatttggacaagctagttttctggctcacaatcaaagaccacgttacggcgtggctcaagcattcattcgagcccaagaactgctcaagccattcatatcggggaaaagtacacccaaggtccctcaacttgtcatcaagatacaaaatcgtccttaaaccgcagacccagatatcagaggtccctcaactaacaaaacagttcgcttgaggtccctcggcggttttaacaccggttttagcctacgtggcggctgagtcagcgtgtccacgtcagcctcctctctctctttcccctcttctctctcttcctcatctctctctctctcttactcttctctccggggctctctgggcaggggagcaactgagaaaggcggcagcggtggtgggagcaggggagcaaggtggtggcacgcagcgggggaagcaagtcggcggttgcggcctccggtctcccccgccctcttcgctctgggctgaggccgccgtgctcgccccgtcgtctacgctctgcccaaagcggcggtggggggagcaaagacgtcgtcagtggcgggggaagcaaggtggcggcgagcggggctaagtggcagccggtggagcagagcggcggcaggcgagtgcggggcagccggcgaagcggagcggaggcgggcgagtgcgtggcggccagcggatggggagaggcaaccagtaggccccctagtggtcatcactcggctgccgcgtcctcgccactgacgtccccgaccgcgtcactcggcgacgagcgtgttggagtccaggttcccgccccacggaggcgcagccgccgttgccgcggtgccggcgccgagcaccctcgaaatatacgggcggtggcaagcggg

SEQ ID NO: 77261 - DNA, 5361 bp, Oryza sativa
agggaaggggaggaacggctgcggcgaggagatggcgtcgccgccagcggctcgccacccagccgcgcccgctgtcgccgctcgcgtgccaaccgcccatcgcccgccctcgcgcgccaccgccgccgccgccgctcgcgtgccgaccacccaccgcccgccctcgtgcgcccgctgtccaccgcccgccctcgtgcacccgccgcccacacttgtccgccgccgtgtgcgccgaccggccgcgcggccgctcctgatgacgagccaccgcccaccgctcgcctgacgacacgagagagagacagagagaggggtaggaggggaagaggaaaaggaggtgagagacaatgacaagtaggcccaaccatgtttaaaaaaaaagaaatgctgactaggttgccacgtatacgccacgtaggacaaaactgctccggattgggtcggggggggggggtaattcgtccggtattaaaagtttagggtgagtgacgtctggtttttgggtttagagggaaaattcagccgacggcgatagttcaggggggtaattcgtactttttcctttcgcaaaatcaaatatcatcccctcatactgagataaaaacagtaagtatgaggggaacttttagaggttaattaaagcacatttatacaaacaagtgtacagagcagtgaattgcctactggaattgtgcacacattatcgtcccctcgtactgagataaaaacagtaagcatgaggggaatttttagaggttaattaaagcacatttatacaaacaagtgtacagagcagtgaattgcctactggaattgtgcacacattatcgtcccctcgtactgagataaaaacagtaagcatgaggggaatttttagaggttaattaaaatacaaaccacctcattccaaatatgtgaatgcaccatggcaggttgcccatttcatatttgaatgaaaccataaggattactagataaaaactctatccaaatatatgccttaagatagacaacaacatgtgaataactcaggtagcaattagatacgatgatgcttgtagatcaactattattctaaggtaaaaatatagtacagacgattattgcatcacagaatagctactaaatactaaagctcctacacaaagcattgtgaatgctcaaccaaaaaatacatggagcacaaatacttcagcaccatcctctaaatgattcattcatataagctattagccaggtttatggtcatgtgacaaggaaggaatacctggtcttctcggttttaacttgtagttagaccatatgcatgttgatatgatcagcatgcagttattagatgaaagaacagcagcctggctacaatttctaaatcattacaacaataggtgaaaagaagtaaactgcaagatagagtatataggttatacaatcgtagatagaggaagaactctagtacaagagcaaagcctgatgtacaattatgagataggggatttctctagaattattatgaagccaatcagaagatagggacacccaattactcaattaaatgatgcaacctaatagcatacagatgcagtaagtaataataaatgtaagatgagctagtaagatgcactcatcaatgaaagtagtggtagaattgagaagcatcctcaagaagaaaagtgtagtaacactagcaatcaatcccaaagagacaaattttgcgagcccaagtaattaattagcaacaaatgtttgaaagaaggtaagaagaaacagtaagggaaccataaacttgcactagggtatattgcttcacaaatcagttcaaatttgaatggaaccataaggattagtggaaaagaactctatccaaacatgcattaagatagataacacaacttgtgaattactacaaattagcattcagatgtactagcagcaatagatgaggttgcaagaggagtagtagtagaattgagaagcatcttcagtaacagtaactacactgtaacaatcaaaattcccaagaggcacattttgcaagcacaagtaggagtaattagccacaattgttcgtctgaaacaaggtaaacaagagtaaagttgaactagggtagggtacaattggttggcagatctagcaagaactcagcaagcagatccatatccctactactccactaagcttaggtttgtctttcttcatacacaaaaaaaaacatgtcatctgatccgatccgatccgatccgatctgatctgatgagagagaaagtaggggaacaagagaaagggggatggatcaggcggaggcggaggcggcggtgcgggagcggtagagcttgccgaagacgtggagggcagtgacgaagcctatgaagcagagcgacatgacgagcaccatggtgggcgagaggcggaggccgggcgcctcgtcggtgtagaatcgcagcatgttgctcccgccgccaccggagaagcccccggagccgccggcggtggaggcgcggcggcggcgcatgccggcggccgcagcggccgtgccgcgggggccaacggtggcagggcgggcggccccggcggcggcgccgacggaggactgggactgggaggaggagcgagccatggcgattcgggtggaagacagggagacgagacgacgaatagtctactctctgggcttgggtttggatctcacatgatatactagtactgtacatacacccgcccgcccatataggtgtccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgaaggcaggccgccagcccgccagcctgcagtgcacagtgtttttttttaaaaaaaaagcaaaggaaatgtataaggaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaatcatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaagatatgttatcttgtggtcattccaccacccgaggacgttgaaatcttgtgcttcatggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgtgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcg

SEQ ID NO: 77262 - DNA, 704 bp, Oryza sativa
aattcctgcaccccgtacaggcgcaatgtactcctccgtgccaacaaatgaattggatgctcgcataggttcagcaaaaaatatggggtaactcccgttttttctcccttttttctcatcagcatcttcgggaagaaagacctaccaaataacataaaaatacttattgtaacttgggatgataatgaacttattgacatacatgctgaagtgtacgatagattgaaaacaatattacactagtataataatatgtgctatcccttgaggattagtatactgttgttaaaaaaaaatacttaccacacgatgagcaaagcatgtttaatgagtaaaatgcaacgctagtaccgcaacttgtgaggtgggtgcaatttagtcacccatattgtaaaatgctcaaacaagccactcatcttgttttagggggtgcaaagcacataaaacatgtgccttgtgggttgttcgcaatgaagttatgctctatgttaatttgttttgcaaacatggtcacatgatccataaataagagaacgtgcaataccaccagtagtaaatccaattaaagatgaattttgttattgattgacaagcacaatatggtcgtgttcattgacagcgggagtagtagcatatacatggaaaaaaatgagtattagtttgtaactttaatgcttgccttgccaaatggctaaaaaaagcat

SEQ ID NO: 77263 - DNA, 6028 bp, Oryza sativa
agcaagggagaacctggggagtgtgtagatgcaacagaattcagaagcttgattgggagtcttcgctacttggtaaataccagaccagatttgtgctattcagttggatacgtcagccgttttatggagaatcccacttctaaacactgggctgcgatgaagcatgtactgcagtatgtggctggtacacagaattttggaattcagtttagcaggaagaaacaagaaattcctcagcttattggctatagtgatagtgatatggctggggatatcaatgataggaagagtacatcgggtgtgctgttcaaattgggtgaaagtttactcagctggcagtcacagaagcaaaaaattgtagccctgtcttcatgtgaagcagagtatgtggcagccacaactggagcctgtcagggtgtgtggctagcacggctaattggcgagctgcgagcttgtgatcctcagtgtgtaattctgaaggttgacaataaatctgctatcaatctttgtaaaaatcctgtgcttcttgatcgtagcaagcacattgacacaaggtttcacttcattcgggaatgtgtagatcagaaacggattgaagtggattacatcagaactgaggagcagattgcagatgtgctgacaaaacctctcggcaagaatcgttttctagaactgagaaggaagttgggaatggttgaagtatgaatgcatcaagattagggggtgatttgttagcctgaagataatcttgtgcatttgcaataatttgtttgcttcagttagtaagtttgaattcttaggcataggatgctgcatgcattgtaacggctgtcccaggaagtttcagtcttgggcagctgagcttttcccctttttctgttagtagcgatggaactggatctggagcgtgggatggcgcgttcagtcgtttggatccggtgaaatcaatgtttgttatgcatgtaacaacctcacaagatgagggaataaaattgaagagaaatcagaaaagctgcaggtggttacgcagcaccaaaaaaaaaaaaactctgttcttcgtttcagttcttcagttactgttcacgtctgaaaaatattcagagattgtaggttagccactgatcgagagctaagcgaggggtttttgctgacaccactacctagtgtatattatttgatagaaaaacctcctaatatatatctcagataattgtggacctttagattgctttaagattcgtgccaacaccttaaaccctaacccttcttccttcctcctcactcccactgccgccgccattgccattcctcctccaatcctcccccatctcctccactcaactcgatggcgccggttgaacctcccctcctccccgcctcttctttttctcaagctgctggtggtaaggtgtccccatctcgtcatctttcccgttttcggtggcttcccgctatatgaaacaccaccaccgtccccgtcttctaatgacttgctccactttgtcctcactagcaacattattggcccaccgcccgccaccgattctagggcttcagcggtgccatcgccgccttgtcaacgagttgccacttggtacctcccacagtcatccctctaagaccggatcagatttttatccctctttgccctccctccacccctaacctcatctagaaacctaaaccctaactcgttgggttagtgttagtcgttgaagttcgttgcttgaccaggccccgcctatgcctaagaggaggaggcctggcacgaaatgtgaagcatatcagaaggttagaaatgtgcaagattttggtcccaatttttattataacatgatttaggaattccgtaattagtactgcattaagtattcttaattgtaacattgcaaagctgatcatgtgtacgtgcattaatatttggtattcattgatcagtacgcttgccggaagaggcttgcggacgagagggcgagggtgaagggccgcttcgtctccagctccggcggcaacgataataatgcacctgcacatgagctgccgccgtcgcttgtcaatctcagcgatggtgctgctgctgctgcaatcatcccaacaagaagtgtgccggagtggtggccagaaatgcaggcgtcattggccagggatgagatgtgtggcggcgcgggcatgaatctccacctgtgcgacgccaacgagatggagcaggttgctgcctacgttggcgtctcctccatggacctctgcgcctacctgcactgctcatggccgcccgtttagctaattagctagctaaatcgcatcgattgattttggttcgttgttataaattcctcaatgatctagatcggcacccgacttgcaaaattgatctgtagatcaagcagcaaaggaacattttgaagaaacaagcaaagcattcattcgttcccttatttttgtcttgttatactattttgttagtccaacgtgttgaatagtgtcgggtgagaagaatatataaatattagacacgttatattaaacctcagggtagaggaggtatataaggaaacgagtctattcaaatcaattctatcataagatatattttactaccatatactctaacatcccccacaatacaagcgtgagcaacacagacgcttatattagagaaaaatcctaggagagtgctcaacacagatgatagccttttgtgttgtaatcgatgtagctaaagtgaagggtaaaacgtagccatggtcgatgaagccatgcatagagtagctgcggtcgatgtagctgaagtcggtggtgctgatgacgaggtagccgagccacaggacgcacaaggggcatcgtagagtggtcgtgcgtgcgcaggatggctccaaggaccaaggtgtaaaatgatgtgctgaagacaaagatggtgacactggagaacaaggtatcacaccaggtttgccaagcctagggacaactcgggaagatgcacacaatggtgctgccaataccgtgcgcgcgaggttgtcgaccaacttgagtattgcactagtgtcgaaggggactagcaaagaaagcctcagagacggtcgcagtgcatagagcggcatagaggaagtagtgtcggtgcatcttgctgttgttagagtcgaacgaacatgtttgaagaagagacaacgctggtaacgttcgtaataaataacaagaaggtcccgaactagtataaatccttatcatttgtctgctaggtacaatctagcgtacaccataggatcagccgattaggtcatggccctacaatttgcacgcattcagcttggctagcgcactcaaccaggtaacttcccaatggggcctccaaatatgtgagtggacgtgagtaagccaaaactcacatgtacactccaccttatcctcttccacaacaaaaccctcctcctatcctctacacgtgatgtaccccatgtaccccattgcatgcgccactgttggttgacgcccgtttcccgctgtgttgaccctgcccatcgccttttcccgaccacagctagcagtgccactgccatctcaccatcactcagttcccagtaagacactttcacaaccatctctctaaacacagcctccccccttccctgttcctctggctgcccctccaacccccactggtccaccctggtagggaaccctaatccatctaggcttgggcaataatggttgtgccgcattggtgctcatgcgcgtcctagctgtaacgccccaattttcattcagaattaaaaatcattaaataatacattttgtagaaattaaataaaagttaaagcaatttaatcaagtgaaattatagaggaaattaaaaattcctttaaaaatcttatccgggaatattttgtaatattctctgtgccctaataaactctctgaaatttcccgtgaattttcagagctcaagaagtaattataataatacaaacaccatttaatcaattaaattaaattgtaaaacaaattaaaacttccccttcctcctttttgggccgcttttggcccaatcccccttcacctcccgcagccgcgcaccccctctctctccctcaggccggcctatccctctccctcggcccggcccttttgcctccccgcgcaaagcctattttgcctccctcctcctccttcctcccctcgctgacaagtgggaccggcggtcccacccgtcagctcttcccctacctctggcctcccaagccaaaaccgccatggccgccttctccccatgtcgtcgcctcccccgcgcccactacgctcccctcccccgcgtcgcccgtgaccgccacccacctcctccactccgcccgcgcgccgcgcccgcaaatcggcacggatttgaatttcgaatccgccgccctctctctctcttcccccgcgttgctagccggttgccgcccctctcggccacgatctctcctccccgagcctatcaaaaatactccccggggcagcctctccccttctccccatttgcccgagctccccacaccacctcccgtgctccccacgctaccctccatctctgccaccctccgctgagcttcgaccgcacgccaccgccgctctagccgccgccaccactagctccgccgcgcctcgccgcatgccggcctttgctccatttccccaatccgccaccgaatcaccacctccactgcgaacccgaggccgccgccgcattcgccgcctcccgctcgccatggctgcctgatccccctttggggcaatctgggccatccacgtggcccctcggtgccgccccgtgtcagctcccacgtgacgccacgtcggtgccacctccgcctacctgtccgccatggccaccacgtggtgcacccgcagatggtgtgcgcgtgaactcggtccaccgtgcgccctccccctcaccgacaggtggggctgcgtgtcggcgccacctaatcccctcggctgacgccataaatagctttaattgcgcaataaattcggtttaacttctagaaatccatttaaatggctcaaaacttctaaaattgagttgttcaacttgcaaaattcatctaaaattgagctctgcatgtttgtttacttttcatgtattgttaacttgatttttattagagtttttcctcgttttgcatgccagcacgtagattccgccgtttcggaagtccgtggtcgcgaggaaagagtttagaagattatattgaagaagcaaggcaagtcacacattccccttgagaatgttgattctagtttataaatgttttatcgttttcaaataaaattgcatgtcttgctaattacgtgggatcatggttttacctatatgttcatttgtgccatattactttatgtctgtcctttgtcaaacttgggtaataattcgactagcttgtgttacttaagttgacctagctagaactataggattagccatgcttaactaccactagctcacataatgggataatcacatcattagacatctcgtatcttgatgagctgcgtgctcaagacatccgatcatgtttcattggtcgtaattatccaaataaaacacgacttaatggtgggttgtgggtgcatggttttgctagtcgcgcccatggcaattaaggtccggttcacgggatgaactggaatacttactgcgcgtaccacaagcgggaatgggtaactacttgatctgtagctttcctctagctgacgtacccaggctagagtgggcatgatggagtatggatgggccctgcgacggcctttgctgcttccggattcaccgtggcacgggggggggggggggggcggggggggggggggggggggggggggggggggggggggggggggggggggggggggggggcgggggggggggggggggggggggggggggggggggggggggggggggggggggggggggggggggggggggggggggggggggggggggggggggggggggggggggggggggggggggggggggggggggggggggggg

SEQ ID NO: 77264 - DNA, 1500 bp, Oryza sativa
tctcctagtgattgacaaggatggatatataggtggtgtatagatttagggtgtaaagttttgatgtgttacagcgggtattatagggtgtggcatagggtgttaaggtattaataaaaaactaattacagaatccgtaagtaaacaacaagacaaatgtattaagcctaattaatccatcattagcaaatgtttactgtagcaccacattgtcaaatcatagatcaattaggcttaaaagattcatctcataaattagttataatccgtgcaattagttatattttagtctatatttaatactttatgtaggtgttcaaattgaacgttcgatgtgatagggttaaaaaaaatttttgtgggaactaaacaaggctatacttatctgccatgctgatgtgaacacggctgagtgaaatttcgcgccatttctagttcgttttcaacggagagattctcagtgcgaaacctgcatgaaacttctcttattgcttcttcagggttcagagttatctccgcttgattattttttgcgatcctagtctgctctgacaagcaatagaaatttgtttaatttgatggataagtaagatacggttacactttattatattagactgagtttgttttagaaattaatacaagtgtgattaggaaatctttttattcttcgcgcacatggaactggggtcccttgagagcctctgaattcttcagtccaaaatgaaaaatacaaatgtattcaaaatcaaataagcatgcttttacataagcaaatttctttcctgaaaaggcaaaagtgaagaaacttaatggccaaatgggccagatttatgcctgaaaaatatgcagaacagctataatttccgccgatttcttgactcacccggtatctgcgttcaattggattgcgtaatctttaccaaagtctacgctgatagcatcacttgccgcaaattctcgttcaaaaagcaagatcaacgtcagcaaatttcaaaatcaatttttacaaaaaaaaaattgtatttgacatgtcaacacgatactagtgcgcatatatgcttggattttgcgctgccttattatgattggtcaaatgttcaacacgtacttatcaagatatcaactaattaagcaagaagccaactgattccttgcaacctcttgattgctaatttgcaaaattgctgctgcattatagattcacacgttagaagttgaccagcttgcaattgatggcaacatatggatatcttacactaaaccaatccttaaaaacaatagtgtgatcacactaagttgattaggacaatcagggtgaattaacatatggttagatgaagaacatactgatcagtcagttgctatccattttatcctactgttgttcttttgtggtaaagttacgtacggatgagtaactaacagacacggacaatacaccctgattagtctgaaagtctgaatagaatttggtgaagggagcagagtaggcaagtt

SEQ ID NO: 77265 - DNA, 2738 bp, Oryza sativa
accaagcagaggttggtaatcgctcggttaaacgcatgaacgaccacgtcgttcacatatatacgtgccgatgaaccttttcttgaggcaatcccaaacctccctggtcgcaacctacatgtggagaacctctaggagcatctgaaaaagatggaacttgtacttctttgtgcggcgacgccctcctaccgttcaccttgccaccggtttgatcgcctccaagatgcctttatcttccatcatcacttgcacctaaaaagtaccctgctagtctagtacactgtcatcagatgaggatagtggaaggcactccctgtgctcccactagccacgtccgatgtcacgatcgatatagctctgataccacttcttggcgtaggttctcaatcaaacaccttgatggcctactgtagctaatccggcatggcacgactcacatagctaaaaaaaacagagctaagaacatgagtacgctaaagagatttgtgaggcaattttctggtttatgatagtgcttatatttctcgatgcaaaatcattgataacataggcatataaattggatccaacatagccttttctatacaaaatggtggctaggctattgaatctttcttgtgacattgctgatctcatatagtttttcaataatctcaactctgaaaagattctttcaaacaaatatttctaggcaaagatgacagtggatatggattaaggaacaaataacctggaatcaagaattgaccttcagatgtagcaagttcagccggatatctagaataagaaccaacacatcacagactgttggaatttcctaacgatattactagaaatataattcccagcaatggcgcagaaatactcctgatatattatggttacagagttcatccgcaagcgcacggatataccattgtagcatttcacccgagagtattcgaagggtatcatatttgtttaatcctgtggaaagatcatagtagagagaaccggactaataatttatatattacttgtcataatcatagtctaagcaggggttaagataaatcaaagggtagattgacacacaagcagcgagctactcattctcatactaaaacatctaagctaagtggaaagaaaatataaagagaatatattcctatacttctaatatacatagtatacatacattctacttatctaattaactagctaataccctctttctgatgccctcctagtacttcgagaagccacccctgcctgccaagtttcttacgacagcccgtcataaccatacaaccggggctaaatacggaggagtaccctccccaaaaaattaacttaggactatatacatgcaggaaggaatacctgtactaagctgtcaccatcagtggcccacctctcatccacagcatataaccccaaataatgatatcccgtaatctagacaccacacataaactaccagatactaatctaatatcatcgtcatgacatagagtaattgcataagtaaacattatactcgtaccgatgtatctcccaaataagctagcggtataatcagtataacatgatcatactgtaaagttggcattcatacactcggaaagtatttcaataccataaatgtataaagaatagtattctaataaaagtacaaagcttacaaaagaggaaaggagagctactagagccatacccgaactcttccgaaggcttccggactccgatttctactctattcctactccattagcttaagactactaaactaaacttgagagaatatgaaagagctttgcttgaggtgtgtgttgaaatggagagagtgagctccttaaataggcaggtaatgacagttatggtggttggaatggtcgaaaataccctccaaccaccatagggagtgaatctccaccgttcccccaaaaccctgaatccatcagcactggcattggttcggccgaaccccctggttcggccggaccctaggctggcccaaccatcccacaagttggctggtggcctcctggacttctcctctccgcagacttgtgaattttggcccaattggtcgtgtcatttctatgttcttggccctttcatacacaagtctgattctcgacatcgtccgattgatttatcgtctgatttgatattgattcttctccactttatagttattctctggaaaaggttagtgaaccaaatactagtggaatattattattctaacacaaatatgcatcgcaagcataactagttctcctctattttggtaatattgacggtcgaaactgatcgctaacgaccgtcaacacagaccaagaacaagctactcacattcattcaattatacaacaaatatcatcaacactactggaacaaccacatcacagatcaaaatcgtgctgccatggacaaaagctacacattcaacagaacaagaacaccaacacccattattgggattttcaaaccccaacctttgggccccccggggttttccccccccccccccaaaagagggccccccccaaaggggggaaaaaaagggaaacaacggcgttgtcattgatctccctcaagttgctgctgcatccatcatcttccttcaagccacactggccagatgccaccacgcccaagctcatggtgggccccgaacatcgagtggccaggtctgggcatggggagcttgtggcaccccctgaaagtggtgtaggcaaatgggaagcttt

SEQ ID NO: 77266 - DNA, 4012 bp, Oryza sativa
  unsure (1)..(4012): unsure at all n locations
tgctcgcggatgcgtatnacattgtctcagtcnttcggtgtgtaattctatcagcgtgtctctttgcacacgaagcgcgcgtgcgtnctattaatatataacgagntgtctgatcttntcatacnannnncnnnncccnncccccccnnggcgggatgatagtaacgctgttatntagcnnnnnnnnnnnnnnnnnnnnnnnnnnnnnnnnnnnnnnnnnnnnnnnnnnnnnnntttgccatacgggggctttactcgtgaattgtgtctagctcgttggtttagtcgcagacgtagttgagtcgttcgctcgttcgttcaaacgaggtgttcccccatggttcgttcattcgtccatcccgagttgtcctttaggccaggttaaagccgttcagagccaccagttccgttcgccgatttcgtttgatcatttgggtgatcccgtgtcacgttaaattgactcgttgagttggtatcttgtgaggctcgcttgccagtcaatgcatcctttgatcctatgttcctttttgggctttaatccctgtcaattggctaaggtttttctgttattagtaaacagcacaaagcatcttgtaaaattcataactaaataatctgagctccgttttaacccattcaaattgcagtgaatttgttaagatgtcaagaatccattaaaattggtttcttttgctgtttcagtatctttttagcttgtatttattgtgtgccttgtttgtcgtttagactccggcagttccgtcgctccagtttattttgaggtggtcgctgaggtcccgtcagctgaagagcaaggcaagtcatacatacatcattgattatattgagcctatttgcgaaaccccctgctttttctctgaaaactgcattacttttataacgttatgtgggatggtttctacccatactcagcctttgtttaccctgattcactgatagcctaggataataatttgactagatgattggtctaggattgcttagccatgcttagatcaactagctcacaatgggattcactataatatagtccttaatttcatgataatgttatgccttcttggcatatggttcattaattaaaatatgctttacttggtgggtcgtgggcacatgcatgatggtttcttttggtggtcgtgcccatgacaattaaggaccggttctcgtgaattcctggaagatatactcatactaaccacaagccagatgggctccaggctgaatcttaagtataatcttttctagctagcgcaccattggcaagggtaggcatgatggagtatggatggacctggattttggcctatgctgcttccggatttacctaggcacgagcgggggcttaatttcaaggttgtaacctatgtcgtaactaaatatcgactcatagttgtttcaatgtgtttctcttatgttatgttgttcagatcgatggcgctatatgtcttctatttcttcagctttatcaatgtaaagttctcctaccaaaagaaatatcaacacagatgggccaagcccacagtcacttgaggaggtcccaaaaagtactaaggggtagcaaactgtattcaagctagacaaagttcggaggaagcctcactatttcttcctccgtgtaacacataactaattatgggatcttttttttagtatatgtgagtcaatgcacacctgcattcacccctacataagtatgtggactaaactgaacaatcagtcatattgaacataatatcacacaatgatcagttcaaataactccagtgaagtaaaatagccttccagtaggattttcttcagaaaatcatatatatcctagatgctgtttactaatcttaaatggacattggaagattaagcatatttagaagatttagtttgtaatctgtctatctctgattttgctttcatgcatacatcaaaagataaagggtattggtgcgctcacattttattagatggcatggatcttcaagtgtgtattgttctgcaattataataaaaactggtgggcctctgttgtagttccgcatttagctttgctggtatgaaacttaaattccacttgctaccaaaatttaaagcatctatcatctttttatgtgacgagatatatccagaactctacatgaaaattatcactactagataagtgatctttgcccggatggcaaaaatcacattagtcccggttcgaataggaaccggaactaaagtttttttttctagtcccagttaaaaagcctaatggaactttttgatctttagtcccggttgtttataccaaccgggactagccgagccgcacggggagggagatcgagagccatgtcttatctcctcgctctgcgtcgtccttatcatctcctcccggcccgcttttccctcctcctcccctcccctcccctcccctctcctcccctccggttgcggcgccatgcggggcagcatcggcggcaggcgggaggcgctcgaggggaggcagcggtgagctaggcagcggcagcaccctccgctccaccggattcggcgagaggggaggcttccggcgacgacgcacgagggcagaggtggcaggcggcttccagctgtgtggcggcggtggcagcggcatcaaacgccgcctgtgcggagcggatgaaagcatgatggacgcagcctccctggccagggcgaagtggaggatgcgttggatgaggtcgttggagagcgctgagatgcggtcgatgccgccgacgaggaagaaattgtagaattttttagatgtttgtgtgaatttgtcgaatgttttagatgtttgtgtgaatttgtggattattgagtatgttcatttaattttgtggatgattttgttgttgagtatgtttttgtgaatttgtggatgtgaatttgatgttggggatttgggcatgtgaaaaaaaacaatgaaaaaaaaccaccaaccgggataaagatggatctttacatccggttatttcaaccgggactaaagatgtgcattcttagttctagattgggcgtcccggtttacaactcaagactaaatgtggttgcaaaccaggattaaatatgagttccctagcagtgtatattgttccgtggtatatatttccctgcttgatccacttctttggatccttgacgtagtgtgtgtcaacctagcctgtgaacttccagttagtgccacaaatagctaccttggaacataggcatcagatgcatcaggaactttaggtgatctgtgataaccaaataccgcaaacataactagacaagtgtctctgaactgacatctgtagtagataatcatctctagctgatagtccatccaaactgaggtgcacacaacgctaatggtaatgctgatgcacacagtgctgatggactattagttagagatgattatgtactacagatgttagttcagagacacttgtctagttatgtttgcggtatttagttatcatagatcacctaaagttcctaatgcatctgatgcctatgttccaaggtagctattgtgtcattggtaaaatgcaaaagaacgacataactttttttatgtcagcggtagttgtgtcaaaattaatttttttttatcaaattttacatttttatggcagaatgtatttcaaaacaatcaacaaattgcagagaaatattactagcaggtganctttttacatcaccctattaactctcacttacattgtctttnaaagatgtaatatgtacatagacgtaagattcaggaagtagctctttggtactattatgaatgattgattttcgagcgacggagtcatgaggtagtggtaggatcgtgtttcgtagtttgatttgagtaatgttagatgcgacaacgaattccgtgggttggttttatttagtatgctacggtgagtctgctttgacgcttcaccgttcttaaccgtactacgatctgagtgtaagatacaattaattgattgagtgtacgtattcaccg

SEQ ID NO: 77267 - DNA, 9818 bp, Oryza sativa
  unsure (1)..(9818): unsure at all n locations
caaccagcccgaatatggtaacagggtaaaacaaaagcccaaggggccacacccaataatgtgcctggtgatcacttgtatcaccgggtcagcaagaaaagctaataaatgattggcctcttgtttcaatcatatatgttttgatcatctgccctctgtaaaaaaagtttcttgatcagtagtggtgatggcgtgaagttacaaaatagatagagtcacctaccagtaatatttctctgcaatttgttgatatgctttgaaatacattcttctataaaaatgtaaatttttttgataaaaaaatattaattctgacacaaatattaatatattccagaaaaactgacaacggttggaaataccaccacaaccattcttgcttacatttacctactattttttatagcgtggcaaaccttcatgcatgttctactctttggcgtgacggcttgccacctataaaaaaactattttgtcctaaattattcttgtagttcgtaaataacaaaatattattttgcactattgtagatattgctgtagtgacctttcctatagtatttgttcgtgagaaacctatatgatataaatgtgccaatgtaccgacaatgtcaatgtgatacgtcatgccatacagagtgtttctaactaattcaaatgcgacatagtttatctggcacgccatgccacacatagtgtttataactgattcatataaaccatattccattcaattaaaagtttataacaaaaatatgtacaagaatgtgacatacatccatttatatcctcattaatgtggagattatgggtatcccatacccacacggcatggttatccgactagttataggggataacttatatctatggaatatgtaacagatcatgacttgggtattacgtttccttgtatattacggaacggcctaaagtcctggtttgataagattgtaaagtagatttaggaaaccgataccgtattggttaaggtttctatcttataatcctgcccccatcctgtataaggtgggcaggaggccctctagggggcatgagacaacctgattgtcagatcaatacacacccggcggattcaaatccccaaacaggagtagggtattacctctcattgagagggcctgaacctgtctaaatccttgtctctgcatccatccacttttaggtctcgtgcgctaccccttgtctctgccaaattcatgtttcgacagttggcgcaccaggtaggggttgcgtcaaattacccgtcgaaaagtgcgatggaatcaactccatgagtcgccggcttcgtcttcgcttcgggattgtcgcttcctcgtcgccgacgacttcaacaagctctcgttctctgacttggattcaaaccagtcaggagagattcaatctaactaagaaggagatgccacttttaggagttatctccctgacgaggcctcatcagttccgcccgaccggagaacgccgccgccgccgacacgcgaagagggagatcgtgtgctgcatgtgcctacaacggtgtcagcggtggcctcgcatcgcgctcgcgatagtgctcgtggtgacctcacgctggtgtcgcaaggcagcaagaccgatctctccctgatggtgtcctcggatactccaatctatcatcattagattgatttctaatcagattaatttgctctgttgtgctttctctgtttttgcatgtactggtgacgagacgggcagcatccaactgaggtcatctttgccatgtattaatccatgcgtgtgttgctggattaatgccggccaaatctccagtcagtcatgctattggcaaacgaaccaacatgcatactgcatatatgcaccgacatgtgcattatacctaattgctaattagatttatttataattgcaacttaactgaagcttgtgttggctattttgtttgcatgtttggagattccacacgcctgggggctgcgggccagcaccgcctttgcgtgcctaacgcggcccgactgctcctagggcacgcacgacctggatgcgatgccgcacgtcgggggcttcggtcttcgcccggccaacacagccagactacgccgcttccgccgtgggctcggggctttcgcctttgtgcgccgccgcctcatccgctgccgattggtgtttccgcctgcacagttggcctattatgccgtcgtttatgggcgtccacgtcttcactgaccggctggcattcgtcaccgctgactggtgttctcgcctacatggttggttggtcacaccactgttcatgggcgtccatgtcttcaccgaccggctggatttcaccgccgccgactggtgtctccgcctacacggctggcctattatgccgtcattgttgggcgtctacgacttcaccgtcggcctgccttcgtcgccgccgactggtgtcctcgcctatacggttggttggtcacaccaccgttcatgggcgtccacgtcttcaccaaccggctggatttcaccgccgtcgactggtgtctccgcctacatggctggcctatgatgccgccgttgttgggcgtctacgacttcaccgtcggcctgccttcatcgccgccgactggtgtccttgtctatacggttggttggtcacaccaccgttcatcggcgtccacgtcttcaccgaccggcttgcctttgccgccgccgactgttgtctctgcctatacggctggcctattatgccactgttggtgggcatcttcgctttcaccatcgactgccttcgtcgccgccgactggtgtcttcattgttattgatggacgacttcgttcccacatcggctacttctattgtcaccaagggaatacgaaaaagctaagtcatcattaattttctttatatgatattttccttttcctctgcctcatgacatcaactggttcgccgttgactagtgagtcgagggctacagatgttatatcatatttttttcaacaatttttataatatttatcttgatagctcgcgacataatctgagtacaaaagtgcctatcgagttatggagtttaatctttctatgctttccgtttggtttaccaatggatagttgtctttaggccgattcctagcacctgggggctcgttggatggaccgaataacacaaggtgctaagtattaatcggaataaatcaaaagcatatagataagataattaattttctgctctttacaattgcaaaagtacccgagtagtaaattctgattcgtgaaactttgttccattaatgacgaactcatgtcactcatatgcatgtttgggaagtgcctaggccgactcccgatgcttgggggctatgactagtcggacagagtgtttaaatgtacggagtcatctgctcagggaaatcaaaattgacaagaggagaaatacatatttataaatattttaaaatacttgaatttttctcgagtattatatttacatcagatactactcatcctatatgtttgttctgcaggatccagatccagatatgcataaaagggattcatggctttaagcttatctcttacgctccaggaatggatcagtcagaatatcaccaccggcttgccgtcgtcgccgccgactggggtcttcacctatacggttggttggtcgcaacactattgttaggcgtctacatcttcaccaccggcttgctttcgccaccgccgactgctgtcactgcctacatggctggcctattatgccgttgttgttgggcgtctacgtcttcaccgaccggccgcctcgtccgtcgctgactggtgtttccgcctgcacggctggcctgttatgacgccaactgatgctatcttcttcacggctggctacgtcgtcgtcaccgctaataggcgtcatcatcttcaacgcaagctgcctacgtctgctgctgactagtgccgtcacctctacggctggtttataccgctaccactattgatggacgtcatcgtcttcattgctggtcgccttgtctgacgcagactggcttgttcgcctccatgcctgcacgttttcgtcatcattgactggcattatcgtcatcgccggttttccttcgtcgctgctcatggtgtctttactttcatggttggcctattttgtcgccgttcaaggacgtcttcattttcgtcatcattctacttcttccatcgccgacaggttatgccgccaccgactaatgtttttatcttcacaactacgcgtcttcgctaccggtttgcttctgttgccgccgactcgtgttcacttcatcacagctatgcaactttgtcatcatggtggagcgacttcatttttattatcttcagcaccggcaaactctattgccgctacttcacaagttttgctacttcaccaaccacgacgtctacaagagcttcgacatctcagcatgcgtcaccaaatatgatgccgtgttattttactacaacaagtggtgttccaatcttcaatatttctactcggatatcttcaacatgcatcttcactcaagcaatgactactcgacgacaagaagctatagcttttgactctatgttcagttgtttcccaactaaccaaagagtcgggggctacacaaatacacggctcaaaattcgataggttttatgtcaagatgaagaaatcaacaaatcagccaatgagttctatggaatctacttcgggagtcatcggtttcatcttcgcttcagagcagacgttctacttcagcaactcttattatttcaccggcaatttttggtttctacacgccgctacaatctactccaaatttctcaattgtcaagtttgagatttaatctacatgttcgggagttggacaattatcaaccaatcagctcagttttaacgagttggacaacagcatatactttcctctaagtgaagcatctgcaacagctatagcaccaagttctactgccatcttcataaatcaagcggcattgcatcaatctttgtcatagacatgctcatgtcaagaaaactattcgagcttcgccatcttctcaacaatttgaaggattattgtcactgacatcatcaccaacacctctacttcatcggccctgacatctccgccgttgctaagggcagctgtttcgtctgtctccgactgattatttcgtcaccaaggctacaaaactctatcgctattgctgggtgccttcatcttcactgctagttgatctgactgctgcctactggtttcttcgcttccatgccgattgcatcagctataaccgatgaacaatttcaattactccaaaaagataagctatatgctcaggggcttacgagctcaagcacaagaatcataccttcaagttggattttgttctagatacaggcaacatgcactcgtattcctgagattatttcctatgctcgaagactggaccaatcattattccccgtaagggctgtcaaccgaatacttgcgccagtcgggattcaatttttatatctattttggagtatcccataagggataatcactcatatcagaagcaattcatatgagctacacttggtctatattacccggaagatttattactcgggagcatgttacatgcgtcatcctttaaagggtgtcgaaggcatattttttggcctaggcctaatatatctgcagcccatattttcaggtgtggcctgtcacgttcttttagggacttaggcactttttgcttaggccaaagtgcgtgtgattatgtgcccaataccttaaaatccttttatactgcagttactcaattttttaggagttggtacaatgcattttaaaaggtgcccaatagtgaagtttttcatagctgccccgctgacttttttatatagtcaaggcactgtttgggttttttaagcaattgattagatacaatatcattgctttttgccacgtaagtgtgcatttttattgcccaatattatggcttaggctgattatatatcttggttattttccaggtgattggtaaatcctttatgagtttatttactcggattttataccacatatgccatatatttccgggtgtgttgaaaccatgtgtcttttagggacttaagcacatctgttaaagcagtgtgcgcatggcgtatgcccaatactttggaaatttctttattaacagcatttaagcttctttatagctgttttactatgtgaattttcaatgatgtagttagggatgaaaacggtcggaaacgatcggaaaacagcctcaaccatttccgtaaccatatttttctcggaaacgaaatcggaaacggtaaagtcgaaaccaaaaacgatatcagaaatatcgaaaaaccgaaaacggaacaatacggacggaaacatatcggtacagatcggaaaccggtaacaaatacggaaacattaaactataaaaacatatatttaactttacataagtatattatatatatacataaattcaagcttatactatataaattataaattaacttcattttagccatgtacaaaagttagagattttattgaagagtcactcaatctataagctgtgggtcaagtatagacatgccctataaatatcgacatatttagaatacggtaattaccatattataagaaacggtaatttccgcaagaatacggtaaatacggaaacgatcggtataacagtaaaaccatttccgttttcatttccatattttttaccatttccatttctgtttcggtcgattaccatttccatatggctcggccggtagaaagtcaaaaaggaacaccggtcggccggtaattaccgttaccgttttcacccctagatgtagacaactttaggttgcacgcatcatattttacaaatcagtcggtatatcacctggatcatgttattcggggattcacaccgcatatgctatatattaatatcatgtcacttggttgactataattattaaaaaccactcagttggttggattatttattccttgactatatgcttagtttgttcaactaaccacatagtcgggggctacacctattaggtgcatctattcgatgcacctggttttatttttcagccctctacaatcttcatatttggtaaaagtactcaggagaccatggcaaagatgattgaagcacttggctttggagtaatctggttcgagagaagattatcttttcgactgtgaagatctcaggggttactgtggagattatgggtaccccatacccacacggcatggttatccgactagttataggggataacttatatctatggaatatgtaacagatcatagcttgggtattacgtttccttgtatattacggaatggcctaaagtcctggtttgataagattgtaaagtagatttaggaaaccgataccgtattggttaaggtttctatcttgtaatcttgtcccccatcttatataaggtgggcaggaggccctctagggggcatgagacaacctgatcgtcagatcaatacacacccggcggattcaaatctccaaacaggagtaaggttacctctcattgagaggacctaaacctgtctaaatccttgtctctgcatccattttaggtctcgtgcgctaccccttttattattgccgaaatcatgtttcgacaattaatatggactaaaaaaacttaaaaatatggcacgagcgaatggacaaactctgtccactcttactatcaatagactaaagtgacgtagtaggggaaaggagagcagggcagtgacctagagtttctcggttgtttttgaagctctaattaaaaaagagtgaagaataagttgtacaacatttttcttggaaccgaaagaaaaaaaagtatggaaacaatatgaagttggtaagtgctttctttttactatgtcagatagtgtatatatatacatacatacatatatatatatatatatatatatatatatatatatatatatatatatatataaaactagtcactaaatccattttgtaataattaaaattcaataaatatttgttctaccaaaattattatactcatacaatataccccatcaaagatatcaatgattttgagagcaacccattcatcaaccaaaatatatacttttatttgggaaacaaccaaaatatacacttgataaatcgaatgattatttattgtggccttgaaccacttctcaaatcacgaagtacggtacgtactaccttataactgcgttgcttacttgctttgtatactctaattagtttagaaatataagacaacatctgtgacaacatataactgatcaccagatatattgccccccattgcctcactcactcatttcagctgctgttcctgctactgttctatatccaaaatgttaactacaatggctatatcttttctgtgggcatgagatgcattgggaactgcgatctgtccaaatcattccttggcgcagtaaggaaagagggatacttttatgcatacatgatggcatgtagtaggacgcaatagcgataacacattattcctgccgagctcgtctgctttgatcctcccacgccatgattcatccatatagacccagctacagccaaatggacggcagaacatggcttaactgaatatatcaaatcaaattgatgcaacatccttaaaattacaataatccaaatcatcaatttgtgtactccctccgtcccaaaaaaaaaggcaaaccgtgggttcccgtgccaacgtttgactgtcaatcttatatgaaatttttttataattagtattttcattgttgttcgatgataaaacatgattagtattttatgtgtgacttatctttttaatttttttcataatttttttaaataagacggacaatcaaacgttggacacggaaactagggtttatctttttttttttggaacggagggagtaagaatcaatgattagctcatgtgttgttagctgacgcagcatgccgcggcttatcccctccagatatcgatggtagcaggtcaagcagtaccccactacctctgatacaaactgctatgtttcgtaaagattagatggttttaataagttaaatgtttgattaatcctttagatccattgtgccactaggataataaaaagaaaaagggattctctcacttagctgctatacagtttgagcattgatatatgggccatagcaaagtgggatctacatgtcagtgattaactccatgtgtaattaagtcaaagcatctgctttcaataaaaaggggtccatggcagtatagcacttgacagatatttactgccccttttttactttctactccctgtatctcatttgttttcctaaatggaagttatcaatgttcttccatgcatattgttttttattttcttcatgagacttgctgtttgaccgtaccagcgctgtacaccctaacaaactggaaatcctgttcggcgatcgatcgctctggggatggatcagcgatcgatcgcctcctccctccctggctccctccctccacccctctacctggtttctttttttttggcaccgcattactttcctattttagtaaatttatatacttaaagtttatacacctcaagtttatacttctaaagtttggagaccaaaaagttttattaanagggttccaaaaaaaaaaagggggttttttttttttaaaaatttttaaaatttttttaaaaattttccccccccccgattcaaatttgaatttgaattcaaatattttttttatatatagnnatttctatatatctaa

SEQ ID NO: 77268 - DNA, 1506 bp, Oryza sativa
  unsure (1)..(1506): unsure at all n locations
agctgtccaatggaggatgccctgcagggtgcatacttggggccacgccagcgaagttctagtcgcgacgtggtgaaaccaccggcggtgcagttgagggtccctacaagcccgcgcactaccggtactaggctgcccagcacgactagcggctgtggcatgagaagtgtcaacttgaagttcgccatgacgactctggagtatcctgctttgttttcatcatcttatatgccgtcacttaggaggatttgttgtggggtttatggtttgagactggtgaaggggaggaatgggaagccgtttgcttttgcccagaaataatggcgtaattgggtggagttggggaggtgtgctttggcagatacagttttgtcttgttgactctacttatctgatatcatttgcaagcgttttgataaaaatcatgcgtcatttatgaataatattcttgcctttaaagatagttttgctcgttgtgctggattgtatgcctgtttcgttggtttgttatgtgttgctagtctcatttgctcgtggtagagctggtgcttcacttcccattgggagtgtgttttgcatttgcttagtgtgctattatttggtactagtacattaaataagcttatcagaatcaggggtgcaagttcgatacttatgcgaattcgtattgtccggtataagaagatagaaactgaattcgtattcgactcaaatcctgtcaaagtaaattgaaacgataagagttttgatatttgacttaagaataatatccttattctttataattgagcatcctaatcaaattcgaaaaggcaattcaatctatatgcccgtttgatttttgggttaatttgatctgtgccattgatcaaattaacccttgatttttagacatggctctcctatctgccactttacctctctcgtcggtctctctcgagttctaagtgagtgtccatttttctcctactctctccgggcgtgcgtggtttcggctcttgttgtctttgttgagcttgactgtggaggctatcgttgtaaagtttgcgagaatgcttttcatcgggcgtccgggccgacgcaagaaatcggacggtagtaacggtgtctcttcacccgagacaacagaagtcctcgcgtgcatgcagggagctagtgcacgtaagcacacgtcaagtgcatgcatccatgcatattcaaatattcaaaatttaaatacatgtttctctacaatcatttatccaacctactatttaattataccattagattcgttataattaaatatttatataatgatcttacatggttatatcagatagcggctggcgcggtaggcggcgagcgggggcgaacgggcagatagcacgcgggggcggacgatggnctttccccactgcatctgcaggctccccccccgtgttcctacatcaccgctacatgtcttgactccagacccaaccccctcacttggcgcttccgacgctaccggcccccgtccactcg

SEQ ID NO: 77269 - DNA, 5534 bp, Oryza sativa
  unsure (1)..(5534): unsure at all n locations
ccgcaccccccatcctgacggtgaagaagaagaccggaccatcctctctgtgtccggcgcctccattgctccctcccgcagaagttcaacgtcgctgcctctgcgtcccgcgcgttagccgcctcagtatcccgcgccatcgctgttccctcctgaactaaggtgcataacgcttgcctcgccgaccacccacgcccactgcccgtccccacaccgccgtgcgcgctacgagagaggaatagctagagagaggaagagcgatagatagaagaagagaggggaagaggggtatgacatgtgggtcccatattttttaataaataaaatactaactggattgccacacgtatgctatgtaggacaaaatcgctctggattgggtcgagaggggtaatttgttcggtattaaaagttcagggtgaacgatgactggttttcgggtttagggggtaatggcaaggaagttgctagatatcccatgatcccaaggccacatgcttaggaacctatcagtctgtcacaccaatggcaccttttcatttttaaccctataaatatttctctttagatgtataggtttagagattgagttttccatactagtaactttttatatactttatctataataaaaaccacatatacatgaaacaccttggaagtttcaagtcttactattgaaattgtattctttactaattttctttaccattgtataaagtacactcaatctccagttttgtttagcatacaagttaaaccatctcagtttttttttttgcagtgaacacatattctaaactaaattattataaatttagtttaactaaaataaaataaaataaaataaacattagcaaatttacaaggtaattaactaaacatagcctaccattttcaccttaccaaaatgataaagtcgaattgcacataatagttatggctatcaggcatcctaccattgattattattgttgtaatgataaaacaaatcacaacaaaataaataacatttacatatttttttagtaaagcgaatggtcaaacatcatattcaactgtatcatctattaaaaatagatagagtatatttttttattacgaataatatgtgaagacattcggtatagaggaaggttaaagtcgtgcattcgcacgactatatacactagtcttctattgaatacattgttcttcgaggcacatcaggtagtggtcaagaaaaaagcttttggacatgatgttcaatcatccatcctattcagagttccacgaaaaatcaccttgtcctatggaaaaggtgagcctaatgaaatttgcatttagataaatccatgctcctattattatgagtgtaatatatggtcaatcattaaagttgaacgatggtgtcacttagaatccgcgaatttgcaaaatacacattcaggtctatattattggtttaatgtagcacaataggtccatttgtcgtttggccttgttagtttgttgatgcggctctccattttggcaccaaatttgtgttcgtcccctctgcagcatagcgtgacgcgaaaattgcatttaaccccttttcgctacagggataccccaaaagccaccaaattcctctcctccctcgccttctcccccaaacacgatgattcgtggtggaacgggaaatcatcaacaatgcagagtgcttcaggcggtggttcgagctgcaccataggtgacgtgtggtggggctctatcatcggcacggcgatgagcgatggacctcaacttcatggggaaggttaaccgatgcgtttgtatcatgagtactgcccacctatttcttgtactccagcattcatctagatgaattttagtaattaactttggttctttatgcaatgcaacatgatcttggttaagtagttggggtttgatctagggtttagtttgttgttgatttgtttggttttattttccatctgtttgccctggttcaaattatttctcaattgagtttcattacacaaatttctctgtggtatgtgagtaaatttgtcgattatatggagtactattggagtctaattttccttaggcgtgtatgttcaaaggtacttcctccgtttcatattataagactttctagcattgcccacattcatgtatatgttaatgaatctagacatatatgtgtgcctagatttattaacatctatataaatgtgggtaatgctagaaagtcttataacctgaggaggtagtatgatggaatttcgattctttttcaattgcacagttaacggtagcaatgatgttttatctttcttttttctctctttcatgtcagcaaatattctttattggttaattaatttactggatgatgtgtagcactgaaagaacacaacataacggtaattctaatgatcggtagtacagttttgttggtaactttttgtgacaagtcgacaagcacgatcacaacacctaaacgccttgcggtgatatggagtcgccaaccacctcgatctagccaaacggccaaatcaagatgggtttcgtagaaaaacagttaaaccggctagcggagccgatttagagatcaaaatcagcttctaggccgatttagatcgatatgaggataactacccgtctcgtgggcaaaacggaaggttttcaggacaaacctacagagaggcgtcgcactctcgcagcggcggcggacaatttacagcgcaaatcgacgaagatggactaaaactagggtaaaatagaaaacatggtaaaagaacgatttaagtagattgtattcggggttttacaatgaaccggccttatcccttaaataggggttggtcttgccttctccacatccaactcgggatagaaactaaagaaaacatgaaacatgccttcctgagtaaggaaactcgagacctgacgaaatcggactcggaccttgacggtctaaccgcccacatacctgcggtcagaccggccctactagccggtcagaccgcccacatacctgcggtctgaccggccctttgaaggaaacccgacactttctaaattttgataattttcccctattttgtccataggtgctaaatttgggtgtaaacactgttgatttgtttccgttgttatctcctgaacatcctcgaacaaacggggttaaacaacacttgtctctttccatttaatcatatatagttgcctaataatctgaggctttctaatttctgtttagatctcaagcggttttatctgcatgggtgtctcaccaaagaccaaacaatttcagatctgcatgtttatatgagatctctgtttatattggtgtgcaccagcttaatttggcccagataagaaagctgaaaccgaatccaacagggtctcttttaagttgtaaaaaaaatgaagaaaaacagggactcttttttgagttggactctacttggcccaacttactttgcatagataatttcctttctttcctaggggcctatagtttttgcctgaattggactctacttgggcccaatctatattctcttgtggcatagatcttgtttggcctataaatattccaagacctattgcttatccttccagattctctgccatagaaattagaggtgttaagctagggttttgggattgtcatcaagggaagttgccaccagcacaacatctgaaattattgaaggaactcccaacagaaattattggggaagagatctcttgatctattcagttggcaggaaggagttggatcatccgtgggggtgaagagagcagaaggatcaggccttgaattgtgaattcttggtggtgattgagcagaaggatcaggccaagaagtccaaacgagcagtgaaatcaaaatagatacaacaggagaggcgcacgtaagttttccatgtctcacatctgtggtttttctgtcttgttatttcaattgaagtcgattgcacaatcgctgcttttcccccctcctttctagatttgttcggtattttatatgcaccctttcagtttttctccaaggatcacgggagctttccgttttgaacagtccttccaaatcgatcttgatattgcattattagaactggcataccatgaatttttttttttggtgtggggaagggggggggggtattatgtgaattttggatcatgagatgtgcagtaagatttatggtagcattcttctcctccaactccgatgagtcacgacggcttcggggaggctgcggcggcctcgaccaatagttcaaggttggtgtgaagggagggggatggccgtgagaagcaatcagaccggccatacggcggctcatgtcatggggtgaggagctaggggtgatggtggggcggggcacgtcgtatccacctggcttagggagtgggagaccgtttaggtgggccttgtcggcacagttggtgcctttcggtggtgacgaggttggggtcgttgtgcgagccagagaataggatggtgttagcgagctgcaggacggggaggggggggttgttcttgggcagatctcgctcctaaacataagggagggacaggggaagaggctggacctatcatataaataagacttcaaccatatgtacccgtatctattaatttaccttctctgtgttattttccatgcataaattttgatgcaattctactgtgtgaaaagtgattaagatcatgtttttttttgaaatgttctataagtagcatgtggccgtgtgcactaattagatttaacaaactaataaactttccttgccaaaaaaaaagaagcaaatgtcccactactccactagcatatctcgttgatgcgtgtcacggctggtccatgaatgtgcgtgttgtcttatgtaccatgtcaaaaattcaataaaaaacactgcatgacaaaatcatattatgaaataggaaaaagtacgaattaccccctgaactattacggacgaccgaattacctctctaaacccgaaaatcagacatcgttcaccctgaactttcgataccagataaattacccccctcgacccaatccagaacagttttgtcttacgtggcgtacgcgtggcagtccagtcaggattttatttataaaaaaatctgggacccacctgtcatacttctcttccactcttcctctctcttctctctctctctctctcactcttccttactctctctcgcgagtcggcggctggcggtggacgcggaggtggcggtggcgaggtgaagcggaggcggcggcagcgtgggacgaggaggtggcgggagacgaggaggcggtggcgagtgatgcgggacgcggaggcggaggccgtggccacaatgagtagccgcctcctcgggcggggatggactgaggcagcngcggccgtgtgaaacggtggaagctgtgtcgcgggtatatagaacgggcattgaacttcaggaggaagcttccgcgaactcctttcgcgcaggaggggtgccagaaggcgttctcttgaactgtcgtcgcccattcttgattgcctcc

SEQ ID NO: 77270 - DNA, 10529 bp, Oryza sativa
ctgcctgttagggcaggggcgaaacctgaggtgtggcatctattggtccgaggaagttatataaagggtattgtcataatcactcgacatggtgacgtgtctggccgagcatggtgacacgctggtggattgtgtcttgtgggtacagttgtgcacctctggccagagtaaaactatttgaatagccgtgctggttatgggtgatcgaccagattcaccgtgattagtcccatccttaataattggttaatgaactagtgtaattcaggtggtttggttgggtctgttcaacgtggtgtagcgttgatcagtggagatttaatattaccttaattaaacaactgttttaccgttttcaactataaatgctttacaactgtctttatgcaaatagccacaaacctccctttgtgccccattgcatgagtgcatcattggtgtggcttgctaagtatggtggttgcactcagccatgctattgttccctcttttcagaagtgtagagcttctgagctgaagacgaagttagaggatcaaggctcagaccccagttgagttttgtctgtggagtggagctgaagcctcgctaggatcgcctttttctgctgctgttactttcatttcgatgtgaggactaagtgcctcttatgtaagtattttacgctttatttacgtttggatatgtatatttacttattgttttgtgtaccctggctgattcctggatagaaatttaatatacaaaatagtctgaaaattagcaaatcagaagtttatcataatccatttataggtaatgagcgtgcacttggtatgcctgtctcttgggtagccaaataaaatttctacttcccaagtctctaaatatagtttattttggattgcggactatattaagaaagtatgtgaaatagaattagagatggtacgtgaattacttaaaatgaggaagtacatggagaaatttaactgggatggctgtgatttgttgaaaggagggaatagatagagaagttatgttatgttttgggatcgataaacttttgaagttaaaagttactattattcgagtaacttcagactttcataatgtaatcaacataatgatggcattattatcaaggagtactacactagctctagtggccgagtagactcctttgatcccatgcgcctgactctctctctctcgaactgtcactcatctgactggggtggcgtttgtctccctagcagagtggcgctgctgatcgatttcaagcgaattcgggtggtgggtggttatttgggtgtaaagtttttaaagtatagggacacacatttgcggtattaaatataaattaataacaaattccgcttgtaaactgcgagacgaatttattaagcctaattaatctattattagtaaatgtttactatagcatcacattgtcaaatcatggcaaaatttgggtcaaaaatttgtctcgcaatttacatacaaactatgcgattggttttttctatatttagtgctccatgcatgtgtccaaatatttgatgtgacttttttaccaaattttttgaaatctaaacagttgggcaaacatgcacaatcaattaatgtacctgcagacatggaaaacccttaacttgttcacctgtaaagcgagcgagctaattcatggaatgtgtactgcgtactccagctatatactagtagcatgcatgttgctagactgtgtcagtgtatactagctagagatccagatcatccagcccatgcatgaacaggttaagatcttgagtaatttataagtccagatgtacgtctaatatttaggctttatttagattcaaacttttttcttcaaacttttaatttttccacgtccatcaaatgtttgaacatatgcataaagcattaaatatggacaaaaaaaaattaattgcacagtttgcatataaatcgcgagacaaattttttaagcctaattacaccatgatttgacaatgtggtgctacagtaaatatttgctaatgatggattaattagacttaatagattcgtctcgcagtttacaggtggaatctgtaatttgttttgttattagtctacatttaatatttcaaatgtgtgtccgcatacttaaaaaaattttggcacacgaaataaacacagccttagttaagaaaggcctaattttatcatatatatatatatataatattaaacgatgttcattgtatatgtattactactccatccgtcccaaaatataaacactttcggactttgacacagtctttgagatgctactttgacaaacgatatctctaaaagtaatatgttttaaataaaaaaaattgcatattgtgataatttatttaatgataaatctagtaacatcaattttacataattgcaattttaaataaaaagatttgcatattgtgataatttattttttatattttttctattaatagtcaaagttacaaatatttgagttgacactatgctaaaaatgcttgtattttggacggaaggagtatatcatacatatgaattgatagttgtgaagtttattaattacctcacccctccatttagaaagctagtacgtactccagccacgtatacctcctctcatcaatcctcacaactaattgatagtccttgagactctgttatgtaactagcttggctaaatctcagtcaactcgagcatgctaaatattcttgatacgagggcctagatgatgtattcagcatttctatacaacatggagagacgtcagtgggagagatcgcgaggaagggctaccatcgaagacaatgttgacttcctcaacaagcccttaggagaagtctttcttggcaacattgagaccagagctccatcaaagaagaacattttgaaaggaacaccaaagaagaacattggaatatgtttttgagttgggtgacggtgggaagaaggtattaggtagtggggggtttagagggactagactaatctttacctattataaaaattaaagatggattctctactaaactgatttttcgtacgtcatcacttatccgtgtcggtcttgttctcgcaattagcgccacaaattgatatcgttctgcaccctacgcgctcgcgtgatacgtccgatacccgtgtcctgtactctccctgtcccaacataaatcaacctagctcgtactaggatatgacacattctactacaacgaatcaggacatactctatgttcagatttgttgtactagaatgtgtcacatcctagtacggggttggtttattttgggatggagagagtactcagtacgcaagcggaggactctcacaggctagacccaagggccccccgatttgtaggctccccatgttatctgtgtgttgcgaggttaattttcctagattcaatgaattgtaaatgatgttgcatgcttatatatataagttttgatatgtacttgttgctagtggatgatgtggtatgtttgcaactttgcatgttttgagcttagatctagtgggttaggtatagatctcacaactcatagcaagccggcacttgaccttaatttcacatttgctagctaagtactaattgaagaagtgtcatgcatatgcatgaaattaatcgatcagaattgcattgaagtaggtggtgcaatgggcataatgcagtcagcaggaaaagtatacatacaggctatttaactcatcaaacaggtccataaattaggttttgaatggcctctagctgcatgggatcagaaggaaggaaggaaggaagatatcgatctggggaggagagatagagcaaagaaaaaaaggtatcgagatgacagatggcatgaactcgatctgcaagtttttatggctcgagcggcatatatatgcagcaatatattgaaggcctggcagcatctgctaactgctgatgagacagtgcgtaggagtatactagaacagtacttgtttgagttcaaattaaaacccctttctttgtcgaagaactgctctaactcatgacaacgctcgtagtggaaggagcggcacatgttcagccactccacattttcagtggctatatcatctagcattctgtctgttttggggattttaggcagctacatcgagaacgcgcgatatgtgatgcaaataccagcatatagctagcaaatacaacttacctaattgaaataatatacacatatagtcaattgctgggaggtcattcttcaatttgtgtcagtcaagcgtgcatgtaatgtatgggtgggccttcatcagagggtctagtagtacgtaggaaaagaacaaaaagagagtgagaactgaaggaactgtagagatatataggtggtgtctctctccatcatcaccttatgatgcagtacccaataaccaactgcagcctcaaggcagaagggttgtgttgtgcctagcatatatatgcatatgaatgcattccccattactctctctcgtagcttggtgtagtacgtactacaagctatagctagcaggcaggcaaaactttaaaaacacatgcatcctcctctgctgtctagtgtagttgaagagagaattgaaggggcatcgatgatcgatcgcattcaagatttcacttgaatgccggctaaggacaacagtgtgcatgcaattacgtatatatagtatcgatcctcttgcacccatgcatcctgtccctgtccctgctagctagctacatgcaattgcagcgatcactgccctcttccattccacactacgtactctctgacctctgaacgtctagccattcatttaacattaactagcaccactgcactgcgctgcagctgtggtactactgtttgtcaattcaacgtagacgaagagaaaaaagtacagcttaaagctggaacggaacctgtgaaatttacatgcatgcgcagcggtctaacagcagctcatctaaattggctactccacatctcagtttggatgactatctaataaagattccttttctatatttcttcctacttcaacacatcatccatatcatccttattatacccttcatatcgcctcttatatattttaataatactagaaaaaatacccatgcgttgcaacgggtgaagtctattttaatcttattaatgttatatatgatttagttaagatgaaattcactatgggagttcgcttggatatatactccctccatccacaaaagttgcacctatttcatatttgagttttttcaaataagttgttcctatttgtagtctttatgcattcaagacttaaatgaagagataaattaaatgttttattagaacccaaagagtcatctaaatactcattggttacatgcttgcattcactccttgattttgtaacatccaaggtgatttaatttctccttggtattggtgtcaaaagtaatatgtgtaacttttgtggatggagggagtatatttttacaaaatcatgagctatagttaggagtctgatcgtctcaagttagcatgcgagtttttttaaacagatttcttatatgattccttctgtattaccaaaagtgaacgaccttgaaaatcgacttaaatacggatatgtatttccaaaaggaaacgaacataaaaaccaactcatacacggatgacgtaccaaaataccggcaaaaacatcttcaatttttatatattttaataatatattgtaaccaacttttctatgtacgtgtttttttaaagcctggattagttaaaagaaacaatgtatcactattctctagacatgcttcactgatagttactaatttaatctctcacatatatggatggttgattaataaaacaagtactacgtttactatgaaagcaaataataataataataataataataataataataataataataataataataataataaaaagaagagataacgcctttccccaaccccagtccccagccgcatagatgtgcgatactgccgatgcggctaagcgggcggagcggcgaccgaaagcgtgcgcggagggaatgtgcggtgggagcggcggcggaagcaaagggggaggtgcggcggtggaaggcgggcgcaaaaattggaggtgcggtgggagcgttgatggaaggaaggcgcggagggggaggtgcggtgggagtggtggcggaaggcgcacgcggaggaggatgtgcggcgacactgcttctactccgactacctccaccagatcctgttggtaccaccactctacctccattccccaacctctattcctgaatctgggaaggacgtgattctgattgtggcgcgaatttgatccgaaggaagacagttgtgggatggtataaggagagagagatgccaatttgacgttcctctctccaggatggtggatgcgctaaaattggaggctatgatggcgcatctgctggagcccctttttcttcccccatatgttattttcggaatggcgtacgtgatagaggagctgctgggatgctctacggaaagaaaaagaaatgaaatagtgaagcggacatatataccagattccagctgctagctcgatccgctaattactagtgagttaagagtctaaattgcagaaattgaatcttagccttaccaccactgctgattgcggaattaattttgtactaagcattaattttatgaagccattgaacttgcctttgatctctccttccatcctttattttattttcttccttcttgatgcatatattgcaatatccgcctgctcgagattgcaggagatctgtggctactgatcaccagcttgatcaactagtggtcaccgatgggttgatgtattcgggaaatttaactatttgccactatattaggtttggcatgcaattatacaaatgcccctcttaaatttacttttatttttctctctaaagaactggtttagtaactagtatttactacttttcttcacgtggcatgccaacgtgataacccacggtgaaaaatgtgagatccactcatcagtacctttgatttcctcactatacgatcttttttcacgagtaaagatcccacactgtttttcaccctaggttgccatgttggcatgccatgtgggcaaaagtggtaaatagttaagaaaccacccctttattaaagggggaaaaataaaagcaaatctaacagggtaatttggataattgtcaaacctaatagttacaaatagttaacttaatttctcgatgcatcatgtagacaacatccttcagtgcattggcggcgacactggtcagggatcgcctcacgaaccccttcctgcgctttgagatagatcgagctctctatggtttagggtttagcgatagagacttatgtttcataggccttctcttggtgtcttaaccccatataaatgcattggtgagactcaggggccaattttgattaggaatctaattagttgttacggatcacaacttttttaatctcttattttcttgttgggaagaaaaccggtgaaaaattgtatctcccccattttgtatggatactaaccaataagatcaaccaacaattaggaatcaaacaaacaataacccagctggtgttgtactacgaggtatgcatagctcatgtattaaaaaatagtaatccttggagacaaattcgtttgattcaatcaggttccggtaatttcttaaacttgaaatatacctcggagaaaaaaaataaaaatagtaactagttgaaactatatattatggttatttattctctttagttttgttgatagcgggtcttgtttcgtcccttttatgatttactatcatgtttttatttggcgttatttgaaattttgaatatagttaggttgtgtacgtgcacctaattaatatcaaaaatccttatacacgggcgtctgatgagagagaaaaatatcatgtgcccgcgcgtctcatttcgcgtcgctaggactccccacgcctccctcgctcgcgtcgcctcctttcccccgtcggcgccgcctcctctacacgagctccctcgcctgtgctgcctcctctcccccgccaacctcgcctgcgctgcttcctctctcccgtcaacctcgcccgcgtcgtctcttcgtcggatccgccgctgcatttcttcttcctcgacgtcgacggcggtttcgtccccgtggtggtggccgacgcggaggatgatgcatgcgcggcgaggtggcaacgacggcggcggtggtggtggaggaggagactcgccggctccctctctctcccaggagcactccctcctcatctccaccgccctcccccttctcctcctctagattcggttatgagggcggtggagaagatcaatgcgggcaaccctgtgtttgtcagagaggaggagatgcaatctagaccaggttctatgttttttgtgtgtttcagctagtgtactcgtaatgttcattgtgtttggatcaaatgttgcaatggatattttgatagggtttcatatttctattttcgacattcaggtttcgttgatatttcgatggttcaaaagcaatgttcagctaatatactcatgatgtttctttatgtgtagatcaaatgttgtagtggattttagatagtgtttaatatttttatcttgatgtacactgggtttgttttgttgtacatagggtttaagtatttcaatggcttagatcgttttgttgcatatgttaaaccaaattgtttcatctagtgatctcaccgtgtttcaatttttttaagaactgaaacattctttcgctaagtgctgaaacattgtttttataaataatggtgaaacaacacactgatttttttggaaaaatctggcgcccaatttgtagacgcctccaattaataagtgcctgaataagattttccactatccaagaaatcataaactaagtaaatttatatatgctggctagctagctagcaactccggcctatatatacataagcagcttatcagatagctctaccagctgcaacgactcgatctcatcatatcgtgtcactcgcgctagtcacgctagatcgagtgctagtgatccatcgatattcgatacatatatatagagagagagagagaaatcgtgtgtaggtacgtagctgaggaggatgcctcagaccccttcgacgcggtggtgcccgacgccggagcagctgatgatcctggaggagatgtacaggagcggcgtgcgaacgcccaacgcggcagagatccagcaaatcacggcgcacctcgcctactacggccgcatcgagggcaagaacgtcttctactggttccagaaccacaaggcccgcgagcgccagcgcctccgccgccgcctctgcgcgcggcaccagcagcaaccctcaccgccctcctccacggtgcctccggctcccactgctgctgctgccggtgccgtcgtgcaggtgcaccccgcggtgatgcagctacaccaccaccaccaccaccatcacccatacgctgcggccgccgctgcccaaagtcatcacctgcagcagcagcagcagcagcaagctgagtggccggcggcggtggactactgcagcactgcatcggcgtcagcgtcggcaactgctgctgacatggcgatcccgccgtgctgccggccgctgaaaacgttggagctgttcccgaccaagagcaccagcggcggcctcaaggaagattgctgcagcagctccaagtcctcctcttgctccacctccaccaattaattactagcagagagtaatcctacttccactctaagctagctagctgctaatcacttagatctatcgatttaatttgtttctgcggccatatgcgttaattcgtacgtacgtacgtgtgtgccactgccaatatgcatgccacatgtgtgtcggcatatcgttcgtttcgttatcgcttcctcgatcgattacatatttgatattgttcttaaattagttttagctatctaggttagtcaatttccctcgactctttatgtaatctgatgagctagcttagcttctttgtgtaccaatggactttgctgatcaattatctatatatcgcttgctgttgattgacttttcgttttcgacacctaagggcctgtttacttcgcgaaccaaaatttttgacgtgtcacatcaaatatacgaacgcatttgaaatattaaacatagattaataacaaaacaaattacaaattctgcctagaaactgcaagacgaatttattaatcctaattaatctgccattagcaaatgtttactgtagcaccatattatcaaatcatggcgcaattaggcttaaaagatttgtctcgcaatttacacgtaatctttgtaattagtttttttctatatttaatactccatgcatgtgtccaaacactactaagtgatctttgccgagtggggaaaaaccacaattgtcccggtttggataggaactagtactaaagatcatttttcgtcccggtttaaaactttgatga

SEQ ID NO: 77271 - DNA, 1861 bp, Oryza sativa
cagcaacaccaaattgaccaacaacaggaaatattaaatattaaaaactatatcattacgcctatatgtagtactaaattgacaaaatttagttcacaccaaaattggaagtttggtttaaaattgaaacaatgtgacgaaaaagttagaagtttgtgtgtgtaggaaaattttgatgtgatggaaaaattggaagtggaagaattattttggacctaaacacggcctaatattgaaaaaaaaaattggaagttgccgggaagctgcagcgtcaacggctgggcgactgaccgtctgcactggagctgtgcatgtcactgtaatgtcagtttcatcccatatatatcagcatctcaaccgtgtgccgttcatggcatgttcttacatgtgtagtatcagactttcaaggccattgctagcttgaatcgtacgtccacgcgtttcccagttaattatgatgtgtaatggagtacaattatgctgctaatcagctatcaccgattgacagcagcatctggagtagtagtcctggccataattcgattggtgtatgcaagactattactagcgattttgatggtctccttctgagaaggacaagagcgagaagatggctcttgaatcttgactagtagtaggagctaaaatcgtctcagttattcaccatcatcttgaaatttttgcgccaaattaattaagatactccatttttaccatctctgaaagtctgaatttatcggataagctctcaagacgtagcttcttccatcgtatcttctcgtcgtcgtcggagtcgtcttcttctctaagcatgcgaggctacgcgtgcagctagctggcctcctaaattccaatcctacaaacgattggtaactccatgtgctattccctatcaattagggctcatttgaatcgtaaaaataaaaaaacaaaaaaatataaaaaaatacataggattctgaatcgacatatacgtagaaaatttactataggatttcaattatacaaaattcttttataaatttcttgatttaaaggaccctcaatacatgataaaggcgttctgctactatttttaaccggcgataagctaaaactaataataagtcataaaacaacttgataataattatatagtatcattagcaattataaaaccaacctaaaaaggccgagtttagttacaaactttttcttcaaacttctaactttttcatcacattaaaactttcctacacacacaaacttccaacttttccgtcacatcgttctaatttcaaccaaacttccaattttagcgtgagctaaacacacctaaaaagtacgataaaacccctaaaatcatctctaaaattaaatattaaatttcagctactgtttataagctgaaaggtaaattaatgatggggacgttacactcaatgtacggttcacctgaaagtctgaaaattcaccagttaagtacgtacgtcctctgcttgctggtagtagcaaatagggatggcagtattgtccatgggttcgggtatccgtggatacccggcccgatgggcatgggcgtgggcacctttttttacccgtggacacgtttgacccgatgcccgtgaagttagtgggtatatgtaggttttagattttacccgtggataacccatatccgacccaaaaatttttagcccatgtatatcttttataccttcagtagtttaacctcccctcgaggcccaatagccatttagcccatttgtatatacagtgttcactcaatgaaaccctagccttatccttttccccaccaccacctctcaatcctctattccctacgcggcggcagcgcacgggaaagcaggtggctggcggc

SEQ ID NO: 77272 - DNA, 3864 bp, Oryza sativa
cgccaggtttttttatcggacttttctttttttttcgctcggtttttttctcccgttttttgacggacgacagaagcacctagagaagtgttttttttcttttctccaatccaatacagatcggatctcttccagggaaatcagattttttttctccagggaatcggactctttttttttcgctttttttattcattaaacggtttgtctctcggactttttttccctttttaagggatcgggtgtttttttgccagggacgggtgttttttttgcccggtttttttttcactttttttttggatcggacttttttttcgtccggtttttttatcggacaaacttggttttttctgcccggttttttttcacccggtttttttgacggacgatggaagcacctcttattttttaagtagtccggttttttttttcactttttttttggatcggactttttttttcgtccggtttttttatcggacaaacttggttttttctgcccggttttttttcacccggtttttttgacggacgatggaagcacctcttgttttttaagtagtagtagatacgaagtttctataccaaatgtttctacttaaaaaagtttatatgacatatatttatatgtaatatactccatccttttcaggttataagacgttttgattttagttaaagtcaaactgttttaagtttgatcaagtttgtagaaaaaataataacattttcaacccaagacaaacttattgtgaaaatatattcaattattgatttgataaaaataatttagtattataaatattactatatttatctataaacttagtcaaaattaaaatattttgatttttacctgaaacggatgaagtagtttctataccaaatattttgggtgtaaaatttgatattacggagtgtttatacggagaaagtaatgctggattaattcttcttccatgcatgtcattccctcatatagttagcgtgtgccattacgaaatttctaattcttcgcgaacgcgcaaaaagattgtacgaaatttccaattcgattgcaccgcctatcgaaatcaaatcggtaagcgccgcgatgacgatctgatggcgcgaacaccagtgcctgaaattctcttcttgtgcttggtggaattaatagatgggctaaggcccattcgaaaattaattatttggaaaatcacaaaagcctacctcatgggatgacatacatgtggagtttagtttagtaccaccttacttattctagaagagggggacctccttaaaaggaaggatgccctcctagccacttgaagcatgtatggtggagagaagagggggaacacgcgcgctcgctcgcctagcagggcaggcggcgcgcgcatgacgtacgcgtcgaatggtccgcaaaattggctcctcacccttgagcagatgcagcctccttttgcaattttgtttaaaatccggtgcgtgaaaacggcgtggagtccggataagttacgcacgaaaattcggatttgttttgttgttggaaacattccgaaaaatccggtgcatgaaaacggcgtggagtccggataagttatgcgtgacttatctggctcggttacgcagagtggagatcgtgcgggcgccctgatcaagcgacctatctctatataaaccgtgccgccgccttcacgcaacacacgcgaaattaatctagggtttgcctcctcctctgtgttgtgtcgtcgctcgtagactactccatcccgctcgccagcgtgcaccggcgatcgggagagcaggtctccggaacctctgtcttcgacgtcctgcatcgggagaagacggcaataaggtttttgggaagcgtttcgcgcgactgctacctgttcatccgtgacggctcgccttcctctccgctcacgtgctgcgccctttgtcgacgctcgcaaccgcgagtagttcctgccgagcaaccggtctttccgccaactcggtacgtgttcgacatattgcgcatatttgatctgttcatgttttactgcttagtttacatgtgtaaatctaatgatgcgttaatactagtatacatctgtaatgtcatgatttatttatggaatatattaaatcattatatgcctatattttcaacagttcttcggttaatttccgcacaagtgcacaacctgccagctgaatttggcagacaattaacgaacacgacatacggattatgcactttgctatcatcttctggaaaacacttctgcatcttactgtcaaaaatctgatccctgatacacgaacctggctgcctctgaattcttcggtccaaaaggcagagtagacttaacgaaagtaacaagatgcttttacataagcacattaatttcttcctcgtagaactttatggctatacgcatgaagaattgaagataggagctcgatcacaatttcttatatccatcccgataatttggagaaacatctcccattcactgggcgagagctgagctagtgaaaagatcgcgttcttgtgcgtgtcctcgtcattgggctctagcctagccttgagcgtagcgagtgatcgatcatctcgcgtgcttatgtaaaagttacatccatggaagttgccgaatcattatatgtaaatgttattttctttttcaatatactagaatataagccatggttaaagtttatttaacggtaaaacatatcaaaacaaataaataacatttatataaatattttaataggatgaacgatcacatgtcatataaaaagttagcatcatatattaaaaacagaggaacaatttttttttaataaaagttgcataaatatacatgtcttcccattggacagacaccagccaccacgatggtgtcgcgatagggacgggcaacatgcgttttttttttaatttcgatagaacatgagttagggcctgtttagttggtgaaataaaaattttttggtgccatatcggacgtttaatcggatgtcggaaggggttttcggatacgaatgaaaattttcataactcacctggaaatcacgaggtgaatcttttgagcctaattaatccgtcattagcacatatgggttactgtaacacttatggctaattatagactaattaggctcaaaagattcgtttcgcgatttacatgcaaactatgcaattagtttttctttttatctatacttaatgctccatatatgtgtccaaagattcagtgtgatgtttttggaaaaagtgtttggggaactaaacagcctcttaggccgtgtttagttacatttcaattttttttaaagtatacggacacacatttgaaatattaaacgtaaactaataacaaacaaattacatattacggctgtaaactacgagacgaatctattaagcctaattaattcgtcattagcaaatgtttactgtagcaccacattatcaaatcatggcgtaattaggctcaaaacattcgtctcgcgatttacatgcaaactgtgcaattggttttttttttcttccacatctaatgctccatgcatgtgtccaaatatttgatgtgacggaaaagttgaaagttcgaagaaaaaagttggaatccaaacacagccgcagcctatttgtagtactttttatagataatagaaataggttacatctccggtctctttccgtaggcacacagcaaaaaaagttcagaaatgaacagaaaaaagctttaaaaagacgagatggaacaaactcccaacttctgccgataatatgatttactaaaataatattttttaaaatcacgtagattctatcacgaaattctgtaggtactacgccatccaagggctgcaggaatt

SEQ ID NO: 77273 - DNA, 3515 bp, Oryza sativa
ccgggactaaaaatcatctttagtcccggtttattcaatgtgacaggaaactaaacaggctgacagagtgaaaaatttttgtttgaaaactaaacaggatttttgccaagtaccatctcgtcattctatagctagtcaattagccgattcatatgacatttcaattgactagctatataaggacgagataagtttctatttgacaaatttattacgtataatcctgactgtttttaaacaaccattagaaataacctatactaatctctaacggttctgaatcgaagactttagagagatcacatggcatctctaatggttattgaccttcatggagaggccaacagtatgatatcacataatcacaaaccttaagcaatacaaatgtatggcaatttgacatcatgcatggatgataaccactcgcagatctaaatcaaaatcatcgcgcgattgaactagaacaattaatatcacactttcaaacataggaagatgaactgtagggcgtatatataattatatatagtaatgtcatatattcatgtatcaaaatataagcttgcacaataacttgacaccaattatatatggatcttaacaaaaaccatgttgcagctatgatcaagcagaacaaccaaactgatgataaataaatgaatagaagttacactactacgaacatagtttttgatggtgacaaaatctggttgtgcaggcggccgagccaccagcctctaacaaattaactaccagttccacaaccgtctatgaaaaatagattttcagaagcgagtactctaaggagaccgcttgtgaattgattttcaaatgcgatagtctaaagagatatgtccatgcaaatgtcttttggtgcaaaagaaaatggaaacttaaatctaatcatagcccgcagaatcccaaattcacaaattcgccaaatccatcacggtgcccctctgcatgcaatagcagctgcagccatgcgacgatgtcctcaccatagtcattgtcgctgtcgttgagtcaaatgcctcgtcgtggttgtcatcaccgagccaccatcgtcgccgagggggttgacgaagaagggtaaggaggcaaagcgagcagatttgccactcccaagaccatgggcgcgctcagtggtcgagtcgctaggagggagggagaggagcagtttggcggtggttgacagtggtggcgacatggatggaatagagcgaaggaggagagaattgggagagaggtaggagactgcgcgactcatggatgggccagcgcattttattaccgctcctcaatttgcataggccttctcgctaggaggctctcacctgtgaaaataaagatattttcaaaaaaataaagatattttcgggcggtcctcttaaatgctcaatagtaaaaatcatttttaaaggtgagtttagaccacaagaccttctcagtattattaccagcgtaattttaatggtagagataaaacccatttgtctgggaaaatcatctttcatattattaactattaaattttgacaagctataggtatatgtcactaaataaatgaaaatcatgttaggactctgtgctgaacacacaaactgataataaataaatagtactccattcgtttataaatttcatacataagtcattttgactttccccaaagtcaatttctttagctttgatcaagtttatagaaaaatatagtaacattttgaatataaaacaaaagaaattatcaaaatatattaaatgttagatttaataaaattaatttgatgctatatgcgttgctatattttttctataaaatttgtagattgatttaaaatagacagaacaatttataatatatatggaacagagggaatggaagtaacatggaggaggcgagatcgctgtgacggttcaaggtagcaattgggcatgtggttggagatggcccacaggcatatggcatggccaattttcacatacatatatatatatatatatatgcatccaaaattcccccatctaggccggtagctagagttgctaccaaccttcctctaggaaaaagtgaactttaaccccctcaactatggtccaaatatgattcatgccctctaaacgtgaaaccgggtatatcgactcctccaactatcaaaaccggtgcaaactatgtccctcggtggttttggctgacgtggaacctacatgacggtgttgatcgggttttcatcctatgttgcgttgacatcgcaaccacgagccctcttcacctcgcatggctcagcggggtggtgtggagctagctcgacggttcggagaagctcatggtggtcctcctgtgcacttcatctaggagacgggtagaggcggcggccagagaaaggtgaggagagagggttggcctagaggcaatgggcgggcgtcgtagagaggaggggcagagggagaggtggtgggggagaggagaacggctacctccatggctgagagctccgcctagccatccgaggcagtcgcggtggtggaagagagaggggagaggcggttccgccgagctcgtgggtgcgatggcgcgaggcaaagatagaaaggagggaggatgacatgtgggcccatatatatattttgtatgaatgactgttaacaacggaattttgcatcaaactcagagaggaaggaacaaaatcgaagcagatttggtgcaagatcgaattagatttagaatcggactacgcatcggctggtattgtatcggctggaaatagagtacagacttggcttagccgatatggcgaatgactgatacgatatgacttgggctcggttttggcctagtttggaataaccgccatcgccaattatagatagagctcaattaaggcaattgtatatattaattagggtatttatgtcagtttttgttagagatatggtaagagaccgtcatgcggtcttgtttgtattttatctttaggaaagtttgagtcatgtctataatggactaagcccttgtttagttcccaactttttcttcaaacttccaactttttcatcacatcaaaactttcctacacacataaacttccgacttttttcttcaaactttcaattttagtcaaactttcaatttgagagtggaactaaacacaccctaagcttgtattcggggtataaatatagaccccagatcattgtaatagaagacaacaaatccaatacaactttggtgcatcgccacccatttgttcttcttttcggcgacttctctcaacaagaggtaagtctcgatggcttgtgctatcggagctattatgtcgctttagatgttttatcatgacccatctgctatcatatgtcttagttaatctagtcttagtatctcgctttagccctatcagctagttctcactttagggttctcgccgatatcggctaaattgtcttactatattagattagctaaggcatccaccatcctgaaaagcgtttaattacttgattgtttagactt

SEQ ID NO: 77274 - DNA, 6464 bp, Oryza sativa
caacaaaataacttgacaagtactttcaggcttcagcggtatgctaagcgttaagttttgcgcttatcacacttctatgttagctgcatctgtgattaccatgtgccagaagcaaaattctttccatacaagtactattaactttctaagaaaaataatttgatattatcgaataccatgtcatttagacaaacttgtagcatatagagatggcagccccattgtttggctgtttggtggaataagccaaacggtatattcgcaaacgaaaagtaatttgtgaaaggctaaaaaataaatttcgataaaaaaaaccctaaaatcagctctaaatttaagagtgaaaatttaaattttggttgataagcataagcattagtaaaaagatgaggccgtctatattgtcactgttcaccggatcttatcattcctttctttcttgtatacgcacgaaagctgcgtatcattccattaagagagaagaaaaggaaaaaaaaatcacggcaaggggagctgaaacgccaccactcatatcaaacacaataacacatacaagctttcaccgagtctagggactaacctatctaacgattcaattggtttccaccattgtcagttaaattacggaaatttagttagcagaatattagtgcctaatggctgacagtactgaccagtgaccaaagatcacctggtaatggtcgatcaccatcaaatttcacctcaagtaggagcacttgtgattttgtgaatacaaataagctgattatttcttagctacaaaagaatgacatgagttttctttctcacatgagattggcttacgaattccacaaaagaaaaaaaaaactttacatactcctgtacgcgacccgaaaacgcataaccgatttggattctaacacttcaacaaatttggcgtgaagctacaaatatcgccaatccggcagtcagggcaatgaaccagtgttaccaagcccagctatcatgcctgtaaatgtggccactgcaaatccaagcaccccaccagcaaaaacctgagaaatgcatcttgaaatcattaatgtgtttcacatatgtgctagaaatcagaatatcatcttatgcaataacatgcacaattgactttctaaattgctaacatatacattcaagcaacagatcaaacctgagctggtgtgtgtccaaggagttctcggagtggtcttgtttcagccagtggatgctccgatgggagttcatacacaatttgattcaagacctaacatgttaaagtagttagaactggaatgcaatttaagcatccatagaattaaagaaattatggagatatccaacagaaaaatcgacaacatccttctcaacatatgataaatactaggaataacatgggctattaattcagactatcacaaacataagcatgtgcatatttcaaatagaaccacacccttccttctctctccagcaaatgactcgtgtccttttgcttttaattaaatggtaatagaaacgtgaaatattcaggtcatacctctgcttgcttccctgcatgtagcctgacaccaaaagcatcatacataacctgcaagtaattgccgaaaagttagcagcttccaccaagtgaaaagaacaatataatccatgatgaaaatgcagcatactgcatttctgaagcagatgactgtaaaaatccataagaatcacaatcaattatgtgaggatgctacattgccaggtgcgggacaggtagggtgagagctaaatcacaggacacttgcaatctttaaggaagaggctagctgtcagctgtttgtattattgcgatgtcctcgactgatttttgtagtgccaatataagtagaacaatcatagtgctaacatgctattgtccttccttccactagtttaatcaactaaacaaagaaggcctgatcaattataatctcaggatacatcttctcttccatattgcaataaagcgagaaaaaaaaatgcaaccttgctgccatgattatcagagaaaattgattgaaccagttgaatcggatcaagatttaaaatggattgaaccagttaagagaactgtagaaagaacatagtaaatttactcgttcccgaccaatcaactactagtaatattccaaaaaccagtgatcagatccacaccccattaacaaaagcctgaacattcggatgaagaactaaccacggacgcgaagatggcggcggtggcgaagagcgagctgccgaacccttcctggaggccgacggcgacggcgagcgcgacgacggtggccgagtgcgacgacggcatcccgccggaccccaccagctgcttcgcgtcccaccgattctccttgtacctacaccaccccccacccacgccaaggtcaggtcaggtcagatcccgccacggggggagctcggatccaggtcagtgtgacgtaccatgtggtcaacaccttgatgaactgcgcgatggcgccggcgaggacggcggcgacgagcgggcagttgccgagcgcggcgaggtaggagaacgacggcgcgtcaccctcacccgctcccaccggcggcgccagcacggaggcggaggcggaggcgttgtcccccattggatggagcgggcgggttctagaagcttctggaagatctggcgcccggcgcggtgcggggaggggaggcgagcggcggccactcgtcggcgtcgtctgccgcgtgtgcaggtggaggtgagggttcgtgggtgtggccgcgcggaaggtggaggcgagggccgaggggaagaggaattggtcgggtccgagctggcatgtgggcccggctagttgctgacactttgtggctggcattttcttctactctcaagtctgaacagctgcgtttgagagctgaacatggtggttttagttcgcgaaaaaaaaatttaggtgttaaatcagatgttgatcggatatcggaagaggtttttggatacgaatgaaaaaactaatttcataactcgtctggaaaccgcgagacgaatcttttgagcctaattaagccgtcattagtatatatgagttactgtagcacttatggctaatcatggactaatgaggataaaaagattcgcctcgtgatttccatgcaaactgtccaattagtttttgtttttatttgatgtgatgttttttttgggaaaaatgggaactaaactaggcctctgtatttggctgcctttaagagttgaaagaagagtatattttcacgcacatatttcccgaaatgttaaacggcgcatttttttatgaaacattttatagaaaaattgctttaaaagaaaaattaatacactttttaagtttatttttttttgagaaacacgatacaaacgcatgcgtccacaatacacacccactcacctgtacggacatcttcgaaggactaggcccacggatgtctcactgttgacgggtacgtcatctaccactgaaaaaataattagctataaatgcgagcacccgagtcaaatctacggttggatttgaacctggatggactggtttcaccacaagaaacctaaccagttgagttagttcacttcgcaagtttaaaataattaattatgcactaatagcttaccttgttttttatatcttctttattcctctcttttcaaacacagaaagctaaccagatgagttagctcacttcgcaagtttaaaataattagtacttaattaattacacagtaatctagcttaccttgttttgtgtatcttctctattcctctcttttcaaacacagccaatctttgcagttacaaggatacctgatagatatatggtggcatttgaatttgatgaagaggaaatactaagttggtgtatgtaaaacgagaaagtcattagcacataataattaagtttaattattataaacttggcaaatggatatatatttgatattttaaagcaacttgtatataaaagttttcgtatggaacataccttttaagtagtttgaaaagcgggctaagtaaatagaggtaattaaatctgaatctcaatcataaaaaaacagggtagtaggttgaaaagcgtgctaacacggaactagtctctttttcttttttgaaatgttaaaaatttctcaatgagttgaaactgattactgaaaaaataatatggaagaaactcatgtatttctctacctctttttttacacggtatttctccatctctaacgctttaacaacgcagttccgtccatatgtcctcccgctcctactgaagcattccagttctttgaaagaaccataggcatgaggaaacaaaaaaaaataaaccggcttcagaaaaaaaaattcgttttgctaacccatgagatcattatgattctccatatgagaaaacaagaaaaacacatatgagaaaactagttccggatcaattttggttacaatgcgcgagcaattatcatatcattagaagaacatctatatatacatgttgttctagaattttctgtgacatttgatacctattgtgcatcggaattttatgtgtataggacatatttcatactatgaaatgttaaacccgtatacttgcatgagcatttggtaatggagaaactataatcacatgagatatgtgcattagtagacccaacactaaaatttagtccgaaaaagtgcaatgtactttttattaatgaaataaaatttattatacatgaactgtattacaattatacttatcagaatgaatggtcctaactgcaatgcaatatcaacaattataatcctaattttccatgtaattatataattttacaattgaaataatcttcacagaatgtgttccctatttcacagatgtcgtgcttgatcatacccctttccctttgttgctgtcattgtaattgcattttgcttaggcggccaggacaatcaacagttaggcgttgcatttttcttaggccgtcgagacaatcaacaattaggcattgcattttgctcaggcagtcaggacaatcaacaattggtctgaagaaataaagtactagttaaactagtggtcattagttaacatcacaaacttatatttagtatttgctcttttagtgaccaatattttgttgttaggcacttaggatctttgattcatttatgtagaatctttgttcatttatgtagacaagtttcaacgaagcctttactctctcccttatagtatcaaacaattaaacttctaccaaaccaaatggccaattaatcacttgggctcactcctcgccctacgagtctcgattgattgcgtccatgacccaatcaagtcggacaaataactaataacaggggtagcgagatgtgccttgcgtccttaagccaattgttgccatcatcaagttgtgggggcaaaaccatggcttcttcattttctcgggagattaggggtaaagaagaagagggaattatagcttctaagttgcttttccggtcatgtcatacgccaatgtcatggcataccataggagtaagtataccttcggatatgtgcaaacctactttcaatgaatacattttaatgatgcactaaaatcaataaaactctcaataaataaattattcatatatacctccggatatatgaagcttttaaaggttctttttccactaactaacatcggaccactaattgttatccacttaaaacatgcattcagggcaggtttgttttgaggcttaaatttggcttattaatatttgtgaatttcaatagtgtttagtgtctatttggtttgaagccaaattttgatatgcctaagaaaataggccatttcaatagttaacttatgctattttggcttcaatccaaatacaactttgccttcccaaaattaatcatgccaaaacttaccaaaatttggtattgtcaaaaaattagtaaggccaatttaggggcctgttcactttgatgctattttcaaccttaccaaattttaataaagttgcaaaaaaagtgactacatttaatttactgccaaattttggtaactatataagaaattctgccaaaatagcatcaaagtgaatataccctaggtcacaaaccaaaccagccctcaaccttttatcatcaaaaccttgcggattagcattagcttatccctggaggcctttttttaatcagaaaaaaatctcatcgcagaagtttttttttttgggcaataggtgcttctaacaaatggtaaaagccctagctagccccgaggacacgcaaccgcccttaccaccgtccacccgaaaaatccaacggccaggatgtcccccttcgcaacaagccgcgcagcccccgtcctagtcactgccacgtgggtcccacagctcagcgaccgagcagacacctaaaaccgccgcttacaaatgggcccccacccttggcgattcgagcccccaaagctcgcgaggtcg

SEQ ID NO: 77275 - DNA, 7236 bp, Oryza sativa
atttatttgtttatataagcttgtactagagtattagctagtagattatctttatttacctatcttgctctaaatattgttccattggctatttctatagtatcctctaaaatacgtttgataaaccaaacaaatgatattactgccgatgaggcatatttagggtttgtgcttaatttatatttcaatccattgccgatctggttcaactacatcggctgggatcactaacgatatatcatcggcctatcggccgattggctatcggctgactcactctatttattgttttccttgctggtttcaagatcaaaccagccggcacgcccttaacacactcgaggctagccttggacctgcactgggattaagtagatctcccaggccaccgtgttttccgtcaacaatgacatatgggtcccacatattttttaaattctaatgccacagaagagccacatcaatgccaggtaggatgaagacaaggtcaacacctccacgtcagtcaaaaccgctcgcaaaaccaccatgggacatagtttgcacctgtacttatagttggagtagtcgatatacccagtttcgcgtttggagggcatgagtcatactcggaacattgttgagggagttaaagtccctttctctatatatatgcatagtcaacaacaacgaggctcgagagagactactttattcacgctggttggacaggtacttatggttcaaaattcctatgcggcacaaactcgcgacgtaatgaagtcgcgtgtgtgctctgccccctctttttttcccacatgttttttctcagggttcgatgagcctccaagcacaagggcacaagactttttttttcaatttcaatttcaccgtgacactgatagatatcgaaaatttcacattttgttcctttctgaaaacttatttcaaaataagtctagccgaaaactatcataaaaaatggaccccaacctcagcgctagggccgatggcactgagctctagcacgctgcttagcgctgaggtagtgacgaccgtcacaggctgtcgagcaggagattgggcatacaagctgacgtggcaaaggtcaccacccgcatctgtgctgacctccccaacctcaatgccaagcctgtgggcgctgaggtagtgaaaaacccctctacccatgcccatacacttctccctcatttcgcacaatcaaactagggtttctaagggctcttggcagtttcgaaggtgagttcactccattccattccatcttctcatttgttgtgttcgatttgttcctcctccattaaccttgttggatgtgttgctatggccctttgtattctgttgccttaggggagttctccaaattcaaaccttgatcaattttggatgagacgatgatgttgttctatcagcgttaccttcttgggggcattgccttcgagttttttccttcctgttttgctagctcaggacacttgggtgtgggagagcaacgatgacacccttgtgatagagtcagcgttttcgtgctttggtgtagcaggttcatcttctcagggattgtatggttggtttgtttgttttgatagtgtcagagtttttaatagtttttcttgtaaatttaactaattatcttaattgcaggagctacgttccttcggaaaaaaatatgggtacgatttaatgtatgtttgcttctatctcgaagaatagataaggatgcatatgtaggattgtaggtatatgaattgaatataatgtagatgcatgcatggagcgatggatggcaagtgaacaagccaaattggccgacaacctggcatggaaagcgatgaagttgctctcttctcgccaatcgatcgatgagatttagcgctacagtattatattcttaccatgttgtctcacaattggttaggcggctccattatatttgtctagttgttgcatgtatgagtatatcaccggattagtaatgcacaaaagtttttgaaaagagagattgagggtttttgttttatagattcaacagagtacttcaatgcataatataataattatcttactaataatatagtaaaatttaaaaacatgctttttagaatatgtcaaacagatacaaagtagccaactagccatctgtcttacttttaaatttgtcattttaattaaaacagacgtaaaacattttttctctttacttaatttagtatttggcaccacgatgcagtatttatgcctgaattatatatttggatcacgataaaactaaaatgtcacggccaaacccatctccctgatggcagtgccatcgcagcgagcggacgccctttggcgctggtcgtgccaagatcacctccaccgcttcggtcgaatcggattccgctatccaaactcggccgttctctgccatagtcaatcttgttccctgccgctgtggtcggctgactgctcttcggtcgcgagggaccggatcttgtttgacgtgccgatggtcgttcccaatctcgagggccggctgatggcacacactcactaccatcttcgaacgcggagaacgccatgctacgcaccttcctcgccagctgctctaggcctctgctccttaggctgctcccactacccctgcctccggcgcctaccgttgtggttgtaggggtagtgccgaaactcagcaagaggattatggccaagctcgcgaccgctagcccgagtcacacggtctcgcacacgcaacacaatctgatgcacaagctcaggctggtgccaaagaagggtctattaacgctagaatttggtaaaattctttagtggattcggttaaggaaaaagtaaaatcagtcgatggaaagcttatccagaatagacaagttcaaaaaagaatcatgaagaccatgacatggtagcttcatttctaccatataatttaccaactgcagtcctacaaacctcattcatcaaatccgatgatccaaattcatcgcatccaacacctcaaatcatcccacgtttcccctcagctgctcaccccctctcactccgcccacccgaaaatcactcacaaaatccccatcctcaccccaatcatccccgatgccgccaacacatcgcgccactgtcgccctgccatctcctatcccggttctctctcccgaacaccccaaaccctagaactgtcattatcaccgatccatcaaagcgccatcctccgccatcaccgctgcgccatctcctgaatccccatctgccgtaccatctcctgaatccccatctgccccctcaatccgtcatcgtcgccatcgaatccccatctctctccgatcctccctcatcgccgacactgatgatggggacactaatgtgttgttatgtggtagtgcatcatatcgagaatttgtgtaaataggatagaacattggaaatctagtggattctttattttttttaatttaatatcaaagcgagagtccaaactatatacaacttggtacttattatttctgaaatttataattattaaattaagaaaaaggctaaattgggagtccaacaagagaacaaataggcagtgattaattccagttttgagaaatttaaatcatggaaaatatataaattatactctaaaccaagtatattgcgaatttcagaattattaaccatgaaaagactaaaatttcgactccaaattgaggacgactcaatacttgtttcttccgaattatgaaattattaaatcatagaccagctataattagcattccaaaccaggaaaaagtcaatttcttcaattaatggcaaattttataactataaattcaggaaaaatttataactgagacttcaagccgaatgcaactcaatactaattttggaatcattgaatcataaaagctaagtataattgaggctccaaaccgaatacacaacttttcaattgtgaatttcagatttatttgatcatggaaaaagtagggttaattaacactagctataaattcaatgcatacaactcaatatttatcaattatgaatttaaaagttgttagatcatgcaaaagctaaattgaggctgcaaattaattaaactaagtacaagtttgtatacttataattccaatttttttgaggagaacgacggcaggagatctgccggaatttaaattagggaagggcgaaacctagcaaagagtttacaggaactataacaaagaggaaatacaacttaagaagaaaggaggatcaggggggcttgaaagcaagcctgcgcaagtccatatcttgtttaataaggtgtgctacttcacctactgtgaggcaagaattttgaaaaattcttctgtttctttctagccatatattccaccaagtagttagtaatgagcctctgatcgcttgcacttgatctttgcttcccacagggttggctctagttcaccaagtttcaacatgagggggggtggggcgtagccaaagggcccagattttgaaattggcagattaaactccaagtttgtctagtaaaaatacactcattgagcaggtggtttgtgtcttcaaaagaacaagtgcaaaggcggcaaatccaagtgcacggccaatgtcttcgaagtatattttgtgcagtgagggttttttgatgaaggacaagccatccaaagaatctcattttgggctccgctggagccttccaaagtgaaagaaagtcaagttttgcaaaagaaccttcaaattggtagagatacgcactcttggctgtgtaggaaccgtaatcagtccagttccaggtaatgtcatccggttcttgggatagcgaggccaattgaattaagcctcctagctgtacgagctcatgaatttcctccacggaagtaaattgtctaaaagaggctagccatttgttgtctgtaagttcaagttgcacagatctttgttttctcttcgccaagctaaaacatcttggtgcaatgtcttttgggaagcgattttgtagccaactatcatgccagaatcttgttttggcgccatttacaacctaaatagttgttgcagcttggaagagtctattgccggattcgtcacagggcaggttcatgcccacccaaggcttttcttcctctttccaattaagccataaccaacgaagatgtaatgccctagaaaagtgttctaattccaagagaccagcccctcccagaaccttcggtttgcagacagtttgccagttaatcaggctatctcccgagttagagtggtctagatcttcgcctttccacaaaaaagatcttctaaaataaaataaaattaaagtaaatactaaatcgaggaggctttgttttggtgtactataagtactagataagttatgcatttttagatgaaacgtgatcgagtatggatgtacagtagagtatggagtgtccatgctgtacggctggtttcacaaatacgtactgtacaaattacagatgaacgcctagctagctagctctagctataataattgtggacacgcccactccatatacatgtgcatctcttgtcctgtatatatgtcctttttaatgtgtgtgtataattaattaagcagtgaagtgaatcgatctgattaataattaattcatggatggatccatcggggatatactgaattgttcaagacaagatcgataaattaattgagcggcggcggctgggactatatatagagagatagagagaggggccgggggggggggggcaaagaagaggaatttaattataagaggaagagggagaagaagagcttaggtacaggctccagtacaagagatcgatcgagagacagaggatcggagaggaggaagaaggagaatccaagtactgggaggcaattaatttgagttgagatcgacttgagagctagcagaggctcatctcatctaggccagcagaggctcttcgctcgcttatttcatccatggcttccaaaggtatgtactactagctagtatcttaatttctatctatatctatatctatatatgctgaatttactgaattcgattgatcgtacgtttgtggaccgatttatcgatcggttaataatatactataagcagctagctggagtagcttaatcactactttgaggaaagaagtaattaatttgctcaatcgttcaattctttcttcgttaagcaagcatgtagaatatctaacctactctctctatatatatatatatatgcaaaattaagctgacgggcagggtgattttgaggccagctctctgctgcatgcatatatactccatataacttaatatgtactaaatatttttctggtatataatagtacttgtggatttactagctagcaagtactcaaactaatgtacttagcgagtgtttactgtgctgcctgcagtaatactcctaattaatagagagagctagaaagcagagagtgataggcggaggtccctcaggcgcagggtgagggaaagaaataaagtgcaggattatcgatggatgtgccttatccaatataatcgcccaatacatccgatatgatcctcatgtattggttggccagattattgtatcagtcgatcgatcgattccccatggccatgcataatcgattgtccagattcatttctataatttaaataaatctttttgaaacagatcggagtagatattcgtgcctcgctctactacaacatgctgtcctgtcccgtagtacatcgatcgatcaatacttgctagtgatctatcgatatcaatagctaggcagccgacgacgacgtttctgtgtgttgtcccttttactaactaattagcttcttaattaataatttattaatttgcacccactcctcatcgttccatctccatcgatatcatcattaattaacggtgaaaattaatttttcagacaagctagtacagaaactgatgtgatctgatctgatggataaatataagtagagaaacgatcgatcaagacctgcatctgctgcaggcaggggcgagcatctgaatcgatcaaagcaatttgcatatctactacctccgtcccatattacttatctttttgactttttgtttgtcaatgtttgatcattcgtcttattcaaaaaatttaaaattattatttattttgtttgtcatttgctttattatcaaaagtactttacatactacttttttttatatttgcactaatctttcaaataaaatgaatggccaa

SEQ ID NO: 77276 - DNA, 6855 bp, Oryza sativa
cccattatgcatgcactagcttttattcatccggatgtatgtgccatcctactactgcccaaaagcttacccttgtgttactgtggaaatcaacctttttctttttttggattaggttagaaatatatttggaaggtcttgttggcagtcagtgatgtgagtggctagtttctgagaaactttcggggttcaatgtttgagaatggtacgcattctcttcatccaaatgttggttggatccatgtagaactttcaatttattttgtattacaaacttaaaaccaaaggcccattcagcttttttttaaaaaaacccaaatttcatgataactagttcaactgttggtaaaggtgataagagtaaaactggtgctagtttcaactgttggcacttggcagtatccgatcgattacggtgataatccgaagttgcggttttagggcagcatgccaagattcagggtaaaaaatcgcagcatgtggtaaatatgtacacgcagtagacttgaaagcaaaagaatcaaccagtaattatccatccctttcatctttctgcacacagtttccatgtccagcctacaatataatagtagattgaaatataaaaacacagtatgattaacccagcgacaatgcacaaacacaacctctttgtttttaattaagtcacataattaacgactgatgcatgcatgacacgtctcaaaagatcatcgtcgtagtgacaatgtatgaacttggtgttgaactttcttcttcctttgttggctaaaaaaaaaacttttgcagtaactggtttcatcatgtgtgcctatgagtagaacttgaacttgcagccacatgagattactatgatgaacatgtaatctacgagtagaacttgtatgtcttggcatctatgatgatctgccggagtcctccgattggtgacaggatcatgagcatcactccaagaatgatgcagatctgaaagagaatcagttgaaaaaaacaaatcagatcagaatgcaagatcaagcagaggcattttcatttcagacaaaaacaggggagaagattgaagaaaaacagagcataattagtttgtgtgttcttacccagttggtgaaccatgagagactgaaccttcttggcttgtagattgctagccacatgatgcagggaagctgccaaagaacacagaaaaaaataaccgtcagttctgaactctgatcatctctcagactctcacccatcaaaacgaaatgatcaatggaaaacttacgaagtaagtagttggcgcgaaggcgaatccaccgaagaacccaagcaatccaccgaagaacgggaaggtgatcgcgatgaacatggtgaacgctgcacagattccagatcagtttcagccatgccaagatctaataaaaaattcagttaagttcagatgatgaacacttgaacagtgcttaccaacgtagagtgttcttgcgatgaggcgaagcgtgaggccgggagggaatctgagcttcttgacgagcacggtctcgatcatgtcgaacaccggcatggcgtagatctggtagctcccgatgacatggatgacgaccatcatgtttgcgagcgcgatgagccatttgggcctggagagcgtgatgaggatgttgtcgtcgacgtggttgccgaacgcccagtatccgacgagcgccacggggaagtagcagagcgcgacgatgatgtaggcgacgacgacgcccttccacatcggcttcttggacggcttctccggcgtcgacgggatggtcgcctggatctccagcaccacgttgtgccccgcgtacgcgaacgcgacgtcgcccagcgcgctgaagaagccgaacaccttccccgtcgacgtcgtggcgcgcaggtggtagtcgacgtcggccaccttccccttgtccaccgacgcgccccacgcgatggtggagtagctgagcgacatgacggcggcggcgagggacacgccggagatggagttgaagtttgggagctgcgagaggacgaagtggacggaggcgaagatcatgatgaagtaggtgagcttgatgttcttgcagccgtggccctcgcagagcacgtcgtggaacttcttcagcgacttgccgccggtgaccatgtacacgatgttgacgccgacctcgacgacgagctgctgcggcaccacgatccagaggcccagcttctcgccgaacgcgtgctgcccgagctcgtggtacctgtcgaaccgcttcccgggcaccatctcgtgcatctccaccatctgccacagcgtgtagagcgtgatgatccatgacaggatcagcaccgcgatgccaggtcccctgcaaaaattcaagaattcagttagattaatttcttggttcgttcgtgtgttcttcgttcagatgaagatgaagaagatagtaggactgaccagccgagctcggacatggcgtaggggaggctgaggacgccggcgccgaccatggcggtgacattgtggaaggcggagtaccaccacttggcgttcctggacgacgtgatgggaagccagtcgtcgatcgccttctcctgcgcgctccggccatcctgccaccattgtttcgccattgattaattcaagcttgctactttgctacagatggttgatctcaacagtactagtacagactacactctatgcaagaaaggtttgttcttcttcttgttctgaagaattcggctcttctttatacatcaatatgtacgccgaatcgggaaatttttcccaaattgtttcgcatttttcactttcggtttttagcaacatggaaaagtagcaagttgtcccataaacggaatatctttgttgggccaataattcgccatttcaaagtttctattcttacgttttttgaaaatcgagatttcgaatcattcgagtaatgcttttaatacttttcaatgtgctataacgtcgtcgccaattctgtaaacctttaattcttgaatgcctggctaagtttagaacggataattatgcgcgttcatgctttctttttctgtctgatttatcaagcgagactttgcaaatttatatatttgttttcaaggagaacaaaaatggctaagtttagaatggataattatgtgttgatgctttacttatcctatagtagaattcctataggataggtgttttgtataaatatttgtagaacaaacatatatatcatttgataaattatggagtatgatttatcagttgagactttgcaaatatatttttttatttttaagaagaacaaaatatctaagtttagaatagataattatctgtattgatgctttctttttttttttcaatgatttataggttgagactctgcacatatatatttttaaggagagcaaaatgactaggtttagaatggatacttatgtgtattgattctttcttttattttgtcggatttatccattgagagatgcaaatatattttgtcagaataaaaaactcactaatcaaggggcatgattttcaaagctccaccatggactgtggaggcaagttagattatcttaaaaaaaatcttcatacaatcacaacactaatagacaagtgacagatcagtggcaggacttttcaattcaatgacacgccatgtttgaaaattataatgcaaacatgagactgaactagtgatttattttcttattggcagttgactttatcacatggccactttgcaatagagtcaatgctatgagctatctgatgcttatcaatgacacctcaggaggatagaaattttttttacctaccacgccaagctcacctaacgacagtaatacttttatatcaagtagagcacacttagagtgatgcatgattatctaataatgatttggggatacaaaactaggctgagattacaaagttttgattcttaagacaggacttgaaaactagagcagagaacaccaaatttcttcagactagtaacaacttgcttctaatatacccaatcttttaactttttattttaagataacacccgatcttttaactaacatcttgcagccttgttattggagtttgtgtccagccaatctgtttgggttaatcaatttgtcgtgctcaccatatgggtaattatactaatccagcttgacccctcgttaactgtaatttttatgttatcagaagtttgccagaaactgatgactattccaatgtactccatagaataaaatagtcttccaaaataatgctttcctatacctttttgggctatggaaattcctaaaaatgtctctctccatcatctggagttaatcctaaaaatattatatatatatatatatatatatatatatatatatataagaatccgcgtcccagatgggctacagtgtcatacagtatggccacggacagatcctagcatgggcagctgttatttataacaaaaaagaaaattcattgccagccaaacataacaatttcttggaaaattttccatgtgataggtgttttttttctgataggaattgctggtcttggaagctaaagcgaaatatagaactgtcagtgtactgtgcagtaacaaggatttctcaataggccaaacaagacagcgaccatgtgaaggagacacttttatttccagttagtacctttctatgtagtgcatttaatttctaaaaggctaaggaaaagaaatttctgcaagaaaaaatagtgcagttctgacttctgaccatggtaagaaattcagtgagaattctgactcttacagctgaacactgaagaacagagtggtagggatatagtacaaacagcctgtaaacaatatcttttcgaaaacagaggatttttaaaaacaattctgcagttaaggcaaagtactgaaaccacaccgatcctatgatatgataggtaaatatatatactgttcctcatatgtttgtgttcaatgaagaagaagaaaaaggtgagaaaaaggagtgagaacgagctgcaatcgatctccattttcacatgaagaagatgaactaggacaactagacaggtgctgccaagaggctgcaaggtggggtcctccgattggtgttgcgatgccggcaaaggagagaatcctccatgaaaaaggagtccaaaacaacactttttgaactctacctttctcgtgtgcaaaggtatctcaaaaatgttcccttttcatcaactgaatcaacgacggcatgaccaactctttgcttgtccatttcatgccctcccggcttctcgcagctcgacatgaaaactcctccaaatttaatttgatctttaattctttccgtttatttttgaaaaagcaaaacaacgctgccgatcatcttttcatagagaaacggtcctagaaagaaagaaaaaacccttttggttgttgttttttcttcttcttttatttggataaattaacaagactaccgacgaaagatcaagatgaagaacacaaacaacaagttcagaaacacacatcgatctccaatggagacagacagagagaaacagagatggatgctgatgaacaaacaaataccttggccggtgggtagttatctgccacctgagtccccatgatcacctgatctcctcctccttcgtctacctcttcttcttttgcagcaatggaggatcagaggaagaagaagaagaagaagaagaagaagaagggttgctgcaaggaggccggcagatcagagtcgccaagtctctacttatagaagaacaagaggaagaagattattaagcccagaccccagtgagttgtgaacgtgaagaagttaacggcaatggcgactgggttagttgaccgttgactccagcgcagcagctatttttgcgtcgtaatttcacggatattggggaggaattaatgctctcagtctcagatgggggttactattattaaatcgggtggtgtgtgccgtccgtcagatccaggatagacggtccagatgatgatggtgattttttttttatgtctcttggagggactcttgttttgctaactcacaaaaaaaagagaaaaagataatcagaattcataacgcatggcacatggaaccacaggagctctggagtttataaacagtagtagcgtgtgccgaaattctctcggttaggtccagcacttggcgtgtttaaattctgtttggagggttgactcgtaagaaatcgtgttcgaattcatagtatattcgtcaaaacatgtactactctataaaaaaaaatgcaatcttagctatgaacctagacacatgtatccaggttacttggtaggattagattttttatgggacggagagggtaagcattatgaatttaggtaaagcatttttgaatatgtatagggataagagcttatcttttatccagatacatatcttaaaatgcctttttttttgtctagatacattgtaatgtccatatacatagtaaaaaaaatattttcttcaatcttatccactgcatatttgccttctacataaacactcatcttccgactagtaacatgtttagacaaaccgtctgttttctttcttttttgagagggtcttgctttcttttattttagaaacattgtttgctgcagttgttactgctcaaacaactaatatcacaaattaaatgacatacaagctatccctccaattacaaatatgagtaataattatcgatgttttcgaaattgacaaggtctttgaacaattttttgactagaaatttatattgattcttttacaaaagtggcgtatccaacatattttaagaatacctttaagacaaatctacattatacatattcataatgccatcagggctgcaggaat

SEQ ID NO: 77277 - DNA, 5324 bp, Oryza sativa
tgctcttagagcaagtttaatagtatagctcactataggctccacttcatctatagccaatccatacaatagttgcttactatactatcaatatatggtctcatctattatacacacattgcgtcttggagtccgtgctgcagctggctacagatctgtagcccactgctcttctctcttatcttttatctcattaaaatatgtttgcagctggttaatagtctttctattgtacctgctattacttcttattaaggttccaactaattaaattgtagtactcctactgtagtggagtaccatattactatatcttaacataccgtgcctaggagataagtgaacaataatgatcgatccccatgtgctcaaaatcaaaatcatgacctaacttcgcgtgaggttttgataaactaattaatattaaccagacctaagcagtgtccactgtatatgtatatgtagatgctggtagattttctctcccatctctacttttttttacttggcttaaataggataatctagtacttattaagcaatacaattcaaatctatttaattatagactcctattctttgggtattttatacttgataatttgctaaagtagctttacggattcatctatttaaacacgatacatgatgtgcgaatttatcatagaattcaaatatattccaactacttttttcaaattaaatttctaaggtatgcagtgtaatagaatcagattcattggataggaagcaatgaatgactcataatcatttgaaagtaaggaaaaaaagagagacgagtccattttacatgtcaactttcgtcaaaataaaaattcatccctaaacttcaaaattggatactatttatcccttagtttttaataccgttttcttttgaaaagtatgtacatcattttttttatattttttctcaatcatttactaacttttataattaatatatattttaacctatttgaatcggtcaaaagatgaaaagtaaatggttgagggatgaataatgtctggttttgaagtttatgaataaatgttagacttgatgaaaattggagatgtaaagggatttttctattaaaagaatatgcgattttgacatgtacaaatggataagctcaggccggcacgtccattgcggtttcaccagagccaatccatcttgcaagattccaatgaaatagaggcatacatggaatatattctggagactgtgaagatttgaagatgttacagataagatgatttgaactatataattccagctacgtaaaaaagctaagacaatgattatatatgagatggtagcatatgtgaaatggtttagtgaatacttaaaactttatttaggtgtttggttagggagagagagagtggcgataattataagggacaattgtttatttgactttgttttgaagcctaactaccaatttgaatctattttttctagtttgcttatttgcctgcttttcgaaaatgaacactccgtctgacctgtttctacaacaccgttaagagttcattttaaaaaagaggaaaaataaaaatcacatttcataatgactaaaataccctccaactctatcctcatctaacccttttctctcccggtctctctctctctatcatatcccttctctctccggcgagggagctgtggcggggaaggtaagcggcagagccggctggtggagggagggaccaccggcggcagcggcgggccatggagggaggggatccacgccggcgccaacttgcggagggagggcggctatgccggcgtggatcagcggcagcgccggctgatggagaggggagcaccggcggcggcggggggccgtggagggatgggatccacttcggtgtcaactcgcggtgggagggcggctgcgccgagcacggatccacgggtgtgccgctggtggagggagggagcaccggcggcggcggccggcggtggaggaaggggatccgcgccgccgtcaacttgtagagggagggcggctgcgccgagcgcagatctgcggcggcgccggcggagtttcaacccataggaagtccacccctgctgcttccagcccgccggcgagggggagctcgttgtccaggccaagcagagcaggccgatggcgtggccaacgcgggcgcaggcgctcgaatggagggaggaggtggcagcggcaacgccggattcgccgaccgcagctcgagatccaccgcccggacttgccgccgccactcctcgtcgtcgtcgtcaccagggccggcgcggctcgccgtctcgactttcgccgcctctccctgtggtggatccgtggaggagaggagaagaacttgcagccgccactcctcgtcgtcgtggtcgtcaccagggccggcgccggctcgacgtctcgccttttgctacctctccctatggtggatcctggagggagagaggaagagagaagagaggattggagaagatagaacgggcgggtgggtcccacatgtaatagggtcaaatgagttagggcagaaaagacattttgtgcttcagttaacaccgttagacgcccttatcggaatagggtcagacagtgtcttcaattttgaaaaggaggatcaaataagcaaaccctaaaaagtagggtcaaattggtagttagagttcaaaacaggttcaaataagcaattgcccctacttataatgtcaactagttgatacctcgcgctttgctgcgggatatatggatgattgcatgttatacattatagaaatgatagatgtatatgtctaaataatgtaaaaatggtgtggaggtaatgattcgacattgcttgcgtattgagttctaaaaatacaataaaattaattataaatgatatgtcatgtttgatgatatttaaaatactctagataataattaccagtgggtgataatgtggcacgcttgcatgtgatttaaaatactctagataataattgctagttggtgatgatgtggcacacttgcatgttgagttttaggaattagtgggcatcaactacatagaaagtatagttatagatgcgggcacacccaaggcaatttgaaagggggttatggtagctgttatgaagaggggaatgtatcattgcaggagaagattctagtgcactgattttttttttactaatgtcttattgtagactcatagttacagagcatatgataaaatcgtcattctataataatgctcggtgctaacttatctctatcaaactattattgaatgatttcagtactccttatgtattcattattcccatgcttgatagtagattgaatttcatagtgaagcattagtaaaagttgcacaagttttttttaaaggaaaaacaaaatgatatactgttgcaggcacagaaggaggccatggtggcgtggagagaaaggagcagcagcagcagaggggttaccagctgccccgtgactcccggggatcactcgaggtgttcaacccctcatccgcttcctccttccgcactgctgctgccgcccccaagtccgcctcccccttccttgctattcccgacagggaagaggataatgtggtggcacagcagcgggcagcagagtggggcctcgtcctccagaccgaccaccacacaggcctcccccagggcgtctccgcacgaccctcctctggctctgcacgcaccagctctgaggacaacccacagcaacagcagagcgccgccgccatcccacgggtgtcggaggagctacgggcggcactatcagcgttccaacagacgtttgtggtgtctgatgccacccaccccaaccaccccatcatgtacgccagcgctggcttcttcaacatgaccggctatacctccaaggaggttgtcggcaggaactggttcgatcctcacacacacacacacataaacacatcaatccaattattcaattaataatcaattgtgtgtgcagccgcttccttcaaggctctggcaccgacccccatgagattgacaagatcaggcaatccctcgcaaatggctccaactattgtggccgcatcctcaactacaagaaggacggcacgccattctggaacctcttaaccattgcccctatcaaggatgaggacggcaggctcctcaagttcatcgggtcagctattttcccatcacgttaattacatacatcacataaacagattattacatttcagcaccatatttttatttggctgtttgcattgttattccaggatgcaagtggaagttagtaaatacactgaagggaaaaaggatactgttgttcgtccaaatggactttcagaatcactcatcaaatacgatggtactactaaatgtttatcttctgctacaaaagggttttatccataaggtcttggaaatttacaacttttggtttcaaactaaaaaagagaaaaaaatcaacaattaatatttacagctcgacagaaggatcacgcccgtagctcagtgtctgagctcttgttggctctcaaaaatccacgctcattgtcagaatcaagcaataacaccttaaaaagaaaatcacaagaatccctaagcatgtcaatgaccgaagttcctagtaagagaagctctgaaagtggatctcgccgaaattctcgtagcggaacaaggagctcgcttcagaagatcaatgaagtacctgatcaagggaatagaactagaaaatctggtctgcgtgcatttatggggtatgcatacaagtcaaattatataacatgttgtttgcatttatcttgtttgtcttacttaatttgtacatgcagttttcttggtatgggccatggaagtgtagagaagaacatgctgaaacctagagatgaagatccactgatcgatagtgatgatgaaagacctgagagctttgaagatgagtttaggaggaaagaaatgaggaggggtatagacttggctactacacttgaacgtattgagaagaattttgtcatcacagatccaaggttgcctgataatcccattgtaagatccatatggaatctcttttacctcttacaccgcacctgttctttttattaatatggatattaaattttcatgattgtatgttttggttcatatttcagatatttgcatccgatagctttctgcaattgacagaatacaaccgtgaagaaatattagggagaaactgcaggtaatgatgatcccatcttgcccttttgctgcacaatttactggaaggtttttaaattttatagaaaatttcaggcttttgtaaaatttttgcactttaacggtataagtt

SEQ ID NO: 77278 - DNA, 666 bp, Oryza sativa
ctagcaataggtgaccttttcaaacaaatatctatacagaattaacaagacattattgccacgacagcatccgatggaacctcacagcaaatgggcagtactcggcaaaatcggcctatcgactacaattccttggggctgccaaatctaccttctatcagtcaatctggaaggcatgggtgccgccgaattgcaagttcttctcttggatggtcacgcaaaatagagtatggacaacaaacaggctggaaaaaagaggatggcaaaaccaaaagatttgcccactttgttataatgttgatgaatcggccctgcatctcctggccaaatgcagactcacaaagaggatatgggcagaaatacagagatggaccgggactgaccttcagatggacaactgggaaagctgtcactcagtcgagcaatggtggacactcgtaacggaatctccaaacaccccacgcaaacctctcaggaccctggtgattttaatctcgtgggaaatctggtgcgaaagaaacacaagaatcttccgcaacaatgcatctacgccatcctcaattctagcaaagatcaaggaggaagggagagcatggggtcaaagcaagggcttcaatcctgcaggagttcagaattttgggagatatcacttaatccctgtttttt
